United States Patent 9,328,346 (POLYCOMB-ASSOCIATED NON-CODING RNAS) - sequence listing, part 45

SEQ ID NO: 8009 - RNA, 16153 nt, Mus musculus
gcuagcuuacacagcgggaccaccuccagagccuguuauauagaauuauugccucuuagucaacgaguuccucuaguuaauuugggagcauuuccugucacugacgugaguccaacugcugcuaaaguacagcacugaugaauauuuaaaucaaggcgcuugccucgggcuaggaccaaggcuguaaaacggccuuacgggaauugccacuuucaguccccauuuuagggaugaggaaaccgacuacugagguguucaggaaugugcccacagccacccagcuggcaagcacuuacgcuggagcuuuuaauccuaaacagcccacagccacaccuccuacccucuccacgcuccaccgccuccugggaaggucgcacgcggaagguccagguggccccgggaggugcucggcuaagucgccccgaagucgcggacuccagagggcccacgcgugacugagcucccgcgggacacgccccucgcucgcccuacagcuggcgcugccgaccccggccgagcccggcacgggggcggagcggcuccggacaguggccuuuccucccgggggaaccugcugagggcggccccgagcuccuuccugucccucccaccgcgguccgggcucggcggccgcucggcgcggggucccgggcgcggcuccggcgacucucggccgcucccaccccggcgaguucaaaaggacgcgcggcgcccggcccugcccgcccgucggacuggaaaggugagcgcgcugcgcggaagcccggagcccgcacucggccgccgcgcgccugcgaccugacccgcacggguacugcgcggcugcagggacacucgacggccagggcgcgggcccggggcacgcgggauccccggggagcggggcgcacccagcggacggcucggcggggcuccuggcccuggaagcccagguaaugcagguggcuaagggacccggaucgcucaugggcgcaaccgggccgacccuugcuuaacuuucccaggccuggggaaagggucaccaacgccacccauuccccgacccugcgaccagggucagcucuugggggaaggauuuguuuauggaagcugauuagaaccgaaaggaagagaguggauauauccaggggaagggacucggggaaaaccuggcgcccgaggcucuccugggaucuacaagcccugcgaccucaggagcccguccaccucauucuuguccguccuucuucccacagaucugacccuacgaaauagccugcccucagcaacgaugaacaaccuaccggccacaccuucuccugaagguaggugaugaaaguuauggaguaggggggcuguuuaagaauucccaccccagaacaggucuuggaauuccgcgaggccucacucaguguagacuggaagacucacccauccccaccccacuccaccccacccuaccccuaccaacccgcugucgggccucacgcaggaaaaagcuccaagaaaacagaauucaacuucagugugcccuuuugcgcuauuuuauucucaagucuggaccggaccaauuccaagcacugcgagucaccuggguuuaggaaguucuuugaugcccaaaggagccauuuuuacauucaccccaguaguuaaguaaaggagaaagggaaucuucuaaagauaaccgggaggacucgugaugucgcuuaauugguagagaacuugagaugaaacccauuuugauggcuugugccugcagucccugcaacuugggacguagaggcgggaguaccagaaacucaagguuauccucagcuaaauagugaauuuaagucuagccugggcuagagggaugugggguguguuuaaaaauucuaggagccagguggugaauugagucucaccuuuccuuuccuaaucaggcugguucuggcgcgcugacggauauuuacauauuaauugguuucaccuugugccagccugggugugggaggaacuaacuuguuuucuuauguauagaacaaacguucacuuugagggacacuguuuuuugcugauaugaaguucggggagggagaacccggggaaggcaaaaucugaggcaguuucuccuggaacuaguggagcacgugauucagacugcugcuuggugagaaguggugggcaaagaggaacggaggacagcccuucaggcugguggguaaaggcucuggagugggaggcgagcuuugcaacaaagucucuagaagagugaagugaggcucaguguuuaccccuucccgucugguuauuucaucuagcacaauacuucaagggacauccaugccgucuguucugguugacauuugcuuuuacuuuuaauucuucuggauguauaucccaaaguggaguuguuguuaauauauagcaauugauauauuugaaaagaaccaugauagaguuuuucuuaguagcuguguuauuuauaucuccaccagcagcauacaaagguucugauuucuccacacccucucuaacagguguguguuauucagggcaaguguggcacuagugucuuagugggugggagauggugucucguugugacuuuguuucccuagugacuagugauguccaagcauguucuugugugcuuguuggucaccuggacaucuggagaaaagugucuuguuggagacuauguccguuucugauuguuuuguuuuguuuuucgagacaggguuuuucuguauagcccuggcuauccuggaacucacuuuguagaccaggcuggccucaaacucagaaauccugccucugccucccaagugcugggauuaaaggcgugcgccaccacugcucggcacuaugucuguuucuuaaacauuuauuuauucauguuguacauaugugugucugugugcacuuguguguuguccccccucuucagcuugcacaugcuggaggucaaagggcaacuuucuggagucaguucucuucuuccaccaccuggguuucuaacucagguccggcuuggcagcaggugccuucaccuggggaccaacucacuggcuccuugcauguuuuuaaaucauaguguuacacuguugcugaguuguguguucuugguucaacaaguguccuggguggguggacuuguaggaugcagcacacaguuuccugcccacuaggucugagcauacauccaagcacaagagagacggcuagugaucagccaggauucccuaaaauaaauaaauaaaauaaaauaaaauaaaccaaacccaaaaaaccccaaacaguuuaaaauauguuuuucaaugccaccaagauaagaccuuguauauagcauuaauauaauguuaauauaauaaugucuaugucuauaacaaugaguacuuauggaugaagauauuguaaugaauaacuaauugguugauauggcaaucuuaguauuauuuauuaccuugacuuuaaaggaaauuuaagucacuaaaauaaaaucacuaaaagacauugucauaggccccugagauuauuguggaucaagcugcuggccauguucgguccgucagaacccugucucaggaggucuggccaccccaccccaccccaugccacccaggguucacaguggccuccucccaggugccgugcuggauacucagcacuuuuacacugaacaauuuucucaccacacuaagaagguuuuauucucaucuuaucgaaaaaacaaaaucugaguuuaagaaaguuaagaaguuuucagugauuucaaaaccaaaaccaaaaacuaaaccaaccaaacaaaaaacugcccaguuuaaaagaaagaaaccaaaagaaaauuucccgucgugccgcugaucagagcagaggaagcagggcuggcugugcccagccugagugauuccccagguguguucuuucuggcauggucuacugcuccggagguuuccuucacccagcugcccacccagcugccggucacagcagauaugcagggcagagggacuggauuccggcuggcacuccuaaggaccgagggcugugggagugacccugucaggcaggucuagagcaaauaagcagguuggcagcuucagguggcaacggaucugaugccuccucucgauaagagaacuggcggcucuggagacaggaggcacaaaggaaucagcuaggaucugggucaacacaaagacagcugugugagggaucugaaggccuguggugguuaggaucugggcagagccuuaaagugguggcccucuacccuggcuaccuaccuacccugaagugcggccuuucuuggaagcucagaaggggagagagggagaacuuguuucuuucuuugggaaaacuggcaggaacugggggucaaaguuagggccuuccacaagcgaccuccacaauggcaggaacugggggucaaaguuagggccuuccacaagcgaccuccacaagcgaccuccacaagcgaccuucacaagcacuggugcaccuacugcccagacuccuccuuuuggagccagggcuccuggauucagauugcuuugcuguugcugcugcugcuguuguuguuguuguuguuguuguuguuguugaguggggcauguguguaacaccagcacucgggaggugugguuugcaauagagauucaaaagcagcuaaggucaacagagcaccuaaggucaaaggucaaaccacuggggggggggagaaccucacccucacauccaaccuuugaguccccugaagcccccugcccauccucacucucaagggccaccuugagcaugucggaguucccagaaaagagcugcugaaggccccaccuccaccaucucccuguuuccugcugaaggucucuaccuccaccaucuccccauuuccuguugaaggcuccaccuccuucaucucccuauuuccugccagugguguccaccgcacccauguccagguucucugauuacugggaucuuggaucagcugucugcagccaagcccucuguugcuucagggacuucacgucaggcacccuaucaguuguuugcucugucugagucauucgggaauccguacccaaaccugcuggcauuucuccauucuccuuccaggcuccagcugcagccccauuccuuacacaccuggacagaaaaacuccuuacgaauacaccuugagcuagguguggugauacacaccuuuaaauccaacccuugggagacagagacaggcagaucuccaggaguuugaggcuagccagggcuacauaguaaaaugucucaaaacauacacacaacacacacacaugcacacacaugcauguacacacacacacaaaugucucaaaacauacacauagcacacaugcauguacacacacacacacacacagcuuauuuauauucugccucagguuccuucuuccauuuuuuccggaaccuacccuaaaccacagcuuugccuucaacucgaagccagaaagaacucgucuugcgaaggucauucuggguccuauuuuggguaaaugcaacaagaguccaggugcuugaucgauuuggccgccuuuguacugaccuaccaaccuagggccagggucacucaggguuaggguuacuggguuagggugaucuuucccagccucccgucuugaguaugcuaaugaccuuuacauuuuaugucugccuuucuuccacugcuagggaucagauccagggccaugcacaugguggacaggcuagcccucuaccacugaacgguaacccaacccaccuuuucucauuucuuaauaucugguccagacuuauucuugacuuccuguauaucugauaggcagucaugcccugucccuacccaguuccuccagagggcuuccccagcccggguaagagcaaaccucuccuccccagcuacucagcccacacgcaugcgacuccaccccacauccuguccagguccuugcuucaaaggagaucuggccacuuucucacugggcugcugauauacccaaggcuucaaggugaauggagaaaggcucccuuuuggguguugagggugcgucagccucugccuucuuuucacuuucagccuguuguccgagccccagagggaucccuuaaaaucaauuuguuugaauuauggguugcuacagagcaaguaacccagaauuuauuugcauaaaacagcagcagccacccuguguuuuaaagaguuuggcugaguaccugcugcgcuguguagagcacgguccccuggcuugugugcgcacaaacccagcuucaguugccaauccagcaacacaaauccaagcaggucauaacuuuugacagcucuugugauggugugucccggaccgauacauggagcugugguggacggguaaguccacagugcccucccagggccuggcauuugccgcuggcugucagcugagccugaaaacuugauuacccuccacauacagucauccuccuguagacuagacagauggagccucuucaggauacaguggucucaagauuuccagugugagccgggcgugguggcacaugccuuuaaucccagcacuggggaggcagaggcaggcggauuucugaguuccaggacagccagggaaacccugucuuggaaaaaaaaaaaaaaaagauuuccagugugauauuuggaauuccaggguccccuggccccuucuacuaaucaaggucugcauuuuuuuuuaaagauuuuacuuauaugagugcauuguaauugucuucagacacaccagaagaggacaauagaucccauuacagaugguugugagccaccaugugguugcugggaauugaacucaggaccucuggaagagcagucagcacucuuaaccgcugagccaucucuccagcccaaugucugcaauuuuuuuuaaaaaagauuuuuuuucauuuuuauguaauguaugugaauguuuugccugcauaugucuaugucaucugugugucacacgcaugcaacgccugcagaaucuagaaaaggcuaucagaucccccaggaacuggaguuccagaacauuccauguagguguugggaaucaaacauagauccucuggaagagugguuagugcugcaacagcugaggccucuccagaccccacagugugcauuuuaacaagauccguuaacauuguuguggaaaugcgucucugugguggcucccugucucacugacagcugcagccacagaggggcucaugugcuaugaagccuguggcuucauccccccuucccucccuccaaguugccuccaccuccaugaggcaccuuugacaugcacacugcagcccaggugccuuccaucauuacagaccgccuuacuuugaccuugaugucccugauguuggcaugacugccucccucacaaccuuccaaggcuuuauucagggugccucucaggaacuuucccucacuaucuuauuuaaaauugcagcuccuucccacacccuacaaccugucccuugcuugcuuguuuuuccacauaucucaaaccagcaaccaccacggugcuccucuuccuccucucuuuaguguauuuucugucuuucuucaaucgccucaacucgccuguucugagcagagccuagcuucacuccaugguuuucccucugugguccuccuucugagguccuccaugcucuucccuccaugcucuucccuccgugguccucccucuguggucuucccucuguggucuauacuugcagauuccccgggcugccucuuacaacacagccugcaaagguugugcuagcagaagaaucaauuguuucaaaccagccugggcuaaacaucugucuuuaagugagggaaggggacuggagggaugggcuagugguuaugagaguggcugcccuucuaaaggaccucgguucaauucucagagcccacauggcggcucacaacuuccucuaauucuagucucugcaaucauauaauacuugucuuaauaugauauauucucagugcacagcccucgaugcccuggacucuggguagacuaggcuggccuccaucucugagaucccucugucuccuggggcugagauuaaaaucugcacugcugcaccuaccuagccaguauuuggccuugugucuggcucauuuaccuuggcagcaugguccucugaggucaucuguguuguuccacacauuagcuccccuccccuuuauuuuuguuuuauguguaugugugccuucggaagccagaacuaggguuccagguguuugugaguggccguguguguguguguguguguguguguguguguguguguguugugugugugugcugggaguuaaacccugguccucugcaagaacagcggagccuuccacacagagccuuccuucccucuagcucugucaugucuuaaggcaggauaaaaccccaggucugccuuggcucuguuuuguuuacccguuugccugcugaugggcauggagaugcugcauccugggauucggaaacagcgcuucugugagcauccggugacaucauucccuuguuuccugagucuguacucagaagcagacugcaggccagagcucuguuuacauuugaggagaccuguggagguagugcuuuggcaggguuuuauuauuaucauuugauuuguguuuguuuucuugaaacgggguuuugcuguauaacucaggcuggauuugaacucucaauguuccugcugccgagaggaagggagggagggagggagggagggagggagagagagagagagagagagagagagagagagagagagagagagagagugugugugugugcgcgguguguguguguacacacacaucgcacacacaccuguggaaguuaaaggacgacuuuguagaaucaguucucuccugccuuuuaugcauauuccagagaccaaaccuugguuuugagauuuacaucacugagcagcaagccccuucacccaccaagccaucucaccggccccuuagggaauuuacaggcuaggucaguuugccuguuuuguugauugaucugugaccagaacccagcacagaguacacacucaaucacuuacuugcacagacuuaaaaucugagacagggucucccuauguggcucuguugccuccuagauucugggauuaaaggcaggcaccacugcuccgggcuauugacauuuuuaggcauugagacagagccucccuguggagccucagcuggcccugaguuuaaggcagcccucccuccucagccuggauuauaagugugccucaccacucccgacuugacuuuuuauuuaagcguggcaucugaauguaguaaguagcuucucacacagggcucccuuccuggcucauaguguuuacugucuccaguccaagguucccaaagcagaccuccaugacucgacccuucccucugcacaggccuccccggccagggagagcucaguugcuaguuagaacucuaagugccucucuggcugucauucacagaucguuuuguaucugugcuuccgccccccccccuuccagauuuggagacaaggucucauuauguagcccacacuggccucaaaccaucucacaguccuccucccaauugcuggaauuacugucccgagagccaccacgcccagcucagccuuucuucucucgagcccacuuccuccuguccucuccauucccgcugcucccuacugggagaaaaaaaaaacccaaaacauucucuguuuagagacagaggcagccuccucucagggacccugcuuuucuucucuaaccugacaccuucaaguccacaccucaagcucaauccaaauauaacauuuuguaaauuguccugguaaucugucugcuacccggagcuucuugacaaguucaaggcggcuucuaaccugggcauuucugcuagaaagcuuggugcgcauuuuuuuuuuuuuuuuuuuuuuuuugguaaaugacucacauuuugaaaucacacugaaaacuagaagacuuacaggaaaagcaggaaugggcagaccaggaacacuugugcaccuuuauaaucagacuccacauaaacacaguaauaaccuccauaaaaagguugacuagcgucugaaccuaaagucucagucuggugggcguguccucgggugggcguguccucgggugggcggaucuucguccuggugggcaaauacuguucuccauuuguuuuuguuuuguuauuuauuugagacuuggcucuguagauuaggccuugaguuugaagaacccuccugccucugccacucuuaaaggcaugcucuauagaaaccauuuucuucaaaacaaagucagucagucaugguggcucacaccuuaaaaccuagcacuucaggagggacucuugaguuugaggccugccacaacuaccuaucgagacccugccucuaaauaaauuuuuagcaaaaaauaaauuuaagcugggcguggugacacauaucuuuauucucaguaccuggaggcagagguuggcggaucucugugaauuagaggccagccaggucuacaaaguuccagaaaccagggcuacacagagaaacuguguuuuuuuguuuuuugagacaggguuucucuguauagcccuggcaguccuggaacucacucuguagaccaggcuguccuggaacugagaaauccacuugccucugccucccgagugcugggauuaaaggcaugcgccaccacgcccggccuuuuuuuuuuuuuagaaacuguguuuugaaaaccaaaaauaauuuaaaaucuauggcugaguauggacucauuaaguuggcaaaguuuguacauagugugcacaaagcccugaauuugaucccuagcacuucuuaaaaccugcauagggugcaugccuuuacagcccuccagauguggaggccacagagucacaaguucaaggucauuuucugguuugaacucuggccaccaggccgcacagcaagugccuguuccugcuagccaucuugcuggcccucaucauuuaaguaacacuauuaacaugugauuuuucacgugugugcgcugugucuguagagacuggagcaaggugcuggauccccuggaauuggaguuacaggaacuugugagccauccaacgugggugcugggaaccaaacccaguccucugcaagagcagcauuucuccacacacauauacauauauacccacccacacacacacacaccuucacacaugcaucuccccauacucacucauacacacauauucacacauacucacauacauacucauacauacacacacacauauacaaacacauauucacacauaaauguauucacacacacucauacauacaucuccccauacucacacaccacacacacaccuccccauacucacacacacacacucacauauacaucuccccauacuuacauacacacaccacacacauauacucuuauauacacaucacacauacauauacacacacaucucccuauacucacauacacacauaccauauacacacacucacacacaccacacacaccacacacuuucucaucucacacacacaugcuuucaugcacacuacauccuagcucuguggguguucucccacguuauuuacacacuaggccugcaauguugguuuaauaauucacaugaaaagcaugugugaaugagccuucagggugacugagcauggcugccuaauaagcugagcucagucuccugcagccccuugguaggcgagagccagcucccucaagcuaucauaacaucaccucauaacaucacuucauaaaucagucccagcucucaggaggcagaaacaggugguucucuaugaauucaaggucagccuggaccacauagugacuuccaggacagccaggacuuugcagagagaccucucucaccauccccaccuccacucccaaauaaaaaaaggguugggcuggccuugauacuggaaagcauuccugacagcccaucucugcuuuuucgguugugggaacaagggcaauucacucacgagguucuuguuguucucugacccuuuacucuugaccccuuuugccccagcucacagcgacugaugucacuucacccaugcaccguggaaccacauuagcguuccuucgacagcucugaugagaguagcccuuucuaggcccaguccuagugccacucaauggcuuccaccacccccuggcacaaauaccaaccaggccccucugcugcuuuucugauccugggauguucagcugauggaaccucuaaggcgugguagggugugagacgugguagggugugaagcagguccugcccugcucugucccccgcgugccuagcauggcuccuggcaaagcaguugggccacagugcugagaguuucucuccuaccccuuuaaucucccccucccucugcucauucauucauucucauucucuuucucucucucucucugcccccccccccacuuccucucuccucugcaccccccccccaugguuuuauuuucuuucuuuugagauagugucuuuccccagccuggcuagaacucacuauaagcccaugccuccagcucuugaggauugugauucuagguucaaacaagccauuagguaaauaaaguagauggcauaaaguagauggcagcuccugcagagagggccagcccauuuuccucugaaagccuggauccugcaguaaccuuuaccaagucccaucuucagcaguuauaucaaaaaugcuaauuaaggaaagacugugguaucacacagucuuuuaucgcuuuaauuccagcucuggggaaacagaagcaggcaggaucguugugaguucaaggccaaccuggacuauggagcaacuccaggccaaccagggcuacauagugagaccuucuagaccauaguuugguaaggcccugacucagaguaauuacuuuagauucaggcuuugggacuuugggguuuuggagcuucaaggauaggcagacagauacaggauagaaugcaggaagguucuggguacuagacgcccugugcugagccugguaaagugcagacccuguccuagaaguaaaagauuuggggcaggguaagaauaguauuuuauggggcuggagagauggcucagcaguuaagagcacugacuguucuuccagagguccugaguucaauucccagcaaccauaugguggcucacaaccaucuguaaugagaucugaugcccucuucuggugugucugaggacagcaacacuguacccauauucauaaaauaaauuaaaaaaucuuaaaaaaaaaaaaaaaaagaauaguauuuuauuacuuagaaaucacguuuauaauauguaaggccggggagaaggcucggugggcaaggcccuugcuguacaagcaugagaaccugaguaaagccauaggugguaucaugcauuuguuuugcuuuagaaacauucccacugguacuggcuggccuggaaaucgcaucgauccaccuguccaucuccuaaacaccgggguuaaaggugaagggcaccuggcagcagcaugccuuugccagcucagcacugccauagugaggugggacguggagacaggagacuccucacaggccagccaguguagggagcagaggacaggaagagauccugugucaaaccgagaggauggugaggauggagcccagaacucguccccugugacuuccacaaguacaccccacgggcaggaguauguuagaguauguagaacgcugcaaaauguacuggauacaccaugaugcugcaucacacacacagacacauaccacauacauacacagacacacagagacacagacguuuacauccccccuucucucucucucugcacucaacgugccccuuacauuacuauaacccuccugucguagugucauaguuacaaucguacaacuagguauugucaccccguuagcaucugcagcgagcgaugcagauggguuaggugauucuuucuuauccaagggcgcacagcuggcaaaggacagggauuguauuuguagccuggagcucuauauaguacaggaggaucuugaacaaucuuucucagcccugaguucugggauuauagacaugucaccacaccuagcaaaacccaacccccucauggucucauucaauaacccuggcuagccuggaauucucuauauagaccaggcuggccuugaacucugaaaccugccugccucugcuuccugagugcugggauuaaaagcauguuacccccacccccaagccaaaagcuccuauuuguuuguuuauuuauuuaguuguuuuuugaaacaaggucucacgcauguuguggcucugguuguccuggaacucauucuguagacaggcuggccuugaaugcagauuugccugccucugccucccaagugcuagcuagcauuaaaggugugcaucacuacaccuagcucaagccccuauuuuuaacuauuguguuggacagagagaaaaucauaaaaauguugucauuuggaaauaguuugcuuccaucucuguuuuccaggauuuucugcuuggaguuccuguagacacuauucgaugaacuuuuuuaaaucuguauuuuaugaauaugaguguuuuccuuguauggauauuuguguacaugugugccugguggccacacaggcuggaguuacauauuaugaacagccugugcucuaaccacugagcaacucuccaggauggugucgugacagaaugccaaagacaaagaguucaccguuuucuuuucccccuuccucaacuucccagaauugaugaccacgccgguuuuucaggccccugagacccuguccccacaagcugaagaggccagcacagcgcucauugcagguaauaaugccaguguaccaauucaaggagccucagaacugagaccucuugcucagccuggaacccagugugacugcuaagauguucccuauacaggaaggacaucgucaggguaacgggguucauucuggcauguaggucugacacaugcauagcugugaaagacccagaggcaugaccauaagggauaggcugggagugaccaugcacaggcacgguuauguggcugcucagcugggguguguggguugggaggaggguauauguggcuugucgagugggugaggaagagcgagcgaguggggagaaccagagcggcucucauaggaagcucuguauuuaaaacacccuuccuguuggcaugagcuauuuauuucccuccugguuucuagcaugaucaucagaaacugguuugggaggaaguugaauuuugucagaaaucaaaacagcaugucuauagccaaguaccaagaaccucuggaugcugugcccuggacaagcuguguucgaggggcaccccacuaggaaguaauggccuaauucagagggccccuuguaguacugaaacaugucucccucucucccucucucucccuuccaaguuguuaucaccgugguguuccucacccugcucucgguggugaccuugaucuucuuucacuuguacaagaacaaaggcagcuacgucaccuaugagccugcagaaggggagcccagcgccauccuccagauggagacugacucagccaagggcagagagaaggaagaguacuucaucuaaugcuucccaggcuggaggggccaauucuuggcuccaacacuaagccgcugccucuguaguuagggaacguuugcucuaaagccagggaguggcguugggugauacuggcacauccacucaccucccaggacacagcccccaauaccggaaucacugacuccaggguccagagacacggagaaagcuguucaugaugcugggccuugauaaggacagugcucgaaaccgaccaccaaagaggggccaugccugaguuggaagugaggucacaugcugguccacuuuguccccucccuaguugacgaccaauagccccagucagugcuauccagucuuucuggaggcaggacaccacagggaggggucagaccagggaggggauaggagucugagaauguuacugccuuuguuugaucugagccccacuguuccccaaucagccucaaacuucuacuguuuuuauccuaauuaaacuuaugaaaaucagauuuucauuuucaagaacuaaau

SEQ ID NO: 8010 - RNA, 2259 nt, Mus musculus
ugcagagcacuccaaaccagaaccuaaaugguagagcaacaaacagcagccugugcgggaagauaaugaaauuuacaaagcuucuaggaaggcccaucucaaguccuugcagcugagagaaucugagccugccaccucagaagugccuaaggaugguugugagcauguguggaugacuucuucaggagccggacagcagguugggaggcaucuuguccuggugcccgauuuucccuuuauuuaguacacauauaaacuugucauuuaacagaaaucauguucuuuucuuuucuuuauuaguaccgugggugugagugagugugggugcuuguguggagaacaaggacaacuuuugggaaucgauucucuuaccauguaaguucuggggacuaaacucagggaucagagguugcacaagugcuuucaccugcugagacacaucgaugccccuccccccuuuuugaguuagggucucaugcagcccacaauggucucaaacuuauuuagccaacagugaccuugaacccugauccuccugucucccucucucagcugcuuggauuggaggugugugucaccguguucaauuaaugaaagccaaauuuuaagugggcugccaccagcggaggucaggguguccccuucugcccuguggugcaucagaaccuucccaugcaguggggaagggagcccuccccaaccccugcuaggagagaacgcaguguuuuagggauaagucuacagcaggcaccuccaaauuagacagcuagucauuaugaagacuuaagucaccuuuaaaaucauagucaggcauggugguucauuugucuaaucccagcacuugagaggcugacucacgaggauugagaccagcuuggcuagcuacaggaggccuuuucuugaaaugcaaaaaugaaaggggggguggcucacaccuuuaauccccacacuagagagguagaggcagguggaucucugaguuugaagccagccugauuuacauaaugaauucucagacagcuaggguuacuuagagagauucugaaucagauagauagauagauagauagauagauagauagauagauagauagauagaugaccucugaccugcauguacaacacacacacacaaaucacuaaaagaaacagauugaaaaugaucaaagugcauuauauauacaucuacgaagugucauaaugaaaccuuuguuucccauaacuaaugaacgcuaaucaacuucuuauucccaaagugaacucauuaauaacagcuucagaauuugagguacacacaucggcuggcacuccucgaaaagccaaacagucucuuucacgcuccaaggcagaguaagaggucaugagccuacccuggagcagucugaggucccucaggucaaguugggaccugacuaagaucacacagugcugaaggucgaagagcuaagugaaagggaggugggagcaaaggccaaaccaccgagucucacacccaagggacgagaagcaaagacagcggcggcccauuaucugcagcaggaaauguuggugaucccaaagccugguaaagugucacccuucaccuaaguaagcaagcucaguaaacuuccccgcugugaucuccuggccuucccagaaugccucugguccccucugagcgcucaauucaacgacaggggugcuggguccuggccccugagccuuagagacucaaaacugcaaagccauuuuaacaucaaccaaaacagaaagauccauuccauuucccccccccccccccgugguguuuguuuguuuuuuggaggcagaguaucgauauucaucucaagcuuccuuucacuguguugucugcagccacagauccuccugcauccuccugcuuccgaaaugcugggaucaaugucuaccagaaagcauccgaacuuggggaucaugguacaucacuucuguaaucucagagcugcagacgccgaggccagaggaucaggagcacaaggccauccucgagucuauggagaauuuugguuucuuuuaaaacccaguuauguugugggaaugaguguguguguguguguugugugugugucuauaccuaucuaucuugccccagagaaccagaaccccuaaucaucaagaaguagucuauauacacccccuuucuccucuaacuucuuucucuccaaccuacuguugggguuuguaauaaaagucgggagguagacguauaagaaccuaauaaaguaguuuuuuuuuuuuuua

SEQ ID NO: 8011 - RNA, 1042 nt, Mus musculus
gugcgugacguggacaccugugcgcaugugcauaacauggccgauccgaaauuuguggcaugccugugcucugugcuccugcauccuacacaacaggcugagcucuauucucuucaccacuuaagucuuuuuaagcugaaacaaaacuugaaccuuugcauuucagucagaagggugaucuaauccaaccacacuccguggauucaagcugacuuaacugcagaggaacagaacagaaaucuccagguaaacugcuucccccuccguuauaacuaggauuaucuuuguucgugaguacagcuacuuccucccucccacgacagcucggcauaggacacucggcacaagccacaagcgggucucacucuggcucaagagccaucucguuagacaggagaguuagaacuuucuaaacacugugguccauuuaggagcauggguaccuguuaacugacauuucuuucccagguaugaaauccacagcaauagugcaucggaaaguugggcaguaacccuagugcaaggcaaaaccaccuccgcugccuuuucacagaaugagagggcaggaccaaaucaggaagugccucgcugucacgaugcaaggaauuccugggacgaacugaagcugaagaagcuaaagugaaaagaagcagagagccucugaucaccaacucuucccgcgagcugaccagagcccagcuguuucucuugucaggcuuuccacuuccauagcuaguucuguuucagccuuacccugcccucccccacccccgagacagggucucucacaaaaccuggagcuaggcuguuggcuggggagccccagugacccuccaguggcugaccaccccacacggugagggaugguuacaggugccaugcacaaccaugccucgcucuuuauguguguguugguuucugcugaggguucucgcuaaauagccccggcuguccugguguucuccauguaaaccaggcuggcuucuaacucaaagagauccaccugccucugccucaagugcugugauuaaagaugugugcc

SEQ ID NO: 8012 - RNA, 2452 nt, Mus musculus
ggugugaaucagaacaaugagagagggaggguuaaagcacaggguccaggagacagagacaagcacagaaggugauggauggggaccagaaggaagagcugaaaaggaacagagacagcauggggaggggucagugacacaaccaugagaagaaaaacuaagccaauacugagaaaguagaaugggaaaggaggaugucgcucagaggacaagagacaaagguugcggggagagagagcaggaguuccuuaggcccuggugccaacucaugucggguauggccagucugccgagcggagauggcgaacuucccguccacaauaaauaggaaaaaaaaccugaguacaccggugcauauggcaucgaucugccuggcagaagcauuuuccuucccauuuaaaaaaaaaaaaauccaccgggagagcccgcccucuccccgccccacauucaucacuccuuuggccaaagacaucacccccccgcacccccaggcagaguuggccuccccugccacccucaguguccggagccauacauuuugucccacucaacuaacgaguccagcuccuuggagggagcccgagagcccaccuuggcuagagcagccuccacaucuuuguaggagaggggccucugcaguccagagaugcccgccucggccgcugccugcuggcacaacugccccagcucgcccccagaaaagcccugaguucccugcaccagggcggccagcucccgcucguucagcgcacagcccugcugagccagcgcccucugcaggaucugcccgcgcgccgcgccgucgggcagcgccacguagaagcgcagcgcgaaccgccggcggguagcuucguccagggccgccggccgcgaggugguacccaccaccagcacgccgucggcgcgcgcgccgcagcugccguccaggcaggucaguagaggcgcccgcagggacgcgccgucgucccucgccggcagcagcgcguccagcucgcugaugagcagcacagcgggcgggcggcagcgcgcagcagcaaaggccgccugcaggaggcgcgcgcccucgacggcgcccgaggccgccaggccggcuccgcgcaggcgcagcagcguggcaccuagucggguggcgaggcagcgccccagcagcgccuuaccgcagccgcggggcccgaagaacagcacgguccgcggcgggagcgcgcugccgggacaggcgggcggccucagcaagggccaaagcagcuccuccucuagggccgccuugagcgcgcccuggcccgccacauccgcccacugcacugggggcccgcagucuaccaucuugcugcucaccagcuccagcgcccccggguccacgcccuuggcgggcucccccgacggcuccgcgaagccuccgugggcggccgggacccgcuccgggaacuugucaaagggcucgagcugcggcgcguaggcgggggagcccaggaccuugagagggccgccgccgccguacuugccggucccauccuccgucgccccggguggcuucgaacggaacccguugccccgacacucggugucguccgcggcgggguaggaggcgccgucggccgcgggggccuuggccggcucguaagcguacuugcgguagcgggcuuccgcgcccucguccaccgccuugcgcuucagcgacacgcccucggcggccgcggggaagccguagggcgcgggccgggguggcgcgggcgcgggcaggggcgugggcgccgccagcccggagggcaaguagggcgcgggcggcgcggcgggcggcgggagcgccccguagccgggcugcgccgcguagccggccgccggguaguuguagagcggcgccgaggggccguagccgggcggcggcgcuggcugcagcagcgcgggcgggggcggcggggcgagcgcggcgcucguuugcgcgcaguagccggacgccagguacccgccuccguagcccgccgcguacucaguggccgccgacggucccccgcacgcguugcccguguacagcggcucagucagguugccagcuacuaccggggagcccccgaggccggcggagccacccgcgccagccgccuuggcucccgggaggccuucguggagcgaggcuagaggguaagguggcucuggcccgggccagggcuccggguccccuuuggcaccguugaggaaggcggcgucaccguagcugcccaggcccgggcgcucguaguccaggacuccggaguacuucucggcguagcgcuugaggagguuggaggcugugagggcggaaaugucgucgugugcccaagcguaguggcagcgcuggcgacccccuggaggcaacuccaacuugugagccggcgacggagugguggaggagacguccaggugcugcucuggccacugguuuaggggcugggcguguuccgguguccagugcauc

SEQ ID NO: 8013 - RNA, 2452 nt, Mus musculus
gaugcacuggacaccggaacacgcccagccccuaaaccaguggccagagcagcaccuggacgucuccuccaccacuccgucgccggcucacaaguuggaguugccuccagggggucgccagcgcugccacuacgcuugggcacacgacgacauuuccgcccucacagccuccaaccuccucaagcgcuacgccgagaaguacuccggaguccuggacuacgagcgcccgggccugggcagcuacggugacgccgccuuccucaacggugccaaaggggacccggagcccuggcccgggccagagccaccuuacccucuagccucgcuccacgaaggccucccgggagccaaggcggcuggcgcggguggcuccgccggccucgggggcuccccgguaguagcuggcaaccugacugagccgcuguacacgggcaacgcgugcgggggaccgucggcggccacugaguacgcggcgggcuacggaggcggguaccuggcguccggcuacugcgcgcaaacgagcgccgcgcucgccccgccgcccccgcccgcgcugcugcagccagcgccgccgcccggcuacggccccucggcgccgcucuacaacuacccggcggccggcuacgcggcgcagcccggcuacggggcgcucccgccgcccgccgcgccgcccgcgcccuacuugcccuccgggcuggcggcgcccacgccccugcccgcgcccgcgccaccccggcccgcgcccuacggcuuccccgcggccgccgagggcgugucgcugaagcgcaaggcgguggacgagggcgcggaagcccgcuaccgcaaguacgcuuacgagccggccaaggcccccgcggccgacggcgccuccuaccccgccgcggacgacaccgagugucggggcaacggguuccguucgaagccacccggggcgacggaggaugggaccggcaaguacggcggcggcggcccucucaagguccugggcucccccgccuacgcgccgcagcucgagcccuuugacaaguucccggagcgggucccggccgcccacggaggcuucgcggagccgucgggggagcccgccaagggcguggacccgggggcgcuggagcuggugagcagcaagaugguagacugcgggcccccagugcagugggcggauguggcgggccagggcgcgcucaaggcggcccuagaggaggagcugcuuuggcccuugcugaggccgcccgccugucccggcagcgcgcucccgccgcggaccgugcuguucuucgggccccgcggcugcgguaaggcgcugcuggggcgcugccucgccacccgacuaggugccacgcugcugcgccugcgcggagccggccuggcggccucgggcgccgucgagggcgcgcgccuccugcaggcggccuuugcugcugcgcgcugccgcccgcccgcugugcugcucaucagcgagcuggacgcgcugcugccggcgagggacgacggcgcgucccugcgggcgccucuacugaccugccuggacggcagcugcggcgcgcgcgccgacggcgugcuggugguggguaccaccucgcggccggcggcccuggacgaagcuacccgccggcgguucgcgcugcgcuucuacguggcgcugcccgacggcgcggcgcgcgggcagauccugcagagggcgcuggcucagcagggcugugcgcugaacgagcgggagcuggccgcccuggugcagggaacucagggcuuuucugggggcgagcuggggcaguugugccagcaggcagcggccgaggcgggcaucucuggacugcagaggccccucuccuacaaagauguggaggcugcucuagccaaggugggcucucgggcucccuccaaggagcuggacucguuaguugagugggacaaaauguauggcuccggacacugaggguggcaggggaggccaacucugccugggggugcgggggggugaugucuuuggccaaaggagugaugaauguggggcggggagagggcgggcucucccgguggauuuuuuuuuuuuuaaaugggaaggaaaaugcuucugccaggcagaucgaugccauaugcaccgguguacucagguuuuuuuuccuauuuauuguggacgggaaguucgccaucuccgcucggcagacuggccauacccgacaugaguuggcaccagggccuaaggaacuccugcucucucuccccgcaaccuuugucucuuguccucugagcgacauccuccuuucccauucuacuuucucaguauuggcuuaguuuuucuucucaugguugugucacugaccccuccccaugcugucucuguuccuuuucagcucuuccuucugguccccauccaucaccuucugugcuugucucugucuccuggacccugugcuuuaacccucccucucucauuguucugauucacacc

SEQ ID NO: 8014 - RNA, 1679 nt, Mus musculus
guugggagguuuuuuguuuguguuuguuuguuuguuuguuuuugauacagagcuggccucagauuuucaguccaccugauucagcuuuagucucuuuccugcccugccucaggaggcuucugagugcugggauacaggucagugccggcacaucuggcugccgagggcuugcuccgugccacuugccacacaguugaguaacucucgugggucucaccugggaaaugguacucuucuuaugccaaucuccaagcugugagacguagcugccacagaccacccuagcuagguaugggggucccugggauguggguucucgaggcuagguagguaaggauuuggcggugacaaacagaaacaaacacagaggccaggaacaauacucaauacugccaggaacaugccuguuccuggacugugaaugucccaugauucuuaccuccucgccaucuuaacucgaugugucucuguggaggagucugcagcacucugacgagguccucuccuuaccugagaaaguauuuuuuuuuuuuuuagaaaaaggauagagaaagcuuaccugccucgagccccacauugaaccccagcuuccacggaccaccccagucgggugcuugcucagggccaguguguuggucugugugcuguauaggagucucuccuuucugcagcuucccggucagagaucuuagucacuuacaauuaacuguggugugaaaacagucaaugggaauuuccagaacuagggaagauauauauuuauauauauauauauauguauauauauauauauauauauauauaauuuaaauccauacugucuccagaauguagcgaagucucaccuccccucaccucaucggucauaugaaucaucucuuuguccaguacaucuauacuguacacuuuaccugucagucaccuaguagcugucaggguuaucagauugaucgagaaaccuuuauuuuagucaaccauggucucaauugcaagcucaggggugcuggugacucaguacaccaaggagaagcuuuauaaugcucccuuuaaguaaaaagacagagguccuggcuauagcauauuacuauggguauuguaauuucuuacuaauguugcugucuccugggucuaauauacaaacuagacuuuauuacagguauguuauagguagaggggacaggacaugcaguuuggguuucaugcacccaaugugauucagggauucaucaccgucagaugagggggaaccauugugccguacugcuuacagaggcuuaagacucuaaaauccaggcuguuccauccuauucuaccacuauagacuuaaaggaauaugcaggugaauaccgagacuggcugcguccaagaggccaguaagugcacagcuguggaagauagcugaguuuccacugugcuucccuaccuuaggauaaucacaguguggcagagcccuacugcugauagaaacaggaagacugacagccaccauccaggcucacuccucucuggguccucaccugacccucagaaggugacugagaagaagucuggcaaugaguaggugguuuccgggcaacaauauuuggaggagggcagcagucacugacaccaccaggggggcguguuguuaaugucugcagagaccaggaccccuuuugccucuuugagggccucaccaa

SEQ ID NO: 8015 - RNA, 39620 nt, Mus musculus
aggagggagggagggagggagagaggcgccgggggcgcgcgcgcgcgcugggcgcugcugggcugcggcggcgguuacuauggcggagucggccggagccuccuccuucuucccccuuguuguccuccugcucgccggcagcggcggguccgggccccgggggauccagggugaguccggggcggggauggggggggggggcgcgggauacagacggccaggcgaggccucgcgcucgccguggggcucgggcgcgcccccuccccagccgcgcaauauggccgggcggggggcgcggagggccgggguggcgcugggucagccuuggggacccgcgcgcucuuccagacggagcccgaccggggcgcccagggggucgcgccuccugcacccuccgcucccaccccaggcuuccucgagauguggaggucccuggcuccugcccuucagcgcguccgugcgagggggguuauucccugccagcagaugcuccugggggcgccuuuucucccgccaagauugugggguucgacgauggggggcuuguuucuccgauguguucuguugccgagagccuaugcguacccuaggcuaggaggguaggggucucuaagccucccuucaucauggggugccccuacccucuuuccccugccacccugauggucuaggcaccggagucacauucccccuucuuucgcucagcuccuuggguucugcagggcaccccccucccacccaccucggauauccaugccuguagacgcuguuuggaggaaauggggcgagcaggccccuaaaccuuuuuggagauuggccucagagccauuccaacccugugaaaaccuaguuccccagcuguuaaucugaaucuagguguauguguguuugcaugccuccucaccucccccaccccgccccagggggcccauucaguuaaucacuccgaggaugcuuuucaggugagauccugaaaacugcuuccaacccccccacccccaauuauuuaaagacccccacgguuggaccgucucccuggcccuuggucaguacuuuugccuugacacacagucccuccucccggcacccacccuccacacacaccccuuaccuuccagccuuaagggccuuguguggccaggcccacccccaccuuucccaguacagagguggagacguuucugugggacacuacaccggcuguguuguuuaugaggcuugugaggcugggaagagccggugaaacccuaaaauauuucaucugguaguauucucaaaugugcuuuggcauugggguuacagaagaagguuauauuuggcaguugcaucgaagugauuauugacccacagauggauauggugagacaauuagggguuguauuugcugcucccauuguacaaagccuucugcuuuggcuucucagccgcccccaaccuuccagcaauggaaguucgugugugugugugugugugugugugugugugugugugucugucugucugucugucugucugucugucuguggcucuaaucugcacgcgcacacacacacacacacacacacacacacacacgagaugcucaggugggucuugguuuaguaacgcagacccucaguagaagacaccaugcuacuuuggagucucaaaaccaaguucacuauccccgucuuugauguguucuuccagaguggcggggcuugugcgucggcggcggggucuuuguucacuggcuagugcuucugcuaggcacugugcugaguucccuguguugcugcugcucugucacagguaacugagcggcggcggcagagacugguaaaccccgccgaagguggaugaacagccuuacauuuguggggagagagugauuuucauaaauaagaauguucucuggggcuugugggccauguuucgagaucugugacagugcuguuucccuaguagggugguaaaaauaaggacauuccgucuucagguuugucguguuauguguguauaaauaaaucucuaagucccuccagugaaauucauauccugccucuagcaucuccaagauuuugaaacagucaguucccugcugauuuggugucugucugugggcuugccuuguugcuagcauaguuaagaauguuuaauugguaagccaacugguucugaacacgguuuguuuuuguauccuccccaaacuggaugcuuguugggguggcaguggguggguauaaccgggaguugggcucuuuuuuugguaaaugggauauuugguuguguguccagcaaacauucuccaaggccuucaaacuucuuggccagacacugcaguuuuuuccgggauacaucuaguugccaauagugcaugcuacagagaccacuguugcaaaaggcuuaaagucagacgucacuucugggaaaguagaggcugggauaacaagaaguugauuuuuuuuuuccccuccccugcauuuccuauacagagcuccugugggcuggagaagugacagaccaaggcaguucucaggccugguaugugagcaccaugugagggcagcaagagauaggugucuacuaauucaucaaaacuggggcuuaguaaaaagccaggacaaggauuuuuacccuggaaacagcauccacuggguagaugguguguuuuaagaccugucuuaggaaucuuaacuaguguuauaaaauguaaaauuaaguuaguagcaggagaacaugacauucauguuuuaaagacaaucgcagcaagagaggcaucugagguucugauaggaacauuuugcauuucuaugaacagcuucauugaguggguuuggacuugagguggggggggggggagugaacuccuguggaggggcagggagccucugauuaguuuguucacacagcuccugggcagaugagauaaagcacuuuaaaauggcuacucuggguaaagguuagaaccagauggagggagggagggagggaggaggcugugcucagggaacuuuguuucauacagguugcccuugaacaaguaacuuaaccuguuacugccucaacugucccucuggaaaugagaaaauacccugugucgcgccgauugggacauuugugaggcugacugacugauaggccacuguuggcacggagguauuuuuagacaugguuucugaguucacugaauaagcaauguuggguuacuuuuuaucuuaugggcagaauaacauacuuugauugauagacacgccacaugucaguguggcucguuucugauuuugcuuuuugguagccaggguucagauuuccuccaguuaauuucugcccuuggcaggcuuuuuccucacccaccagcagcauaccugaucuaauggaaggcaggcuggaggagugaccugcuuuaggcuuuauugguugguaauguuaugcaacucuggguguguuuaugguacuauguaaauguuacauaagaacauggaggcugagagguggccagaacuuggcugugaacacagggagguuagauggaaggaaggcuccauccagaaagcccuugggagucuucaggcaggggggagaaacugcaccguauuuuccucuagaaacccucucagaugauugugccuuucaggggacugcuguguuauaaauagguuuauucuccaccggugagcuaauuguaaccuugcuaccauuuaagaaucaguagagaggaggagggagaagagagaggagaggggaggggaagggaggggaggggaggggaggggagggaagggaagggaagggagaccugcgccaucgcuuucagcguguccugucgaggaggcugcuuguugcaucugggaacaugaguugguuguuuugcagucuguucucauaagugcccaggaguacagggugcuguguggaaauggaacccucagcccagggcacuuuugacuuucuuucuuuuuuugcaaguuaaauuauaauacugguauggcuguuguguuuuaguuuugaaaucuuugcguguugcugaaguucagcuugggacaacagucaacaauaagucugagguuccuucucucuguacugaguucuuauguugucuguuacggggggggggggggggguccaccgcuguaagaugguguuuuguccuuuuccucuguauuuacagaaagauccucuuccucauccagccuacagugcugguccagcugcaggcacucucaguggucaaucccaccuagacuaggcauucauucacagccuuagaguaucugcucuugggccagucuaacuggcauuucucucagcuugcgccauggagagcccaguuugaauaccgggcucucuguuucugcucaucucaguguuucuacccuguguguggcuuaccaugagcuuggacuccaaagacaccaucuucacucucgucugcuguguaccuguuggcuuccaucaggauaaggggacggggacagguacauggguggucccacagagcagccucuuucaccuuguguagagccaccaaaguuugauuuagcagugaauucuccacccccacagauccuacccaugcuguccgucucuauucaggccuuguggccauucuucccauuuccgucucucuguccagucucaagccugugucugccccacugaauccucuggguuucacauaaugaaaaugacaagugucacguggccucugaugccuaccugguuacauauaggagaugccuuuguucauucaguugggugugugccuagaacagcuucuggcaugaggacauaacacugaaugagaggaacaaaaguucccaaagcccugcuguuguggaacuuaaaaucaccguggcuuaaaugcaaccuaaguaaacacaguucccagccgaggcucugaggagggugggcucgugcgugcccagagccgccauccguccucugcuuuauucauccucuguaaaccucggagauggcuugguauuuuuuucuguaaguuggucacagacacugcugaccaauaauaugagccguugcuccucuaggaaguacagggcuaguuccugcaagccucugaugagagguuucaucaguugaucaacagauaacccuguuucuguguaaagacaccuauuuaauacauaguguugguucacaccgagaaacucaagcaagagcagugcucuaccucuugucugaaucaagcucccaaacacaccguucuccccaaggcaucgcugucuucuugugcuugggaacgccagacaucacuucagcacuaugcuuggagacuguucuauauagcaaaaccaucaacaaaaagcauggugcuaaguagacugccaagaggacuuguguuuaccgugggagaaccuaaauggggagcaagugucaccuugaccaaccuccagugggagcacguguaccgagcuugcucaggucuuacuauugugugcauauauccucgaauggcuggaaaggauuuugagcauuguguuuugggauuacagguaacuuuuagcaagcaggcuaauucauuugcaugcagucugaauaauggagaucaguuucaguaguuaaacaaauguccuagagguaaauugcaucauguagaauuuuaaggacuccuuuuugugugcuugugucuggugugugcacaugugugagcugccacacuugucaugccuauauggaggccagagaucgaugucaaguguuuuucccagucauuguccaccguauuuuuggagacaggguaucuuggauagacuagcuagccagcaagcccacgggaccuggcugucguccccgccacauccucucccaguccuuggauuacagacguaugccuccauaccuggcuuguauacggaugcuggggucugaccucaguuucucucauucacacagggagaaguuugacuaugucccuagucccuaaggucccuaauggugccacugcaucuggacauuuuauugguuuuuggcaaugcuggggcuggaaccccagaauuguguaauacacacaccuagaaguccucuaaguagauagacauauacauguugaauauguuugggugauccauagauuccuuuagcacauacuuagugagcaccuuccauacugggcauuggccuaggagcguagcugccuuucuucagaaugcccaccuugugccgaaugagacggauacuagacggcagagaagagguugugcuuuuggcagccacccuguuucccacgcagagcccugggaucugcugucucuccacuuguacccagucagucagucuaacagugguguaguuggcccuaccgccuagggauuuggcagauaggucucagugcguugauguucaggugggcuugguaugauugaacuugcccuuuaaagcuuauucucaguccauugcagaaaggaagucggugaugcuccugcuggcuuagaagcaagugaacacccauguucugagcuuccugucccaacagacacguguaggcagacgaguugcugagagugguccucaucugacaggaagaguaaaacagugcucuggguccugguuugcugggcaguggauuuugcaagcaaccauuaaacuuggaaggggaccucaucuuagagaagccuaccuuagcuggcucccgucuugcugugcguggacuugagaccuguagagacugaguaaagaguaaaguguuugugcgcguguggugaucagacagccgugggcacagcggaacgaugggagaaugcagagaaacagcccaggauguggccaggagcucagcauccugucacuaggacauacauaggaaagucuuuuccgaggugugguggcguggggcaugaaccuuuccucguagcugaggcugaggcuggaggaucaucuggaguucaagguuggaaguuaaauggaggaaacaggauuuguguacuuuccagauuagcugggguugaauugagcugaggagugucuuaagaauuuguggaggagccccuucaccccaaguccucaggcauuaucuugauauguguuuguauguugcacuuaacacucgagacauaagauuaaaucaguuuguuucuaaugguccaggcaugccuggccccaagaagaagcaagagggacacccuugcccuucagcaguuuacgggcaaagugacuuugcuucugccuguuggaauuccaguggaacugcagggguucaaaccuucucauucaccgggugaugguggcaauaaaagccaccaauaaaagucuaaucugcuggaagugcagcuuccucggcacaaugccucuagccuuugagaccuccuuguuucucagccucagcacugaggguggagggagcuuaggcaguggccagcgccuggugcucugacugcuggggucugcuggguucuaacccugcagucaccucuggcucccuccccugcaggguuuuacuguggacgugcacucgcucugucuccucuguccccucugucccucccuguugcuuuccuauguuuccagggucagcucuaggccuccagguuugcauggucagucagauguggcccugcucuugggcuucuugcugccccuugucucuugccggccgggaccuuggcacuguugcuggccuuucagugugggcccaggaugccuuguguuuuucauggccccaugccuucccuguucuuucugguaagcuuccucccuccuccccuccucaguacugugacccaggggauuuuauacuucuguguuuucccauggucagcagucagcagugcaccuucuccugugagagugcuggaggcucacaucacuuaagguuuuguuccugcauucagacaacagguccuugagcuagacaucgaaccuuguguauuuuaagugcuuauauacauuugauuaauugaacucauuuuuccauccucuuggcaaaauccuaggcaaauaauuccaauuuugucuuucugugauuuuuuuuugaaaauauauauuuuuacuuuuuaaaguauggguguuuugacugcauguauguauauguacugcacgaguguuagagaccagaagaggucguuggauccccuggaaccagaguaauggaugguugugagcugccacgugggugcuaggaagcaaaugcaaguccuucucugcugagcagccagggcuccuccgcugagccugagccggcucuccugcccuguguuguauuuuguucuuuuaaaucccagucacuauggauauuuuuuaguuacuuggacauaaucucucuuugguuucugugugaguuauuacacauucauuuuauugcagccaaaugaacugugucuuagccccauuagucucugugucguaguugauuuguuugucuguuuguuuccucuucauuaccugaguugcagggaccggucaucccuguagcuucucucccacacaagugugagggucacuguugucugcugacaguguaguaccugggucaggaagagaagacucccccaacuuuaaugaaccagaaguaugucugcaugcaugcagccaaaacaaacaaacaaauggcacuuucucuguuuguuauaaauuaaguuaaggagaauaaaccaaauuccugaagguuuaaacaugacagcugagccuguguguuuaggccuaggaacuuuugcacacaugccuuccuggugauaccgcuuugguguugucccuccugugaugugcagguauuuaccaucagccauaaauuacacuacagugacagcucuuuagcauaaacaucaaacaucucuucugagugagaacaaagcuuucauucucugcaccccaggcuuacaguugaacuuguuuaaacagcucucugggguuggguuugucuccaaguagaucucggaaaggcaguucacagaacggcgcaguguggagcugcuuuccagacaccucucuugugcaagcaccauuccaagaucuuuuccaagauuuggaguuaaaugccaaguuuaucaaacgucuauuguuaaguugguggguuugccucuaauacagaaacucacuuuauuacaccaguugcucacccccacccccacccccacccccaagugcuuuuccacucuccuugucucccaguacucaggaggaggcuggagaggaggacuaauuccaggucaguuugggcuacauagcaagaucaccuuacaaacacaaguaagacggcucagcaagaaaggugcuugcaccaggccuccccccagguuugccgccuaggacccucacagcagaagggagcacugacucccagauacguacuccuccuacccccacacaaagucaaucaaaaaccaaguguuauuacaacaccauagaaaacgugcuuguuuccuaguaagagaaccaugucguuaguccaguagaucuaccacacaccccggcaagcacacacuccuagccugauacggaaaagaacugaaauucucaaaacucccaaaugccgaucaacugaugaauggguaagcaaacuugguacauucaaauaguggaauuauuacucagccacaggaaggaaacaauuacacauacuacaauauggaugaaaacacuguagaacaaggagccaugucaugugaucccauggagaugacacuuccaaacauggauuugugguuagaggggcugcugagaagagaggcugguuaaugaauuuucuuauuaaagguuuucucucggagugcugaacaaccuuugagaauuccacaguggugauuggauauugcggaaggcuuaaauaccacaguauacacuuuccagugguuacaauaaguaaauccugcuauauguauuaucauuuaaaacuacuguaaaucuacacacccaaggcaaacuguguaauguaaccucaaauacaaaaacuaaacaaauguacaggaaaaaaauugaaggcauggugcuuuuccaaguguuucuccaggcccuccaccauaucccaagucccaacaaccucugacucacaggaagggcagcucggguccugucaccuuuuccucuguucucuaccuggcauaguaucugguaaaugcaagaauacugaguuggaccaacaguguuuguuaagucucagcucagaaaguuacaugcacaucuacauugcaauguuauuauuuauuuauauuagauuuauuaauuaguguugcacacgcgugcacgguguguguguguguaccauauuugugcuuggccguggagauuagaagagggcaucagaucccuuauagcugaaguuacagaugguugugacccaucaugcgggcacugggaauugaaccccacucuacaagaacagcaagugcucacaaccacggagcccucucuccagcccauagugacacagggucuugcuguguagcccugucugguucagaacuugcaauuuagaccagguggccucacacucaggaauccgcccgagagucaccugagcgcugagauuaagaacacgcacugcuccucucacuccgucucuuuuaccuuugagaaaggaucucacauaucccaggcuagccuugaacuuccaacugucuaccucugagugggcaucugguuuuacguggugccucuacuacuggaguuccuccucagagccccuguacugccauucuccccacugcuuaaaacgagacaguaacuacacaucuagacaacugucaacaugcuuaugaaaaucuugaauuggaggucagagagaugacucagcugauucaaaagcacuucuagccaucucugaugacaugaguucaauuccugggaccacaagggaaagaagugacuacagagagcuguccucugaccuccacacacaugccuuggaauuuguacugcuccccuacaaauaaguaaauuuuaaaaauuaaaaaaagagaucagaauuagacaauaaaaauuaucugacccugaacugucucaaauagauguuugguuugcucaggagauaaaaaggugggaagguaguaauuggggacuaauucugagucccaaaguuugaacuaugcuaaguagaaaaaucucgcaccagcuauuggcuaccccuucccaaguuccauaucaucuucaugaucaucaaaauugaauuuuaaaacaagacacgaaguucugagugcuuauauaaagacagucagaggccacgacgcacggcgguauccagaggccacgacgcacggcgguauccagaggccacgacgcacggcggaauccagaaaacugaguugauuuggugaagagacuuuuuuuucuguagaauauuuuaagcccagauguugaaaagcauuugaucagauaugugacuuuauuucuggucucaauuucuuugauguaaaggucuguccuuaugugguguuugauaaguaugacuuuguagaguagaaaguuugaaauugggaaaagugaguucucugaauugguucuuguauuucuaccuuccaugguuguccugacuuaggaucccuuacaaugcuauguaaauuuuaucgucagauuuucugugggggagggguguuggcacuguaauuugauuuauaguacaagauaauugggaugagggcagggugggguagcucagcaguuagcagugugcacugcucuugcagaggccuggauuugguucccagcaucugcuucaagcugcucacaacugccuguaacugcagcuccaggaaaucugaugcccucugcuggcuucugaagguaccugcacucaugugcacacauuagcacguggauacaacuacgcauaauuaaaaauaaaauaaaugcuuaaaaaacauaugugauagccaggcauaguagcucacaccuuuaaucccagcacucaggaggcagaagcagguggauccucuaugacuuugaggcuagccuggucuacagagugaguucugggacagcgagaacuacauaaugagaccccaucucaauagauuaaacaaacauauauguguaugguaauguauuucauauauuuuauguagaauuuauauguugaacaaauuagguucccauuuuuuguguauuacugaauuuauuuugaaaguuacaucaucugagaaaccacugagaguuacacguccaaguaagcaaguagagaagaugacugagcgcccagguccugcagccugcucucgcucucaggggugcuggccuugcuuuucuccauuacugcucugugucugguguggcugcuguucugggaggcaccaccagucauccacacaaauauuuuaaagaagaaaauggagauuguguaaaguaaaacaacccagucacagaaaaauacacuggggcaaguggcauggcccugcaaaccuuaugcccugcacacucacauacaucacacacaacauacacacacaccccagauacauacaucacauaugaacaccucacucacacauaucacauguauacaccauacauugcauauacaucacacauaauacauacacacaucauacacagacgcaucacacacuuacacagcacacacaccacacacauaccauaucacgcaucacauacuguucacacucacauauaauaccuacaucauacguacaucaaaugcacgugcacacacacacaaauacaaauuuucaaaagacaaagggcauuaaaagaccgaaaccuagcauacaauguuuagaauggccuuaguaauuuuacagcgacuggauguccuggguaauucuccagugugcaugacuagaacugagaagcucguagcaagugggggcuuugauaagcagcauaguguggggaugccaaacugcagaccuguggggaggcacaacagaaagaguggccugguagagacaggacaaccugacacaagacggcucacgagaucuuguccuuauauggacucacuaggcuuggaaggaugugaugccaaccucuggccaggguaaugaggcuggacaagccacaggauuagaucagacaugaaugauugcagacagcaauuaucaaagcagaagcaagagaggaaccuauuuguaaggaugggcaugauggcucuugccacugagugugacaaccugaguuugauccccugagauccacaugggagggggcagaggucugaugccuucagguuguccucugucuuccacgugugcaagauagcaugcaugugcaagcgcacacacacacgcacacacaugcacacacaugagagcagauguuuuaaagaacccauucuuaagccuuagaacuucugaggaaaugcauuggauccagucuuaguuuugaguggaaucuagugggugcauagugugcgaggugucuuugucagagacugugccugguggguagugcugaggacacagugcuugcaguagguagggucugucaggaaaggagacaccuugaagagcaugcuggaacagaucuggagucccggcagucgaggcagaggcaggaggaguugaaggcuagccuaggcuacauagcaagacccugucauggagagccaaaagauggggacuagagaguugguucagguguuaagagcacuugcuguucuugcagaggacccagguucccagcacccacauuguggcucacaaccaucuguaacuccaggaucagaagaucugacaccuucuggccucuauaagcaccagguauauacaugguaucuauacauccacacaagcaaacacucauaaaauaacagcuguaauaaauccuaacagucacaugugaagccacccgccucccuugcacucagcaggcagaggcaggaggaucaggaaguuaaggccagucugggugguggaagacccuaucucagagacagagaggggcaaaaaaaaaagguaaaacugaauuguauacaaaucagaccuucagaucugaguuuauagaccugcagaggugugcaugcucagaggacaccacuaggagucagcaaagcccagaaugcgggaaacuccaggauaaaccaccuggcuuccuuagcaggugacuuccugaaaguaguaccaugggucugacagguuuaagagcuuuuggccaaaugcagugaaaccggcuuuugguucagauuuaaacaagccagcucuugggcaucuuucacgauaacagcgcugacaggcacugggaggguuaggggcauggucaguuaauuugaggaagugagaaagccaagcaguuuacgauguaacuuguagaggauucucagagcuagccugggaccagcugccccugcccuacacuuagaauccagguacagagcgcagaugcugggccaguccauucacaccccagaguaucuggaccaccauggguuuuccucugucuugaaggacuucagcacuguagugauaaauggccauuagauuuauuuuguguugggggaggagugccacaagcaaguguuuagaucagaggacagcuuucuggaguccguucucuccugagaugcgauguuccagagaccaaacuugggccaucaggcguggcagcagucauaccugcugagccuucucagcagcccugugagaaaacccucuuuuugaguaaauauuuccuugagucuacucauauucuguucuggagacacaggugaaugaagcacugucuggcuuuggguuguuuguuuguuuuuaaauaguacuuaagccagaacacugauagugacccagucccucuguuugugaagagaugccagagaucugacuguagcacugggagccacagugaaggcuaagccaccaaggagaggugacugggggguuucuguaagccucggcaaccuaaugguuuggugguuucuaagaagguaagaaugucugaauaaagggcacuaggagacagaacacgaacugucaaagaccaacgucugcacugguagcugucuggaaaccugacuuuagaggcugaagagggaagauccagguuccaggcgaacuuguaaguucugucuuacaacaacaagagggaacuuucgcuguauaugcagaccugccucuuaaaaauaggauggggagcuacauuggugugcauggcacagcugucugcucagaaggcagaaggauuagacuagaggaagcugcaggaauacucagugaggucuuuuggugagagcauuaagaauggauaugaccugcuggagguagaauuauggggguuuaacugggaaggugucuccagugguucugacaguuaggaguccugggcagugucacagggacacugcagaacacuauggguucucuaggacaacuggguuuguaagguugcuuaccguuugugagccccauaccuucucuaaggccuuguuccacuaugucugccucagcucugagcuguguggagaccacauaacagagaaugcagaucacagaagaguggacucuugcuaauguuaucaguugagcaucacagcaucugagaaagccagcuucaugucuuuguguuaucccuagugaacuuacuuaaauggcuuaguagugaaacucuuaccuagcucgccugaggcccuggauucugaaaauaucagccugucagaaaagcacacccaucagauacaacccugagaggugcccguaacaaacaccaaaaagcuguagggagguugggcgagggccagggaagaaguggugggcccugaugcuguaggcugcuguugcucacacgguguauagugggguuagaaacugcagcgugggggcugcacaaacccccgcaugcacuguccugauagacuguccagugucccuaaggaguaaugaauaaacuaaggaccauggucgcucuagcuuucagagcuagagaacugguuguguucauaaccaauucuuggacagaacaggcugcuguguagcgugcuccuaacuuucugagguuuuggguauccccugcgauaucuuguggcacugugagucuaaggcucuguagugguuccugagacuucccagcugagcgcagccugagccucuguguccuccugacacaggagacuguguguacagcacacagaagccagagucagcucauccugggacuuggcuuuucucaaaacaaccuuuuucugaaucagauuugcauucacauccuaccacaaaccaccuucuagucagacagacuuugacccaugcuguaguccugucgaggugguuuugucucaaguucaguucugacuaauuagacucaucaauaacagagucugugcuguggagagagggcucguguucugacacccccccccauuugauuggccauuugauuuauuuuuauauauuucaaaaugccggggaccgagcccagggccuugcaugugugagacaggccucucaucugcugacuuguucacacagugaguuggugccucugugguagucacugcucgugcuugcugauagaguagggaguguuuuaggugacuguguuguuguacacacgugcaggugacccuguggcaguacacaugugugcaggugacccuguggcaguacacaugugugcaggugacccaguggcaguacacgugugugagguggcccuguggcaguacacaugugugcaggugacccaguggcaguacacgugugugagguggcccuguggcugugcacaugugugcagacuuuugaccugaugagucaugaugaaacaugacaagaggcuguugucauuagcccggauuuagcuuuucagaaagaauuaaauuuaggauaugaauuuauaguaaguucagcauaugcuuauaauuuuauuauugcuucuucuguuucagugaagaguauuagcagaugaguggugagugcacgugucuuuaaaggacacagcagacugacugagacaagugcucuggaccuagaccagagggaagagagcuuguagcuagcgagaacgugaugucaucuucuucacuuccuuuuuccgguugaucaggaggaaaaugaagugcagagauagucaaugacuuccugaagccacacagucccacaaccaugcagcgagcuagcaauuuccucugagacuguggcucaccucuuccuagucauuguuaagaaauauuuuccuuguugggguuguuuucuuucaauuuuuacauuaaaagggagguucauauguaaaguauauuacuauauauaauguuuauauguugugugagccuuauuaacaguccuucacagcuucagcccaaaagagacugucacaguuaggguaacugugugcuccaggucauguggcuaguauuggaacuagcacuugagguucaggucucugugaccuguugcucugugaugcccacugucccuccugcuaugguagauucagauccuuccagggugcggguauggcgaugguuaucuucacagugugucugcuugggcuugccgcucaucuguaaaaagcaaaggugaacacagugagaguggggugagccuugcucaggguagccacagcacuuggcaggcgcuuggcuaacuucccucuugucucuguaagauaaacgguguuugcugguuggauaguggagaccuagauaggcucagggacuugccugccugcuuggcccgcuccuuauugcaggcccacauggcccacuucccagcugauccugggcccuucagcauagauuucaccacuucuguucuuuccugccuuacaccaggccugcuuaaguacuucccaaaaauaaugagccaugugugggcguggucauucuccagaaugaaucacugugagcgaggccagcaucaccgaagggggaacagcuaucgggaaccagagacucccgucuccucugccccacuaauugauggacucugaggugacugcuuuugaaaaggccgugugucucacucggcucagaauagucaucucuugaaguuguuaauuuucccuuucuugcuucccaaaauagacccaaugcuguugucuuugcuggacgucacaacacggugcugagaggugcucccuguggggaaccccuaagggacacaaagggacuugucaaaggcgccuucuuggauuagcaggacuccaaaggaagaaaagggggucuugccaaguuuucugaggcuugaauaaauuuuaaguucuuaagaggaguaagacagagccuggcuuaguagcccaggccugugaucccagcacuguggaggcuaggggguggagaguucaaggccagcugguuacuuagugaaaacugucucaaauacaguaaccaauaggaaaacaaacaaaaacagaccgagcgagaaauuucacccacaaguuugggaggaagaucugaggcuuuuuuagucguggagcuagaagaguagagugaguuccaggggagcuuccuguggaaauugcuuucaugaccgaucugcucgcagucccuacuucacacucucugucugugagagaugguacagcccaagcugcucccgggcagcugugugcuugggaauucaucucaagaagauagagaucuccucacacacuguaaagaauacagcaggcccugccuguauggaaaagcuuccgucuaccugccugccucacagugcugccucauacccuguguccuugugucccuguguccuugagugggaacagcagagggguugccucauugauagacacucugagguagcuuggguugucugggguaugcagagugagcgaugacuuccagaguagaagaagagaugaggauaggcuuuucuagccugggcuucuguuuggauugggcccaagccuuucuguuuuagcggcuuagugugcaggucuucccacggcgggugugccauggaggccuugccccuuucccucugucuccuggugggcgagcaagcacuucauucagcacucagcuucagugccagcuucaguauuguagccagagcuacauuccugcccaucccgggaggucagggcuagguuaggcuugggggagacaguagaggagcaccaacugucugcgcuauucuuguuagucagauaaauaaaggauugcagcuuugagaggcgccagguucaucugcagugauuuccuguugggggcacacacuucagugugauccauacccagcaaagucaucaaccccagugaggacuguguauucagcguggaugaaaagugcuugcgugugguugugugcguguguguguguguguguguguguguguguguguguagcacacagugggugugcguaugcaugccaggugcugcucaggggccuuucaggcccugcuggcuuaaguuuauuaaacacuuuuaugugcaugaguucacguuguccucacagugacuuugugaagcaggcauucagauucucuauggagagcacccucuuugacccucccucgugaugagaggugccacacauggccuagagggagugggugauagggagacgcagggggagcuugucaggggaagugugccuggcagacuuuggaaggauuuaggcaagaaaaggaauuucaguggaaggacauaugaggccaggccucccucauccuggaacugggugccugguguccaaaaagagaugggaggaggcugguuucagggguacugcauaguucuguaugggauguagggaaugccugcucucccaauggaagacuccguccacccagcaggacccauuuggauggaguagauaguucauuuguccuuuauuggcauagacuagagcaguuaggaacacagggccuauagagcuugucugugagcugaauaaggugcaguagugccagccaaggcugccuuucuguccccggcucuauaaaagcugcuuauugggggcaugugaagcaugccucugacuccggaaaaggaccuggugggagaucucacaucacuguugauaucugcccuucccuguccuauagcucugcugugugcgugcaccagcugccuacagaccaacuacaccugugagacagauggggcuugcauggucuccaucuuuaaccuggauggcguggagcaccauguacguaccugcauccccaagguggagcugguuccugcuggaaagcccuucuacugccugaguucagaggaucugcgcaacacacacugcugcuauauugacuucugcaacaagauugaccucaggguccccagcggugagugaguucuugugcuguugccucaccguggaggaagggcaucuuguccuuucguucuugucugcucuucccagcccucagcucagggauagcugacaguagguuuaguugcucucugaggucaugacagaggaucagccuccuuucuaggcaggcuuguugcucagaaggugagaagagcagagcucccagcuacuuguggggucgaggccaucagcagccgagacaucugcucuggggacaggguaaacaucgugaagaaggcugaaauuugaaagggaggugauuucaguggagcagugucagacaccaccucagacagccccccccccuugccauuugucagaucuuucuagggaaagacugagagauauugggccaagcuugcuacucuggugugcugugagcuuccagaguggguuugguuccacaguuguaggggugcuucaccgagagaaagguaguauuagagagaaucaaggcacgggcuaacccagggagaccagaggaaguggucucccacaaguggagacccacaagugagggucauucaugggugguccaguuacgggguggguuggauccagccgugucuuguuuucacuguuuguuccauccuugcucaucuucccaggacaccucaaggagccugcgcaccccuccauguggggcccuguggagcuggucggcaucaucgccggccccgucuuccuccucuuccuuaucauuaucaucgucuuccuggucaucaacuaucaccagcgugucuaccauaaccgccagagguuggacauggaggaccccucuugcgagaugugucucuccaaagacaagacgcuccaggaucucgucuacgaccucuccacgucagggucuggcucagguaccagguucuccaggcacuguguguguuggcccucaccacugguuuccagcaggaggcuguguuuaugaggaaggccggggcccugcuguguugagucauuugguuucauaauucucaucaucuggaaucugacauguaauaagauacgaugauggccucaccaaaaacgcuucaugcccugagauuccagaggucaggugcaaaacuuucuauuacuaaagcccugccucgcuccagcuuuggagcugugugccugugaaacuugagcugguuccaccugagugcuggugugcucacuuuaagggccccuuuugagaaacaggagugugccggauuccugugaggcgcugacagcuaaccauugaucccugagcagccacgagggguguuugaggacacugagugaagcucagacuggggauuuggugaaucauugacuuugccccacugccacaggcuucggggaggguuaucagaaaggcagcuugggcuuccagcguagcuuggucuccacuuccuguucugcaaggcuuucuuacaugagcauuggggugagcacagucugacaggacaccacagcucaggguggagagaacuuaguagguugcucacaucucaggaaauagcucagcugacaaaaccagaagcauauuaaauuucugcgugugguagaauauggcugaaaucauccauaaucccagcaguaguacuuggaaggcugaggcaggagaauugucucaaguucaaggccaguacaggcuaccuagcaaguaucgggccuaccaggacuacauugucaauccugucucaaaaacuugucugugaugugucccaaagacuugcugcugcuguugcugcuacuguugcuguuguugcuguugcuguugcuguugcuguugcuguugcuguuacugcugcugcugcugcugcugcugcugcugcugcugcugcugcuguuguugcuguuacuguugcugcucuugcugcuguugcugcugcuguuacuguugcuguuguuguugcuguuacuguuguugcuguugcugcuguuguugcuguuguuguugcugcaguugcugaacugaagauuaaugaucacuuuagagcuauucugaucuggaacauaaaagaaauaguuaaagaggucagugcugccaugugagcacaggugagcacacaugugagcacaggugagcacacaugugaacacaggugaacgcacaugugagcacaggugagcacacacgugagcacaggugagcacacaggugagcacaggugagcacacaggugagcacaggugagcacacaggugagcacaggugagcacacaggugagcacacaugugagcacacgugagcacaggugaacacacaggugagcacacaugugagcacaggugaguacacgugagcacacaugugagcacaggugagcacacaggugagcacacaggugaacacacaugugagcacaggugagcgcacacgugagcacaggugaacacacaggugagcacacaugugagcacaggugaguacacgugagcacaggugaacacacaugugagcacaggugaacacacaugugaacacacaggucucacugugugugacuuuguuuccccgccauggguuagacugugguuacacaaggaaguuguaccaucagucauggccagaugcccuccuggaacucagggaguccugugagcucugacauaucauauccaucauuuuggcuuuaugaagcucggcaguagagugcaccaacaugaauauauuuaaaagcugcacauuuuuagaaaccuagaaaauauccagcauaugcuuucccaacaaaggucagacagugguugaaagagccugagagagguggucuuacuguccugggaauuuccagauguuucagaccaucugagccuugguagauacuuuguuuaaugacaguuuucuguggguaauucaguccauuuugguacagagugcacagagcucccaaguauugucuuauuuguuuaauuaugggggcagggggugagcagguauguguagcugaguaggugcccuuagaggccagagaugccagauccacugaagcuggacuuugugaaccaugugauguaggugcugggagcugagcuuggaucuucuggaagagcaguugggcaugcuuguuuguuugcuugcuuacuugcuugcuugcuuuuuugacaagaucucacuauguaaccuuggcugucuuagaacuuacuauguagauuagauuagcaugaaacucauagaaauccaccugccuuugcuuucugagcaugugauuaacagugugcaucgccaugcccuguccaguguguguuccuaaccacugacccaucucucuagucuagguauuggguuuuuaaauaauguuaucuuuaaagcauuaagcucauguuauguauguaacucugggccuuauuaacagaugaguacugaacauccccuagaaacaaagacugggaaggagcuagccugcucagacgggcuggcaugguuguuggaaugguuguacagcgugcacacauagaggagucuugaagaacagguugagguuguaagugagguaagcagcaggggcguuccaggccacagggcaggcuuugaaugcagagagcagaaagcugugaagguucaguuuguuuaaaaacucauaaggagacuggcauggcgugucuggagggggcggaggcaggcuggccaggugucagagacucugggggccacacuaucucacaggucggagugugacugaagguucuuacacggacagacgcauggucauuuuccccuguggacaguguuggcagugguguggaggauggguccacuggccugccagugucuuacuagaaaggauggggugaagcagggcuggauguggcugcacggggccaagagcaggcugagaugagcccggagagcaggcgggcgggcgccuuuaggaggagggcagagugggacagggcaggauggaauuucuguaaagcccuggcggagacacacgugcauguuaagcacacaguaaauccagcaaaccuaggguuacuaacagcuguuauuugguccagugagagaauggaagucagucaugauagauaaggggauuggauagaaggagagauagacaucagaugagucaaaugaagcaaugaugagcccuacaaggcaguaaacugagucaugaauuaguguggguaguccccagucuacacuggagcuuccugcucuuccucugcagagcuacguacccugugugcuuccaccauaggucugcuuuguuggccacacagcaucgcccucuaguggcuagugagcaggguggccagaaggcagugcccaacucaggagucugcuacauucuuccuguuacaccagaauaaagcagccaucagugaguugguaacucuagucaaagauuuacauguagucuuucauccguauagccuggaggggaaguccuggcuaagggcagcuagcauguguuuuucugugcugacuugugcuuagccugcugguaaaccaccuagcauggcuccugccuugcuauagcauccuguggcuauugggccagggagaguggagagacaccugguggagggccuuucuggggguguauauuguguggcaggcccagaguuuggcaaaauugcagugucagauuuuucucuauucuuuggccuacaggguuaccccuuuuuguccagcgcacaguggcccgaaccauuguuuuacaagagauuaucggcaagggccgguucggggaaguauggcguggucgcuggagggguggugacguggcugugaaaaucuucucuucucgugaagaacggucuugguuccgugaagcagagaucuaccagaccgucaugcugcgccaugaaaacauccuuggcuuuauugcugcugacaauaaagguacugugucccaaagucaguggccacuuguuggcgcuagagaggccuggcugcucugcucugcugcacacagcaggucugaauaagaccauaguucuaaacccacuuuaaauguggagcauuuuaugccaagaugcucacacggaaccuggguuauugcguagcuaagaaggccucccaugccccacaggcuuuucuuccucuaucccuugauuugcucuccgaucugcacccagcauggcccccauugggacucccguguguuuguuuugaaaacugcuacaauaggaauuacguucucaccugccugggcagguggcagagacacauacacggucuacaacacagcacaagcguuacacacacugucguagggaagccaccauaagcagacacuggccuuucagugucaccucauagcuaugagacugguuucggucuguuuuauaccuagagccccagagcuucugcugccgguccucccccuccucuauccccucuccuuccccucucuauccccucuccuuccccucucuauccccucuccuuccccucucuauccccucuccuuucccucucuauccccucuccucccuccucuuaucuccucuccucccccucuauccccucuccucccuccucuauccccucuccucccccccucucuccucucuccucccuccucucuccucucuccuccccccucuauccccucucuuuucuauccccuuuccuccccccccaccucguuuuuucuccuuugucauaaggcagacuagacauauaggacagccuagccacaaauguacagucucucugucucagccuuuuauauacaugggagaagcaggggagggguagacagagacaagguuaugcuggacuuuugugcgugcccaugcccguguguguguauguguguguguguguguguguguguguguguguguguguguguguguuaacacauacuauguuguguggccuguaauucuaguuccaggggauaucaugcccucuuuuggcaucugcugguacuugcaugaauguacacauagcccuacaaagacacaccauacacacacaccuggcauuugguaccccuggaacacagaaauuaugagggcacugaguuguguuuuagaagugucuggcaguugugacacacuucccucugcagcacaaugacuagaggcuaguguccacagauguauggggaaugccagcugagcguguucuucagagugcugcggggcugcaggucccuggcugcccaacagcugaagagcccuggguguuagugcaggggaagaagagacggucucagcccucugaggagcugcugcuaucccagacgucuuagagucauuaaaaggcuccaacuguccuauggcaggucauggccuccucagaaaggaguuacugguuagaauauggcccucuuuggggucagagcugacaagguugagacauuucuagcagccagccuuuauugauucuggaagcuuguaugaguugggaucugaguuagggccaggaaaggagggagucagaccccuuuguucuugccuuguuaccaugauauagccagugugaggcccugggauuagcaccagccuagaauuuggaagcuuucagcccaguuucuaaucuuccuagcaacagcagcaagcuuagccagauugaucaguguugcuuucuccucucccuguccuccguccugccaccccaaagugaaagagaggggucagcaagcucccugccuuccacugcuuuccugaagggcaagauggccuuugugggagugcucagagcauuccuggcucugcaacagggaugcacaaaugggauccuucugcucucaucauggcccuuggccugagaauggacaccaaguggaaggagacauuuccagugagacaggugcugcacugggucaugaucgagggaggagugcaggcaagagcgggcucuccuccugggcagcaguggguggagcacggagagccuccugucagagcgaggaagcaagccaucaaucgguaacaaacugaaccugcacauuccagacuuggcgauaaaguggcgcugcugagcaucuuccucacugacugggcuacuugcuugucucucuaauaagaccccacagccaaguggcgcacgccuuuaaucccagcacagagaaggcagaggcagguggaucucugaguucaaggccagccuggucuauagagcuacacagagaaacccugucucaaaaacaaacaaaaaacaaaaacagggcugaagagauggcucagugguuaagaacacuggcuucucuucuagagguccugaguucaguucccagcaacuccaugguggcucacaaccaccuguaaugggaucugaugcccucuucuggcauauaggugugcaugcagauagagcauucauacauaaaauaaauaaaacuuaaaaaacaaaauaacacaaauaauggcaauaacacauaacacuacuacuacuaauaauaauaaagacaccacggccugagugacuuccagagcgguuugcucugugcucgugguccagauggucacagccugugaugcugaaacagggccaggagcugagagcuccuaucuugagcuacaagcagaaggauggcuugugaccucugaaaccccaaagagugccccagugauauacuuuguuuagcaagacccuaccuccuaggcuuuccaaagagccacccacugagggucaggcagucaaaggcccaagacaguuguggaggagcaucucaagcaaaccaccacacacaccuggguaagggaguaagccugagagagaggugcucucuguccucccuggaggcugccagagauguggaggcaggaaguggcacuguguguagcacauaccuucuuccuuauugcauaguguuccuucuauguggcccuugucuguguucucugcagauaauggcaccuggacccagcuguggcuugucucugacuaucacgagcauggcucacuguuugauuaucugaaccgcuacacagugaccauugagggaaugauuaagcuagccuugucugcagccagugguuuggcacaccugcauauggagauugugggcacucaaggugaguaucgaacucagccagggagcaggaagcuugagacaaaaggccuguccauccccauguccuccucacugaggcaguugggaacaaacgcugggaaugguaguuucgugugaggaacagagccccuaacuggguuggcuuuccucauuggcugucauuagcccuccccuaggaagagccauagaugaaggcuuggcagcuguuaaugcauggcacagguguuugcuaaggaacagcaugaaggaaugaaacuaagaagcgagaccagcacaccaggagcaggagugcaacaaucucaugccaagguugggcacugccuugcacagcucacgguggcaagaugcggugcccaccuguccgcauccuggaugaggaaacaggcuuugcacuugguuguacuguugccuccagauccugaugugauuguuggugcuugguugaccugggcagcagcucuuaccagcaugacugucgggcuaauggcaguuccaugugcuccuuugcccauccggcucaucugggcucaccuggacuggugaaugguggagauguucuaaugugagucaguagccaugccauugagaggccuuuaauucugggagugcuucuguccucugcacauucccauaaaguacugcuacucuaguuguucagagagaagacaagagaugcucauggggucacuggcuugagggaugcggagccagggcucagcccagaauccucucagaguccacacauuuccuaugcacacaucuuccuugaacaugcccgguuugugucugccagggaagccgggaauugcucaucgagacuugaagucaaagaacauccuggugaaaaaaaauggcaugugugccauugcagaccugggccuggcuguccgucaugaugcggucacugacaccauagacauugcuccaaaucagaggguggggaccaaacgguaagaagucccucggccccagcccucgccugccaccuugccuggaugucccaugcgugggucaugagugcacacaggaggaaauggauuagcacggaggagcaucuccuuguccuugauggccaguguuuuucuguuccccauacugggacacuugacagcaguguccaccaagcccugguuccauagaaguguggcccuggaggcaggcagugaagaaagaauucagaguagaagaccuggcuugagccgggcgugguggugcaugccuuuaaucccagcacucgggaggcagaggcaggcggauuucugaguucgaggccagccuggucuacagagugaguuucaggacagccagggcuacauagaaaagccuugucuuggaaaaccaaaauaauaauaauaaccaccaccaccaucaccgccaucauauaaagaagcuaguuguggcagcacacacaacuuuaguuucaguacucaggaggcagaaaauggcggaacugaguuugagacuagccuggccuacagagcaaguucuagaacagccaaggcuacauagagaaacucuugcucaaaaaaugaaaaagauuuggaaggaggguugggaaggguggugucuggggaaaugcugcaguauagagggaagcuugcagagugagcccucuugaagcagacagaguguauucuguuggaguuuacagacuagguuugccauccuagagcagagcuaaucuaggcugaaacuggggcaccugggaggguguggccuaggagggcguggccugcucuccacaccacugagaagugaaggaacuauauagcugacaugauaggauggaggaaaguggaggagagggucugugagcuggacguacgugaacugauuaggcugcugcauuuuguccuuuugaccugagagugcaucuacccaggcuccagagugugggcggggcaucuuacaucacauaauuacacacaauuacugcucagucacuacgugugauuucagucaccucuagaguuauuuucaccugucugaagucaaguuaagauuacaaaagaaauugaaugaaauuaagcucaucucaucacugugucccccucaguaaagcgaaggcuccagcagcgucccacugccaccgucuguguggucccauaacagccuguaccaguaaggagucgucagugcugaaccauguagacuugaauccagaaaggccaugcaguagaagacaggcuugcuucugcuccccagagagcugcauuggagcagccgucucgcacacccagaccuuggccccagcgcuccgaugagagccguccucguguugucugaaugacucucucuucccuugcagauacauggcuccugaaguccuugacgagacaaucaacaugaagcacuuugacuccuucaaaugugccgacaucuaugcccucgggcuugucuacugggagauugcacgaagaugcaauucuggagguaccuucuacuuccacucuagcuuccagcauuaugggucaccccguggugcuagugccccuucuccacagccggugagaugcuuggugccgagucuggaggcagcugugcugcucugagagggcagcuuggcauuguuuguuugcucggggcuggggaugcacugggcuuuguccaugcuagucgagacuccugcauaccugagccgggggaacaugugcugagcagugcuauucguugugaugaccaaucuuggggggggggugucucuacacccucugucuuaucuccucauuuuucuccaccccuuccuccuucccugccucucuccucucacgcacuguauuauuaacucacagugaaggcaauucccaggaugcacacaggucgggaccuugugagucagaggcagguuguucugacguguucucacacgcuccuagccgcaucucugggagcccugcuguuuccuccuaguacuaagacuagaacuuucuugguuagcaagagugcuuaggacuuucuuaaaauguuuuuucucauaguuaaaaaacagauccugacaguuuugguagcuuguucaugcaagagccuggugaggggacaacagcaggguuagcaggagacaauuucguugguugguugguuugguuugguuugguuuuuguuuuuuugugugugucaggguuuuuauuuguaaugacccuggcuguccuggaacucacucuagaucaagcuggccucugcucccaaaugcuggguaaaggugugcacugccacuacccagcuauguuauuuuauaguggccuccaaauauucucccaugcagugaugagagagguccagagccgguccagccuuggccuuuccucucugguccugcccuuuucugucuaugauauuagacccaaguaauggaggaaaugcuugugugugacuaaguaaagaugacuggaaauccuagagcuggacgcagcccaguggcacugcuagaauucguauaguagguauauauaguauauauaguauagaauucguauaguagguauauauaguauauauaguauagaauccguauaguagguauauauaguauauauaguauagaauucguauaguagguauauauaguauauauaguauagaauucguauaguagguauauauaguauauauaguauagaauucguauaguagguauauauaguauauauaguauagaauucguauaguagguauauauaguauauauaggauaagcacgagcaucccucuuucuacagagaaaauugccaaggaucuuuguaaaaugaauucuuuuuaaucuaaauguaaaccguaaguuaauguggcggcugcagcucuuggccucccaguaaccacagagaagccaagcuugaugucaagguucucgucaauacugggcaguuaaaggaucuauguuagccccaugcuaacgacugccucccccgcccccugcgauacuuccaauguaauauauuguucuagcucucucugcuucagauguuuccucucauggugucuuuucaggcccucuacuugugaccccagucugaaucucccugugucuguuugucucucugucucugucucucugucuccuucucuccccucccccuggcuggcagaugucccacccuacucucucuucugccuaggcauuagguggucagcauucauugacaaggcagagaauaaaugguaagcauuguuuacacaaaccugagaugggagauucuagacguaagcauuacaaugcuugcuguguccagauugaagcaagaaaugagggcagagaaaucagcauuugaauaacaaacacaaggauaaccuuuacacagugcacaguaacauuaugucuacaggucuuuuuaaaaacugugugugugauguaugugcauauguguauacguguggaggccaaaaguucaccucauguuuuugagacagggcgucccaauugacccacgaguuagacuggauggcugaggugcuccaggggucucacacugggcuuguagauguacucagccccucaugcuuacacagcaggcacuacacccacugagcugucuccucagccgugccagacaacacuucaacugugaauaagugugugucuucuuucucaugauauccagaaaacuagggcuaaauguguaaugcaugauuguagcaugacuguggcaugauuguaacaugucuucaccccagcugcaugugcucacuuugcaucuucacugcaaaucuguaaaggcagauacucauauucuccucauuuuguagaugaagaaaaugauagaaagguuaaguaauuugugcaaggucauggagcugagacucuacaggccaaggcaugagcuuuagcuacuauugccaagucagauaaucuuaccucacagugcaggagagauggcucagcaguacagugcagcauggcaguggacccuguuagugcagugcggcaguggaucucguuagugcugugcggcagcggaucccuggaagagcagcagcggaucccguuagcucagcagugggucucauuaguacagugcagcaguggauuuaggcuauucuuuuuggaugggguaaaaugagaaaaguacagcucccacucugccauagacugaccuagacucucacuccuccugucucagcuccuaaggcccagggcuaagguugaacccauuauguucagcuucgaagggguuucuuuuuacuaugaguuuguuuauguauaaaucaaaaggauaagaauuaagaauacuccaguuaguuuuaagagugaauccuaggaugcugaagcaagaguguuacaaguagaaggccccacggaacuuagugagaccaucaggaggcagaggcuguugggagagagagcacuugccugcgaccugggugccaugguacaguacccaggaggcugagaaaggaggauugaaagcuugaggccaauuggguagcgauaacaagacccuaugucaaaaacaaaaggacaccgagauacugcguaggucuguaguagagagcuugccuagggugagcacacacacgaauucaagucagaguccagaugccaucaucaguggcacaccccaggucucuccugaugccaccaucaguggcacaccccaggucucuccugaugccaccaucaguggcacaccccaggucucuccugaugccaccaucaguggcacaccccaggucucuccugaugccaccaucaguggcacaccccaggucucuccugaugccaccaucaguggcacaccccaggucuccucaguccuaaauuucccugugcuuuuccucuucccuugcucuacuggagaacccagucaaaugucccauaguuucccagacugcauuccacagauugugggguccgcaugccccugcgccugacauuuccugugaauuaguaugugagccuucaguucagagucacaucuggguuauagauucuuuuuuuguccauuugguucaaaaauguuucguggcuucagucuuuggggcuucuaauacaaagugcagaagagcagucuuuucccuucaugguggggacaaccagggugacugcuuacagacccagaaugacuagaggcucaaacucaaacuccagcauuucugcagggccacuuuccuucagugaguuggcugcuuuuguucuuguggagaaagaccuggccacaggguauguuggccuacucaccucagagaguucaaggucagccuaaacugcauaaugagaccccgucuuaagccaaaaaggguuaagauaauaaagaaaaguuuuaccuacauaucuguuuguuugccaguguaugcuuagaauaggacauacaggagccaccugcuucccucugguacucaggguuccagaguaacagcccacucucagcacacagcaaacggauggcacuuucuucuccuaacauuguuaugaaccaaugaguucccacucagcaggguggugcaugcuggaggcaggaggacccaaguucaagucuagccuggccuacuuagggaguuccaggacagccagagcuauguagagagacccugucucaaaauaaaauaauaaaagaaaauagaaaaaaauguuccuuuccaauuccuuaguuuuauuuagauuuuacuagcucugggcagcuuuuggggucugauagguccuaagcuuaaagacuuuuggggccuauaguugucaaguuuuguuuuugcuuuguuucuauuugagaugggcuuaugagauucucuugaacccagucuuccugccccagccucccauauaccagaaccacaugcccagacagcugugcuugccgggcuccugugcaguccuuacacugcacugugcccgggaucaguugcccucuccaaaggucccagguuuguguccgugaaaaaugguuacccagcguggcugcccuuucuccuccugcugccgcugacuagguggcuuucaccucuccuaggaguccaugaagacuaucaacugccguauuacgacuuagugcccuccgacccuuccauugaggagaugcgaaagguuguaugugaccagaagcuacggcccaauguccccaacugguggcagaguuaugagguaggagcucacuugauaucuguggcuucuucaucugccaaguugcucugcuaaaaaacagauauuuuuuaaaugagccaacucccagguuugacuuugaauauauccuuuaucuguaaauccaaaaugugaaacuuuuuuaucauuaucauagugcuacagcuaggucaguauacgcagcaggcacauugaaaauaguaugcacggucaccuucaggcuacaagugaagggaggcaggccgcgagcgugcgugcgugcgugaguguccugcucacagcuguccuggccccugcucuguagaugucugugaggauagagcacccagagucacagcaccuccuacccaggcauuucaggcacgaggcacucacucugugcugcugcaccaaggccuccaacuguggucacuuuuccggcuauuguguagauuaacccuuuggaggugacagccuagaagaagggagauccuugccauugggagguagucaaggcaggacagaaaagaauaaguagaacuggggaaaccuaucaguggccuuggccuuggugucuuaucuucaggguggcuuuaacagaccugucaaacuagagaaguggccuugaagcuaccagcuagggagaugcagccauggcauucagaccaggugucccagaaagaggcaggccugagugagacagaggccuuuguagaaacuacagauagagggguggggaaggaagugugugggggggagggguaugaggagaagaguagggggaagaguauggagggcuuggaguuaagagggagagcacauggggugggagguauuggaaggagaagaguguuaccaugguccugacugacuuaaggcucuagaggccugcagaguagagucuccccagcaggggcacaggcuuccauucacaacacuguuuuauuucugcagcuucauuguuacagacagacauaacauuugcagcugacuuuacacuagguuaggcugugggaacuaccacggucaagccacucaacacaucuuuguuuauauauauacacuugccuuaugacugugcagagagcauuccaggucaacucugggcagauuucagcucugcuaauucugaaaaccauucagaguuaggacguccucuuccaaccuccuugccucccauguuaaggagagcacacucuaccuuuaaagauccuggccacuagggggcguuucugcaccuaggaacccauugagggcuccucagugccuaccaguugcuugugguugcagaagagagcaauauuuuccaaaaugcuugggugccuuagauuuagcugagggcgagauagaaagagccagacuuuccugcuguccguucuccccuugcaccucugccccuuaaggaagggaaggccuaggaaaaaagccucaacgcaucacgggguggaucugaccugacgaauaggcaggcagcgaagaugagccagugccagcggccaaggcuucugugggucucucacugcgggucucucacucugggucucucacaggccuugcgagugaugggaaagaugaugcgggagugcugguacgccaauggugcugcccgucugacagcucugcgcaucaagaagacucugucccagcuaagcgugcaggaagaugugaagauuuaagcuguuccucugccuacacaaagaaccugggcagugaggaugacugcagccaccgugcaagcgucguggaggccuaccucuuguuucugcccggcccucuggccagagcccuggccugcaagagggacagagccugggagacgcgcacucccguuggguuugagacagacacuuuuuauauuuaccuccugauggcauggagacucugagcaaaucauguagacaacucaaugccacaacucaaacugcuugcagugggaaguacagagagcccagugcaucuggcguguugccaggagcggugaagggugcugggcucgcccaggagcggcccccauaccuugugguccacugggcugcagguuuuccuccagggaccagucaacuggcaucaagauauugagaggaaccggaaguuuccucccuccuucccguaggcaguccugagccacaccaucccuucucauggacauccggagggacugccccuagagacacaaccugcugccugucuguccagccaagugcgcaugugccgaggugugucccacauugugccuggucugugccacgcccgugugugugugugugugugugagugaguguguguguguacacuuaaccugcuugagcuuucugugcauguguaggccagggugugguggccauacugucucugagugcugcugcuucucagugagcagcauguaguuaaccuggugcccuccuaggugucuccuguccccagaccccaucagucagggagguucugucuucucagcaggcugcuugcccacccugugucacaggcccuccucuuccauuucagaccagaaccaaagcuggcccacuuguccaugguaggagaagcuuuugggucaaaaugagggggacuugaugagcagagagagaauguagguggaagucuugggugcuguguuucagcaucagccaugggaaaugagccagcccaagggcaucuuccuugacagcugugaggaagggccgaggaauccgaagccagagcuugggacucagauuggaauguaacaucuguuuaugucccaccccagauucugcaaacugcaguguauauuuuuggugguggguuuggggugggaagggauggguugcagggcguggggagggaggcuggggugggagggaggcaucugcaugggcuucuuguacuggauucucugaucaggguagagaagaggcaaggcuugcauccacuucagggucccuacugaggagagugagcgguccgagcugaauaugguguuuaaccuaaguuuaguauuuaaugaauucuagaagccuggcuguggguggugauuuggucagcauaucuuagguauauaauaacuuugaagccauaacuuuuuaacuggagugguuuauuuuaauucaguuuauuuuauuuuauuuuggggggagggucaggauuuuaacuuuaauauuguuaaguuuuguaaaaggagaaccaucucugugacaauuaccucuuagucuguuuguuuuuaaagaaaucccuaaaacaaacaaaacacaaaaauucuccagacucaaacgcacauaguucagucacuggaaacgcuugucuuugcaccugagccugaucccgcugagcagugagggcugcuuuuccccaugggggcuugcugucucguacucccugcacccucggccccaucccgugagcaccucggcccucugcacauugcccggcugguuggacccuuuccagauacuugcucagcaaaugugggcugcgagccugcugagcgcuggcccgggaggaucuccucaggguggggcaggcuugggcgcugcucugcuccucuaccacuggagggaauggaaucaugcgaugggcgagcaccugcuguggagaccagaagugcucauggcugguccugagagccuugaugagcuaggaucacuguucuuaaagaccacugaaacuggaagggggaccuguauccccuugggaagagaagccccuggcaagcaguggguccuggagacuggguucauugugagccuuuccugccaggggaggcaugagucuuugcagggaaacugucuccuccagcuucuccugccuuggucuccccauauucuuagccuuucuauuuauuuccugguguauaacuuuccuugcuuuaaagggaucuuccuuuaauuccuugggccaauuuacuggccauugaacagugucccuugagucccaacugugucucuggggaaccuccuuacccaccccugcugaccucccacuucccacccugcagcugaguauccgugauuacaggcgauugaacuguagaguccucucugccucuguaccugccagcagcagccucacagugacccccacgccacuggacaacucccaggagaccugugcgcuccgugcagcucagcucagccgccucucaggaagccuggagcaggucugggggaccccccccccaucacucuuuacauuaagcugagaguugggagaagcugugcuuuggcucccugaggccacccugauccacggggcacccgcaccucugcguucuggauucacagaccaagucuaaagcccguucguuccugaguugccgucaaggccccugaacgguacucucgguacuucuguuuguuuuuuguacaauuuauuagaaaggacuguaaaauagccacuuagacacuuuaccucuccaguaugcaaauguaaauauauuguaauauaggaaauuuuuguuuuaauauaagaaugagccuguccaguuucugcuguacauuauuaaaguuuuauucacagaacug

SEQ ID NO: 8016 - RNA, 1309 nt, Mus musculus
agaagacagaaaaguuuguauugcguucauucuaguucuuauccacgaaaggacccuccccccacacacccccaacgagauccugugccaccuaugaaggugccaccugccuacucuggaggauuagugaaugcguaucuaacagcccuguugacagaaguccuuugugcugauuagagguaaacaccucuucccccacaaccccaguuugugcagguccgauugccucuugccuccaggugagaagccaccacagggagcugaaguucucaccuaagcaagaaggugcuagaaaacccagagcaagugugagcccagaaaaggcaauuucucuaaguccuuggcaugauuuucucaaaucuuaggauuucagagcuggaagaggccucauguucuggaaaagacgugugugguccaagcccuccugccugagacagcagucagagagggaaagacugccccggaauggauuuaggaacccaggacucuugacaaagacugcuaauucagcagcuggcagcuggggagcggacugccugauuccucugcgguuccacaguuucuccagggaggauuggagaguccugggugccucccugugggaugguggcacccucugcuggucgugagccuugugguggaacuaucuccagacucaaagccgucuggugcucggcgccaccuggaaaccuugccauauuuugggaucccauacagcauuuguuccuccaggaggaucuguagugagcugguaacugaguucacacugaggaaguugugaggagggagaugcugccgguuaaaaguacuccacagcacggcuccagagcucagccuucucugccccaccuccucuuaugccacgccccuugccuagcaucuguuccccuccuccaauuagccuuacccaggccuccugccucuccagaaugucccuuaccuccucaugccucuuagcaaauccccuguggaucugcuccugagaaaucuauacuucgucugcaacuuaugucgaagcaggugucuuguucccagggaguucauguuucccaguucuuuggcuccagcugcuccauccuaagaugggguuuaaggguggggggaggggagaccuggguagcaugggauuaguagaggcugucuaacggacaaagccccuucucacuucuuuaaggacaaccccuugccaagucucccaccaauccacaauucccugugaccccacagaccugcuuaaguucuggggaacccucggaaaguuggagcacuagagcugcgaaaguucagacgcuguagagucccagugagu

SEQ ID NO: 8017 - RNA, 8571 nt, Mus musculus
cgggagucuauaaagcaaggcuacacgcggcccgcugggcuggcgucccaaagccgucccuaacaccaucaagcagagagagcgcggccucugaggggcgccggacgccggagccaugacccuccgccgacucaggaagcugcagcagaaggaggaggcgacugccgcgccggaccccgcuggccgggcucccgacuccgaagccgcucgcgccgccccgcuacccuccggcccuccggcugccgccgcuccgcccggagcccccggggaggagcuguacgcagcacuggaggacuaucacccugccgagcuguaccgcgcgcucgccguguccggggguacccugccucgccgaaaggugcguuacuuaaccugcauccccagauucgguacccugccuucuuccuuccgcaggauacacucacccgcagcagcgccgaugacugccacauuccccggcccugcgacccugggccacccgccuugcuccgcccagaaggugcaaaccugcccacucgggucucagaaggcuguagcccccgccaucacaacgcccccaguucggguggcucuccgcuccauuccccacacgcggaugccccaucuccucccacucucuugccuuaacuccgccccagcacccccuuucuacagcuugcuccaucuggcuuucugccgccuccugcuccgccugcggguguccagaagucuaaaaacucucaggacccugccgcccaagcaccuucucaaguuggagcagggauagagaaggaaccucaccacuugccucgaacaaguugaggguccuggagcccugggcgggagagagauuaauggccccuuagaaguagugcugcgaauucccaaaaacucccccuccgcaggaacacucggcuucuugggcucagggccucgugcuuuguaccgcaucuuagaugcgggaugugaaagcguagcucuucuaacuucagccaggaccggacgcugugggagagucacagggcaggaaggaugcgggccgcacccgcccucugcccuaagucucccucuaagugaaacucuuccucuggccugagagaaccugagucuucagaugcugagagccaagacccagguuaaagagaaagaauggguagcccuucccuaugcggcccccuccuucucucauggucccuggcucccccuacacacaaugaacagcuuguugagaacuugcauuuuaugaaaaucggguugaaaaacaaaggggucucucuguacugaccgguccuuccuucuuggccuauuuggauacuguccccacccagagguuagucugcuucuggaggaagaggguccccuucucuuccuugcuuuaggguagcuuauggggguagagaguguuaacaaaagcacagaccaggaaggccucaggcaguuuggcacuuggggaaaggguuggucccagaugagacuuccuccaagaacuaaaaucuuaggagggacagagguuguuuuuagguuaucugggguccggaagaguucaggacauucuaaaaaaaaaaacaaaaaaagcucccaguuuuucaagcauagugagacaaguuugauucugagauuuacuuguuuuuauuuauucaauaauuauuuuguucuagaaaaaaauucauggcaauaucaagagacucagguuuggagggcauacagccagcuucaucuggaaucuacugucccaccuacccccaagcaaccuguucuuaggagauuuggcaccucugucacauucaggcugucauugccaggccccuggcucucugcucuccugaauacugggucugcuugaaccauuaaauggacagacucagcuggugggaaucuguagaguaagaacccuaagucuauggcuuccuucuucaacucggggaagcuccugccucagcuuuuggggcccggaaggucuggacccaucagacaugaugccaguggugagauuauucuagagucacaggcuucuccaagcugguuagcagagguggaguuuacugaucuagaacccagaauagaugugacccugaggucccagggaccgugugaacucugggagugauaacagcagcuacauuuggcaaauaguuaaauuagcgccaaagcagagguguagcuaggaaggaaaagacaggcagcaggaaguggggugcugugucagaguugggcucaggugagaguccuuccagaaaggguuccucagcaucugccccaggauagcuccuugucagcaucugccccaggauagccccuugucggcaucugccccaggauagccccuugucggcaucugccccaggauagccccuugucggcaucugccccaggauagccccuuguuggcaucugccccaggauagccccuucucggcaucugccccaggauagccccuugucggcaucugccccaggauagccccuugucggcaucugccccaggauagccccuugucggcaucugccccaggauagccccuugucggcaucugccccaggauagccccuugucggcaucugccccaggauagccccuugucggcaucugccccaggauagccccuucucagcaucugccccaggauagccccuucucagcaucugccccaggauagcuccuugucagcaucugccccaagauagcaccuucucagcaucugccccaggauagccuuuucauugucuucugacuguuuuaccacccagggcucaggauuccguuggaagaauuucacucagaguccugaacagcaacggugagucacccccacccaaagucccugcuguccagaaaagugaggugguggggguggggauggagcaucucagcccagcccccuaggaggcaucucccauccuugagcaugacuuccccacugggauugaggggcaggugggggugugggcugugugaaggggcggcagaacaaggggggcucuucugagucauuaggugcuccuuaaccacccccaaucaaugccaguugugucuuucuggaagagcuggauuagugagaggugggggugggaaggagaagauaccauggaaguccccuaacucgugcuccuuggcuuauucccugagcccacccagccccgcaggcccagaccaugggcauucugugaccagauguuugagucugauggguuuuaugaaucaggcuuuuagucuuacauuggugcuaugccauagcugcaguuugggaaggcucugagaucuggacaauggacaggcgcucauccuaggaccuggggcucagguucccuuuuugccuaugucucaugcccaagacccuggcuuccccugacaugguucugcaaacugugaccuccuggccagguuggucuguuuggcccuuuaacuaagaaucugaugauauaugcucacacauacauuuguuguuguuguuguuguuguugcuguuguuguugcuguuguuuugcguuuugagacagggucucucuacagagcccugguuguccuggaauucaagagaucccccugccucugcuuuccaggugcugggcuuaaaaaaaggcaugcaccaccgugcccagcuuauuucaauaucuuaaaggguuauaaaaacaaagaauaauauaugacagaggccauacagggcccacaaaaccuaaaauauucgcuaucuggcucuugccaguaaaaguucgcagacccuuccaggaacccagaaagcacugggacagacagagaacuuccacugcuccugccccacaacauacggggcucccaaggaagagaaguaucuugcacagccuuagguggcaggggcugugacucaggauagaagcuagaggccucgucuccagggccuuucugaggcugccagacucaaagaggcuuucgcagccacuuuauucugccucuggcugguggaaaggaaggggaaggggugggcaaaggaaacucugggcucccccaucagccuaggaucuggagcaguuccagaccauuguguccagcaggcugccuucaguucgggaagggguggccccaggcuccccucccccagcccucacaucuggugggcuggccgcaccacagcugggaggagcagcugugguguggucugcgcccagccucgugacugcucccggggcuggagcucuguuuucuccaaagcaucagagccaggaugcuccagccuggggggccaaauuggggccuucgguuagugaguauacggucagacucaguagaagucugggggugcugguaggcucacuccuuuccagaguucccacccuacccuacaccccacagccgccccaccuaagaggcugguuuuauucuguacagcuccuugaggccaauuucaguuggguuugggaagggcauuccaaaaaucuguguagaaugagcugucacaggagacucuggguccuucugggauguucgagaucagacuuccacugagcugugggacugucaagcuccugguuuuguugcuguauuuugagacagggccucacuaugcagcuugcggcaucuuccugccucagucucucaagugcuccgguuacagaugugggcccaccauagccagcucucccaugcuuuucuuaauuuuagugaucuugacccucugucugucuucugcaggaagguucuaacuuuggagaaaggggacaaccagaccuuuggcuucgagauccaggugugaaaaacugggcaaagaagcgggaggaugggaggacaguuuggaggauggagcaggucugcuugccucugccgagugaacguucggucucuuguuuacagacauauggccuucaccaccgagaggagcagcguguagagauggugaccuucgucugccgaguucaugaauccagcccugcccagcuggcugggcucacgccagguaggccuugagcccagagugcacagggcucugggggaagugcauaacuuuacuccuaagcagaggcguuuucauuuuccuccuucacccuccaacuuggagaaggccagaagaauuaacagaauccugaguguggauuuggacacacuggccauuuacuguggggccgugugugguucuuuugcaaaacagggcaggcaacaguguggcgcgguggcgguacccugagcccaaagcggaaaccccggaaaagcagugcugcuugugagcagcuguucugccuccuggcagcugugcaguccagcugggcagaaucugguagagaagcauuuuaccaggucugccucaaagcgguccaugagggccuguccuucucccgauggggcaccugugcuguguccuucauugaacgauggagacccggagauuaaggucccagucagccagccugaggcucccaugaacccacaucuauucugucagcacaauugccccuuggcccuuaccuucuugcccacuuaccagcggcacuuugcuagguaguuccugacugcccuugauguagccacagcaaggauccacacgccuuacagaugucaaacgagcacccccaggugugagcaugaaaucucucgugccuggagccugggccagcucccaguugggcacuguucauccuauaugccuuaccuguaucgaaugauucucaugacaggugugaguuaaacagaaacagcuaacuccgggaggggccugggaaccugggagggcucugugaugggggagaagagauuccuggggguaugcauaugccaaaacucacuucuucucagaucccuggaagcuagcauagguugcuauauccagacaagcugguggucucuguucagggagaaauggcuguggguuuguguauuaguuguuuuuuuauuuuguuuuguuuuucaagacaggguuucucuauguaacagcccugacuguccuggaacuugcuauguaguccagauuggcgucaaacucauggagauuugcuugccucugucucccaagugcugggaguacauuaaaggccauguaccaccaugccgaacuagguuuuagguuuuguuuguuucuuaguuuuguuuguuugcugagacaguguuucucuguauggccuuggcuguccuggaauuugcucuguagaucgggcuggccucaaacuuagagagaucugccugccucugccucccaagugcugggauuaaaggcauguguugccacccuucccccacaacugguuuuguauauuuugaguagagaaaaagagaugcccaggucuuccaccacuguggaagugaguucugggugguuucuccaggucaccauccugcucuuucuggcuggagccuuuccucuaugcccugggaaacagauacucacuucugcucuuccuggcaggggacacuauugccagcgucaacggucucaacguggaaggcauccggcaccgggagauugucgauaucaucaaggcgucuggcaacguucucagguauccgugucuaggugcagugccuaagggcuccugaguuuguggugcuuccucagccuccaggcucgcucagccuuugucccccucuaucccccaggcuggaaacucuguacgggacguccauucggaaggcagaacuggaggcgcgccugcaguaccuuaagguggggaucaagaaaguaugggcucugccuuccucuuuccggucccugcuccuccggcccuuuuaaggauuccggcaucuuucuuaaacucuguuagccccgaggcuucugugccuuucucccuuucccaugcguccccauauccugcuggggaccugguaguccugacaguuggcuugcaugugucuuacagcaaacccuguacgagaaguggggagaauacaggucacuuaugguacaggagcagcggcuaguacauggugaguaggucggggcguccccacggauacccccagcagcacuccccucuuagaacucacagggauggccuggagcuacugcuugggaccucacauugcccuaagcugauaacacaguuuuguucucacagucgcccucuggagguuaggguugaguacugcuguuuguugccggccuuuaaucccagaagcagaagcagaagcagaggcaggcugaucucugaugccagccuagucuacaguaguaaguccucggacagcuaaggcucacuucuguggacugcuuuccugucuuaagaggcguucuugaguuuaacuccagcuuuacagacagaaagacuggggcccagggcacucguagguagccacaaggaaagaacaggaucuucugcccaugccuucugccccuuagccuagggcguggcuccaggauucaggaagcucccgggucuucuguccccacaggccugguggugaaagacccaagcaucuaugacacacuggaguccgugcgcuccugccucuacggcgcaggcuugcuucccgggucgcugcccuuugggccucugcucgccgcgccugggagugcccgcgggggugcgcggcgggccaaaggggacacagacgacgccguguaccacacgugcuucuuugggggcgccgagccgcaggcacugccacccccgccaccccccgcgcgcgcguuaggcccgagcuccgcggagacccccgcguccgugcuguuucccgcaccucgcuccacgcucagccgcagcgccagugugcggugcgcgggcccgggcggcggcgggggcgcgccgggcgcacucuggacugaggcccgcgagcaggcccuguguggcgccggccuacgcaagaccaaguaccgcagcuuccgcagacggcugcucaaguucauccccggacucaaccgcucccuggaggaagaggagagccagcuguaggggcgcgggugggcaggugggaaguauuuauuuauuuauucaucguaacagccugugcaaaaaguaggggcgguagugucgguccaaggaccccgggagcccaaagcugcgggagaggguccuugcuagcucuggucuuucuggucgguucauuggcuugucugcugaacaaaaaaaaaagggggggggggcuaguugcuuucugcccuccccuaaaccacagcaggagcucuacagggggagaauagacacugggaauugggagaaaucugggggaccaaagagggcuguaccaggcuaaagucugggucagucgugccuuguggggguccugucccaagaaacccucuccucagauauacuggcuccccagcccuuccuuagccuuggggagaggagauccacgauggaucauuccccacccuacagagacagacagacagauacacacacacacacacacacacacacacacacacacacaucaauggaccagugggccccaagggggcaaggugcugguccccucccuccaaccuugaccccuaagggcuuaaccccuguccaggggccuauaacuaagugggguccugccaggccgggguccuggguucugugcuccuuggggaacaagaaugaguucauucaggugggguggggcagccuggacuguuccaccguuuucugcauauguugcuucugaaccacaaacuguauaaaauugauggguuuuuuuugcau

SEQ ID NO: 8018 - RNA, 20533 nt, Mus musculus
caggcaugggcgacccugcaggcccgagcggggcucgagcccggaaggcgcgggcagagacgcgagugcagcccgcugggccaggugaggggcuggagcugcggggaccugcguucgccgaucugcgggucaacgugguccccuccuacccgccccgggggcggcaggacgggugggcggcgcugugcucggccagguccgagagccagcaucccaggccacccagugagggaaaugcuguccauccauucgggcuuggggacagcgguggcgccagaggguggucugcauggaugaaucccucagcccccucccuuggacacauuccucccuccucccgcgucuguuuauugauaagugacuggaggaacuagaggugguuucaaggcaagugaaccuggguuuggggcuaguguaaugggcaugcccugguuggcagguccccgacauguguccaaagauacugauggaccuggagcucugucuaaccugcacugggguaucaccuccaagggggguguguuagaucacugacuugggcaaagacuugacaaggaagccaagcuuugucgugagcaggggcucagaagaaagacaguguacggugggugcuguaaggucaugauuuuuuuaaagaugguguuuguggggccacgcuggugaggugaauggcucugaugagaaauggugaagggcuuggcuggagguaagacuguuagcucaggcguucaggccccaugccugacucagcucaccuacccagccacagagcuucucaccuguuccuuaagaugggcucagacuacuccaugcaauagaggcagguucccacuacgcagggcuaaguagccucagaaaggaugccuggccacagacuuccagauguggggaucuggguucuaaucacauagcuuugcuuguuuuuaaaccauguuuaggccuggccuuucucaaggaauaauaaaaaccaucccuuucguguuucacugugaggcaagaugucaguaaaguuuuucuuuuuuuuuuuuaauuuuauuuauuuuauuuuauguaugaguacacuguugcugucuucagacacaccagaagggggaaucggauuccauuacagaugguugugagccacuaugugguugcugggaauugaacucaggaccucuggaagagcagucagugcucuuaacugcugagccaucucuccagccagucaguaaaguucuuaguuguugcuuuuauugugugcccgguguccaauguccgagcuguguccagauccaucagggcuucaggagcccugcugucccugcaaguggaaauuuuaguuaagaaaacgcuugaaugcauuccuaagcaggugucugguggguccuugcaggagcugggaaguccuagaggucagauuuuucugauucaaaauuacaauucaugccgggcagugguggcacgcacgcuuuuguuccuagcacuugggcggcagaggcaggacagccaaggcuacacagagaaacccugucucgaaaaaacaaaacaaacaaacaaaaaaauuaugauucaaccaaaaggaagauuugugauuccguuggaucuguccccagauggaagggacagcuccuuagcucagaugucucccucaucuagcugaucuuucugacccagcucaaguguaagcuugugugggucaacccugcaccucacccccacaggcacuagcuucugcccaucuguuucaaacugaaggcuguggugcugggcagacauuguuuucuaguagggagauagaggauugacaagagggaagccaguccuggguggggcaaaaacagguuagcguggggguagggugauaggaauaggucuuugagaagguuagaugaaauggaaaccugauacaccaggaggaagcagacagacaaaaagacaggcagaugaggaacagugacuuccccaguggagggaacagccagugccagggcuguggguggugaagaaaggcucuugugacaagggggagguguggguggggagagcaguaguagcagguacugaaguuggggcggacgcacacgccccuuuagagaccaccuucccuuuuuugagucaccucagccuuggguuugcccucuacacagcaacugguacagucccguuugcagcugggccccgguguuggcuagcucaagaucucaagggcucccgggucuuccccugccuugggcacacugccuuguucacaguaguucaggaaugcugagcgugugacuguuagcagggaguuuugaucuagggacaggcgaugggauaagacaccuguucuucagagcugucagucacuuucuggggacaaggugccaggcucuggccccugugucgacaggagauacagaccuguugggagcgggucaguccaccuugugauggcaggcagugcuuguccugucucuggugcacgggagggcgauggcaugcucccucuggagagcagguuugacuccugcuugccuucuguuucuggcuagaggugccucaccugucccauuagguuucccuguccugugcuucgcucauggccuucacuucuggcugugagggaugcuagagaaucaaguccagggccuugugcgggcuaggcaggugcucuaccacaggugaaggaaaaucuggguauccgagccacaagggcaucccuuagcuggugcccuuggggcagaggucaggagcaugugacccacccacgggcuuuccccuaucucgguccuuccaccuacugcuguggaaauaucuacuucuccuuucccaccccuuuggccugcaacacgguccaauagcuugaaggcacugcccugguucuacccgaucucugggcucaagagggaaagggagaaugauggagugggagaagggagggggagguguggucaggggccguggccagagcuagaggagagcuaaagguuagagggucagguaccucagaggccaggugcccagacguguccaggaaggaaccagaaucuggaguuagccuuuucuuucuucuuuuucuucuuguuuuaccucugccuccuccccccuugcaccucucccugguuccucugcuggggauugaaccuaggaccuuguaaccugguaagcaagcacuuuccuguugucucuauccauucuauuuugugguagguuuucacugacuuucccagaguaaccuugaccuccuucuguaguccagacaggcccugaaguuguaauccuccugccuuggucuccugacacacugggauugcagacuuuguuaagaggucugacauuugcauguguuuauuuaagaccucccaaugaugaugcauagcaacgugugugcuuggcucuguuucuuucugaaagaggucucaccagguagcguugacuagcuuugaacucacagagcucccccugcccuugccuccuguccuguuauaaauccucugcguuuuaagccuuauaauggccugcagcuuuuagagauacucauugugauuucuucccugacaaagaagcagggagagacuguugagggacugugggcuggagccacgauugggacccuucaccucacuuccugaucagggucuggguucccauuguaggaguucagaagagucuccuugcuuggguuagaagacucagcucccugagaucagagaggcccacacagggucuugcccucuggggaccucugggcucuagggcuaagcuggagcccuguaaggaaggacaggugcucugucuguccuagcaggggcugcuuucucgcugcuacacauccccguguucccaggggcuucaggcaagaagcauguuggcagagacaggaugcuuccuggcucugagaugcccagauguuguccacagcuccagaccacuaucaagucccucagaauccauugccuagguuguuguguuccucuugugacuuguauccuaccccaguucugacuccuugguucccaaucacauugucuccaugagccccugauugcuccucacuaauucuaauuccuccacaggccaccauggacagagaccagccccugcuccucccuggugacuuggcuauguugcugugcccugaagggugaggggauguugugaguuguugacaguccuuuugguucacccagagugggugaguauugcugcuguccuuggugcaccccuggggcccucgagcaggugggguacgauggaggcagaggugggugcaggcagggcugccuggagaggauguggucugggggcuggagggggaagcccugccgaggcgagguggcgggugagcuagguggcuaagcaugggaacaucugauuucuucagacguggggugaugaugcggggguggggacggggaagccuuauguucuuaacagcuuaggcuggggcucuggguccuggucucaugugaggugacagcugcucuuggggccaaccugugcacgguuccaggaagccgaaggguggggugggugacugagggcuugggagcauagcgggggcauguggguuugaggcuuggccuguuuccaggguguagguacugcacuggggaggugcaaguccuggauuauaccugccaggcauggggaccacccugucaccauggcaguguucauccaguauucucgagaaggaaagucccuaaccugugaccaagcccaggguguccuugauuugcuucuccauuuauggcauuagagggaagauggcuucucauggucccaccaggagggaggcagugugggcugaacuggagaauccaggucugugggguuccuggagagcccagaggcuggccagggguugaggacacccuccagaugggcauucuguagcgaaggggaaggacuuucuuacagggucucucagaccaagggcacccaagguuuggucagcaugccuaggggagcugggauucaaucuagcacccuggaugucggccccaguacucucuuccucuuucuuugggacauaggaccaucuucaagcaacaauuucuuggguuuggggaacucuuuuuuuuuucuuuuuuaagauuuauuuauuuauuauauggaaguacauuguagcugucuucagacacuccagaagagggagucagaucucguuacggauguuugugagccaccaugugguugcugggauuugaacuccugaccuucggaagagcagucgggugcucuuacccacugagccaucucaccagccggguuugggaaacuccuaaccuuccugaugcugcaagccuuuaauacaguuccuuauaauuaauuuuguugcuacuucuuaacugugaguuuguuacuguuacgaauuguaagguagggccgggugugguggcacaugccuuuaaucccagcacucgagaggcagaggcaggcggauuucugaguucgaggccacccuggucuacagagugaguuccaggacagccagggcuacacagagaaacccugucucgaaaaaccaaaaaaaaaaaaaccaaaaaaagaaucguaagguaaauaucccuguuuuccagugcuccuaggcgacucccagaaaaggguuauucaaaaaggguuuaaaaaggguuauuuaaaagguuagacccaaaggggucgccacccacagguugagaaccacugcucugcauaauugggagacugcucauggucuccuucaguaucuucaguccuguggagcuugguggucagggugcagaguuucauggagguagcuagacuaggaaagacagugagugugcagucagucuggagggaagcaggaggugccugggaaacccggcuccugguagcugggcugaguguguacaccugggagucagcuucgugcuggcaacaggguccauaacaccaacuuggguuggggacagggagggagaauuacuguaaguggaaggggcagguggcccuggucaguagagaucuggacuuagggagcacgugagucaggaugacagcaguggccaggugccuccucuugacccuuguuucuacccccagcccacuccuggcuuccugaagacccagccuuccaguugggggcagcauucauguuugcucuguugucugggugaugugacuggguggaauucccaugucaaauauauugccaaugccacccugaggggcugccagccagggccccgugaguguuagagcugcaagucuugugacgugggcaccuguuugccaggccugggcaugggcccagggucaugcucacucuggggcucccgucagcugacuauuuugggcucuugcugaccugggccaaagucaggcccuagccaagagagccuugaggcggcucucccgguccccagaggccagcucugguuucugcuauauaaacagaagaggacgcauuggcucggagacaguucccauccagaguuugcuccgucagugccuggccucagcugggaaggacaggcgggccagcugucacagauccccacggaguuccugaggcuguggaaagacccuccacuaacccuggauuccucuuuugcccccugggucugugaggacacaugcugguaaguuuaggugacuggagauaccaaggcacaaaaaaaaaaaaaaaaaaaaaaaaagcugugcuguuuggauuuucccccacucuguccauccugccagauguucuccacugugaguggcaggcuagauucuugaggggaggggaagggagaggaauagaggggugguaaggccuggaaacagagaauguagcuuggcugcacuuggugguggaagucagacuuaagaacccuucaagacugucuggggacauggggacagacuugcccucuccuuccucagaggcugcccauagauugucuuuacggccugguggaggcuuccagguugcucaagcaguggaagaaaagagcgagcugggugucuacgggcuuaucucaaggcugcucucugaguacagccccaggcucccuguccuguaggagccugcggcugggcugcgguagacuucugguuaauccuccucuagccugcucuccuuucugucugacccaggugcuuugggugcugagaagcagggccguagugaagccgguuugccucaaacaugcuccccgggaccugggccagaggcagccucuuucguggguggcuccuauguucuccuccuccguucuuaaaaaaagaaaaaguuuccccccuuuuugaacaugagucucuaacagaauccagauccugccacuaaaaauacuuuaacaauaggaaaguguggcagacuuccggcugaggcuccuuaucggggagguuuuaacuuugcgcugaggaggcuggguggggaaaccuugggcagggcuaaggaaauuuggugggugugggcauucugucaggugguggaagacccucugggguggagaacugaccaguagagaugcacccaacaagcuuguagggagggagaaaugagguagccuuuccccgagaacuuugagcucuucugugcuuuccugcucucccugccaguuccucuugaggucuaaccuuauuccuauauacuguguauuaguuucuucugcccgggagauagauggggugagaaaaucacuggauugagguagcuccuguggcucugcugacuuccuuugguaauaacacaccccccuacacacacacacccacucuccucacccccaccccuguauuaauggagcacuuucuguggagggagcuucuggucagagcugcuuaagugcucuugcuuucucucacucagccccucagaggggaugggguuacuguucaggucucagacagggacaguguaacccuggucccuggucugugccugcuugucccuugccacucucagguuucugcuacaaguucccggcauucauauaucucagcgcucuguucugggguuuagccuuucucuccccuuagugaacugaacuccccaccguggaacuuagggucuccccagggggccaugggaccuggccagguuucacuacauagagauuugcuggccuggagcaagauaccugugguagcucuuccacagcuugcccguauugagggagggguggggugaacagggcucaugggcuaaccugggaacucaaacuggaaaccugauuuucuuuuuuucgggggugggagggacguaaaaauacaugaucagugcagggccuggagaaggaccaggaaauuagggccagagaccuggucuugacccuucaccuggguucccagagcugccaugggaagccccugaggcagcagguagcacuucccugcccacaacacaaauccccaugcccacugccagggcaggaagcggaaguggccuggucagggcuggcugcaggcucuggggcuaaacaggggaagcucccggagcuacuucucaguggaggaaacaaggcucacucccuugacccaccccaugggaagagcauggggguuguggguggggacagucuuaguaaaaggagggagguuccugcccuccgcuuuacaggauggggcccagcccgcuugggcaucgugggaaaggacugugugaguccacuuccccuauucccugcuuacccaacucugcagaggaaugaaggugggcauugcuaucucaggcuacuuacuguugaagaguaaaggccacaacagaaaaaggcucucugcaggaaggggagacagugagcuacccucauguuccucacccaugggucugagcgggagucuggaaucccuaucaugcuggguucccucccugcuaaccccguguucugagaccgagucuguguuucaggugcuccugaacuuucagcgauccuccugccucagugcuaggacugcagaggugugccaccauguuuuuccaaugucauguugcagcuccuccuaacucccugcuuugaguaacugucgauagaacagauguauauauggagggagaaucggcuacuacucugauuucagaaacauacacuugaaagaacuugaacucagucaaguccugcugcaucugcauucccuuaaaucggcaaccuuccuaaugcugcaacucuuucacacaguuccucauguuguggugacccccaaccauacaauuaauuuuguugguacuucauaacuguaauuuuucugguugugaaucguaauguaaauaucugcauuuucagaugcucuuaagugaccccugggagaggguaguuugaccccccccccagggggucgugaccuacagguugagaaccucuguccuaggcuaaaagcuugggauguaguccgaugaccaaccucucuagagccaacacacuugaggcucuggaguuccaaucacccaaaucaggaaccgccccgcccaagacucccccagaaaccccuauaacacacuguggucugaucugcuucugugguugcauuuacaaccacuggagucaaagcagcagggucagcgugaaccgggaguuagaggaucucguuuauaagaugcagguuguaauuucaagcucggggugggcaggaagagggcugaauggauugaauucaaguguggcaccuuggcacaaagucuggcccuugguuagugucuugcuucuggacuuucuuccccauaccaaugagaaaagacuucucaggaauccggucgaccgggagcugaaggaggcaguugugauuccagcagagggaaggaggaugcggggugggccuguggcugacacugcacugcagagaggguaggaauuagcugaaggaccuuacccuaggguacacugguaggcugggcccugguguggggccugacuggauagcacugguuuguaucugcaguauguuagcucuucucccugcccuuggugcguuuugggcauucagcucuaguuuuggacacacagcucccagaauuacucauucucuguucuucccccacccccuaccgcagugagcaguugaaccugguuugagucuuaagagcaggacuuggugguccacugagaggcuucugcccaggcugggaccagguuggcuccaggucucccaaagccugcgucaauuaucuaccugcuuccauccugcagaguccugggcuaguguuguugggcagccucuggccugcaaggaugaagugugggaugcccccaaguccuuuaugccuuucuucugucugugcuaggguucaugcuccacauugguggcccuagcuauguucccacagagggacucuuucucugccucacacuuccccagcagcagcugcuguuccuugucccccucuagccuugaggcagcaagaaccuuuguaguguguaguggcucaaggagguuggccugggugagagugugcucuugggcuguccucugcugcuuacccuuuagcuucucccucaggagaaguggucugugcuacuuuuuugugaaggcagaaugguggggaaaguggauaaugcuagaacucaggauggcacacccuggugaagacaggaccugcaccugcuucugcuggagggagggaccguccuggcuugucuugcuggcauauuuaaacacaucuugggaguagaggggagguggggggcuggguggagagauaaaauggggagccagauaugacauaaccagagcuaagguuauuuguccuuuagagcaaaggcauccauucucauagaaccccuggguccugucuucaaguguguguguggggcauaaaugauaguaguggcuuccauauuuaaacaagggcccaaguaaacuuuugugcaagggcccaaggaaagaaagauccaacuauggaugaugugggggugggaggguccaggauggcuccaguggacaucauccuguccacacuucuucuccuagguggcuuuuuguccuuuggaagguggcuugguaaaguccagagcuauggacucagccgcaacgagacuacacguuagccugggggggggguugcugguaacuucugaacauaucaccgaaugacaucagcaguguaugaaaacuguuccguaugcaggggacagugauuaaaaagaaauagcaggcugguugggggggggggucuuuuguggugaugggauggacuccagguuacaaaugcuaggcaagcaagaacucuaccacugagcuacgcccuuagcccauuuuuaaaaaccgguuauggccagaauaggccgucauuggauagucucgguuagucugcugcacuggugggcuggcagcagaaaucgggaaccaggggguggggucaaggaugggauagagauacugcaaagagaaucccuaguagggaaagcuaaccacugaaucuuuucuccauaccccuuccuuucucuuaccugacuacaaaugagguuuccuuuagcuuagacugggauggagaugugaccugcagggugacagcuccagguggcugcagccuggucugcacuuugaguacagcccuggccagacccuucccugcaagcaguaacugguuacagcugcucucuucacugcuggagcagguaguggggaggcagguggguccccaucagggacugggaccagggaauugacagaagagugugaaaaggagauggaguucgauggcccuggguucaagaccccauugugcuacuaccuagcuuagugaccuugaacaaguaccauuaugucucugaaucuauuuauaaaauggggaagaguuggcaagaguuuggaaagauuucucaggcuccacccgguucugaaauucggcaauuucucaacuagggugcauccauccugcgagggguuaagaggccaucgcugagaaaccagcaucgguguggagccgagcccguugacccagccuggcaaagcuaugcccuuugggaaggaaccuugaaggccagagugccuguccucaguccuggggcuagagacccugcacauugccaaggcugaggcacgggcccagcccaccuccuaucuucugggugugucccagaauggcuugccucagcccugaacugcccuggcugcucagaauggcagagagugauacccuagguguccaggacagacugggaaagggacaaaagcggagcagggccugggguaggggugggcaggagggagagggagcuguuggcaccaggagcagcuggaggggaggagauccuguucuggggaagcccugcgggcacggauuuacaacacccccuccuccuggucgguuauuucggaccccgggacccgaucccggguccggcuuggugagccuagugggucuggaagcuacuauauuuagccggcgcagcgggcgagaggaaaacuauuuauagaucaaacaauccgcgcucccugcgucaauggaaccccgcgugcgucacgcgcgcagacauuccaggcccccccucuucgccccgcccccucgggcuccccguccccgcgccuccuccuggccgccucccgccggaaccgcgccgccccccgcgcccuuguauggccaaagcucgccgggccgugugcgucaguggcgcccccgccccucuccaugcgucacggagcgcuuaagaugugggucgggcucgccaggggagccccagugcaggaggcugcgaaaguugggggagugugcuagaaggacugcggagcggagcgcacgcgggaccaggcugcgacugggucgcuggucccggccacagggagugggagccggcuggguagguaccccgcagggagcguguuucuguuucuagggacagugcaugaaagagaugggguguacgcgcgggcgaaaaggaaggguguuuucgggucggcuuacgaggagggguguguagggugcauuuuugguauuaaaggauagcucuuggaguagggugagccagggcuugaaguuuaggaagcgggcgaagggucugcaaggugcuugguuuugguagguagugggcgcuuguuuaggagguuuccccgcuaggaucuccagugugaggcacucuguacucuggguuuggguguugauugccggguaggggguugucugagcauggacugggaaaagguacucagagcuucggcguugcugggauccauccaaguacaaguaagauuggauuuccacgggucuccuucccgggcucucagcccccuuucccaguguuuacuuaauacuucauaggcuguacuuagauuuucugauucccuuaccgaacuuucuuucugaaccgugcuggaagaccuggggguugcugaaggaaauggcuagcuagguuggcuggguaaugguuguguuagacuaaguugucagaguaucuagaaaccuaggagcuguagccuggugcagcuacugaaagccgcacguggagccuggguggaaguugcucacgauagagucucgauguaguacugacuaggggggagaccccuucugucaucagacagacuuguauaccccaguggucuuuugagucuguuagguagggugcagccugcgggcuuggucaccuaacagguguugccaggaccugccccaagccggauucucccacucccucuuucaaccccgccucuuccuccuccuugagacacccccacccccucaggaggcuagaugcagaucuguaucuuguguugcggacuaucggccugaagcuggguagauugguggggguugauccggauguaggauguccaaguggagaaacaggauuugaauggagcuggaacaaacgcccaguccugacuggcugccacccuucuuccuccacccccaacccaucccuucccaggcuucuugcaaacagaggcagaaguggccauauuucuuucuuucucccaggugcuguaugcccuagggacuugacacggggcaggcggggugggaacugguuggggggggggugcuguuuuaugggaagucguaugccuagccagcgguggagcuguccuggcuaggcacccaggggugguguggggaaugggagaaauacugggacuagagggucucaagggccagcagguggugauagucuuuuucuccaccccacccucugcuccagcacccucugccucagcacccucugccucagcacccucugccucagcacccucugccucagcacccucugccucagcacccucugccucagcacccucugccccagcacccucugccccagcacccucugccucagcacccucugccucagcacccucugccucagcacccucugccucagcacccucugccucagcacccucugccucaguguuccugugugaccugucuuuucaacuagaaagucuagaacuguacagaccccagaguuggagguggaaagggacacuagguccuggagccuccucugugggcuuuuuugaccagaugagaacguaagggccuccuccagcuaccccuggucauucaggugcuucagguuugugaccuuugcugagacccuggaugcugcagcaaacagacaucugcuuuagcagagggacagcuugucucugugcauccgcugguaggauccuccacucuguccaauuagcuugcggcugcugcuggguucugaguguucucuuacaaaaugacaagguuagggggcuggagagauggcucaggggcuaagagcacccauguggcaguuugcaacugucuguaacuccuguuccaggggggaucugacacccucacacggacaaacaugcaggcaaaacaccuauuggcauggaaaaugaaaauaaaugaccggguuagcugagaaauuccuuuugagaguugucuuuucuccaguccagagacugcucucuggaucuuccugcucaguuccucgccucccuucaauauaugguauuuaagguuuuacuuuuuuuugcguuuucaauuguuuuuaauuguauuuauaugugucucugugugugcacaugagcauggguguccuacaaggcuagagacaucagauguccuggagcuagaguuacagaugguugugagccaccugauguaguugcugggaacuggauuuaguuccuguggaagagcagugcaugcucuuaaccacugagcaacuucuccacccccccccccccccccaguauacgguauuuaaaacucuauagcaaugcuacccaacccauuguggagcuggggauggugagguggccuaguuccccccaacuccuggaaacaugucagaaaguacagagugggugccugugggaucagcaugcgggggguggugguggugagguguggggcugcuuucucccgaggcuaccgugauagacaguuguaccuuggcuggcagccucuaccccauuuccaggaugucagucucugcagacguaugggggagguggggaagggguauacagagccuagggugugccugggaauguacucccaggaagugacugguugaaaagucagcagaucuccugggggauagaggggugggcugaagcucuguggguugccucucucagcccugaccugugaacagggaggcuggggguuggaggaacacagcuucccccuguuccuggggggacaugcuggacagccuuuccuagcucccccggcccacugggguguggcuggucgucggacugagcucuuuuggaccuggucucugccugugagcuuugugacucguugagauagcauuugggcugagggauugggagucuucuguucuuugguccugacacccgcuuccuugucuaggccugccaccuggcuccccccaccccccuccccggccuaccaaguuucuugcuucccuuacugaccccuccuccucccuccuuugugucuccucccucuccagagaugcccuguauucaagcucaauauggaacaccagcaacgagcccaggaccgcgugaccaccugaccggugauccccuggcccuugaguucggcaagccuaccauggaccuggccagccccgagacagcaccugccgcaccugcuacacugcccagcuucagcaccuucauggacggguacaccggagaguuugacaccuuccucuaccagcugccggggacgacccagccgugcuccucagcuuguuccucugccuccuccacgucuucuuccucauccucggccaccucccccgcuucggcguccuucaaguuugaggacuuccagguguacggcugcuacccgggcacccugagcggcccauuagaugagacccuauccuccagcggcucugaguacuauggcagucccugcucagcccccucgccaucuacacccaacuuccagccgucccagcuuucucccugggacggcucauuuggccacuucuccccgagccagacuuaugaaggccucugggcauggacagagcaguugccuaaggcuucuucagggccuccgccaccuccaaccuucuucuccuucaguccucccacuggccccagccccagccuggcccagaguucucugaaauuguucccaccaccagccacccaccagcuuggggagggggagagcuauuccaugccagcagcuuuccccggcuuggcacccaccucuccgaaccgugacacuuccggcauucuggacgcacccgugaccuccaccaagucccggagcggggcuucagguggcagcgagggccgcugugcagucuguggugacaaugcuucgugucagcacuaugggguccgcaccugugagggcugcaagggcuucuucaagguauuuuguugguucugggggacgaugauaucauguuggagguggggguggagugggucauccguugggaucuguagugaccucuccugagguuucuucccagcugguucuguccugcaggacaggggacaggugugugccaucuuagaggcugggacuuuuuauucagcagggcacacaucucucuagggcugcagaaagcuggggaagggggcagaagguguguguguguguggccugcaguggugcucagaaacagaaaaccuagugggcagccucugguucuccacagaacuuguguuucuggcacuggaugaaaggacacaggcagaggguuugguucuugcuggggguggacuugggaacaggcuguguguuugucccagugcugggugccugcuuggcuucccccaccuccacccccuuaguccucuccucugcgccaggaaaagggcagguggacacaugcagacaccuguuagaacaggugucuggacggccgugggaguuccuagacccuggucuuggguucugggaucuucccugugagguugaaaccuucuccaguaucucccagacuccucucugcgcucuggcccuccguuucucccuccccuacauccaaauguuaggaaaauagcuaugaacagagggcgcuuuugucugcgucggccacaggaucuggacgguccccuccccugggcucuccaccccccccccaaaccccaugcucugacagccuguuccguguccccccuuccuccagcgcacaguacagaaaagcgccaaguacaucugccuggcaaacaaggauugcccuguggacaagaggcggcggaaccgcugccaguucugccgcuuccagaagugccuggcugugggcauggugaaggaagguggguggcaagauggugcccucggcauaggcgaccugauggggugggacagccgggcucaccaggaucugcaccuaauucccacucccacuucuagauuccagccccuaaaugcagguguagcuuccaccugcuuucuggaaaggguggggugaggagggccuugugggguccccaucauggucugaguucucugucucugacuucucagaagugggguguauagugugcccugaagacccuccuucuccaggucuccuuucucaauacugcccgucucucugcaguuguacggacagacagccuaaaagggcggcggggccggcuaccuucaaaacccaagcagccuccagaugccuccccuaccaaucuucucacuucccucauccgggcacacuuggacuccgggccuagcacugccaaauuggacuauuccaaggugaggucuugcccgcccaucugcccugcccugagaacauaugcaaugccuuugugccuguuaggaaaggcucucccuccagggcaacaucaggaaacaagcauccucuauguacuggcuaguuggagaaaugcauugggauggguguggggucggggagccaguuacaaacagcugccguagcccuguuuuccugugggaauugacaagcacaugggcccagaauagggcucuuuugcacgccuggaucuggugucccagugcaugagagcucuguaaugcagcuuguguaggcuuugcuguggacccaaugcaggacacagcugugugaugcaggccuugcuguggagccagugcgugacacagcuguguggugcaggcccucauguggaacuuaccugcguuccuuucaguuccaggaacuggugcugccccgcuucgggaaggaagaugccggugacgugcaacaauuuuaugacuugcucucugguucccuggacguuauccgaaagugggcagaaaaaaucccuggcuucauugagcuuugcccaggagaccaagaccuguugcuagagucugccuuccuggaacucuucauccuccgccuggcauaccgguaagcugcccaccauccuccuagcccuggccccagcccugcggccccggccugccuggacccugaguccugacuguucucugccuucugccagaucuaaacccggugaggggaagcucaucuucugcucaggccugguacuacaccagcugcagugugcccguggcuuuggugauuggauugacaacauccuggccuucucacggucccugcacagcuuggguguugauguucccgccuuugccugccuguccgcucugguccucaucacuggugaguggcagaaacuagacugggcccaaggguugcaggaccauuggguagguagcaucuaacacuuuggggaccccuagagugccugcaacauugggauguuaggaccugcaaagggacuuagcucuauucgccccuaaagcuuaaaucagccuccgaaugaccccggacuccucagguacgacuguaggcgcugggcaucuagcuuagggauucuguuuguuuaaaaaccuagcugucaaccucacaagacacaggaacgugcacacaugaauuuuucacauucugcgcuuggauagcuaucgccaugguccagaaacaggaccuacuucagcucuguugggcucccuccuuauugucucuguaagagguaaccacucugccagccucaguggcauuccugucauggauuuuacugugcguaucacaggguauggacucuaguguuaaauguagagguuucugggucccuucugcuuccgcucccauuuccacuuaaauuucuuaggggauccuccugaguagaucaagaccaggagcuggaucuugaaaggguagggagugauaucuacacccagcucguccuuagucuguccugcgagacuccaggauuuuagaacaguguggagccuggaccuccagaaaaccuggauuaggcuuuugccuuggccagccauucagugguuucaaauauugaccagucuggacagugggcuccugugggacgugcuagagggcuggggaagcuugucagggagaaggcgucaacugagcggggcugacucuaccuucccugcugcagaucgacacgggcuccaggacccucgucggguggaagagcugcagaaucgcauugcuagcugucugaaggagcacauggcuaccguggcaggagacccacagccggccagcugccugucacgucugcugggcaaacugccugagcuucggacccugugcacucaaggccugcagcgcaucuuuugccucaaguuggaggacuugguacccccuccaccuauuguggacaagaucuuuauggacacauugucuuucugaccccugcccugaacaugugugcgcacacgugcgugcucuucugucacccaugugccuuuaagccuauagcccacggacccccagaccacccuacccccagccugguuuugagcuaagacugacguaccuccucacuccagaagauggacagagaacucaagaccugggggaggguguguauucacgggggugaccccacuauuugucuuaucccuccagcucaguccuggccuucguguguuuuuguaagauaaaccauuuuuaacacauaccacucuguuguaaauaagcugacgcuacuguaaauacagaaaggaagagguugagauggggguugggaggaagggguggggcucccaccagcugggcgagccuccaacucgagaucucuuccgcucuccuuccauguguacauaacugucacucaagaaggugauugacagauucugauuuauauuuguguauuuuccuggauuuauaggaugugacuuuucugauuaauauauuuaauauauugaauaaaaaauagacauguaguugaaauugag

SEQ ID NO: 8019 - RNA, 6678 nt, Mus musculus
caaaacuuccggcccgcgcgccgcucaggcagaggaagcggaggccuggaccggcgucuguagggucuggacucgguccucgucgucugcacugcugucccgagacggcgcgaggucgcgggcagcgauccugacguccgguccggucagaauucucggugcggguccaaauagccuguuuuugcuuuuggucuguccccgaauacugcguguucgcguuagggaagaaggggacccgaggcugaguggcuccugcucggauuucuaccagcaaggugaggcaugggcguguccugggucggauagacuucugccuguugguuagggggaccagagggaaaugcaaauguugucucuguguaaaaauuggcugaggcuggaaggaagggguggguccuggaguaaugcugaaaccaagggaaguugcugguuagagggagaaacaguuggaaaggcaggaccagagcugggaauuucuaggugggaaaaugcagaauggaauuaaacaagaggauaaauaauaacgaguaagggagccgucgcauccuugguccacgagaaaggaacucuuggaagaaccugguauucuggccaggcuauacugaggggauaauaggagccaguuuauagcgacaaauagugucucugcuguaggaauagugagaggcagaaaacacccgguggggacagguaugagagagggagccaggcugauggcagagcaauccacauacuuugcacccagaauggagacaaagcccagcuuuugggaagcugaggcagaacauuugcugccucagucaaggaguuggaggacagccuggauuagaugaaggggugucucagaaauaaaaaacaauccccccccaucuuaaaaacacuaauaaggcagauugaaacacaaggcaaggaggauuccuuugguagaagaaauaguugaacugucuaaagaugagauggcguguguuggaggugaugagaagucaccaggaaaggggcagguagaacacacaucuaggaaaaguaacugcuugcacucccugugggcucgguuuguuacccaaguuccuuccucaccccgccaccucaguggcucuuugcaugguuacccaguagugacaguauaauaacaaauuuagcaccuaacgcuuugugcuugcuaccugacaggcaguuuuaagggguauacacauccaacuuuucagucuuugagacuuuuauuugaagguuauuacuagcucccuuuuuuauggguccuggagauuggaccccucacucgugcaagacaaacgccuuaccacugaacuacuacccucagcuuguacagcuguagggcagagcuaugcauucugguccuggaugccugaaguuugagucauuguuuuuaacuaguagacuguuugacauuaaaauauccuaaaucuuugcugaagucccaauuuauagguagcgaacagguuuacaaaggcugagugguuuuuauaaggucugaaagagucuuaguucuucuguuccuguuguaaaauaccugagauugcaggcgguguugguacacaucuuuaaucccagcaccuggaaggcagagguaagaggaucucugaguugaaggccagccuggucuuuggagggaggucuagggcagccagggcuacacaaagaaaccuugacucuaaaacaaaacaaaagauugaaacucccuacaggaaugaguagcagagccaagcucgcccuguagucccaccugucuaggagggacugggaaagaggucagucuaggaaacagaucuugucugucugucucuuuguaugugugagggggucaugcuuuuaaauacaagugucucuauuuuguccuggagcucacuauguagucuaggcuauucuugaacucccugagauccaccugccucugucuccugagugcuggaauuaaaggugugugccacuacaaccagcucagacuuuuccucuuacaaaugaauaagaagcagaagcacuguuagguaucgacucaggacugcuggacgugagcagaagcaucccgcacugcaucccucacugcccccuguuggacaucugcaugagcgcucccacacugcacaccucacugccccauugcuaguugcacucugcucaucuugcugccuuucugcauuaaauggcccugaugugcguguauuauagguuuuaaagccagccuuuguagcuuucauugguuuguccaaagugguuugugaccucgaaggagucaacaagagcuggcuuucugaugcagagaucugauguugauguuggcacaaggguucuguaacuuuguugcccuugggacagaguccacuugcuuuaaccaggccacuaagguuggagggaaccgacucagacugcucucacugugcuccugccucagggucugccguugugggacccuuccugcaucugcagcuuccugcugccuguugcggcacacugggucuugacucucaccucacuugauacuuggaccaaagaccuugaagcucggccccuugcugaucccaagggucuguggguuucucuuaaaaugugcugccaaaacacaggggggcugguagaggcaggggcagagcccaguugagcaggaaguggacaggaccuucuagaugaucugacuugguucucacagguuggccccuagguggggugaaguauccugugucuugccuuugcuccggcuccagcugccugcaggaugaacugucgaucagaagugcuggaggugucgguggaggggcggcagguggaggaggccaugcuggcggugcugcacacggugcuccugcaccgcagcacgggcaaguuucacuacaagaaggagggcacguacuccauaggcaccgugggcauccaggauguagacugugacuucaucgacuucaccuaugugcgcgucuccucagaggagcuggaccgugccuugcgcaagguuguuggggaauucaagguagguuuguggcccagccaauggcagguggaccuggaauauguaugucuucacccuggcuguguguuaacuggcuugccuuuccaaagagcagaguuaaggcucaaaaggacagauguguugagagcucugugggggagguaggcucugugugucugggagggcacauacauagcuccuuaggaggaagggcgagcuucagcagcgagcucccugaccucccuggcuccauagcuguccgugaugaccucucacuuguuucuuucuuccucacguagucugggcugaaacucuguaagagaggaacgugcuuggcagagugccuucucucugagugaagucccuuugcgcacugugacccaugccuguguacacuuuuguaggcaggaagaaagggguaagggacacagaaggccacuaauguuggucaccucucuggugauagaaauggcauuguggacuuuuaauauauuuguuuggauagugcacagaauaauaguuucauuaugacguguuacacauguaugccauuguaccuugcucuuaucuaucccucucuugaucuuucuccccagugcuucuuucaugucacucguguguccgcauauauuuaaucuggauucuguuguuuuuauuucuuccacauugcccuauucuccacucacugguggugugauuuuuuuuuuuuuaucuuugucuuuuugagacgucuaguuucaaaguauggaagggaaauccuuccccuuucuugucguuuucccugccuucauuccucugucccuugagccugucucuucccaggcacaguggcaggguuuacacagccagguggaugcuguccuaugcucugacauugcgcuccggcaccacugucccugugagcuugggaagggugagguggugagguuucccuagugacucuuuuaagacaugcagugucugucccucugagcuccuggugacaggcaggcauagagaagagggcuuaaagaguaggguccugugggcauggaggcuagccuagucuacauaguuccaacacagagcugcauagugaaacugugucuuaaaaagaaguguguaugggugacuuuuagguacuagagccaucccuccuccucaguaagucugaccuuggcaggugacaucacagaaaugaacuuggggugacaguggugccugccuuaugggaccacaaggccuuagugauugagaugugccuagggguugaauagcgucugcugcuguugcagggcuacagaggaaugccuguacccacccaaagcaucaucccaaacgcugcaauuaaaguugucaccauaccuacauucaauuuuuauaguccaaagucuucggagacucaaguuaaucucuuacuugcaacccccuauaaaauacaaaaaccuguuccauaauuccagcauacagugacacagacuacauuaccauucccacaggaaacacugggccaaagcaggacugaaaacccagcagggcaaauuccugucuggugucagagguuguagauagcuguuugccuuuagaaaaucuacucccccucagugcaagccuaggcaccagcauuaaaagggcuuuuuugcuguagaccuguguaacagugguuacuguaaaccauaugacagagucaguauuaggcuguuuuguaucuccucugucagcaaaauuguuacuuuuaaaucuggccucaggcagacucuugggacaagggucuuugcauaaacaucacaggacuggccuggcccaguugauaauauuguugcccucugaagccucuuggggugguggugaugguggggcaccuccauaguccacauugucuagcaccgcugucuuucaaacaucuacuaggauggcccauugagccccacuugaaguauucaguuacuuuccuaguccaaauuuccugucuuccaccuuuccuaaaacaguauugucagaccugucacaggagguacccacuccugguaccaacuucuaucuuacuuuucucuugcugugauaaaacacuguaaccaaggcaacuaguagaagaauguguuugggcuuauaguuugagaccaucaguuugucaccaucagggugaggaguacaacagcaggcaagcaggcguggugcuggggcaguaguugagugcuuacagcagguugaggcggagagagaacuggggauggcacaaguuuuuuaaaccucaaagcccaccuccucuaaggcuacaccccuuccaaccaggguucaccccuccaauaaggccacauccccugucuauuccaaauaguucucaugagagguaauuaauugguguagaaaaaaacugaaacaggagaccagggacccguggcagugggcacaauagcauccacacauggagaggcucguuuuuugucauugcagcauuuaauguguuccauguuuauaguugagcagggaagccuggcucucgggugcaccuucaagguuauauaaauauccggggugugggagcgucuucugcccuguuuucuggaaaccgaggaaagcuacaggcauccguguuccuucucacauuuguuggcauuccagauuccuuucuugagacauacaacaucagaugguuccauaucugugucacagacuccauauagccucucauaaccuuaauccaaacuucagcaguuccacagcauggccucuggcuauaacacgguacuuacuuacugugugugagagugucccguguggugugugcgugugcaucggccccucagcucacauuugauuucuugcaacaccacuucuuaacagagauggagcugggcaaggagggucaguucgagggaaccauucaggcuggcaguguuugaugucaccaucacaaguccuccucuaggucugucugccauguuuagugggcagggugguuacaggugaaaaugaguucccuggguugugggaaucaggccucagagaaucagaacccucuaaggccauggccugcucaucucucgugucuuccccaggaugcacugaggaacucagguggugauggccugggccagauguccuuggaauucuaucagaagaaaaagucucgauggccuuuuucggaugagugcauccccugggagguguggacugucaaggugcacgugguagccuuggccacagagcaggagcggcagauaugcagggagaaggugggcgagaagcugugcgagaagaucauuaacaucguggaggugaugagccggcaugaguaccugcccaagaugcccacgcagucagagguggacaacguguuugacacgggccugcgggacgugcagcccuaccucuacaagaucuccuuucagaucaccgaggcccugggcaccucagucaccaccaccaugcgcaggcucaucaaagacacccuugcccuguaggucuugcuggagccuuaauggcagcuccuuaaugguucugggagcguguugcugggaucucggggcucuggaaccugcacuagauccuuggugagacuugaagagaagcucgugguguccuuguuuugugguugccagccucuggugacccugucaccuuugcaguggucugguccuggaugcagccuuuccaccugcucuggugggguucaaguucuacacuguacuguacuguaggggugcugaauaaaguugaggugugaguuugucucagcu

SEQ ID NO: 8020 - RNA, 27291 nt, Mus musculus
cucgaucucagcagucagccucuggaucauucuguucagcucauugaucuccucucuggugcggcgcagagucucuccaugccggaucacuguggccuuuaucuccucacacuagggguugggaaagcagagaugcccgugaggcccaggaugugacaucaacccagugagcacaauggaugugcaagaugcacaguggucaggcugggcugccuccucagccuagagcugugugcaaucuucuggugauucuugguaugcaagaagcccuuuccaauagaucccggaguccuucccacugucucaucuaaggacagauguccuggccucucaccuuggugcgguaccaggacucagccucagcacggcugcggcuggcaaugucaucauacugagccuugaucucagccacgacacaguccauguucaggucccggcuguuguccaucuugacgacgauggaggugucugagaugugggaauggaggaugcgggucuccugcaggaggagggagacagcagucaaaaacuucuugaaggcucagccuaaccccacacaucucugccaaccucucagaccugcccugguccacacaggacuucacagucauggaaugacugucuacagacuacuccuuagacuuccaccuggcugcugcccucaccucgucauacauucuccucaggaagucggucuccugggucagugccucugcguuggccuccagaucugacuugcgcagguaggcacaguccacauccugggaaagagggaggugugagcccguuuucauccaucccacacagcacagggagauggaucccagugauuguaugugcaaaucgucucugcuucccuucccagcaugcacuuggcagcucuuuucuguggagacucucaugcuugguggcacuccacacacugccucagggccaccagacuuuccaggcaauuugcccuuugucacaggccugacaugacauucaucauggugcuucucagggaauucccaauccuccauggauaaguucacagcaucccugauauuaacaguguuucucuccgagcacagugugccccugggggaugggggagauccacauuccucugccaccugcuacucaccuucuucagagccacaaacucauucucggccguggcucucagagaaacuuccuccucguaucugaagagaggagaggucaggcagugaggguuuagucucugacccccauuuccacagcagagagagcagggaggauccuuagcgcugauccuuccagccccgugaaggacuuucugguuggaucuagaguuaucuagggaucucugucuguuuuaguuuaggguguagggcucaugggaaacuugugagcauucugcuugaaggucacuucaggagaggaauggaggcucagccucagugucuugugggaagugacaucauauauucuuggccauguagaccuagcuuuccaucacuuaccccucucaucccagcugcugaaagaccuagagacggaaggacugggcaccuaggucuguggacuuucuggggcuggguccugccucuccuaauaacuuaggcuguaucaacuugguugccacaguucauaggacaaaggacaaguggagcaggcagauugcccuagagugucuuccccuagaagagagccggccaagcggcuagauugucuccagcugagcuagacagagccuaaucacagacagggccccuucaggugucugccuacacagaaaucucauagguggcaggcaggaucuggcaaugcccuccucauacacuuuccuggaaacagucuuacuuccugugccuugagcuuccagcuaagcaaaauccugagccagcgccucacccagagcccucaccucuucuuguagcccuccauggacuccugugcaugguugagcucagcagccagccucccgcugucggccuccacacacucagcuucccgccucagcgccucgauguagcccucgaacagaggcuccauguugcucucacagcacuugcgguucugguagaacugccacuuggucuccagcagcuuguucugcugcuccaggaagcgcaccugccaugggagacagaagggguucagggcagaucugggcugaugguggagaggaaguagaggggcucugggaaggagcccuuaucuugguccugccugacuuucccacugggagagggcacaagggacauggucagugccuacacucaggaguccagguggacacuucauuguccuaugcugggcucagcgaucucugaagccaacaagucaggaguccccacaagcagagcacccauagucacaucccagggacugacaaagagccagggagauggugucacaggccauuuagaugcacucacuaggaaggccucugucuaucccuccaguagucugcacccuuccugucagcccaagugcagccucccuccuuggguugccccagcuccaugcugcagccccugggacucccuguagucaguuuguacccaggacagccuggccacugccucucaggacucacaggugagccuugugcauccucucucuugagacuagaggcucaguaugagugggcuuucugccuccuguuucacucagugcccggccuuggcugugacaugcaugcucugcuggucuaggacaccgaccuugucgaugaaggcugcgaacuugcuguugagacacuugaucugcuccuucuccucaugcuucacacacugagcauuggggucgaucuccagguucaggggcgugagcaggcucucauugacagaaacgguggugaugcagggugggcugggcccgcagaugccuccagagcgguacccgaagcugcguccacaggagccagagcggaaggccccacagacacucuggcugccgaagcccccugagaguccgcgguagcaggagaugccccuguagggagcugcagagaugcagcagcggccgggccuggguccgcaggcugaggcgcagcugaaggcgcggccacagaauccugauccacaggucauggugcuucugaagaugggcugaagcguucuggaugggagcuccguaguccugguggcagcuccaaugugcuaguccaggcaccgggguccuauuuauggcagcuucauagggguuuggcuaagaaggugguugaggcaauuggacuuuaugggcuugggcgguuagccuuguccaagccucucuagaaugugcuuuaaugguggaguggcccgcacccuccucuuuguaaggcgugccagcaggugccuggggcgcucagcaggugccugaggcgcucagcaugcugcaucuucaaagugccugagguugggcaugcgcacucugaggcuucagcuucggggagggcaggaaggugccacgcauagaggggagcugggaauugggugccaaugcaguugugucuucaguguguggggaggacgguacccaagcaagacuggguaaucaaccccaaucgguggcguuggcuuugguccaggaccuuaucucugucaaagcagagcgggaucuugucccucgcugcuguuccuucugacuucugagcauugcuuuucccaacauggcagcaccuaguauagggcuaaguauucgucucuucaguccucuacaaucugacugguguuuacagaauguguggcauauagucuuuagguacuucaacaccauacuccccccuacucccacccccuacccccgcaaugaaacucggggucuugaguggacuagcaaggacucuggcccugagcaauaccguaccuccuucaacauacauuucuuaaaaauacagguaguauauauacauauacaucauauacauauacauauacauauacauauacauauacauauacauauacauauacauauacauauacauauacauauacauuacacauacacauacacauacacauacacauacacauacacauauacauauacauauacauggaaaucaacagcaaaaccagaacagcacuuccaauccauuccauagucuauuuccucagcugucugaggauuguuuuaaaguagguuuucaccguuuaccuugcuacaccuguccugaagcccucugugugggaggucagagcuuuagacuguucuccauggaacaucauugguauguguggcagcuaaaguuucagucaguugacucucuggcucucugguuuugcuguggacguuuaagaccucacuaccuacuugugaacggugccuauuuauugcccagcacauaugagauacagcuaccgcuugacacaauucuuugagaugguuuggggcuagaggcuuggcucauuuccagucaacauuuggggcaggauaauugauaauaugguuugggcacuucuuccuguaccagaucaggggagauaacauguuagauuguggcucugaaguuggauugcuugagaacacuucucccuuuacaaggagcgagggcucuguagggaacauacaccuuacuuugacaagagugcuuuccuuugcaugggcuaucuacugggugcucaucguggguuaccuacugugugcucaucaugggcuaccuacugugugcucaucaugggcugccuacugugugcucaucaugggcuaccuacuguuuacucaucaauauaagcaagaaacaaucucuaguucauacuccagcuguuugagggaugcacuauuucucuuguuuuuacagaagaggaaauggaggcucagacaggcugaauaauuuuucucaaagucuccuaguugucauguggugaauauggaaggugcuaauccuuuguacccacaaacaugaggacuaccuccccacuuccuagucucugagaaaguuccagaggauagagaaugcuggcuggggugaauaucccugaauguagacaguggaaggcaggaagauggcagagcuagugauuggaacagguugaaugggaggggcuaguggugugugugugugcucucaggcauauauggggauggcaucagcugagaggugcuuggugaggcccuaaaaggcaccaguuuuagcuaccugcauccucuuuaguuuugguucaucaaugugcccuaguuguucaucagucauuucuacuccaauagagcauccuacaaaaaccacuugggaaggcacaguggauagaacagcggcguggaagucccugggagcccaggcaagcagaaagaucuuagggaggagcaaggggugggcuuggugaaaggguaggaaaggaagaaacuucagggugaagcucuggcuuccgcauucagagauugagaggacagauguggagucacaggcugugucggucaucuggucacccagauggguguggcaccugcugccacuucauguuuucagaaagcugggccaaaguguuggaagcucuuugaaaccauucuaggcacugcccacaacaguguccccagcuacuggcuggccagaugucccuggaacauuugcugagucaagcaacaccuaacagauggccuuuccugccaagggaacucccaucaaaacaggccacagaaucaugagcccaucacuaaugccuagcucuugcuaagcagguuucaagccccaagaagcaauuuagaaugagaaacaaagacacucacaugugacaccauuucauuggacuucagggucuauuauucacugcgaaauuuugaacacucagcagggcauuuagucgguuugcuuccagggaaaugcugaaaacuggagugggaaggcaagaaaggaguuagagagugggggaaggggguacaagaggucgguugaaccacaccauucuaacaucauggcucuaacaguguagagucaauacauuguagcuacagaaguuaaaaucauguuuauugagaaauacaacaacagacaggagaauuuauagcugguaugacauaacacuauaguaaggaauaaaacacaugaacaggaguccuuaagagcuucuacgcacuggaauguucucacuaauaaguggauacuagccaaaaaaguacagaauacccaggauaaaauccacagaacucaaaaugguuaacaagccaaagggcccaacugaggaugccucaaucccacuugggaggaagaagaaagcaaucacuguggggcagagagaaggagggaucugggcaaaauagggaauagggaggggaaaaagggaacaugaucagguauuggcaguggugguggugguggagggcaggagugaagccccaagggccagaagaaagaaugaaaauaggcaacuucaggagguaggaagugggggagggcggauccucuagaauguaccagagaccugggaggugagagacucucaggacucaaagggcuggaccuuagaugaaaugcccaacagugaggagagggaacuuauagagcccaccuccaguagaaagacagggcaucaaguggagggaugggguugccaucucacagucaaagacucuaacccagaauuguuccugucuaaaagaacugcagggacagaaauggagaagagauugagggaaaggagguccagugccaagcccaaagugggauucagcucgagggaaggcuucaaggccugacacuauugaugcuauguugugcuuacagacaggagccuagcauggcugcccucugagaggccuaacaagcagccgaaugagucagaagcagauacuuacacccaaccaauggacagaagcagaggaccgcugugguugauuagggaaaggcuggaagaaguugaggaggagggugacccuauagaaagaccagcagucucaacuaaccugaaccccugagaucucucagacaccgagccaccaaccaggcagcauacaccagcuaauacgagcccccugacacauauucagcauauauauauauauauauauauauauauauauauauauauauauauauauauauauauaugguuuggccucagugugagaugccccuaacccucaagagacuugagguuccaggaaguggggaggucuggugggguggaggguguguggggacauccucuuggagacaggggaggaggaaugagaugaggaauuguuggaggguagagcgggaggggauaacaauugaacuguaaaacaagauuaaagauaauaauaaauuuaaaaaagcucuuauguaucaugauucuucagagaucguaccuuccucuggccuaggugauacagaacuuagaucuuauaauuauuuauuccucuuuuauuuuuaguuuuagaaccauugguucugaagccaguggcauaucuguccacuuuccagguuuuuaauucuacacagauggacucacgucacaggucuucuuucaugucuggcuucuguucugugaugcuuucugauguuuucauucacgguguacucauuguacccagggaaucagucccuucucugcucagcuaggcucauggucuaguccauauguggaagggaggacauggggacaucucuccccagcuguaguugugugcagugguuacaggguguauuuuguacucccucaguuuuaaaaagaaucucucuggaugccaggcagccucauuucacacaaaguaccauuccaacagagcaauagacauggacuaugcacaugugcgugugugugugugugugugugugugugugugugugugcgcgcgcgcaugcgugcaugcgcucacucaaugugugaguggaggucagagcaagcacccuaugggaaucaguucucuccucccaccauccaaauccuggggacugaacucaggucgucugccuuugcagccagcacucuuacccacugggaaaucuugcuggccuuuguauaauucauucacuaaaaauuuuauauuaaugugugugaguguuuuaccugcacauaugucugugcacccuguucauggcugguacccauggaggucagaagagggugucagaguccuuggaacaagaguuguggagaacugugaugcugaguccucugcaaggacaauaaguguucuugucgugugagcacuugcaccagcagccccgccccgugcaagggagggaagauaccugcucagggugagaaucagguaacacaagguuuggugcaccagacccugguggaagggaugagcuuggcucuuugcauucccaucugcccaccaucgacugcacacuguagagguguuugcaugaagccccuaacacacaagcuugcuuuguccucaacacccucuuuaagguuuucuuugcacagugcucccaggguuccaggcuggaggaugggggagaacucaucuuugcucuuggugagcuucuagcuuuaagagcaaagcugggcacacacacacacaccgaucacaaacagagagacauauccuaaaacacuacuacauacaaaaauuuuguuuguggacacauuccaaaagcuuggcacauaguaggugcucaauaaaugucugcugaaugaaugcagugaguacaagcuacacauuaaguuuugaguaaucggaucaucaaagcuugguggccaguuguacaaagcuuuguggucagaugggguggggucacacgaagcagaccaggaaguggccauuucuagggguggggugggaagagugaugcugcuugcugaggccggaagaugaaguaagagaaauguauucugaccaaagagagcuggccaguguggcaaggaugaaggaggccugauuccagcgccugggcucugcugaaggaugaaggaggucugcuuccagagucuuagccucugcugcauagcagucucucucugugucugugucugugucugugucugugucugugucugugucugugucugugucugugucugugucugugucugugucugugucugugugucugugucugugucugugucugugucugugucugugucugugucugugucugugucugugucugugucugugucugugugucugugucugugucugugucugugucugugucugugucugugucugugucugugucugugucugugugucugugucugugucugucucucugucugucaaucugugugucucugugugugugugugucugucugucucucuuugaucauagaauuucaugauccuucuuucaaggacccuuagccuuacugggcugcuauccuugguucugucucccuacuaaguccucucugaguccuccugcuuccgccugugaaagcccauccucgcccuucccagagagccucccuugcccuuccuggaagggcaaugcagucaggcauuccucugcaccugacaugucuacaaaguacccucugcauauucugacuuuccucaucuccgugucuauuuuccuugacaugagagagccccagaguccugguuuccuucuuccauguagucucuccuuucaagggaacacguguuuggaguuuaccuuacaugucauaucgaucccagaguccccagaugucccauuugcaagguauaucuuaucuuugcuacccacccaauucuuuccccagaagaggaagagacugaaaugagcuuugaguaaagauuucaugagaugaaaacggucuuaucugcagucaccacaagacccacuuguccacauaggcuggaggaagauacugcucucuaggucagaccacuuuggcccacugucuccacauacaagguggcccuuccagaagaguuuucuuuuauacaaagcuucuugaaacaaaagaauuaaugucucuucugucagugguauggcuauuggcucuuccccuaggagguuccuucucaaccccuccagccagccaacgaggucuggccuacucucaaaggaagcaagagcuuccuuugcacuucuauuguguuaggaaagauuaccaagagcaucccccaacagucucaugggauaucuggauaccaccagccaggaggcuuggggauuagaagaaauauaaaacaaaacaaaacaaaaaaaccaaaaugaaacaaaacaacaacaagacauugcuuaauuuaugaccaaggcuuucuuuuuucaaaauaauacuuuauuuuucugagauaauguaguuauaucguuucccuuuccuuucuucucuccaaacucucccaugcacaccuugucaccuucaaauucaugucucuuuuucuuuaauuuuuguuacacauagauguguauauauacauacauauacauucuuaaauacauaaauaagaucuguucauaucauauguuacuuguaugcauguugucagggcugaccauuugacauugggccauccauugcugguccuuccaaucucucucugguuuccuaaguugccuuuaauuuguuugucaaggguugaggccuugugggauuuccucuguauccauucacaugucuacugugccaucuuucagcuccuguuuagccaucuguguuggcgagacuucaugcagcgucugacauuucuaggaggcacagucucucaacaaauuuccuagucuucugacucuuucaaaucuuucucccccccccccaccucccacaagauccuugagccuuacggacagagguuguugcagugagucaguuggaacuggggauccauaacucugcauuuugguugguugugugggcaaaggauuucugauucucuucuaagaccaagugaaaaacacaaaucugaacgauuuuccaauggaugacguuuggaucuucugagcuuuccuuucuguuagagucgcugcuuaaggauuggucaagaugaagguuugugaggacaucuuuccuuaggcuguuggacuggacuggggaggagauggacaugagggucuuuccuagaguaaaggccaugguccuuucuucuccugggacaggcccauucaguagaauaaugguguucccaauaauaauuggauacuuucuaugggccagaugcuguguuaaguaugaccuguguauuauuuuaugaacuccuacuacucuuucaagauaugcccauuacugguaauugaacauaaggguuuggggaugugagugagugcaccccaccaaagcugucaacauauccccaacagcaacugcacaacaacaaacccacgucuguuugugcccuuggaguggaucaggcucaggcccaaguacuuagugaagauuaauucuuuaauccucacaacaacauuaugagauggguauuauccucaucuuacaagucauaauggaggcucagagacgcuaaguagcugccuggaguuaucugguaagguagcgugguggagccuggauuuaaaacuagguacuuuggaaucugacucuguguccucaacugguauaacguguauuuccacuuuucaaaaauugcagcuccagaaggaauaauuguauguaaugacacaauaaacaccaggcauacauggcugacccagagggucagggcacagucgugacauaagcaaaacaaugauguguucuguucugcucuggcuggcuuuguucuagacuguucugugacugaaaaugaugguucuccccauuggagggaaacaacaugaacucuugagaaaacacugcucagagcggcugaaaaggauuggggcacagccuaucgcaccgugcucuggaguuuacagagccuguacguaccccuucagacuuccaagacaggcaggggaggugaagccucugccagacuucagcauagugaagcaccugcuucagggucagagguagucagggcugcgccucuggccuacccagcucuuguuuguucaaggcccaugcuggauggguaacgcuagaugcuacaguuaugucuuaaugaccaucaaagccacuggcaagcugauguuacaaagugggagggucauuggggaagguuaggggguucaugguaugagaaggagagguguucauagugcagcaaguaucagaggcucgacugacaguuggagacuucaugaucuuuucaugucaccuacuggauuuuacauacugagucaaauacuguguagauacccacagcaaggucaccccacggaugacauaagaaccugaggugaaaugaagaccuuagauacucagcaauguugggauuuucuggggccagugagccagagagcacuuaggccucagggaagauggaaggaagacauucccuugguccuagauagccaagauggacuagguauuguuuguguccacagaugugugugugucaaacagagacauguagccuauuaguucguggaaauuguguguaagaaagggaaggauaaggaucagugggcuugagagauggaggagguagaaggugacuaacuuaacuguuauccagauauggagcuuuaaggggcacggagaagaacuaugcaaguggggcaucucaccuaacacaccaccaguuccaugccacccgcaucccuagcugggcugugucaggaccucggacagcggugccgccauuuuuuuucagucccugauuggaacaacagcuccgccccuuuucauuuuccuuguagcaugagucaccuacacugucucuccagcuucguuucuguguguugggcacaggagcagggcauggagggggugagcuggcccuuugaaggaggaaauugaacaguuuagggcaaaggaccacaaacaccagcaaauggucaccaauuuagcacauuuaaggaggagccacagcaacuaaacaagccaagcucauaaagccaucuaauugcuucagaccacguggucacagucaggguccccacauauauaaaaggccaacaaaccuaaagagguaaacacugaauucacguccacuuuacccuccaccuggacgucuccaguuucagaguugcccuucucccuaaauaaccaugacuugcggauccuacugugguggccgugccuucagcugcgccucagccugugggcccaggcccggccgcugcugcaucucugcagcucccuacaggggcaucuccugcuaccgaggacucucagggggcuucggcagccagagugucuguggggccuuccgcucuggcuccuguggacgcagcuucggguaccgcucuggaggcaucugcgggcccagcccacccugcaucaccacagucucugucaaugagagccugcucacaccccugaaccuggagaucgaccccaaugcucagugugugaagcaugaggagaaggagcagaucaagugucucaacagcaaguucgcggccuucaucgacaaggucgguguccuggaccagccccuucccggagcacagcaugucacagccaaggccaggcacugagggaacaggaggcagaaagcccacucauauugagccucuagucucaagagagaggaugcacagggcucaccugugaguccugagaggcagagcuuauggccaagagaaguggccaggcuguccuggguacaaacugacuacagggagucccaggggcugcagcauggagcuggggcaacccaaggagggaggcugcacuugggcugacaggaagggugcagacuacuggagggauggacagaggccuuccuagugagugcaucuaaauggccugugacaccaucucccuggcuccuugucagucccugggaugugacuaugggugcucugcuuguggggacuccugacuuguuggcuucagagaucgcugagcccagcauaggacaaugaaguguccaccuggacuccugaguguaggcacugaccaugucccuugugcccucucccagugggaaagucaggcaggaccaagauaagggcuccuucccagagucccucuacuuccucuccaccaucagcccagaucugcccugaaccccuucugucucccauggcaggugcgcuuccuggagcagcagaacaagcugcuggagaccaaguggcaguucuaccagaaccgcaagugcugugagagcaacauggagccucuguucgagggcuacaucgaggcgcugaggcgggaggcugaguguguggaggccgacagcgggaggcuggcagccgagcucaaccaugcgcaggaguccauggagggcuacaagaagaggugagaauggccugcuguggugcugguauaaaaugugccguauauuaaagcccagguuguggaaguguagccaggcugacaucauuguaggauccugcugucugugaaauaucugcacagauguuccuuggagaggaugggggagcgucaauuucugccucaguguucccucugcagagugcgacuaacagcucugccuucucuggggaggauagacacagcccccacuccagcuccuucucacuuugaucuucugcacuguaaucccugaacagauucugcucaggaaaguaggagggucaugagccaagcugucugucucacugccuuggguacucagcccugaaaucugggucuguugaugggucuguucagcagcugggcugggacugacauaaauggggggaggcuggagccgcaguacccaaccccaugauguucccucccagaugagguugguaucaaaucauccucuccuuccuggguugucuucggaacagcacugguucucuucuagcuuucacccacucccagauagcccagguuccuccagaaagaccuaucaggaccaagagcucugagggcucuuucccugaguucccugcaugggguguggauuucaaccacccauaucauguccccuauuucuguccuagguacgaggaggaaguuucucugagagcuacagcugagaaugaguuuguggcucugaagaaggcaaguagcagacggugggagguggaacaacacaauugagggacacacuguacuuguggucacccuucaugaauuuuuaucuucacacaucaaaauaggaaaaaaucucagagagaugacccaaugaaugucagacccagggcuaugacaaagggcuguugugagggcaacagccauuuggaagguuggcaucuagagagucaguaguccaaacccauggagacaugaauacguuuggaaugucuuuuggauccuucugcucugaugcaggaccuuggauguauuagccuugaugugccuuucccucaucaugggguguaugguugggauuccaggagccacagggcuucauucuguucauugaaaguggugugguuuacauccauucuacuagucugaucagaauguuagggcucaagacaguguguaaggguugagaggauugcuaggaguguccaguugaccucuugaagcacugcuggaucaauuggaagaucugggggacaacugggaagcuuuuuagaacagaacagaaccaaagagcaagaagagggaagaugucuuggaggcugagagccagagagucuccaaaccuguggaacugucaagagcaugcugggaaguggggacagagaugacuugcacacaggggucuuucucugcugugcuucugggacagaugaagagagagaagaguuuaggacacgaugaggcucacaccucccucuuucccaggauguggacugugccuaccugcgcaagucagaccuggaggccaacgcagaggcacugacccaggagaccgacuuccugaggagaauguaugacgagguaaaggcagcagccagguagaaguacaucgaguagucuguagacagucauuccgugacugugaagucuuguguggaccaggggaggacugggagguuggcagaagugugugggguuaggcugagccuucaagaaguuuuuaucugcugucuccuuccuccuguaggagacccgcauccuccauucccacaucucagacaccuccaucgucgucaagauggacaacagccgggaccugaacauggacugugucguggcugagaucaaggcucaguaugaugacauugccagccgcagccgugcugaggcugaguccugguaccgcaccaaggugagaggucaggacaucuguccuuagaugagacagugggaaggacucuggaaucuauuggaaagggcuucuugcacaccaagaaucacaagaagauugcacacagcucuaggcugaggaggcagcccagccugaccacugugcaucuugcacauccauugugcucacugggucgaugucacauccugggccucauggacaucucugcuuccccaaccccuagugugaggagauaaaggccacagugauccggcauggagagacucugcgccgcaccagagaggagaucaaugagcugaacagaaugauccagaggcugacugcugagaucgagaaugccaagugccagguauguaagguucagcugcucugggaccagagaggcuggaugucuacucagugccacacagccagcauguguccugcuuggagcuuaccauuuagucuccuaccauuuguacagcuggguuuccugauuaugcucacucaggcugacccaagugaacaaggcaagagguugcuucuagaauguucccgacuguugggaaagauuggauagcaagcuggugacagaccaugagacccagggacccuuggcuaucucaauuucuuuuguguucccagaacaccaagcuggaggcugccgugacccaaucugagcagcagggagaggcugcccuugcugaugcccgcugcaagcuggcugagcuggagggugcccugcagaaggccaagcaggacauggccugccugcucaaggaguaccaggaggugaugaacuccaagcuggggcuggacguugagaucaccaccuacaggcgccugcuggagggcgaggagcagagguggguccuguagcuuuucacuuuuccaacccuucuuggguccucagcauugagccccacaccuuggguaaccuguucaucuucgcuuccucacuucauggucccgcacguggauaggaaaucuguguaaguccuuuaaccuucaucuaaccuuuacccuugauguaaccuuugaccuaacuccaucucucucacuccugcuggccucgcucuaaggcugccuacguggagauacuggguuuuguccucucaaggucuagcugguacucauacuuaggcuccacccuccucuuugccccauggaggccuguguucucaggaguccaucuuuuggucuaagcugucccuggccaggucuacuccaaccuuggaaauucagauuuaucucauaauaguaccuucuggcagcagaguccaccauccccuguuuagcuauuaugauggucaauaaugagugcccuaaaguacccucccauugcaguuuggacugaucuagaggacagcagagacuaauucucucuuggaacuuuguuuuuccuauucagacuuggguacuacuagaggacccucuugcuguucaagcuucuugugguggaggguuccucacaccccaagucuucaaggacuccacuuuaaaccaagcucuuguuauuguacuuucuguuucauguucagcugcuugguuguguucugaaccucuuuuugugcauagccagcuuccaggguggcacacagguagagaaucauauguacuggggacauggggauacagacuuggcaugugaucacacugagggauccuaggacaacaaaaucgcuugagaagccuggagguaccuggugaugguaucugagaaucugaaaguuggagacagacagacagacagacacacacacacacacacacacacacacacacacacacacagagagagagagagagagagagagagagagagagaaagagagagagagauaucucccugaaaaagaaccccaguguguccaccacauagaaggagagaggcagaggaccacaguaucuguugaguuugucagucucagucuuuguguguucuggccaagucuguuugguucccuucuggaaaauaauaccaaguggagaagaaauacaggucaggaaguguuggagucuuaacccugaaccgucauuggccauuucccccgugggugcccaacaggaggacuguuauagguaucuuccaaugagaggacugcuguagguaguuucccaucugccucuaaaguucuaagcucucaucucuccaucugggaucauugaugaagacauuugcugucuucagacacaggggcaaaauguucugauuucccuuagacccauauuguuacaaugaugggguuuacaagauuacaccuaauucccucgaauggacuuacagcucaaaaccaacagggcagcagcagccagugcuucagcacgugugucuaggaugucuuagucuccaguagagcccuuggauuauucugggaggagaccuagaacccacuagggugcacagugaauaagcauggugugauagaggucaugcccugccuucagaacucaccugguuccccccccccaaagguuacccccagcuccgggguucucaguuuuuccccugcacccuuucccuagggcgagagccuagaaggauccaugauggcuccuguaacaugcuuucgguuuacuaaagucucccuuuccucucccacagguugugugagggcguuggcuccgugaauguguguaaguaauuccagccucccccuuuccugcgggguggugcgcgccuuuggggcgggaacacuugagcuugcugcggagacucuuggcaauggccgugccugacaagguuuccccuguucuccgggcuuucaggugugagcagcucccgcgguggcgucgucuguggcgaucucugcgucucugguacugccccugcugucaacacaagagugugcagcgcccccugcagcggaaacgugguggugggcacccccaaugccugcgcccccugcgccggggcaggcgccugcagcggaggcuguaagaagugcuaggaggucacaaugcugcaagccacuggcacgggcuacccugcccgaagggacagcacagcgggacaguggccucggcgccuuuauuucaaucuguagcuuucccuagcaacuuguuccuagaguucuugcuuucuuucccuuucugccuuuuugcuggauucauuggucuuaggaucuuggaggauccgcugccccaggauccucuuugucugacuuuacccggguccuuagcacgcuuuugccugggcaaggagacauggauccacaugguugccugcuuuccugacacuccgcuagaaaccacgugacccagagcaucuucuuccgggucugccuggcagcagcucccccaaacgaggggcucagcugccuguuccuugggcuuugucucucuuugcguucccaauaaacuaauugcagcaaaucaaacucgcgcccucagucucuccaaagugcugccuaugccaagugcuucagccagagucucaggacuccaacguucaccuggguguuuucaauaggcaaagauaccuccuaucugaucuggagaaaucaggcuuuugggacaacaaagccaaacuccaggcagagucuugugggguggucgguauucuaacugagguguucugucucagcacuguaggcugggugacucucccugagcucuaucaggacauuuuaccuuguagcacccuuggccuccucacuagaugccggagguuuccucugccccucauuaugauaagcaaagacauuucuagacaaggugaaaugucacccagggauucucagauagucauuuugcuccccuucuucaaagggcauuucuggggugcagggaggaagggacucagaauggcagagguagggaagagagggauucuggguaggucagggucaggagaccuggcuacugauucagaguggcgauguguggauaaauacuauguugcuucucugcuggcgagugaggagaggugcacuuaaucccuagugcugcucccagccgucccaggagauaggauagaggcuuuguuccuagaggcacuauuggaauagcagucugucugucugucugucugucuaucuccaguacugcagcaggcaggucucucuuccucacuggacuucaucugugaaaugggacaaugguacuuacauuguggggaugaguguuagcuaaugaugagagguaaugaaucucuacagaggggugucauuuuuuuuaauguaaaauaaucacaauuuuucccagugccgaggaccaaauccaagucucugcacaugcuagacaaaugcugccccgcugaguuaugccagggaggcuucgaacacaaguuccugacuccuccugcuucuuccugauucuguguguguguguguguguguguguguguguguguagcucuuucccuuggcaucuuuuuggguacugugaugauggagagguucucagagccuuccuugccaagucugguccugcugcuggcugcccgcugggagcugagguggagguugucugguggacuauaccagccaggcucgaauuauaauaaucugagcagacagaauuaucacaagugguuaugaacugcagugagggcuggaggaaggagaggagguugacaagagguaagacgguaaacucaggagcugaggugauaggagaggcuugggcuggccuggugcucuggugacccuuguccuucacuucacuggacugagggugaccuagggugucugugaagcacaucucugguugugucugugaagggguuuccagagauaauuuacuaagggggagaagaccuacucugaacaugggguacuguccccaaucuagaggacuggauaugacaggggagagaagaggaagucaguccgguggagacucuccccucuccuuaaggucacagcuucaacauggcuucccuccaucucuggcuugcauccuccuucccagauuccuuuuuuuccagaccuaaggcccagggcucuuuguagagcccuuugccuguuuccuccaaacucaaacgcuccuccaaaaaggagaagggaggcccacaagacucaggaagacaguggagagccaggcucagaggacccccagauucacaggccuugcccaaggcuauaaagguggaacugacagggagcuccaggauuguguguguguguuugugugcaugugugcaugugugugacugcccaggcugccuuugcucuacccacacuccuguacacauggaccugugcaagcaugucgacuccucagguacaugggcuuucuuagaaacacagcuuuuugcuguuguagguguuuuucaccacuacuuuaucugggugacuauucgggcauuugcucacaucucuccagucacacagcacgugacuauggagcuggggaugugggccuagagaccaucacuggagucucuaauacuugaggcuacagugucaaccuuggauaaguggaaggaagguugcucccuggugugcucugugucuuucuggggugcccugugugacacugugaugagccuccugagguugccugcccuuaaggucuccuccucaaguccuugggaagaauuaucaauguccaagagcagcuucuaagaagggaagaaccgcaaggccccacccccugcggggcuucugucccugcauuugcugaguaaugagaacaucugaggcccaguaggggagcaagcaaaggggacuggaagaucugaaaugcacugaguggugaaucagggccacgguauggccuaguauacucuuuuagagagccugaggucgccuugggggaggagggagcacuggaagaagggacuguguucuguggaggccucugacugcugugugguaugagcaagcuucauccugcucugaguuguguaaaucaguggcuuccaaaaggagcuucgugcugguugauuccuuuuuacacagugggauuuggcuucaucugaaugcaaagaacaaggcaggcuuaucaacacuuugcaucuccuguguaugugaagccaccauuaacugucuuacacugaccucgaggugcauacuuaacucauucauguaggcugaaagcaucacccgugagcuuaucagggucuaugaggaacacaugggcacaggagcagauuaaaacuauaucagaaaacccggacuacgaauuuauucaacacaccaagaacagugaagguuguucuguccaugcagaccugaccuugggucucaucugacuggacggcuggcagguaggguugucaaugguguacuuucugccuuccuaagagcccacagcgaccuguguuugugucaucucuuugccuccuguaagucuuuuaugaacucugcugccuccuuaacuccucugcaaccacucugucacacaugcauuguggugugaauguguuguguuaucugaggaguaauguuaguguccauuaucagaauauaaaggaccugaagcuggggggguuggugguacauacacauaauccaaucauccagaaacaggggcaggagaaccaggaguucaaggucaauuuuggcuacauagugaguuggagaccagucuagaugagaugagacccugucucaaaaaaucagccaacuaaccaaccgauuaugauugccaguggccacacuauuuaggaaaaucagaauuacuagauaaauuacagucaagaauacugguauaguuaauuaauuuauuauucuucaauaaauccugaacuuguugaaagacacaaacauuuguucuaugguuuuguggcaggagggagagaaggaaguacauuagaaaacuguuuggaaagaaggaggacaauccugguggcugaaucagagggcauccuaggcaagcagggaugcuggcuucuguucuggccaggacuguggcuucaaagggugcugcuuuuugcaaaguagagaggaggaaggugggaagagggucaggaagacgccaggagaggcaagguucaagggucaaggcugugggacgggaucaggggucagcaugggaccugcugcugagguccagugagccuggccucaggcuucaucagucaggaccucaaguggaagcuaagguggagacugcugugguguccaggcucagggugugaagguagaagagcccugaaugcucaaguguggauucagggugagggcuaugagccaaugauugaugccugcuggaguaaugagagccuguaagucaggagaugugaaacuuaagagccaaggaguggaggagggagagagacagggagcuuggucugggucccagaggaccuaaggccuaaagagugaaggggcgggguguuuuucaagaguguguggguggguggggaaggagccaggggcugaggaaggggagaagcagggagaguagcagugguugaugacuggggauggaggacacugaaagucuguuuccuccagccuagggucagagcuuuucugggucuucuaugcuggaguauccagggaccagugaggucaauucaagaggaacggagugaccaucuuagugugggggaugggugcugggaccaaggcgccgagcuggcaauggcaaugaggaaugggguccagagcaacacaaaguggcccuggggugugugugguguuagggugcaaggagcauauaugugggagaaggaaguaggguguggauggaagagggcuagggacagaaagacagacuggcaggcagacagacagacagguggacaggcagacaggcaggcaggcaagccaacagacagagacagacauguaggcagacagacaaacagacaggcagauagacagauagauaggcaggcagagagccagccagacauucacaaauaggcagacagacaggcagacaggcaggaaggcaggcagucaguucagagagucagccagacauucacaaauaggcaggcaggcagacagacacagauagacacagcuagccagcuagccagacauuaacaggcacaggcaggcagguagacagacuguuaggcaggccggcaggcaggugaacaggcaagcaggcaggcagucacacagauagacagaugacaagcaagcaggcacacacagacacagacacagacagauggacacaccacacacacacacacaacucugccuuucagcagagccuaugggcucugguuuccuucagggcgaguuggaggaaggaagccuaucugucucacuguacgaaccacagggauugauugaggggucuacugggagugaacacaggauguguguuuggggaaaacagguaucaggggucacaucucucuuuaauuggugggcaacacugggucacauccccaaagucacauggucuagugggugugacauaggcaaaccugugcuuugagcucugcuugguaagaaugggaaggcaauucuguuugggagccgagccugcagauaccuaccauaaagacaggccccaguggcuccagucaucaggcccuaucaccaagccaauguccccuaggugacauuaugaacccaccacaagaaagcacaacaccuuacacaacucugagagucagcacaguuuauugcacaacagggccuagaggccagaggcacaggaaacagcacuggguauucccagggcugcagcugaggcaggaggcugaucuaucagcagcaagccccuugccagcagguagcugaauggaguggcagcugcuggggauggggaauguauucucagaacacaagggcagcagaccuugaagcuaccaugcuuagccuuguaguccaggccacuuccuggcucccucuugucuccuaacaccuccccgggugacaagggccgcuuccacagggcgcacacaggccagugcuuacugccacauucccgcugcauggggcacugcagacacugccugucacaggccgugagccagacacacagagguccccgcacacaacuccaccacgggagcugcugacaccugugagaacaaaggcagggucagucuugaagccaccccagccaccuucccuugguccauucguuugcuccagcccucugaggaaugcuacaauaaagucucaguuuuaguuugcaagcuguguagaggagccuccucuugggagccaggaggcccgaguuauggauguacuucuguucuuuaaccccucuguggacucaguuuccucacuucuacaaggcagacauuauauuaggggacucugaggucccuuggggugacaucuuucugacccuagacauccuggguacuaaccgcagucucucugcaugagcagucuagcccucuagacuggaguuaguagugaugcuugcucagugucugcacagugcaccagggaaaucuuugcugaugucugaaucugguucccuuucaggguucauuauacuuacagacauucacagcucccacgccuucacacagccuguguggaagaaaggcagagagaagagagaaggcaucagaacagacagguuaucggguuuuucccucaggcgccgaauuccugcucacgucuaucuuugugucacguagaaaaaggugucuuuugugguggcuguggcacaccacacagggcacagcacugggcagacuucagacuugcuuccguucuaauuugccuccauccagcugacucugccauguguagccugaacaagucccugacagacuuggguagggggaggcucggcuuuaggcgggaaggaccccaacaggcugaugcuuugaagggauugucugacugcuggugcuguuuggggaaagcuguggaacuuucaaggugaagccgagcuggagaaaguaggucacgggaagugagacuuccuguguuguacccaaacucuggcuccuucuugucuggugagcuaccaugugaacaguugcuuaacauaccuccucaccauguccugaacugucuugccugcucuucuugcuacaaugggcccagaugcucuggaacuaugagccaaagaaaagccuucacuuguguccuucugucuggcacuauggucacagcaaugcagagcaauggcuguauccucuggggcacaaaggccaggggcagacauuggccagcagcucuaacccuaggcaaggugccuaccauauaaaagcgaaggguaaggacccaagggaguucuggcccagagguaggacacugguucuaauuuucgcaggguccuaugaggugggcgcucuggcccuguagcgacaauggcuuguguguuaaguccacuuaaggccaguucaagagcacugagcuccaaaaauugucucuaacuucuguugcuuuggggggcuaaaauugacaugcaaaaggugggagcaggcaggcuaagcaagagagguuuuugagauaguugaguggggggaaggacucaccucugcuccucgcccuccagcaggcgccuguaggugaugaucuccacguccagccccagcuuggaguucaucaccuccugguacuccuugagcaggcaggccauguccugcuuagccuucugcagggcacccuccaacucagccagcuugcagcgggcaucagcaagggcagccucucccugcugcucagauugggucacagcagccuccagcuugguguucugggaacacaaaagaaguggagauagccaagggucccugggucucacugucugucaccagcaugcuauccagucuuucccaacagucaggaacauucuagaagcagccucuugccuuguucacaugggucagccugagugagcaugaucaggaaacccagcugugcaaauaggugggagacuaaaugguaagcuccaagcaggacacaugcuggcuguguggcacugaguagacauccagucucucuggucccagagcagcugaaccuuacauaccuggcacuuggcauucucgaucucagcagucagccucuggaucauucuguucagcucauugaucuccucucuggugcggcgcagagucucuccaugccggaucacuguggccuucaucuccucacacuagggguuggggaagcagagaugcccaugaggaccaggaugugacaucaacccagugagcacaauggaugugcaagaugcacaguggucaggcugggcugccuccucagccuagagcugugugcaaucuucuugugauucuuggugugcaagaagcccuuuccaauagauccuggaguccuucccacugucucaucuaaggacagauguccugaccucucaccuuggugcgguaccaggacucggccucagcacggcugcggcuggcaaugucaucauacugagccuugaucucagccacgacacaguccauguucaggucccggcuguu

SEQ ID NO: 8021 - RNA, 5840 nt, Mus musculus
gcuuauuauaaaagcauuuuauuggacagacucuggaggaagucagaaccaggacagaauuuagguggguaucuggguagggaugggguucugcuuugguggcuuacauucugcaacauuuuggggucugggucaccaaagaacauguauaggugcugacgugcaacacaaauguagaacugagccauggggaggccagagguugggauucguucccuuccgggaaccaaagcaugugguucugcagcaggcauggucuagacuacucuccagaaaaaggaaacguggccugggagacugccuaaaagaagcagucucugugggcccggggcugcccgugaggaccagggucuugcagcaggcucuucuuagcucuugaagcuccuccgggaggaggaggugguggagacaaauuugacacuggagccgcugccaccaccacugccgaagcucaugccuccuugacugcugccugcacugaagccagagccccccacacuuagcccgcuacccaaaccaagacccccaccaccccuggugaagcgugggccaaggccaccagcaaagccgcugccaaggccaccgccaaagccacugccaacaccaaugcugcugccuccuccguagccagaagagacacuguuuguaacgacagcuguggaaaagagagagaugagugaggugggacugucauauuuagcccacacagcuaacauguuugaucccaccugggaaauaguguauaccuggccuuuuuuucacaaaguagcagaaugggccagaagaauuaaauuauucaguuggggucccugacagaaaacugaugacccaagaggcaaggcagggagucagguacuugguagagguaaggguuuaggacaagauccaguguguauucauaugguaggagcuccauggccucaugccccugccuguguucuguccuuccaccgcucauuuugaacuaucugauauucauuuauugugauggggaaugucuauuaucuagagacagcaggguucugaguugacccucuaaaguuacuuacagauguugacugguccaacuccuuccccacucagccugaaagacagaaaggugggguaagagugaaaaauuguuuacacacacacacaaauagcacaacugucauugucaugguuaggguggaucacaccgcagugaagcaaagaacaugcucucuggaaggucagcccaaagacaacgauguggcccagagcuaggcugucagaguagcauccuaaucuucauccucucucgcccaguuuauggaaagcuggagugagcaccagcacauaugaaugagugcagagcaggguuugccuccuaggaucuugcauuccauguaagaccucaagccagaaggggaugccucgcagccaccauugccugugccagaagagugaagaacaugcaguagcuggauggagagcccagagguugugagaccaggucagcaagagcuuccccgagaaagaugauccaggagaacgaggaagauggguuggggugaggguaaaggugggugugauggagacgccaggucuggaaaagaaugugggcaaaagcagacaggggacacggugcaggaagcaucuuaguuauuugaggaggacagcauccaagcacugaaaugggcaguaagccaaagacgccagucaaggcccgcaguaugcccacaugucagaaugaaacaggaggacauucagccauuugcguguguaucuaucaucccucaucaaacucuacauucuggaggccaccucaagcacacuacggcccucaccugcacuccucgcccuccagcagcuuccuguagguggcgaucuccacguccagagccagcuugguguucaugagcuccugguacucccgcagcagccuggccauguccugcuuggccuucugcagggccuccuccagcucugucagcuuguuucuggcaucuuugagagccagcuccccgcguugcucagcuucagcaauggcguucuggagguuggcacacugcagagagaaagggagcaaugggggcacguggguagcugaacugacccacacuauccuuuucugagauccuaagucagauguaccaaauggggagaccuagaaagaacucaguauacgaacucaguaucuaaugugagugguggaauauggcaacauugugaauuaucacagcugugggagugugugugugugugugguauauguaugguguggugugugugugugaguguguuuauguuuuuguggggguggugggggugguauauguguggugugugaguguguuagugugugugugaguguaugugugugaguaugugugaguguguaugugugagugugugugugugagagagaguugugugagagaggugugugucagugugugugagagaggugugugucagugugugugagagaggugugugugagcaugugugugaguguaugugggugugguauauguggugugggugugugagagugugugagugugugugggaaagugugugugagaguuagaggugugugugugagagguaugugugaguguguguguguguguguguguguguguguaguauauguguggugugugugugugugugugugucaaaugggcccuccuuuguccucuuuuaacuccucccuaccugcuucuugacguugucaauuucagaucucagccucuggaucauucgguucaucucagagaucucgugcuugguguuucgaaggucaucgccaugacggccagcugucuguugcagcuccucauacuuuagccaccacaagagaggaaggacauaguuaaggugggaugggauacucuuucccaggugcacaggcaggaacugccagaagguaguggaauccccuggggucuggggcugauuugggccuuuucaagaaagggcuguucuuaaguaacuucuugagagucuugguuuuucuaaagcuacugacaugaaauuuucuccagucccugggcuuuguggaaaauaaauagcuggcuccuccugcaaccuaucccgugaggccucaguagccucgagaguccuucccuuagcauugcuauggucuggaauccuggacagcccuaugcaggugcaucuucucucucagggauauucacucaagcaagcaccuaccuuggucugguaccaggacucagccucuguucggcugcgguuggcaauguccucguacugggccuugaccucagcgaugaugcuguccagguccaggcugcgguuguuguccauggaaaggaccacagaugugucagagacgugugucugcaucugggacagcuccuacagggacccuugaaguuagucaucugauucuuuuauuuaacuugaguuucauucaaacuucccaucuauugugucauaauaaaauauccacagggaaaauuuggguuaauugcucaccgcaucaaagaacaucuucaugaaguugaucucguccaucagggcaucgacccuggccuccagcuccaccuuguucauguaggcagcauccacauccuaaggaacacagaugguuggcauggaccgacaugcaccuaccucaaauggcuccgccuccaggagagcacagcccagggcugcugcuuucccuucgccacacccaccuucuucaacaucacaaacucauucucagccgugguacgcuuguugaucucauccucauaccugguggucaaagggacaggaaggaugagucagaggacaagggucagaaaaggguaucugugcagucacugugagcaagcauucacacuagaaagaggcugcucacaucucauaggcagacaaguaugggacacccugagccccgggcaagcccccagcccccauaauaugcugccuuuucugaaguugccugccaaaaccucauuccagcaucauugcuauucuccuguuucacccauaauccugcaugaguagagguauagcuugugggagagcacuugcuuagcaugcacacauuccugaguucgcucuccagcaccgucaaaugcauaagccaagaaacaaaacacuggcagccccuuuaaucaguaucugauuuaugcagcuaaaggaauucuuggagccaccaagcagggggauucugccaucaacucccagaaacuaucaaacacagugccguguguuuuugagggcacugggaagaaagccugagagggugaggguuccagguggcacuaggggcacacgcugcuacuuggguggguggguaaaugcuuuauagagggaccugagccugggacugggacucucuggacagacuuggagcuauucuuagugguguaacgcaugcugcuagccuguggagaagacagaggccaccgucuggcuauggggcauaucugauacaaugaagauccugacgccucuuucccccacaucacagcucacuuguucuuguaguccuccaccagguccugcauguuccucagcucugaguccaggcggccccucucccccagaaccccguccagcugucuacggagguuguuaauguacuguucaaacaacggauccagguucugcuuuauggucuuggugcccugcuccugcagcagggcccacuugguguccaggaccuuguucugcugcuccaggaaccgcaccuggaggggccgagugggagggggggaagguuuggguuugaggcuucugugguauuuucacuagugugcuaccugucacaugcugucccaccaaaucuuguguucaguaccuggccugugaccugugagggacaaucggcacugaugcuccuaacaucauucuuuuaggaaagauaggggacagccagcccaguaguagguggaugaaaugugaucuaauuauucacuggggcugaaaacccucuuagacugcucuauagacacuuaggucucccugcaauccuguuaugugaguccuuaggucaucucaguccacugggaccagacacccuuauggggcaaccucuggaggagaggaacucugacucugauuuccagaugccagucuaacugaagagcaacacaaaccaggacagagcaucaacuagcaacacaggcaguaucagagcugagacugaagccucuucccuccaccuuuguucagcauucccuguagacacacaggcugcucuagggaggacaugucucaccuugucgaugaaggaggcaaacuuguuguugagggucuugaucugcucccucuccucaguccugacccgcuggaugguggggucgauuugcagguucagaggggugaggagguucugguuaacggugaccucuuggaugccuccaggugggcacaccgggaagccagcucccccauagccaccaccaaagccagcuccaccaccgaagccaaagccacuaccagcuccaccaccaaaaccaaauccacugccggcuccuccuccaaagccaaagccaccagcaccaaauugguuccugaagcugccuccgccagaacuguaggauauccuuuuggagccccccacauuguacaggcuccggcugccauagcccccggcuccacaagcacccccaaggcugauccugccaccaccaccaccaccacugcgggacaccgagcugaagcucguacgagagacagauggggugauggcagaggcggcgcugaaagagcggcugcccccacuucggaaggacacacuggacuggcgagacaugaugguuccuggaggagcaagaacacugggcgcuggugguggggaggugcuggcgaggucagcggcguucaacaggacgcuguggguggcucuguaa

SEQ ID NO: 8022 - RNA, 2453 nt, Mus musculus
cugcaguucuucauacuggaggccaaaaaaggugucagugaauauugagagcccugaccugcuugguaacuguuggucucagagccacccucugcuguaagucccaugagagcugagugcaccaggucccagagcucugagggcccagugggccaggacucuccaggggaggagguccacccccagcccgcacauccaagcuaguugucugcucacuuuggucugguaccaggacucagccucagcccgacucuucugggcgaucagcucauacugggcuuugacuucagcgaugaugcuguccaaguccagguugcgguuguuguccauggacaguaucacguuggugucagacacauuggucugcacuuggcucagcuccuguagaaauaagagcagcugccaccacaguccugcccuaugccuugggcagaaacaaaggauacagaauaggauccuugcauggccucagagggacauccuaggcuuccucgggauccucccuggaaagaaucuaccacuggaaaaagaaccuccaucuccccguugugaggugggcuuacaucuucccuguugauccucaggucuucugcugagagaucaggggaccgaggggagugugccucccugcccugugccacccgggcucugugcuaacauagucacugguuucugugaucaucacauccccaggagacaagcacuccccagcuaggcuccuucaggcuauuucugugcccucaaaggaaagggggaugacacagaagucagacacugacaaagucccaauggcuuccgacaaucagugcacuagaccacgguguucucaagaccuccuuguauuucuauggccacuguccuuuuaaaggaugcauuggggacaacaaaggugauguaaagguaacaggaaguugaggaucugugaucuguucacuggguuaugacauuggcucccagagggcucugccucugucauccuuugacucccugagcuucuaccagacugcccucaacuccagcugucaaccaccuuccauagucucauugugacccauagcaugccacacacacauacacaaacacacacacauguacacaugcacaugcaugcauauacacacauauacaugugcauacacacauaacauauacacauacaacccaagggaauauggcaggcagagagagagagagaccaaaaccauaucugacagcuugggauguugacuauguucuaagcacaaggguagggacaaaugggucacugaagagcagaagucaggggacaaggguucugagcucacccuccagaggugucauggccaaaccuaaagcauagaaugggauccugagugccagguuagccaacaugaauggcaaaagaacuguugcccugauggauggggaagcccuuugacaagaagucauucccccagcauaguccacagcuuccuuuccuuucuacaucuuccccuaaaucucccaacuugccaacuuccugccaucacagacacugugcccuuuaaugccaaagcccugccaagcugagcccuuccugugccagcucuuccuuaagguccguugcagguguguccucagagggccuccccuccccugcccugcaaaagaacccccaccacagccuccagccgugccucggcaccuugggccugucccaacagggcuuuccuuacuuaagaaccugacccuaagggcaggaacucugucuuacuuguuaugugggaggaacucuauaaacgcuuguuaaguaagccagguaaaaaugaaagaaagggaugcuggguaagccagcuccaugcuucggguagagcagagcuaaaugugaaacaugagcacagacaaucgagcaugaggguggacagggacauccuaacucgugagaaaccaccgugaaacccagcaaagagaaaagggaaaacaccccaaagcacagaggggccaucguaggaggcccagggaagacuaaggagacgaacacugagucaucccaaagaaacaaggaugaggaguccagaacccaacagcaaagcccugcuccucugagggaaggagucaggauccugcagguuaaggaaguauaaaacaugggaggaggcacagagccaccaagagucaccugagcauacaugaaaccaaauagguuucauuuuucacguauugcuggauagccaaaaacuuaccguggacauuaucugaccacuccuuucuuuccagaaaucccaaaaaugagacaagaggcacugggggggaucgcucagggaguaaacaucuguuguguaagcaugaguuaggauccuaagcaacuaugucaaaagcuacacaucuuaguguaugccuugugacaacaccauuggagugaagggagacaaguggauccccaaccagacucauugcucaaucucuucaagacaguaaggugagagaccuugccu

SEQ ID NO: 8023 - RNA, 3884 nt, Mus musculus
cgguggcuggggcguggccugcugggggaggucccuaccuccucccgcggcgauauaacaacaggucgaggacugccacccuccgcggcggaacuccuguucuggucucucgcuucgcucuccucuccagacaagaugagcuucacaacucgcuccaccaccuucuccaccaacuaccggucccugggcucugugcgaacucccagccagcggguccggccugccagcagcgcagccagcgucuaugcaggugcugggggcuccgggucccggauauccgugucccgcucugucugggguggcucugugggguccgcaggccuggcgggaauggguggaauccagaccgagaaggagaccaugcaagaccugaacgaucgccuggccagcuaccuagacaaggugaagagccuggaaacugagaacaggagacuggagagcaaaauccgggaacaucuggagaagaaggggccccagggcgucagagacuggggccacuacuucaagaucaucgaagaccugagggcucagguaaggggccuaaggggggaggggcaguagcuccgggcuguucugucuauccagugugcccacacccccaaacuugaauagagugugggcuguugacucccuccacucuuuccacauucaccacauccccccacacacacucuaugggacggaguuaggaauacucuggacucucacccacaaccuguaggaauuccaagcguagugguuacacacgcgagccggcuucccccaagcaguguagugggaagagaacaggauuggaaaaaaaauaaaauaaaaaggugugugugggggaaucauaaaaugaacucagacacucacuucuuuuccaguaggaacaguuagaggguuaagcggauguggcuaaggcugagucaucuaggaguaaacaggagcuuaccuguaggaggggccagcgggacaaguggggggggggggcgcgucccaggacggggggggggggggggguuagcaggugcaccuggagaagaugccaggagaggaucagagaaaucuuguuggaagcugcucuuuuguaagcaauccagauagugcaggcccuggcagaggggcaaggaauccaggaagggagaggaggcucaggugggaagggaagacagaaauacacgccucugacuguuccugggacugggauggauucacugaaacacaagacguguuuucucaucccccacuucuccacacacacacacacacacacacacacacacacacccucaugugacccggaacucucaaagcgacucucuccacuuuaauccacccagaucuuugcgaauucuguggacaaugcccgcaucgucuugcagaucgacaaugcccgccuugccgccgaugacuuuagagucaaguaaguccggggcugcagcuggagcuaagaauggccuacucccagaacuguauuagaguaggguuccuuccuuuccgaaguuuauucagguuaggguucauugacuacugaguuagcucuucaucugugcagcccaguuuaagcaaacgcuccaaggccaagaaucgugcuaagggaaugacuccgugacuguuuauggugggcacggggcuagucuauggagguggcacugguugagaagguucaggcccucugaucaccuccacuccuucagguaugagacagaacuagccaugcgccagucuguggagagcgacauccauggacuccgcaaggugguagaugacaccaacaucacaaggcugcagcuggagacagaaaucgaggcacucaaggaagaacuucuguucaugaagaagaaucaugaagagguaagccgggccacugaccaggccuaggagcuaagggccaagacuaggcgggccaggcugcccccaaagcagccuagcauggaagcagaagccccggcuguuagccuguuuugauuaagagcagagccauuggcucacacauguucuauggcucaccuaaguuacacuauugagagucaagauaacauuaagccaguuaaggccuggcuugugcaucacuaccuccuggaaagcugagacaggaggauugaguucaaugccauccugucuuagucuaguaaaacagagauugugugaguaagacccugaguuggaggcaaagguggggacugccagucuuaggagcuggugcucaugugggccuucuggaagaagcuuaagguaagaucuguggaaggaaaaagcagcuacaacgaggagaggauaucaccagcgaguggcagguucaggcugucaaggaguggcauucccaaccagcuggagcagaagcccagucuuaggcuugccaaggguuuccucugcucucuucugccuuuacacucaacaucaccuucuagaaaaggccaucaguaaugaaaggcugggcugaacugacuuuaagugucaccugccaccccccuuuauuucugccuucuuuaggaaguccaaggucuggaagcccagauugccagcucuggauugacuguggaaguggaugcccccaaaucucaggaccucagcaagaucauggcggacauccgcgcccaguaugaagcgcuggcucagaagaaccgcgaggaacuggacaaguacuggucucagcagguacaaacuaggaaaggcuagcugcccgcccccacuccgcuuaagguaagcucugugugaaggggaggugccaaggacagcaggucaugacugacccuccucacccuucagauugaggagaguaccacaguugucaccaccaagucugccgaaaucagggacgcugagaccacacucacggagcugagacgcacccuccagaccuuggagauugacuuggacuccaugaaaaaccaggugagcauccuccagucaccugcugcaguucugcuaggcccagaccucagacacuugguggccccagccccaacugucucaccccuaagccugcuccacacccccauucccaaucaagcgauucccuaagaugaaucacuucuauuugauuuuuuuuuccauugcucccacacuguagccuagcauuugauagacaagaggcaucaagacccuuucaaagaaggguugagcaggcuaagaguagagacucacucucccaucucuguguccugcagaacaucaacuuggagaacagccucggggauguggaggcccgauacaaggcacagauggagcagcucaaugggguccuucugcaucuggagucagagcuggcacaaacucgggcagagggccagcgccaggcccaggaauaugaagcccucuugaacaucaaggugaagcuugaggcagagauugccaccuaccgccgcuugcuggaggauggagaagauuucaggugagugguacccugcuaaccacacaagugaggggcuuuucuccacucccggagcuuugggaagugccaaggucuguuuguugguaaccacucaccaguggccucaagugagugaguuaugggcucccucccgugagaaaagaaugauuacauauuaucccuggcuguccaugggauggcaccgagugccucuuuucuggaagaaauggcugaggagacuuuggggggguaaggaagggccucagggaacccuucuuccacauacucugucuccccucuauucugggcuguuuauaacuaaggcuuggucaucuguuacagucucaacgaugcccuggacuccagcaacuccaugcaaacugugcagaagacaacuacccguaagaucguggauggcagagugguguccgagacuaaugacaccagaguucugaggcacugaggcagagaaggagggaaccccugggaacugagggaccaauaaaaguugagagcucacuggacauca

SEQ ID NO: 8024 - RNA, 23410 nt, Mus musculus
auuaaccaucaacuuuaaagacuggauuuauuuggagaaaaacaaaaaaacccucaacccaaaggaugggauuuuacaucucaagacaucucccaaguaaugucuacagauuacaaaucauuuucauagaagauauuuuuguacaaauuuuacauguauucaggagcgggacauaagucaaccccuguuuuuauuuuaacagaggagcaaaguaggagagugggacaaaacagcugucuucggaugcaacuaucuggaagggaaauagacaugaagagggcaaacuaccuucucauugucuacaacaaugguuuaaaaaaacccauucaacuguggguaucugcaaaagcccacuuccuagcuacuagccaaucaaauccaccggagaagcgauuugcugugccuacugcugcagcacgggacaucagugcuccugcacagcaggccuaggaccaagguauccucugucugcagguaccugacuacccacaacagggaggcucgccaucuuuggagcugaccccuacaaaggugcacaucaaagcagacaggucaagcuacaguguugcaagagaaaccaggaccuugcucaaucguucuuugcauuauccuuuauucuugaggggaguaaagaagccaacccuccuaagcagaaaaccagucagggucacauacauuauaaacaagcaccagcguggggcuccagugagggagauuuauagaaaccuuacaucccauucaaggcugaagaccuccaacucaccccauuuacacaccccuauucaccacccaagcccaucaguugaggcugaaagcugcaggagcaggcagaaaucaaagauagcacagagaaaacucacuggcuugcuugagaaaagcagcgaguccucaggccauggcuuuuuguggcuaagauacagugucugugggaggugugugacucacagacagcucugggaggcuaagugucauggagaccaugagaugaccagagugacaagguuuucaaaauaauauggguauauuucaaccucuagaaaggagaguuuagaaggggcaaagccaggccuucucacuaccuguuaagugcuuccucauccagaaaugaccauucuauguauguguuuacuggaggucacacuguuucccucacuaccggguauaaaauauaauuagucaccuccccaaagcuuuccaaaccacgauugaguuuccguucaucuugguccccaagcgggaacuacuuguuagugccccguagacucacucccaacuacccccuugggggguaaaaaaauaaaacaauucccccuuaggcuggccccauugaagucagaacuaaaguagaggggcuggcagccuccuggagacuaaaacagcuugagacuagagcuaccuuucuaaggaugggaaauuuauucagguaaauucagguaauguuuggguauucacaggugccaucucaggauaagaauuagaaaguagaaaucucacuucugcuuugcaccuuuuucuacugccuaacugaugugacugccucucugucacugcaauucugcugaauggagccccaggcacuagucacacaguaacugcuugguauugucagacacaacuuccccauucaaaagcgguagccacgucucuggcuacaauggugauucuccaguuacuucaauacuuuaaaaggcugcagcagcaugcaaaagaauuucauuucauuaaaaaaaaaguuuagaaaggucuucaggagauggugaguuuauuuugucuugucuggauagagguuugauuugcucuugaauguuccgggguggagacuaggagaaagcacagggugcggagguccuacucagugcagucgucgcccucauccucauccucgccauccacagacagagcagcguacuugcuugcagagcugaacuucuguaacaggagaggacggaucauggaugggagcccagaccacacccguuccucugcgagagcagggagggucaggggcacgaguggacggccgcacacauccucuuuccgagagccgaggaagguaaccccaccuuaagugugcucacuggagacaaaaggagucagacgcaaaacuaagaggaaaggcacauggcacuuacagaggcuggguucuccucagguuucuuuggcucaggcgcagaucuggagucuugaucuuuuuugccauccuuccugcagagacacaauagguauucaauaguguugcugggauagugcauuauuuuuagauucugcaaaucuaaccgugacucuaguuuauucacagugguaaaccuggcaaugcuugagaaagccaagaacuacuuuauaaagauucccugcgucuaacacuacaagauucauaaacagugaggaaaaaaaauauagauaccuauccaaguccuuccaguggucucugcucccuccauccccgggaccacggcugcagcuuccagcuuggccuuguguggcacccaccacauccacuuuauuuccaucuguuuaaacagaaacacaaaaccaaauucaaggguuagaaaguaacucaucucccuguccuugcuuuccuuuaagcugaaggaaacacguaugaaggggaauuauccccacuccaaaccagccuaaagccuuuuuuucccauuaaaaguccuacuguagugaccaucaccuagaaagcaggacagaaauaggaacuagauagauuguucuguagugaccuugguuuacuaauggugacauuucaaacuuggacaggacagacacauuuauuccuguccaauuucuccacaaaggcaggcuuuaccaggaagaggcagcuuuaaauacucuuugaagaagucauuccugcccucuucuggcagaaaagguagcucaucaaagaacauuaaacaacaacaacaauaaaacaauugacagcugaacguugauggggguagggaaguagagccacugcuaaggugucagcguuucuauaauccucaauaaaacacaguaggccacucccucacaaaagccaugaaaguagaggcuggcugggaagaaggggacuggcagaaaggaggcuaacagggcagcagugaugaccaugacugaaacacaucacuugacccaagaacuaacacugcagcuuccauuaaaaaaugucuucuugcuagguaguaauggugcacaucuuuaaucccagcacucgggaggcagaggcagguaggucagccuggucagaguuccaggacagucagggcuacacagagaagccuugccuagagaaaaacaaaaagaaaaauucuuuggcaagaugcuuaauccuggagucucucauuacaggcauuuauuuuauuuaugugcauugccugcgugugugcacaucaaaugcccuggaaagaacuggagauaugcaugguugugaguaccacaggggugcuaggaacugaacuuguucacauggugcaggcucaccuuuucuugaugguccuuccucagggggcuggacugcagcuacuuucccuccaccacuggaauaaagcagcaagcaaucagccaucaguuuuuacaggaaagacaacacaagcuuacaccauuuuccaaauguaccaggcugccuuuucauuccacacuacaauauuaaaauacaggaaagacuguugucuucuacacuuaagggccauaugcuuuggaaauccaacaugcuuagcuggagucuucucuuggaaaaauuuaagaaucacuugagugagcaagguuacacugacaguaugucccagggcaaagcaugucuacauauuucuaugguaaauauucccaucauagcugaucuuaauccaccaaacucaugucaacugguuaacaaaaaucaagaaaacagauacuguugagacaacaguauaugaauuauacaggaggcaaccuccucugcagcacacacucccucagggcaccuccacuaagcagcugcuguuacaggccuacucaccuuguaggggacggcugcucugugucugagcucugagaucgggcaggaggguuagagcuucgcuucacccacgcauucuccuuugguggaggggcuggcauuaccuuuagaggcuggucagguuuaggaggcuuagagguuggagagugacagucuucuucuuuauugaggguuucauuuucuagagacuucucacucucucuccuucguguaucugugggggaagaggagcucgcuguacagagcccaccuggacuguagcagcaggggaauaggggcaucacauucuuuuccaucagcagcagacagacacuaacugguuccugauagcuacaguuacacauaaaccaauggcuuccaggccaccuggagaaaagugcuuucuggaaaaggggaaaaagcuaucugaaagaacagcaaucuugucuuuauuuggaaggaaugaacacuuuuuucggggagguggggggggggguguuacaacuugucuauguauuaggacagccguaacugggaauaacacgcucuuguggugaaugggacucaggaccaaagcccaggaaccacugcccaacuccagcucagcagaggccuuuacauggggacaaaaacccagacacauuuguauuugcacaaaaacuucucuggaaccauggagcuugcuuugccaacaguuacagccuacaucugaaguacaagcucuagcaaagcggcuacacaaaaccaguaucacacuuacucuagccagaaggagcacuacaccauguuacagggcgacuacaaaggucaaacagcuucagaaaacucuuacaacacuuggcuccauugacaaaucacucuggcuuugggcuguuuuaaaacacucaaguacaaguaaacuugggaggaaggagagcuuuagcaacagcgaaucacaguaagaggaggacucuacaauuccuguaaaccaucuguaucaaauucaucguggcauuaagugucuucuuugugccugguaccuagaggccagacgucauaaugacaucuucuggaacuggaguuacaggugauugagggaacaggggaauuaaaacugggaacucuacaauuucuccuuuacaggaggaggggugcagucaucaguggcccaggacucugugacacuacacacacaugcuaaugaggaaaugaccauuuacccccaagaacaccacuaauguugccuaaacaacaucaaauaaugucaccccaagaggucaaaaaccagugcaaagugagguggcucuaaaaaaaccaacaccagugagacagaaaauagggcuggcaaaauaucauagcagguagcuugccaccaaaaccugcugagaucaaucaaugacuggaacauucucucuggggaaaacagacugcuccgaguuuuccucuggccuuguaucaugacacaagaccccacuccuccacaaaauaaaugguaaaaaacaaaaacaagacaucuaacagucaacuauucuccuuagugacagacagucugcagaucacugaagugucuauucuggcaccuguucgaggccuugcuaacucaggagcuucugagcagagcucaaggccagucuggucacacaagucuuaggacagccaaggcuacaugggaaaaagaaguuaacacugcacagcgcccacacaucugcgggagacaggacuccgauacccaccccaccugacuuacuucugccagauguggcugaggccccagucugcgaugacucacuuccuguccuugaccguucucuuuccugaguuucuucacuucgccagcuugggugucugcacacaagagaucaacaaagacgacacuuaaugccacaaugaaucugauacaaaugguuuacacgaauuaacaucuauuaauuaauuaauuaauacacggucuuggugagugcaggccagaggacaaccuugggacauuguuccuuagaagcuacccaccguauucuaauuuuaugcaugugcugcccacauguacgucuguguaccaugcaugugccuggugccuagaggccagacaucaucaugagaucuucuggaacuggaguuacaggugguuaagggaacaggggaauuaaaacuggggauucuacaagagcagcaaguauucuuaagcuuugucacauuggcccacaugaucaguguaagauuguaucacacggcuuucuuuaucuuaaaccauuucaaggcagcagguuacauaugcuguucugaauaccucaggauuccacauuagcuucugcucugaagacagaugugaaagucauucagacagaacagugcugagcuuuuccuaauaaaauccuaaaauauauauauauauuugugccagguaugguagcacauacuuuuaaucccaacaauccuaggaggcaaaagcagguagaccucugaguuugagaggccauucugguuuucggacagccagaacuagagacccugucucaaagaaaacaaaaauauuuuucuaacaauucuuauauucuuuauguuuguaugcuauaugaccauagcauacaagcuuacagaaaaaaacagcgaaauaauuccuggcuauauucaacaagaaaaagcauucucuauguaauaagagagaaugaauuuagaggucaugcuggcaccugcaccaccugguagcagagcaugaagagcaugaagagcaugaagccugacugggcucagugauuucugguguggccuguuuucaaagaucaaggcuagugagaugacuugguaggcaaggacacuuccugccaagucugaagaugcacaaaguuguccucugaccucuacaugcaugcucacaaaggucaauaaaaaaagaauugggucaaccauuuauuuacuucuguuccaaagcacuaccaauuucuauuuaugucagguguagcacaagucuuuuugaaaacaugaagucacagaagucuuuagugugugacacucuuacacucuguagacugcuccaccccacccaauaaacacauccgcgugacaaccaguaaccacucccauuucccaagugcucagggcuaggguuaggacuuggcaguagggagaagccccuuguugaagacgccucaccucucccggggccggcggucuaguuuuggcucauccagcugacgcugcagcuucuccugcuccuucuguagccgcuccucuacuucucuuucccuagcagcugugucaacaggcuucgccccuccaaagauggaggcugcccggcuggacugggaggugcuggcggaggcgucauccuccuuaggagcgcuucgaggcuugagguucagucugggucucugggggggaccuaaggcaaacgagacucuaaguuaaaguuuccaaaacaccaggaggugacugcugagagccagacucgagacucuuaggaaucuuguucaaggaucuggucugaagaugaacauuuucaacagguuaaaaacaaacaaacaaaaccuuguagcaauaugacauggaagaguuuuagguguguauauuauagacacaggcgaacacagccaucagugcuggaguagucucacucucugcauggcaggcaauuagaaucuaaacuaccuccacagccaagggaggcuccaucuaguucuuacacuuuuguaugaaauucuuaguaguccaauuucuuucacuuuucaaauuaucaaaguacuuucaaaauagacuuaaauuuaaucaagcaguguuaccuaacaagaccaauuuucauccugaucaaagguagaaaaaaacuaacauucagauggugucgccacacuuagccuagguggcugcuguuuauucuuagcccuuguuagagcugauuguaacagugcuuuguuucgguaacuaggggcacaauacucagaguugaccucugaaaacuaaucucaccauucauagaaucagugauaaugacuggcugggacucucauuuuccucacugauagggcaacagaaggcugugucuucuccuuuucuacaguucauuaaauguuaacugaagauggcuauggagcagcauccaagaugaaaacauucugucuccacgcugccauccacacccaggucuacugugcucugccaccuccuuuacaacugagaaacaacuuucuaguuuucugcuccaugaagaaagagaugaguaccucugucaucacgccuauaaucaucccgagaguagucaucccuggagcuccacgaccgaucaucccgucugucauagcggucuucauagcgguccccaccuccucuguagucaucaucucuccgguacccacuuccaaaugcccuucugccacugccuauccuggagucauagccuaauaacagaucucaaauuguggucacacagaaaggggggggggagcaaaauagaaaauucuugagaaguguuuuucaacugaguauuauuaucaugacuaccucggucauagucucugcugccucggucaucauagcgaucccggcccccauagcgguccaugucucugcgugggccgucccgauauccgucccuauacccaucccgauaccggucugaaucguaacgaucucgauacucuagaaagaaaagaaaacagguaacaaguguggcagcucacuagaccaauuggaguucuauucugacuacagccacaaaccauuuguaccaacuuaaauguuuuaguauuuauuucuuuaaaagaaaaaaacaaucccugaugggugcuaggaauggagcucacucggcagaaugcuugccuaacacacaugcggcucuagauuuaauucauaggaccacacuaccacuugggaugcugggcagcagcaggaucgcagcaggaucaaguucaaagucauuuuucuuucaaaaagccaccccuggcacccccauaacagguacaggauaucucccugauucaauuuugugguuuuaauaugcuuuuucuuggguggauaaugauaaauaucuauauauucuauacaaauucuagaacaugauguuuaaauacauuuaagcacaagagacuauagcuagaauuuucuauguuugauaccaaucaaccaaagacuguuucaaaguuuggcaugagggucagagacggcucagcagauccugccucucaagccugacaaccugaguuccauuccuaggacccacauggaggaaagaaaacaaggcucucaaaaguuguccucugaccuccacaacuuauaccaaggcauacaugugcuugguuaggcaaccaauaaauguuuuuaaaaaaucuggcaguggcuaaggagaaggcucuacucuuaaagagugcacacugcucauaggucaaguauccagugccuucuuuuggccucucuggauccuguucucgacuacacacucccuccacguuaucucccucccuucuugcuguacgugaacuugcuuuguaaaccaggcuggccuugaacucuagcugcaucugccuccugagugcugggaauaaaggaugcaccaccacaccugacaaaaaaauaacacccuaaucucaacacacaguaggguuaaugcaggcagaucucuugagucccagaccacccaagacuacauagugagaccaccucaaaaacaaacuuaguauuaacacaacccaguacaggcaaacacaaggcugcaucucaccuucacucucacagcacugcccagccuuuccugcugcugccaguguucagugaaaagguucuuuguauacuuucuucagcacaaaguacagucaauauuuucuuaaaaacagguuuauuuacuuaaacuuuuuaaagugcugucugccuguacacuuauaugccagaagagggcaucggauuccauuacagaugguugugagccaccaugugguuacugggaauugaacucagaaccuucggaagagcagucaguucucuuaacuguaagccaucucuccagcccuagucacuguauuuuuaagugaaucaaucuuacguuuucugaaagucaccuuuaaaagcuaagcacaauuauagucacauagccguuccuggcuguguuccacauggaaucucacugguggaguuuaaauaagcaucagcuuuuugcuguagguuucaugucuguguguauguaggucuguguuguucuugcuuggcgucagggucucucugugaccugaaguagauagacccacugacaagucaguaggcucuagagcuaccacccucacugcaccacaucugucuucuuaccagggagacuaggaauccaacuuaggaucccacugcuuguuugauaggacuuuaacauuugagaccaagcuacuaccucuucugccucaguuauucuuuauaaacaauuguguucaaagagaaaugccuguacuuucuguuaauauuuuuuaaaauuaggaacuuaucaaauuucuuaucugcauuugucaacaauucuuauuaucaaaauaacuccccccaaaaaacuccauagaaaccagacuuuauaaguuguuccccaacuucuaacguuccauuaucaaacagacccaagaaacaauuaaaaaaccugaacuuacugucuccaaagcuaucaucgccucuucuagguggguagucaucaaaacugucuguggugggacgggcccuccagucugugucuguuuugucagaaucccgauuucuaucucgaccaaaagaacggucaucccugucuguagacagaaaaccaaacaaguuagcucacccaagacaccacuuacuucucacauggucccucacaucccaccuacgguuucuauugcacuggcaucccaaggccaggccuugagguugcucucuccagguaaccgaucuauucuuuuccucaaauguauuuuaauuaauguuuaucuauaucacacuaaagcucaagcuccuagguagcaaaucuaauuauaaauuuacagcccaaggauaguaggugguuugaaaucggaaggagauaggaugaaucuggauuauacucauuagguaucaguaguagucccuucgacugaggcaaaucuccuuuaauacugccuaaaguuaccauggaacaaagcaggcugagaacugauucuagccucacuaccucccuaggaccacuacaccaaacugggaaguucuaccaguuuucuuaccuuuauccugugcuugaucagcaacauccacacgaauucuccuguuaccuagagacugagagcauaggauccuauuaacugacccuuguuagcuuaaaaagcucuaagaagcaggacaugguggcgcacgccuuuaaucccagcgcuugggaggcagaggcaggcggauuucugaguucaaggccagacuggucuacagaguaaguuccaggacagccagggcaauacagagaaacccugucucgaaaaaccaaccaaacaaacauaacacaaaacucaagaacuucaagaaaaauuugaagcaaauuuagaguuaacaaaguugguguuagauuaauauaaaguuaacucuauuuuucgaaagcuaacuucauauaccggaguaaacucaauuuaguguaaugaaagcaauucucaaucagcuaacaugcuuguaauuauagcccucaggaagcaaguuccaggccagccuaggaucuauaggaagacccagcguccaaagaacaaggacaauuaaaauaccaaagcagcuaguuauucaauccaacaggccaacaacacagcagcggcacacugaggacugcuuucuccaggccuuuucacucaacucagagcuuaguuccucugacuuccccuuuccuaauuaccuuuuaaauacucugaccaacugcugagcaccaacauggauaucuggcucuaccagugaauuuuauuuaacauuaucugauacagacuaaggcauuuaaaucauuauucaaugaaaauauuucuaagagcugcuuauuuacaauuauaccaaaugguagauucagacuaugaaauucuggaguuaaauaccccagccccgaaaagauacacuuuagagaaccuaguuaacuuuucucucuacauuuauaaaggcaguuuauuuuuaaaaaguaaaacccuagagcugacauaaaguaguaaauagguucauuagaaaucugguauguuggguuucuucccuaaaauuccauugcaaucacuguaccugaaaugguaucaggagggacucgguuugguugauaaacaaagacugcccauccuucgccugcacuuucugugauugguuugccugccugucugucugaggggaaggugucagaucuuggaguuccugauggcuauaagcugccauguggucgcugggaauuaaacccagguccucuggaagagcagccaguacuccuaaaggcugagcuuucucuccacccccucaccccaccucuuaauuucuuuaccucuucauugagacucagagcacugagcagagaauccagguccucaaauucugcguagccgaaaccuuucaaccugucuggauugcuggguucccgugguaagcguacagcgcugaucugagagaauaaagaaacaaacaaacaaacaaaaaaacaggguuaaaaacaaacaaaccaacccaaacaaaaaguaauuucuccaaagaacauauaagaaccugggagaaaaauggguagaggggcagaagacaaauuacucuauagcccacacuguucaagucauaguaauuuaacccuuaaaacaaaauuaauuaagguauucuuugcaucuuggacucuguugccuuccucuguggcccaucccacaaucgguuuauuuagcuuuuauccucaauaucccacaguuugacacaaaaagacacuuacauuuaauccucuaaagaaauccuuaauggagucuucugucacaucauagggcagauucccuaggaaagcaguguaggguggcgacuugggaagacggcuccggucaauauuggguucccgagcagcccguggagcagugggaaggauggaacggucaauuggaggcgcccuguacacgucaucaucguuacuaugccaaguuguugacacuaggacagaagagcagacaaaaggaaauuaagaagccaagcauggcagagcaccugaguaacugagacaguaggauaaaugugagcaaauccagcccggguuacaggcuaagaccaucucaaaacaacccaaaauccagcagucauaguguagaggcuggcucaaagucugagaccagcccaauauucacagugaaccccagaccagucacuacuauaaaaaagagauucuguauuaaaaagcacaugcuggaaggugguggcacacaccuuuacaucugaguucaaggcuaguccagccuagagagugagucuuagcauagccagggcuacacagaguaauccugucuugaaaaagcaaaauccuucaaaccaacucccacagauccacaugcauauaagauuagagccagagauucaugccaacaccaagccaagucaaaacaaggcugugccacugaagcaaaagacaagaaaauacuucuaagguguuauaaucaagaucgaaaaaagagggacugaagagauggcucagcaguuaagagcacuuguugcuccugccggucucagguuuaauuuccaagcacccauaugguggcugggauccaacaggcacacaauuauuacacauaaacaaagaaaaaaaaaaaaaaacagaaaguaaggaguacucaaggucuauuuuguggaucuuaaggccuuugacugcuuucucucauuucacucuuuaaggaaucuaugaaccaaauccuucacauguuuacuauaaaacacuuuagccugagaagccugcgacacuguucuauauacagaaaacaaaacucagugaagacaauuaucugaugguaaagcauuugaccaggauccucucuaccucaacacgcuaagcacucuugacagcucucacucccacaugggcggggcuugugugcucugccccuuccccaccuuugcuuuugugaagacagugugugucuacccuggggcucgaggccuuccugucucuacuucccaaucccaggaauuacagcucauaccaccuuaccagggcuuccucaagauuugucuuccccccaaacccaaacaaaaaaacaacuauccuaguccuggucccugaauuuguauuuaguuucaacauuuagagaauauauaagcuauauaaaacuuccuguuuucauuauaaaagaggccacacacaaaguagucaauuugcaauaaguuuuuuggggggugggguaggaauggagaaagaaaacuggcuagacugaugaagcccuaggugugguaugcaugucuauaauucaaguacuaaggaggcagaugugaacagaucucugauagcuugagauaagccuugucugaaauaucaagucuaggucacauagggcaacaggagaccuugucugaaacacaaagccgaaacauauauacccuaaccaaaaccaaggccaggcuggguggcgcaagccucaauuucagcauuccaggacagaugaucucuauggauucuacgccagucaaggauucauagugagcucauacuccaaacaccacccacccacccacccaaccaaaacaccacaaagcuuuuagguuuuccuuaugagugauaucacaacgcaauugacaaaguuguguauauucagcugcuggcaucaaguugaggugaaaauaggcugagggaacaaaauaggaauuaacuacaugggaaauacagaacagucacgauguaucccuugagcuagccuuacacauuuagaguacccuguaacagacagagugagcgcaccaccacaccuagcugcucagucuuaauaaauagccaggcccagcaugugauuaugcucaaaguucacuuuaguuugaaagucaaccagagauuaaacccaauacccugaaacacauaaaaaauuucaagcuguacaaauuaaaauccuuucuaaucacaaacgaggcaaaucauggaauaccauuuuauuuagaaaacagugaacuuuuaauuuuaagcacaaugauagcuccaaggacaacaacaaagggaaauuaccaucuccuuccagaucgucuguuucaucagcccagcugacugguuuggggacauaggugcuuccuccaccaguuccuccauccucagcuagaaaguccguuagggagauggucuuccccuucuuauucuucuuuuuugcugaaagagagaaagauuacucaaagacaaguaaguacuuaagucuuauccugaaccauuaaagacauguaaagaaaucaacaaagaccuaccagauaacuggauuguggaauucacaucauaaaagaauuguuacgcagauauaaauguggagaaaacacaaaacauucaagaagucaggcauaauauuugagacaggagaggacaguuguguguguguguguguguguguguguguguguguguguguguguguguguguggugguggugguagagaauagcucauuugcuggcauagaagcaugaaguccuggguuuaauccuuacuauauaaacugaguguggcaggauacacuugaaaugcuagacuaaguagguagaggaaggaagaucagaaguuaaaggccaucuucagcuauagggugagucugaggacagccugguauacacgagacccugucccacaaaacuauaaaugcuuaaguauacaacaucuuuagguauagaaaaggaaagcuauccauuaauacccuuugggaaauaugacuacaauggagaaauccuucauuuauuacuaauagacaaauaaggcaaaggccuuacaacaaaucacucuccaguuacauuggaaauuuuuagccaggcagugguggcacauaccuuuaaucccagcacuugaggaagaggccggaggaucugaguuggaggccagccuggucuacagagaaagcuuaaaaaaccaaagaaagauaauuuaauuuagaaaugacuuacaaugggaaaaaaauugcuauauaaaccaagguagcauugaguucagggaucuaaguguuucuguuuuaccauuccuguaauaaagugcuuucuaaaaaguaaaacuaacagacuggagugguggcucagucauuaagagccauuuguugcccuuacagaagacccaaauucaguucucagcacccauaacuccagaggaucuggccccuucugaauucaaacaugcagguaaaacaacuauauagauaaaacuaaucuaaauucuaacaugcuaguauauacacugcuccuuaaauacaaagaaaaccaguuccuacuuacauguaacagucucuagcuacacaaagcuauacaauacuuuauguguauugucuacuuguuaaauaaccacagggaagacucaaaaaaucuauccagagggaaggaaaggaaaccucagguauuuuccuagcacaugaagggcucuuccuucaggacacugaauaggaaauaacuucuauggcagguuaucauagccacgguaaaaugccugcugcccccaguggcauuugaaagcauuugauuaaauggcaugcaaauaaccugaauucucuguaccuucagaacuucagacccagcacagucaauucaagggaccaagaggaguucuagaacaaagucaccaccaggccauuaaggggggaacuuccccuaaaaccaaaaccaaagcaaaaccauccuaccuggcuggguaggaaucggccuguuaacucaguaccauuggaugauuucaaguuugaggucagcucugguaaccagugacuguucccuccuccaaaaguuaagagcuuugcuauuauccuaauagcuucauaguugucacuaugcaguccuggcuggauacauacucugagauccgccugucucugcuccucaagugcugggauuaaagggaugguucacccagcagcuucuucuucuucuuuuuuuuuuuuugguuuuucgagacgguuucucuguauagccccuggcuguccugaaacucaagcuucauguuuuuuuuaacaaucacgaguccuuucaauucucaccuuucaacucaagaaagaauauauauuuuaaaagauuuacuuauuauuauacacaaguacacuauagcugucuucagaugcaccagaagagggcgucagaucucauuaccggugguugugagccaccauguggcugcugggacuugaacucaggaccuuuggaagagcagucgaugcucuuacccacugagccaucucgccagcccucaagagaauauucuaauucgauacacuaaugcuuacuaaaaagaaaguugcuuuuucaaauucaaaagcuguugggagaaaauaaagguacccuguuuugcuaugaaugcuacagacagcauuauguauguaacaacagccucaaguguuagagguugaauguucaacccaaaugaagagaugacuauaagucaguccuuuuuuaaaaaaaagugacuuaaugcuaaugugacucuaaaaaauugauagucuaucagucagaucacaugauccuuagucuguucaguuucucugaaucaguuguugacuaugccauauuucaaauucuaagguuagacuaccgaggucuggccacuggauugagcuacaguuaacuuacuguguuugaaaauacuucaucagaggcuggguccuaaagcacucgcucuguuccaauucacaugcagacauguguaaguuuugugccccacccccaugcaucuccagcggaccacuaaacgcccaagcagccaagaaugacuuugaacucugauuuucuugcuuccaccucaguauugugaucacaggcaugcaccaccaaaccaggcugacaagguaggugcuggagauugaacccagggacucugugcacucuaggccacugaguuaaccaacaauaagaucacuugugcaauacaagguagacuauauaagacuacauguugagcagggugugguggcgcaugccuuuaaucccagcacucgggaggcagaggcaggcggauuucugaguuugaggccagccuggucuacagagugaguuccaggacagccaaggcuuuacagagaaacccugucucgaaaaacaaagcaaagcaaaacaaaacaaaacaaaacaagacuacacguaugagcauuugcugauugauguuuuuauuaugugaguccuaaaacuguccuacaguuuauauuuacuuguauuuaguugggcuggugagauggcuuaguaguuaagaauacuggcugcucuuccaggucccaaguuaaaaucccagcaaccauggcgacucaugacaaucuauaaagggaucugaugcccucuuuuggcauguacaugcagacaaagcacuccuacauaaaaauauaaaaacaugagaaaacugggaaggagggguaacauuugagauguaaauaaccaaugagaaaagcaugaaauucccuggaacuggcauuacagacaauugugaaccaccaccugggagcagggaauugaacccugauccucugcaagacuaccaagcacucuuagccacugucaucucuccagccacauuauauuagucuuuaccuuccaccaccacagcguaaucuagaaugacucuacccuuugaaaugauuuggcuuaaaucaacuuuguagauuagguuuucucaacucuuaaccuuuuaacucaaguuuagggaaaaaaaaucauuaacauuacuugcuauuucaaaauaagcuaaagcaucaauaaaacauuuacaacaaaacauuaauacuuuaaaaaaauccuuuuaagucauuauuucucccuuuaacauccuuacugcugggcuggagagauggcucaguaguuaagagcacugacugcucuuccagaggucuugaguucaauucccagcaacuacaugguggcucauaaccaucuguaaugggaucugaugcccucuucuggugugucugaagacagugacaguguacuuacauauaauaaaucuuugggccgcagugagcggaggucccaaguucaauucccagcaaccacaugauggaucacaaccaccuguacagcuacaguguaucauauacauaaaaccaaccuaccaccaccaacaaaaacauccuuacugccccuuccuccaccaaaucugguugaggcaagucuucaagauuaaaaucccaagccaggcgugguggcacacgccuuuaaucccagcacccgggaggcagaggcaggcggauuucugaguucgaggccagccuggucuacaaagugagugccaggacagccagggcuacacagagaaacccugucuugaaaaaaaccaaaaaaaaaaaaaaaaaagacuaaaauccccuaaaagaucucucauuuaauguggcugcacaguaauccagucacacauaagcaguuucuaaaggagaauaaaguaagauaguaccauuugucuuauuccaucuuauuucaucgacaaguuaucaaaauccucuaugcccuuugauccuucaacauuagggccuuccacauuuaaaaagauuucaacuguggggggcuggaaagauaggucugugguucagacuguguuuccaguacccagcucagaacaacauguaacuacagccacaggaaguauccauguaccuguauccacgugcacauguuuagauacacauacacaauuaaaaauaaaaggaauaauuuuaaggccagguguggcuacauauaccuuuauuuccagcacuuaggagguagaagcaggaggaucucuguuuaaggccagccuggucuacaaagagccuaucucaaaaaaaaaaaaaaaagaucaacucuuuuguuuaguucuucaagaauauagucuuugcugggggcuggugagauggcucagugguuaagagugccgacugcucuuccaaagguccugaguucaaaucccagcaaccacaugguggcucacaacaaaacaaaaaucugaugcccucuucuggagugucugaagacagcuacagugugcuuacauauaauaaauaaauauuuuuaaaaaaauagucuuugccacacauugauuuaaccaguucaauucuuucaucucccuucuaacaccauuccugauccuuaaaacaguuaguucccuuguaaauuacaucucaaagcuauuuuguuuuguuauuugagacaggguuucuguguagcccuggcuguccuggaacucacucuauagaucagguugaccucaaacucagaaauucgccucccacugccucccaagugcugggauuaaagaugccaccacacgcagcucaaagcuauuauuaaaguaaacauacauacuguuucaauaugaaacaccauuuuccuucaauugacaauacuuaguauuugacuucuugaucuaaguauccuuacagagcaacaaauacucuguacaaaaagauaauuuguauacauuuaacuaguucuugaaacuguuucacuaugaagaucaacacaaaaaagaaaccauuuaauacaucuucucacugaaaaaaaccaaagaaacaccucacagcaugccugucuuaucaauuaaaguccuaggcacagcuuauacacuaacuacaauuuuaaaguaaccuguaucaaacacgauuccuuagagauaaacuguucauuaacaaaugaaaaaaacugagacagcucacuuaacaacucauauagccacaauaaaaauguaaaggcccuuuuucugagccaggaucucacuguaguccaggcuagccuggaacuauggcaaucuuccagccucaaccuucugagugcuaggacaauacucaagguagcuugcucagcuaaacccucauagauuuaagucuucuuuuaaagaagcaacuaaagaauugccuacauagguucagguuuccuagaaacuuaaaagaauccucauuugucagucagcucugagacaaagauacuaaggucauauggaaacuaguauugucucaaauauuuuuucaccuuaccaaauagugauuaaguuguaucuggcauuuuuacagagaaaacccaagacccauuuccaacucugaacugaauuggagaggagaccuuccuaggagggcagauuauuaaagaaaaaggaaaggagacaccaucagggaaaucuuguaaaccaguggaucacagucaacagaauaaaaccaaauacacaacuuaccagggugucuuuuucucuuuuaacuuuugacuauuuuuugauugcacacagguuaaaggacaaccugcaggagucugcucccaccucuacuacaaggauucuucaaacucaaguugacagcauuggcaccaagugccccaaaccaucuccccaguccagcuaugucguucaccacuaagaaucucccaagaggaaauucaucuagauuucucauuuaguuaagacacuaaacuuuaagccaaggaguauuuuucacugauuaaaauacguuuuuguaauuuguagacgauccuuuuagccaucaauuccaacuucguucuuguacuuacaaucuuaaugagcccagcuaggaaccugguguuuccaggacugugacucugucugaucugcuaccugcaaacaacgugacccucgacaaaucuuugagcaauuuuuccucagcuggagaaaccaccaguucuuuacaugcucucacaggcuuguucaauuaagugcucuacuaacaaaagcuguuacccaggguuggggauuuagcuuggagugcuugccuggcacggccaaaaacucuguucaauguccagcaaugcaggggaggaaaggaaguucucauggccgaaggcaguagauucagugagaaaguuuuccaaagacagaacccgauuuccuuguaauauuagaaaagauggacuucugguuaagacacugaauguugccaggcguguugcuaaacaccuuuaaucccaacaaccccaaggcaagccuggucagauagucaagagcuaaaugagagaccuugucgcacaguuuaggcacagcaauccaaaagguauuuuuaacagauuaugcuauaaaaaauaaacuaaaacgaaaacuaaugcugggugucuaaaagcccucugguauucacagguccacugcaaaugccaaaaaaacccaaaaagcaaaaaacuuggaaaacaaaacaaaacaaaaaaacaaaacccgaaacgaccuccacaaaccucacuugcaaugcagggaauauacauuccaccaaacaaacaaacgcacgcagaaccucuagccacuauuuuaauagcaccuucuggaaguuucccaguuaucugggaaaaugacaaaagcugaauccugacacuaaaacuacccaaaaaauggaaguucuauauaaugcaacgccccgauuuccuuccccaccucugccuggcauauagugugcacucaauaaaaacuguugguugaaucaagagguggaaagaaaaaggcacaggagaaaucuaggugucuaucccuacagcaccuaacacgugggagcacccuggguucccuacccccaacuauaguggggccaaaccuaauaugcguucgcuugggaguacagcggccgugccacgcucccaaaccgacuaaagcuuaaaguacaaggucauaaacgagcaaaagccagguccauccaggcuucccaucuggaguccagcagcgcguguuucugaggcgcgccuucuccaccaccucgccucgucgcccgugccgcgcacgcgcaccgcugcuuucaucggccccuccacagccucgcgcucgcguucuaacugcacccccccgcccccacgaggguccgcaacggccucgcgccuuggagacccggcccaauguguuccgguccgcgcgccaaccgccuccuuccuccacccgcgccuuggcgcgggcgcggugcuucacgccuuugagagccucgcgccucccgcacgucucucugugcugccuccuccaauugaaggcaggguccaccauuucugccuacuccaaccucgcgcaacggggugaaaagggugugagggggaggggaaggccuuccccucccccuagacaucccgaggcgguaaccucaagcggccaugccgcuagccugccgcugcccccagguccgaaaggagccggugccuccugcccccgaccuccagcaaggagcggaccaagcccggaggcuguuuccgagccuggucuuuggccacgcucggccgcucacucaccugaggccgccauguugggagagggagagagaacgcaaaggacccggaugaggcagucacgugauuauagcgggcgcgacgggcuuggagacgugaaaccaggagggggcggggagccgaggacggaggcagaaggcggggcgccgccgccgcgcuggguucguaaagcagcgcgaggggguggcgcggcgu

SEQ ID NO: 8025 - RNA, 20382 nt, Mus musculus
cagaggaagggcggggacccggaugugugugguggcggcggccgaagagcuacaacgcggagcugagaggccuauggaugaggaggacgcggcggccccgguaggcggggaucgggggcggggucccggaggccucggucucugcagaucucgaggcggggguccugggcgacggcugcggccucagggcggggccaggggcuccggucacgggcguuccucucgccgcgcacccuccccauugcagccagggccugugacgacggggcguagccucauugacagguuaaggccggguggucccgggugucaccugagagaccccgcgguccugaggccgugcccggacccagugcggcggcagcugcuuggugcugaggcugucagguucucgaagauccgaugccuucagaucuggggcuccggcaucuaccuggguucgaguccuggcccagggcccugggggaucccagugcugcgccgcaggugucugcucuuguggggcaugugcuggucuguagcuccugcagaagagccccaaugugcacauugggaucgaacucagcuuagcccaggauugcuaagcaccuacuguguguagggcacagugccagguguuugggaggcaggaagaaaauauuucuucaugguuuucccgcuuuuggaucucuggaagauuuuauucauucauucauuuacuggccuugcugguugucuaaauaccgagagagucccauguuuuucuccgguacugcugcugcuuuaggggcugcggcccucugaauucuguuacaacuuggaguuaagaucugcuaaguuguuuuuucuuuuguuugagacagggccucacuguguagcccugucuacccuggcacacacuauguagagcaggcuguugaagaauucagaaauccguuuaccucugcggacuaaaaagggcugggguucuggcagaagagaaggcucagugaauugaacagcaugggcuucaggcaggguggggguacacacuuuaauccuagcacccaggaggcagaggcaggccagaguucaaggcuaguaaguugcaggacagccagagguacacagagaaacccugucucagaaaaacaaacaaacaaaaaauucauaccguuucuuguuuacaauucccuagaaguuuuucauuacccuugaaauaaaauuuaaaaguccugacuguggauagacucuugcuuuacccuguucuuuuuguuuuuuuagacaggguuucucugucuaaaccuugcugucuucugaaauuugcuuugagaccaggcuggcugccucuuagucauagauaaccaccugccacuaccucuggaguguuggcauuaaaggccugugcuuccauaucuugccaccuuauucuacucugguuuuuuuuuuguuguuguuguuuuguuuuuguuuuuggagacaggguuucucuguauagccuuggcuguccuggaacucacuuuguaaccaggcuggccuugaacucagaaauccgccugccucugccuccugaaugcugggauuaaagaccugcgccaccacccaccaccgccuggcuucuuauuuuuuuuuaagauuuauuuauuuuuuguaaguacacuguagcugucuucagacacaccagaagagggcaucagaucucauuacagauggaugugagccaccaugugguugcugggauuugaacucaggaccucugucugugcucuuaacugcugagccaucucuccaacaccuccucuccccccuuaccuuauugucauucacuuucccuacauacaauggcucuggugggcuguuuuucucugccaugacaccuuuuuucuaaccaugggccugagcaacuguuucuucuguauggaaugguuuuuguuacacuguuacacugccugccucucuuucaguuuuucaggcaguaccucagagucugucccuguccgcuauuuuguuacaucucuguggguuuuuuuuuuuuuuuuuucuuccacugguuaaaaugaccauuugugggcuggagaaauggcucagugguuaagagcacugacugcucuuccagagguccugaguucaaaucccagcaacaacauggugccucacaaccauccguaauggaagagugacaauguacuuacauauaauaaauaaauaagacaaaaaauuuuuuaaaaaauaugaccauuuguauuuauuaucugccaugcuccccuaugcccacuugaguggaaacucugugagaacaagcauccagauuccucuaccuugcucauaacuuuguuccuaacucugauaacagagcacacgauaaacaauaaaaauccuaauaaaggucgagcggugguggcgcaggccuuuaaucccagcacuugggaggcagaggcaggcaaauuucugaguucgaggccagccuggucuacaaagugaguuccaggccagccagggcuauagagagaaacccugucucgaaaaaacccaaaaaaaaaaaaaaaaaaaaaaaaucccaauaaauacguauugccugaguggcugaggcuggagcucuugauguauuuggacauccggcgucaagucuggugcacuuuguacauucaggguugagcaggcugggguccucugcucugagcccugcuuccuucucagccaucugucuugucacagguuuguucucaugaacaagauggaugaccucaacuugcacuaccgguuucugaacuggcgaaggaggauucgggagauccgagagguccgggccuuccgauaucaggagagguucaagcauauccuuguagauggugacacuuugaggugagcauaggaaacugguucuacccugucccugucaguccuuuuccaggucacagacagggaaagggguguguuagagggugaggaccauuuacacuccacugccaggggcaccccagugccuacaugcauuccuuucugccccucugucaccgggucacugggacuauuguugguguuuuaauuuguuuguuuaguguguucguggggagauggcugucaaaggagguugauucuccuuaggucacaugggacucagggauccaacucugguccuuaggcaaaugccuuuauacaccgggcccucucacugguuuguuuuguuuuugagacagccaggcuguccuaagacuuacaguccuucuccucagcauccccagagcuaagauuacaggcaaguaccaccucagccaucucggcucacucucuucccgucuggcaaggaaagguuccggaaaggcccuguucugucucggaaguucccguggcagauauuggaagcugccagguucugucaugacagugaaucuguguggccugcauccccucaagucugcauuucaaagacugggcacagcagggaggggccuccuauaaggcagcaggcccugucuagggagauccuagagguccgaggucugggccuuccgauaucaggugagguucaagaauauccuuguagauggugacacuuugagguucuguagugucauagguacuacauagucacaaauacuacccuaagggagugggguaaccacccacucgguaucauucuagaccuuugguuuguauuuuuaucuuuucuaucuugaaccuucccugacuccuuccugccuacaucagguacuuuucauccaaagggagaaggaacuagcaucauuuagccugaggggaggagacugaaugacucuuucagucugcaggauuuggaucagcuguuuucuagcuccacugaggacagggcugaaggcaagggccagagugcagcaggaggaauugagguuagacaacacuguggggccccuaaaaagcaauuaggaaagguuguacuuuuuuuuuucuucugaaaaugaagaaacuaggcuguacugaucuaguguggguucgacccuggcuggaagcagugggaagggcacauaagguaccauuaguacucuguguguguguaucugucugucugucuacgcaugcagauuuuuuucccucucuuucuuuucaagacauaguuucucuguaacccuggcuauccuggaacucacucuguagaccaggcuggccccaaacucagagauccuccugucucugccuccugagugcugccaugccuagcuaugcguagauuuccgugaagugugccuugaugagcuagcugucugugguagcccucacaagguugggguuuggaguauuaggacauccucccaacaccugggcuuaccugcuaauagaaccuuucuauauuccuuuaguuaccauggaaauucuggugaaguuggcugcuacguggcgucucgaccccugaccaaggacagcaauuauuuugaggugaucaagcaguaggugggcagaguuggggggcugggguguggugaugggguuggugaagagugaguucauaaagguccucuccuaagaccuggccuugggaggaggugcaggccagcgugacucucuaucugagagacaggugcccuggagucuccucaguccugccuuccugcucugcuguccccuugcccagguagacuuggacccuugucucucuuuccuaaccccuaauauacugguucucagccuuccuaacgcugugacccugaacacaguuccucauguuguggugaccccaaccauaaaauuaugauuguugccacuucauaaguauaauuuugcaauuucuaugguuuuaauguaaacauauauguuuuccaauggucuuagggaaccacuguggaaggguuguuugacccccaaaggggucaugcuccacaggcuaaagacugcuguccuaacagaagcccagaauugauuuugugcuuaacuuauuauuauuguuauuauuuauaaaugccuguguauggguaugugcaugucauuauagcucccauggggacuagaaguuagugucagaucuccaaggagcugggguuacaggugguugugaacuaccugaugcgggucaugggaaccaaacuuagaucagcaccuacuccuggcuggccuggaacucacucugcagaccaggcuggccucgaacucagaaauccaccugccucugccucccgagugcugggauuaaaggcaugcgccgccacuguccagcuagcacguacuauuaacugcucccuaccccuacuguuuuuugaucaggcuggccuugauuuuauagagauccaucugccucugccuccugagugcuggcauuaaaggcaugagccauuaugcccaucuaaagcucaaggaugauugucugaguaaccacaguaaaagucccugccuccccuguucucccugucagguccuacccucucgucccuacuuuggucacccccuuuucccguccuucuccacaaguucauucaguuuucucuuccugugaacugugucuuguucucaucccuucagguaucuaucguggacaguggcguccggggcaccauugcuguggggcuggucccucaguacuacagcuuggaucaccagccuggcugguugccugacuccguagccuaccaugcugaugauggcaagugagugguccuucgcugugggauugaagucugacugugaagaauaagcugccucugaguggucuucuucucuacuuccugucuuggguuuuuucauaagcuacccuugcugguguggacggaagagagggugacaugaauagcaggacacagguggaugcuguuagaguggagcugcugagacgggcugggaggaguaagagcaggcaccaugcauaguucuuucugugucuugugccacucucucuauaggcuguacaacggccgagccaaggggcgccaguucgggucaaagugcaacucuggggaccggaucggcuguggcauugagccuguguccuuugaugugcagacugcccagaucuucuucaccaaaaaugggaaacgggugagugggcaaccccgggaggguucaaguggcuggaaucugccugagggaagagucugauggguuuguucuuaaguccugucuggacacuuccaugcccuggguagucgagacuugauccagaucauaggcucagagcagccagugacuacauccaacaggagcagagaccuaugacuggagggagcgggaaagggcuuguggauguagcucaggcauagccagcaagcucagcugccaugcucagggcucuguguucaguccccagcaguacauacacagggugcugcggcgcucaggagaaucagaaguucaaagucauuuuugcggucuaaugaauucaaggacaguuuggguuacaugggacacauuuguuuuguuuucuguuuuguuuuguuuuugugacaggguuucucuggguagcccuggcuguccuggaacucacucuguagaccaggcugaccucaaacucaaagaucugucugcuucugccucccaggugcugggauuaaaggcaugcgccaccacugccuggcauggggcaccauuuuuaacagaguuuucuuucgggauguggccccugagagccugccuacuuacgcuauuccuguacaugcauaggcaacacuaagucgacucaguggguuuaaacaaggagcaugugaaguuaggagggauacauggugauccuggaggaaaggaacuggaacagagggaauguggguggauuugauccaagcacauuauaugcaugcaugaaauucucaaacaauaaaaauauaaaaagagauggcccagcaguuagacugcucuuccagaggacccagguuugguucuuagcacucauguugccuagcaagcagcucacaagugucuguagcuccaguuccaagggggucugaccccucacacagacuuacaugcaagcaaaacaccagugcacaugaaauucugaguucgaggccagccuggucuacaaagugaguuccaggacagccagggcuacacagagaaacccagucucgaaaagcuaaaaaaaaaaacaaaacaaaaaucauuuuaaaaugggaaaagagaaaaguuaugguguggcuguauuaaguggaggguccggggguuugauuugaauauuuuggcuguuuucuuucuuuuaccucuugagcccuuuacucuucagagaugauuguagcagagagagaaagagagacuuaaaacucucugccucaccuucucuccucccacuguguuggggaagguugcuucucacgccaggcaggagaucagcucccuuugcagccugaguggugugccauggugcugcgguuuucagggcacuuggcagcaaggcuggagguugagacuugccuucaaccuccguggaacuuggagggaaugaauacugagcaauccuaaaacucuacugaaccucagucugugaguguguacgugauaauuaacugguugcaucaucuugggaaggcccuuuugagaguggaugaguucuaggaacgugaaccucacgguagcucucucuuucucucgcucugcggcaggugggcuccaccaucaugcccauguccccagaugggcucuucccagcaguugguaugcauucccugggcgaggagguaaggcugcaccucaaugccgagcugggccgugaggaugacagcgucaugaugguggacaguuacgaggaugaauggggccggcugcaugacgucagagucugugggacgguaaguaguaaguagaaggcccuggauaaacgggcugggaagaacagguuuaggcaucuaagcacauugguauugcuuacagugaggagaaagggcaguaugcauguguguucguucguucuuucuuucuuuccccuccccccucuuccuuccuuccguccuuugucucuuuuuaagauuuauuuauuuuauuucauguauaugaguacacuguaccugggcagaugguugugagccuucauguuguuguugggaauugacuuuuuaggacuuggcccagagcgagugagguugcuccagucaaccucacuugcucugggcggccccgcuugcuccaggccaaagaucgauuuauuauuauaauuaaguacacuguagcugucuuuagauacaccagaagagggcaucaggucucauuacaggugguugugagccaccauguuguuugcugggauuugaacucaggaccuuuggaagagcagucaguacucuuaccuacucagccaucucaccagcccccauguguccauucuuucuuugagacaggaucucauugugucucgaaguccaggcuggccuggaacucaaaucugccuccuggguauugggauuaaaggcuugucaucagccaggcgugguggugccuuuaaucccagcacuugggaggcagaggcagaggcaggcggauuucugaguucgagaccagccuggucuacagagugaguuccaggacagccagggcuacccugucucgaaaaacaaacaaaacaaaacaaaaaaagggcuugccaucaagccuggcuuuuucuucucuuuaucuugauauaccucaggaauguugcuuagucuggccuugaauuugcauucugcccaccuuggccucuuggcaguccugugacacugugcccguacaguggcuuuuguguggccucgggaagugggaguuagggcuuugacaugguucuuggagaccagagcuguguucugagaacaauuccuucuuuccccuucacuugggugggagcucagguugguuguugauucccagaaucaguaugagcagcuuucucuuccuucagugucugaggacugaugugggcgcccacugcuuaugcuuccauuuugccuugauucaagucagcugggcuuucucauuauagaacugaggagcagaggugggccaggguuauucuaggagguuguuguggugucucuguguguguguguguguguguugcuggguauugaacauaccuuuucacaugcuaaaagagucugcuacugagcuguaucugugguucuuuuugugugugugacagggucuuacuaagcugcccugaugguucugaacucaguuugaaacccaggcaggucuugaauuuugaauccacaugccucugccuccaagcaguagggcuggccugcacccaggaccugguuuagggaucuugaauaaacuugucacuaucuucuggcuguuuuguagaagaugacaaggcagaugguugacgagcuugcuuucaaccccuucucuucagaccugcuguagugucucucuggggucugagcugucuugggaagccugagaggggaauccuccacucucucucugcaccucuugcugcauugggaguggauggaugcaaguuaggagucuaacucugaucucuugugagauacucaguccucacagagaacucuccacugcugccucuguguucccagccuggccucuuucucuccaguuugacuaccucaccucaaggcaggcaguuaguuucaagguagccugugauaggaaaacagaagcagugggggguggaagugggucugugaaguucaggguagaaugaguucacacaagguggcagaaagucagcccucugugggcuguguugauggcugcuucccugcuggcccuggggugucagggcugugcugguugggagccaagaccucaguugccccuccuuggcucuucacuccuuucuaucaucguuuuuugacaacauccacagaguugaacuugggccugagccagggccauguuccagcucucaucucugaccucuccucacuguuuuccuggcauccuuucccugccuggaccuguccccgcucuacucccagcuccucccaggcaucuuuucuagcugagguggaauccuguggacauuauaaauagacuuccuuccuucccuccccucagaguccucaguccacuugcauaggaauuuuuucccccuuaagcauagcugcagagucuggcugucuucaaacccucaccucagcucgagauggcugguggguagguccacugcaccaugagcacagggucaucuucagugcacuugggcagcucuuuguuuccaggcagucuccuacuuuaguuagucugugcuggaauucauuauuuagcccaggcuggccuugaacuuguggcaguucuaccauagccuccugaguacugagauuacagaugugaacuaccaugcuuggcuaagcaagaacugucuguuucucuccccaguucucuaguguaucuuuucuuuucuuuucuuuuuuuuuaagauuuauuuauugauuauauguaaguacacuguagcugucuucagacacuccagaagagggagucagaucucguuacggaugguugugagccaccaugugguugcugggauuugaacucuggaccuucggaagagcaguugggugcucuuacccacugagccaucucaccagccccccuuuuuuuuuuuuuuuuuugguuuucgagacaggguuucucuguguagcccuggcuauccuggaacucacuuuguagaccaggcuggccuugaacucagccugccucugccucccaagugcugggaucaaaggcgugcgccaccacacccggccuguaucuuuucauuuauuacauuuauuuauugaaguguguguguguguguaugugugugugugugugugugcacacgugcacgugugcguguacguguggaagucaggacagaugugggagcugguucucgcucucuauuauauggguuccagggauggaauuuugguggucagacuuggcagcaagugccuuuacccacagagccaccucuacagccugaggaaggagucucuugaaggacauaugcccuuuuagguuugccaacugccccaucuuucaaaugaagauaacuugccuggccuccauccucuguucuuuuguaccauccacuguauuuauaaccagagcuguguuguccuagaaggacccaggagaguuuauuccucuaaagauggcuaacauacauuuucugcucuugcuguuggggacccgccauuggauccaaggccuucuccagccugguugacagucucaguacagugcccagaaaccuggagaugugggaaggccucaaaucugacuuaaucucagguuuuucaaaagaacauaaguggaauuucaguugggacaguuuauuuauuuauuugugugugugugcacacaugugcacauaucacgauaugcauguagaguggaugccagagguuaauuugcaggaaucgguuccaucuaccaccauguggguccuggggguccaacccagcucaucaggcuugccagcaagugucuaccugcgagccaucuugucagugcagggcaauuuguuccguuuuguuuuccuuuuuugaguuuuucaagaugggauuucacuguguaguccugacuguccuggaacucacucuguagaccaggcuggccucgaacucagaucucccuaccucuccgucccaaaugcugggauuaaaggugugagccaccacugcccgacuugcagggcaauuuguguaugugcaggacaauuagcaucauuaggucccagucacagcucugacugguaugacagcccagcauaagcacccauauuuccaaacaucuucugguucuguagaguagucccagagagaagggaagggauuugcugcaguugucagucagucaguggauaggaaaagcagcccugggagucaucccuuggccugucugugcccuuuuugacaguuuaauacugauggucccugacugaagguuuuucauuugugauugauuguaugagaacuguacauauuucagcagaagccauacuuggacugagcacaggguccccaauggaggaguuaaagaaaggacugaaagagcugaagggguuugcaacuuguauuagucaggguucucuagagucacagaacuuauggauagucucuagauaguaaaggaauuuauugaugacuuacagucagcagcccaauucccaacaaugauucagucgcagcugugaauggaaguccaaggaucuagcaguuacucagucucacgcagcaagcaggugaaggagcaagagcaagagcuagacucucuucuuccaauguccuuauauugucuccagcagaagguguagcccagauuaaagguguguuccaccacaccuuuaaucccagaugaaaaucguagcccagauuaaagguguguuccuuaaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuauuccucguacaaucgcaaacgcauuaguaaauugacaaugggcauucauauuacuuuauaauccucguuucugcaacugguuacguggccuuaauugguauuuauaacuaccuuccucuacuacccauucuguauuuccuucuccuucagccaguaccucagcaggucuuggcucuuuuccuggaggauugacccauaccuucauuccugaugggucugcgucauuugucauccugcuuggauuaggcuguuguaguuucccauuauuuagacauagucucacuuuguagccuggcuggccuggaacucucuaugugaccaggauggcuaccuggauggcucacagggauccuccagcuucugucuccugaaugcugggauugaaagugguggcgcacgccuuuaauccuagcacuugggagguagaggcaggcagauuucugaguucgaggccagccuggucuacagaguaaguuccagggcagccaaaaaaccaaaaaaccaaaaaaaaaaaaaaaaaagcagaugucacccugcuaggcuauagcucagauuucgaagcuugagcauuuuaguggucaagcacuugccucacaugcaugaauuccucaguccauucaaucccuagugcugcaaagggagaagaaguagguuggaaguuugaucuuuuccccagguagugguauuggacauuggcuacagcugcagcuuccuaucaacugcuaacacaagaggaaucagcuggcacacugagcaacgcaccgcauguagugcuccguuggucaucuauaggcaguguucuuuguuuugguuuugguuucucuagacaggguuucucuguguagcccuggcuguccuggaacucacuguguagacagagaucugccugccucugucuuccugagcgcuaggauuaaaguuguccccuucccauagccuagccagugcucucucucucucuuccuuauuccuuucucuuuuucuugcuuuucuggaggcagugucucauguaacucaggcuagccuugaccuaauccuccugccuccaccucugagugcugggacuaugaccacaccugcuuuguuuuuuguuuuuuuuuuuaauuuuuuucuaauuuuauuuauucauuauauguaaguacacuguagcugucuucagacacuccagaagagggcgucagaucccguuacggaugguugugagccaccaugugguugcuggaauuugaacuccugaccuucggaagagcagucgggugcucuuacccacugagccaucucaccagccccacaccugcuuuguaaugauggcuggggaucaaacucaggacuuccugagugcuagcagauacuuccaacuaagcuacacugccugccugccugccuuccuuucuuccuuccuugguguuuugccuguguauauauuuguaccaugugugugccugcugcccuuggaggucagagagggcaaugaaucccuggaacuggaguuacagaugguugugaaacaauaugagggugcugggaacuggaccuguguuguuuggaagagcagcaagugcuuuuaauugcugggccaucucuagcccagauguagcucuuuuuggguaaauucuucccuuaccuucuguggccucauuuucccuccuuuuaaagaaaccccagguucccuugcccugggaggacugaggguggugaagaauugcuguugcucccagggccugcaaagugaggauuugcagggccugaaggggguugugggucugucuguacaucuggguuagauuaauuucgucuuuguucacucuucaugguuuuuggcacuccuaaaguggcagcuuugguacacaacaagagggaauccuccguaggcucaacucaagaggagacuguguuggggccugagcugggagcuuguacuugauuccucuuucaguuacuucugagacuucugggcuugguccuuuugaaaagaaucagggucucuucuggccagugguggaagagugggaaucagcaagaccaaagagugcaggagaucacggagugccgacuaaauucugaucugcagcuucagugaaguacuaguuggucagcaguaacgguguugcugcugcuggagggucccuuguccucaguuaggaugcacacgagggagggaucauuggggcuguaguucguucagugauagacuguucagcucuccugcacagagcucuggguuugauacccagcauuacaaacauccaaccugcuuggccuaaggauuguccuagugggagguacaaggucauguccauugugguuggugguugcaauagaaccgauccccauuuccugacagaauguguguucucaucaacuggggugucaggcuccuucgacacccugaucacucacucacuucauuuuaucuuucuaccuaauuuugacaaucccauuucacugaugaagcaauuaaggcuuacagaggugaacauacgcuguucaagcuuagugcaacuaagcaauauuaggguuugaacuuucaaacuaagaggcaacugaggcuuagacugaaggaccaagccugcagaucucggcagcuugaaacucuagaagccagaccuacagguucccgaguguggugcccagaagggaucugccagggagugguucccugcuccagccacugcugacggcucaggaggacuugcugagagcaggagagcagccuaugguucggaguagcugcccuggguugggauggaucuacuuuugaagagggccuggugcucagagcuagggugucagcacagggccucugugcucaucuggagcuggugggcguggguugaaguuccaugucagggcaggucauccucauggccuccugcccuuaggaaguauccccacccugucagaacugcagcagaugccuucugugggcugaggcugaaggaacacuggggcggguuuuucccaagauucaggauuuggaugggccgucuuuuggccaugaacuagagaacacccuguuucccacauagagaggccaguuggauaggaugggucaagggcagcuguggguuccucauccaccucuguggugcuggguggaguagaucauaggcugcuugauagaugaggguaauaagcaccaaugcacacuucuccuggcuguggcggcuggggagcacuuuaaacgcuacagucagaguacaggggugggucuggcuuuuccccaucuguccucacuugcauguagaguaugggaggguaaacuuggcgguucuggugcugaguggaaugagaucuucucugaagggaguugaguagugcuggcuucugcaggagcugccccaggcccucauacuggugcaggcugguugaggcaggcagguugaguuguagagcugucaguggggugaggccaccaucuuaagccuuguuagggguuaguggagaaggccccagugagggugcuuuuuguauggcugcagggcugggaggauaaaguugagggcaguuggauuaauuaaaagagaauuaaggaauccuaggugaugguaggugcaugagaggagauggacugaagcauagcuccacuguuaccauggcauccuauaggcaagaccuggauuggggguugcuacccugcugugugcaggcaagaccuugugggacccgaagagcccaaccugucacuugucucucuucucugacauucacaccccaugccagccugaaugaagguugggaacagagggccugccaucuguuucuacuuuggccuuugcccaugugaaaugaaagguagaguugcuaucucuggguucuuggcucccucgagcaaugaaugacccagcaaugaauagcucuguucagagccaaguagagcagaucuugagaaacuaugucagucccaucugugcagaaucagugucugagccuauccccucuccccugaguucuacacaucccuguucucaguaagcaucccgaaaaggcugcuggguuccagagggaaggcuggcuugggguuguucaggaaauggauguucuagccuagaccccccagugagcuuccuggcaguguaccucuggauccccaugcgauucuccagagucccugacaguggcucugaaggaagcaagaagcaucucacaccaaccaccuuguuuccccgacauccuuguccucugccugucuagaacuuggaguccacuuugccuuuugaacccuuucccuuuuauccagggguauugucagacccagaacacuggcacccaagauacuuuggacucagugucaucaccugaugcuugucucuugcccugcagcugcuggaguauuuggggaagggcaagagcaucguggauguggggcuggcucaggcucggcacccacugagcacccgcagccauuacuuugagguggagauuguggauccuggagagaagugcuauaucgccuuggggcuggcccggaagguggguaggcaugcuguguuucucccuguaggauugcucaguguggggcuauugggaaaaccugcucaaggagccuguagagggaaguucugagcugaggcagagcacaguucuaaguaucuguuuaguggacagaccuuguagcaguguccugagcaucauccacccuggucuugaaacugagccccuuccugucccccuugcugcuguagcccccaguuuguggcugugggucgccagccaucugugaugucacacauucccuuugucuuccugcugcaggauuaucccaagaacagacacccuggcuggagcagagggucuguggccuaccacgcaggugaguggaagcugcuggaacgggcuggggagacagggugcagagucgccuguucugcucacauaccuguggacucucucuccucuuuucaagcugcucagguuuucccuucaucuuauuuuuuucucucagcccugagagccagaggcacaggacuguggcaggagaacugagcccagagcggccauugcaggccucugaccuggcuccccugccccuccaccccccuugaagaucuacagagcccuugguugcuuuuguuuugggucugauuuccuguagagcuuucuugaauacugagccuuggugccugggcccuccccucagcacccuuucaccccaccugaucauccacucuagggacccucuccuuucuucucgcagcuccucaaucaaaugaacacuguguucuuuuuaaaagccuaagguucuuccugcaucucccucucaucuuugucuuguucugaggauguagaauuagccuuucaaguguguccuuuccccucccuucaacagaugacgggaagaucuuccauggcaguggugugggggaccccuuugggccacgcugcuacaaaggagacauuaugggcuguggaaucauguucccccgggacuacauucuggacagcgagggugagugaggcugggcagcagccagacugcuccgggcaguagacaguaccacaggagcucacguuuccugucuccuaggggauagugaugacaguugugacacagugaucuuguccccgacugcccgggcuguccggaacguccgaaaugucauguaccugcaccaggaaggggaagaggaagaggaggaagaggaggaagaggaggauggggaagagaucgagcaggagcaugagggcaagaagguggugguaaguggggagguguggguucccucugggcuccuggggcugaggcggggagggggggggcagggacugggaggcagggucaggagcucacaggagagcccaggcuggaguccuggucuauuuuccagccucagcacacccucugguggcugcuuuccacagcacugcagugacuccuaaagcccauguuuaggaaguuguggguuuggggcuucaugucugagucaccccaguauccccagagaaggggccagagcgcacccucuucuccacauccuagggaggugccaggcccauccucauccgcucuccccacccccacuccaggucuucuucacucggaauggcaagaucaucgggaagaaggaugcuguugugccgucuggagguuucuuuccuaccauuggcaugcucaguuguggggagaaagugaaaguagaccugcaccccuugaguggcuaguggggucaccaguccaucugcccucuccgucugcauuuucucucacagcaggcccugggagggcauccccaguuucugucagcucaggcugcaccucucugucucugggccugagagcaguggugggcccagagggcaguauugauaugaaugggaggagccccuugaucggguuaaucgguccuggaucuucuuucaccucgcugggcguugagcaaacugggagguauaagcccaccugcugaccugauugguauggugcucugccgagggugagggucgaguagaggcagucugucccugucuaccacagcuccccgaauucucuucauccccucuccucauguaagccaguugcugcugucucccccuggcugggcuagggggccugucuuggccaucucuccuuucacuggcugcuguccuaaaacacaucuagggucuccauuguuuucugagagauggucccacccucaacccacagcagaaagccugaacuuggcuuccugccugcucacacgcaacugugugugugugugagagagagaggggcugugugguagcgugggacuucagccuuugcugccaucuccuugucugcacucuucuucaaagcaccucuagcccuggcuccccaggauggagccaaggcaccggggcauguguuguauuguggcuguuugcccagagcagcagcuuggccccuucuuucucuucaccuacccaccccccacccugugccccagcuugcugcuugugccaguugacguuucugcuccaguguuugauucuagugucuauauagaccccccaaccagccccccucuucccguuuccugagcuccuccaucccaucaacagggagagaagcagccggagcucuuggucucaguuugcacaguggguagggcuggggaggggguuuguugucgugcugcuggggcuccccuugccccucguuucgggcccugcacuaugauauaugaaauguauguacagaucagagauguuuauacagccaauaaagacggaguuuccguauuuaucaggacagacggaaggggaauccuucccagggcgaguaggugggggcaacugugggcccgucaggccagcaaagguacgucucugggagacuuuuuuuuucuucuuccuaugaagaagguaucaacuccucaaaaguuuauagaaauucuuuauuauuacacaaaaauagacucucuuuuucccucuguuuaugugaccccacucuggucucuguguggagggaaggcaggaagcuuucaagcuucucccaucccuccaugaugggcccuggagcuggguggagcuggcagggucauuccccuccagggcuccacuacugacaccuccucaccccccucacaccugucucugccaucugcucacaugccaggucaccuuaggggcccacucacucagcuuagcaggcaagggcaggaaagagcaguggcccagaugcugccacucccucuuucacaggggccaggccaggguagugagcgcuguggaugcugggagggugcagugugggugugcacucggagcuuguggcuuuccuucauuuccucuggcccaguagaacuuuggugaugaaggugacaauggcacuugccgguugguccgggucaagcuccgcaaagaggugacacacauuuucccagggacuuccuggcuucuuggccacgaaaccaaagauccugc

SEQ ID NO: 8026 - RNA, 5736 nt, Mus musculus
agcuccggggucuccgaggguuucuacauuuacucaagguguauucuucauaaagcagucuucauucuacccccagcagccccagcuuuuccuauuauugucucuaaggcuaggucuugcguuuuuaugguuuuguuuuucacagacacaggccaggagucuuuauuuuaccuuccccguuugcuuuaccaacucucucugggucuguuucuuacccuccgugggagcuucugcccauaugccugacaucuuuccuagcguuuauacacaucucuuucacgaugcacagucccuccgacccccaaucuccacccccauacuaucccuucucgggucaccuuuaucaccgucccccaccccaauauucucacacuaucuacagguuccucaucuuccugcacauacacucaugcuaacuggauuucacgguucaccuucucuguccuccccuuuacuccucccuacuccacaaucccuuuagccagauguacagcucccaaauuccgggcgagauucccaggaacaaagcaagaaaaaaacaucagaacaauuugggaaguaaacagcggcggagaagaagggagggaaaagccggguggacccagguggguggcccuccaguccacccaguuaagggacugccuuuuuccccucccccuucaccuggcuuuuaaggggccgggcccagaccucugcuucuuaaagaggagcccgcagcagcagcugcacuggacucucuggaaggaguguacagggcaaaaacucugaccaugaccugggaugggcugcccacgcagccgcugcucaugcugcuaaugcuguuguucgcugcgggcucaggguccgccuuagcggggugccccggcugcggcgcugggaugcagacugguugucgcgggggcugcguggaggaggaagacgcgggaucgccugcagacggcuguacagaagccggaggcugucucaggagagagggacaaccgugcggggucuacagcccuaagugcgccccaggacugcagugccaaccccgagagaacgaagaggcgccuuugcgggcgcugcuaaucggccagggccgcugucaacgcgccagagggccgucgggugaguccaugucuccccccucccuccccgcuucccaccugccuaccugagauaggagaagcaagucucuccugguaggaaucuggacagaugcagguugggcagccucuucaagccucugggaccggcccauugguucuuccugggccuugaguggaacgugaaguggaaacgucaggggacagcuauaaggcugauaggggcaccuuagaauaagcaagagagaugucugaauucuccucugcucucccuuucccuuaucuauuuucuccaaagggaaagagacguauguaggcggaggauggaggauuugaguuucagcuuuccucuauaccccgcagggucaacgccauggcucuccaggcucacacuggagacaggaccuagauuccuuauggaggaggaggaaagggaaucucaaacucuaguuccacacacuaagaaaugucuccugcuccuccuucagugccacugugaacggcagugggcaucgggagcaucggcaccgggggaguaaacacagugggcagcgggcaccggggguagcaggcacugcagacggugggcacgggggcaguggacaccggggcagugagcaggcccuagagggccuggggagggcugaagaagugggaagagaaggaaucugccaaaucagacuuaugauuuaaaccugguaggaauuggaugcccuccagccccacccuaucccagggaugaacacagaagacugagucauugggugggugggacuagagugagucagcaccccaaagaugggggugaagagcaacgggagauggaagauagcaagucccugguuuuuccauagaaagggaugagaaaugaauuuggaucauuuggcagugcaggccugccauuccagugcuuagggguggaggcgggaaggucagucagugucagccuuggcuacauaaucucaggccagccuacacacacacacacaccauacacacagaggcacacacauacacacacaugcacacacaugcacacaugaauauauacacaagaauacaugcaugcaugcacauacacacauacacgcaugcacgcacaugcauacaugaguccccccacaugugcauuggcacauacgcaugcacauacauauauacacacaugagcacacacaagcacacacauacacacaggaacacacacgagcacacuggagugagggguugaagcuccaguuucuagugucagagcucaggguucuagggcuccucugagaagguguguuuugguuggagaaggcaguuugaagcaucaucccaguuuggcauuaaauggggggagugagggacaaggucugaggaagauaugguacccagacagacaacagcguugacacugcagagggaacggaguaagaacaugugugagcuuaucuuuuggcauguugcgucagcucagccuuuuccuagcuauggcuuacuugcguccugagcuuuucccaggaccccagaagcucuccagagccagaugcacccugcagguuggaaaccuuuuauuuucugccccuucugcaaccuucaauuuguccugguuaaggguugaacccaagcguuccuagaccacuaggguugagcugagacaaaaaaggaagagguccccauguuuuuugguuuuuuuguuuuuuuguuuuuuuuguuuuuuuuuuuuuuuuuuuggagacaggguuucccuguguagcccuggcuguccuggaacucacucuguagaccaggcuggccucgaacucagaaaucugccugccucugccucccaagugcugggauuaaaggcgugcgccacaacugccggguuguuguuuuuuuuuaagauuuauuuauuuauuauauguaaguacgcuguagcugucuuuagacacaccagaagaggacgucagaucucguuacggaugguugugagccaccaugugguugcugggacuugaacacuggaccuuuggaagagcagucggguacucuuacccacugagccaucacaccagcaagagguccccauguaaggcccucaaaguaacaucucagggcugggagggguggacugacuuacugaggggucaugucagggacauuccacuggauccuuauugacacccucuuaucucccccccacacacacacacaccucacacacacuguacaaauccacuguucuuuugcccaucuuucugggcuggugugcccucuucuggccucuaguggaauaggcaggucuuuucaaaggaauccugaagguugaaaauauccaacacuacuuuguacucaugggauuugggggaggguuguggggggugagacggguucuccauguagcccugacuauccuggaaaucacuuuguagaccagacuggcauuaaacucacaaaucugccugccucugccuccugagugcugggacaaaggcauacgccacuaucagcuaggauuuuauuuuuauuucacauguguggguguuuugccagcaaguaugucugucuguaugaguaugucuguguaccacauggcuacacagggguaccacagguuacaaaugggguuggauucccaguaacuagaguuacaaacagcuguuaugagacaccgugagggugcugaggaauugaacucugguccccuggaagaguagccagugcucuuaacugcugagccaucuuuucagcuccuguugaauagacuagacuggccauggaccugugacaguucucuuaccuaggcuucccaagugcugggauuauagguacacaccaccauacccagcaguauaguuuguuagagggagaaauugcaguuaggguaaagccaggagagacugaauccuucagucccucucacuuuacugguagaaguggaccuagguuccgaggcugcuggucucugcucugacugaucucugauuuccccucccacucuuccuguggccacagaggagacuacaaaggagagcaaaccccaaggaggugccucccgcucucgugacacaaaccacagagaccggcagaagaauccacggaccucugcugccccuauacggcccaauccuguucaagauagugagauggugcgugggggggugguagggaaggcagagggcuggagauuuccacuggacucaaggaagucuggaccaggcaggcuccuagaauccugaguaccgcccucacccaccccuguccuucucuagggccccugccgcagacacuuggauucaguacugcagcagcuccagacugaggucuuccgaggcggagcacgugggcucuaugugccaaacugugaccucagaggcuucuaccgaaagcagcaggugagaagaagcugccuguccucugugcaagcucugugcgcggcagugaggaaggguacuugaugcaaagcugcaaaaaggaugcugguucugcuggagcaugucuccaaaaacaacagccaggugguggagagaggcagguggaucucugugaguucgaggccagccuggucuauguagugaguuccaggacagccggagcuacacagagaaacccugucuggaaaaaccaaaaccagccaaacagcaaccaaaaaaaggauggauacacacacacacacacacacacacacaaaacuauuucuuccaauuuuaagacccacauagauaugaaaaacaucaggaagauuguaacuucaagacuugccuaggcuacaagugaagggcugguaggaagacagagggcuggagauuuccacaggagaucuuuccauggacuugaggaagccuggaccaggcaggcuccuagaauucugagugaguucaaguccagccugggaaauuucacgagccucugucucaaaacaaaauguaaaaugaaaagaaguuuauagcucguuggcaaagcucugcuuagcaguacugugggcuccaucucuagcgugaucugaaagaaaaacaaaggccaacaauugcaaugggagacuuaaagucucuucuaggauaaggccuugugguggccucaaaugggagcccuggggaaucaccuggaggcgucugagcuggugcugguggagccccuucugcauuuugugacucaguaggucugggcuagccugugaacacaaguuucuaacauaagugauguugggcuguugacagaaacugcauuuugaaagcuauugcucuggccuagcagagugggcccuauucaguagguaaagcaacuaagagcucucagaugcuuuccugcucaaagccuggaccucacccugaccugcaccucucuccccagugucguuccucgcaggggaaucgccguggccccugcugguguguggauccgaugggccagccuuugccagugucuccagauggucaaggaagcacucagugcucugccaggagcagugggugaagccccgagggagccuccaggacgccagcaggaacagggggcugucauuugagcuguaugugaagcaaugaauaacucugugccccaagacccaccuucacgccccaccccauugucccugucacccuugggccuuuacacagcuaguuagaaagauugcuguuggcuuguguacuaauaaaacaguauugggggggugucucuggcuuac

SEQ ID NO: 8027 - RNA, 2303 nt, Mus musculus
cgucacgugacggggcuaucauggcggcggccacgagccagcccggcucccggaagcaggcugugaggggcgggcgcgcugcuggaacccgagcggagccggagccagugcggggagggcggcccggcggccuggagccggacguguccggagcgucccggcagaccggggcagcaggugagaugggggccgggcgaggugcgagcggaugaggggacgcucggcugaggcuagggggcgcaaggagggucagccgugacccauagccggggaaccugcggugcgcgcgcgugaccgcgaagcauuggagaggccggcccgggcggaagggaugcucgggaauagauguggagacacugagcuccaaaacuggcuuaucagcgaggaugggagguacaagaagccugcagaaccuaucauggagaugggcaguagccccuuuugaacuugagggaccgagauuacugaaaggaguccccuuugcuguaccaggcaaggguggagcgagugcucuggccucuccccacugucacccucccccgccccacugaguccuaggagacagccacuccucccacccacccaacuggucccuccagucucagcucugggggagagaaauugacagugcaguuggguggaguugcccucugcuuagacaccuaacuccucgacugugcuaccuggauuauggaugugacuguggccaucguucucuccccaggucguccgggggcccaucaugcuggugacugccuauuugucuuuugugggccuccuggccuccugccugggucuggagcugucaagaugcagagccaggcccccuggaagagcuugcagcaaccccuccuuccuucaguuucaacuagacuucuaucaagucuacuuucuggcccuggcagcggacuggcuccaagcucccuaccuguauaaacucuaucagcauuaccacuuccuggagggucagauugcuauccucuacgucuguggccuugccuccacgguccucuuuggccuaguggccuccucccuuguggacuggcugggucguaagaagucuuguguccucuucucccucacuuacucucuauguugcauaaccaagcucucucaggacuacuucgugcugcuggugggccgagcacucggugggcuguccacagcucuccucuucucagccuuugaggccugguacauccacgagcacguggagaggcaugacuuccccgccgaguggaucccagccaccuuugcccgagccgccuucuggaaccacgugcuggcuguggcggcugguguggcagcggaggccguggcuaguuggauagggcuggggccggucgcacccuuuguggcugccaucccucuucuggcucugacuggggccuuggcucuacgaaacuggggagagaauuaugaccgucagcgugccuucuccaagaccugugcuggaggccugcgcugccugcugucugaccgccggguguugcuguugggugucauacaagcgcuguuugagagugucaucuuuaucuuugucuuccucuggacaccugugcuagacccacacggagccccacugggcauuguguucuccagcuucauggcugccagccuucuggguucuucgcuguaccgcaucgcuaccuccaagagguaccaccuucagcccaugcaccugcuuucccuugcuguccucauugucgucuucucucucuucauguugacuuucuccaccagcccaggccaagaaaauccuguggaguccuucauugccuuuuuacuuauugaguuggccugcgggcucuacuuucccaguaugagcuuccugcgaaggaaagugauccccgagacagagcaggccgggguucucaauugguuccgagugccccugcauuugcuggccugucuagggcuccuuguccuccacgacagcgaucggaaaacaggcaccaggaauauguuuagcaucugcucugccgucauggugacgacucugcuggcaguggcaggacucuucaccguggugagacacgacgcugaguugcgggugcccucacccaccggggagcccuacgccccugaacuuugauccuccaggacaaggggucugagaugggcucuggaacacacccaccuacccaugacuugcuuugugacucuguccugcagccccucuugccagugcucuguauugggaaggacaugggggugacagacuggaaaggugccaaaagcugacaguguacucccuucuccuugcuguguaaaaauaaacacuucuaauggaugugacucac

SEQ ID NO: 8028 - RNA, 2303 nt, Mus musculus
gugagucacauccauuagaaguguuuauuuuuacacagcaaggagaagggaguacacugucagcuuuuggcaccuuuccagucugucacccccauguccuucccaauacagagcacuggcaagaggggcugcaggacagagucacaaagcaagucauggguagguggguguguuccagagcccaucucagaccccuuguccuggaggaucaaaguucaggggcguagggcuccccggugggugagggcacccgcaacucagcgucgugucucaccacggugaagaguccugccacugccagcagagucgucaccaugacggcagagcagaugcuaaacauauuccuggugccuguuuuccgaucgcugucguggaggacaaggagcccuagacaggccagcaaaugcaggggcacucggaaccaauugagaaccccggccugcucugucucggggaucacuuuccuucgcaggaagcucauacugggaaaguagagcccgcaggccaacucaauaaguaaaaaggcaaugaaggacuccacaggauuuucuuggccugggcugguggagaaagucaacaugaagagagagaagacgacaaugaggacagcaagggaaagcaggugcaugggcugaaggugguaccucuuggagguagcgaugcgguacagcgaagaacccagaaggcuggcagccaugaagcuggagaacacaaugcccaguggggcuccgugugggucuagcacagguguccagaggaagacaaagauaaagaugacacucucaaacagcgcuuguaugacacccaacagcaacacccggcggucagacagcaggcagcgcaggccuccagcacaggucuuggagaaggcacgcugacggucauaauucucuccccaguuucguagagccaaggccccagucagagccagaagagggauggcagccacaaagggugcgaccggccccagcccuauccaacuagccacggccuccgcugccacaccagccgccacagccagcacgugguuccagaaggcggcucgggcaaagguggcugggauccacucggcggggaagucaugccucuccacgugcucguggauguaccaggccucaaaggcugagaagaggagagcuguggacagcccaccgagugcucggcccaccagcagcacgaaguaguccugagagagcuugguuaugcaacauagagaguaagugagggagaagaggacacaagacuucuuacgacccagccaguccacaagggaggaggccacuaggccaaagaggaccguggaggcaaggccacagacguagaggauagcaaucugacccuccaggaagugguaaugcugauagaguuuauacagguagggagcuuggagccaguccgcugccagggccagaaaguagacuugauagaagucuaguugaaacugaaggaaggagggguugcugcaagcucuuccagggggccuggcucugcaucuugacagcuccagacccaggcaggaggccaggaggcccacaaaagacaaauaggcagucaccagcaugaugggcccccggacgaccuggggagagaacgauggccacagucacauccauaauccagguagcacagucgaggaguuaggugucuaagcagagggcaacuccacccaacugcacugucaauuucucucccccagagcugagacuggagggaccaguugggugggugggaggaguggcugucuccuaggacucaguggggcgggggagggugacaguggggagaggccagagcacucgcuccacccuugccugguacagcaaaggggacuccuuucaguaaucucggucccucaaguucaaaaggggcuacugcccaucuccaugauagguucugcaggcuucuuguaccucccauccucgcugauaagccaguuuuggagcucagugucuccacaucuauucccgagcaucccuuccgcccgggccggccucuccaaugcuucgcggucacgcgcgcgcaccgcagguuccccggcuaugggucacggcugacccuccuugcgcccccuagccucagccgagcguccccucauccgcucgcaccucgcccggcccccaucucaccugcugccccggucugccgggacgcuccggacacguccggcuccaggccgccgggccgcccuccccgcacuggcuccggcuccgcucggguuccagcagcgcgcccgccccucacagccugcuuccgggagccgggcuggcucguggccgccgccaugauagccccgucacgugacg

SEQ ID NO: 8029 - RNA, 717 nt, Mus musculus
caacucuggaccggaaagacucugggacacagucuccuucuucaaccucagucaauuacagucauuucgcaguuggguggucaaucacuaagucuuucuugccuuuauucccugagcucaggcaggauuuuaaauuucaagagaauuaaaauaagaaacccacauggcuugcuuugcguuacuaggaaagaaaagguguaauagccuuugauguauuuuuuuguuuuuauuuuuguuuuuugagacugguucucacuacgugauccuagcuguccuggaacuugcuaaauagaccaggcuggccucuaagagagauccaccugccuaaugcugggguugaagguguacaccaccacacagggucuuugggauucuuuaaaacucugacuuuguggagagggacacugaaaagggugcagggacaaccuccggguucuccuagguucuccucccucccaaguuuggauuccagccuacaucuuacauggguuguauaagaaaggcuauagaguugagugaagaguaaagggaagaauucauugugaacguucacagucuuuuguuuuguuuguuuuuugaaacaggguucaaaauacugagcguagggauuucugaguuccaggacagccagggcuacacagagaagcccugucucaggaaaaaucaaaagaaagaaagaaagaaagaaagaaagaaagagagagagagagagagaga

SEQ ID NO: 8030 - RNA, 12515 nt, Mus musculus
uccugguaaaugaguggaaacaagaaaaacuuuauuuacaagugggaaugaggggagugggguugagcagaugauuguccuggaagagggucccaaggagcagagguuggugaugucucaguaaauaguggcacuucaugaauagagccucccccuccagcuggaggcuccugggcucgaccaaguacugggcuaaagcguggaaacugagcauugacaaaguacagagguaugugggugauucggccuguggaccagcacugcagagaaugagaaagaaaggcgucaccaucugggccuccagcuguccugaagacaccugcacgugcacacacacaugugcacgugcauacacacacacacacacacacacacacacagccuagccgacucaccacacuaagcaaggccccuuuguugaaggaaggauggaaagugaugagcugagcuugggcuccugguucccccugaauaauaccacuucggcaaaaagaagaagaggugagaagacaaaagguggcuggaugugggaaggucuuuguggccagccccaaugucagcuugcacuuaccagggaagcaguucaaacacggggcuguuucgaguucgaaaaaggaggaugacaggauucccguccugaaccuguggguuuccuguaagaaauggaucagccaauacaggggacucuggaaacagagucccagaggcagagaacagcagccggggugcugucaagaucuauuaggcuguggcuuaggaaagcccuuugucuaguugaguguauuggcacacaccuuuaauaccagcacgggcagacaaaacagguggaccugugaguucaaggccagccugagguacacagugaauuccaggacagccagggcuacacagugaccuuuucucaaagaaagacagcccauucauucucucugcuccuuaccuuucaugagcacagccagacguucaccacuugggucccacaccauggagugggccucucccccgagucuguaacaggacaagcauugaguguggcucauucccacuucaucccuccucccacagcuacucagacucaccucuccucuccaucuggggucugaauuguugucucagaaagaucugcuacgaugguugcugacuuugcaccuccaacauguccuuucccuguuccuguaagcaguguucuuggcuuaugugcuucccuucagcccucagugcccuauaacugcuaucuuccucugaccaccccagagagucugcauucugaaauguccuaacucaccacaucguucugggaaugacaaggaauaaauuaaugcuucccccaauacagugaacagcagucgguuuccaucuggacuccagcagccagucuggggacaggaaggaaaagauaggagauggaucuacaggagggcuaaagcaggggagaagaugaggagccauagguccaggcccaggggaauucccuucccuuccucccagcuucugugaauccauacaguccucacuuaccuggcagcgcccugaaagaguuggccacgccucacaaguccacaucugggccucccagacucuaaaccaaagaaagccagauuacagcagggccuucaggcuccaccccuggacuggccgggaagugaagugcccuucucuggguucuucccucacuccccuagcuuuucgccuacucaccuaaagacggcagaaggaguaguagccaggacuuugcugccaucuggggaccacagcagauugguaaccccuccuccucggaaccaaggaagggggacacaagucucuguugaaacgucccauaccugagauagagggaacucaguacagaaacucaaaagauuaucaagcaacucauggugggcuacccauuuauguacacaaauccccagagaaggggaagcagcaagaaaccagacuacucgacauaaagaccuauguuuaagaucacagugauagcuggcagagcucagcugaaacucugaagacaaacaacaaccacacugccucacacuuucuaccaccagguaaggaaggcucuugucugaggggugggaaccaacucaccagaauaacagcaucuacaggugaggcugagagcagccaccccccauugggggcccaagccaagcuagugacuggugugugcccagggugagacaacaccugggcgcagccagaggagggucugccagggauaaacaaaaggauguggugagaaaacaguaaacaaacaaaugcauugggggagggggggcugaugacugugagaacacuugcugccuuugaucccagcacucacugcgggugcucacacccucuaaguccagcccagaggucgaugcccucucgcacuuccaucaccaagugcuguuucagagccauggccuggguucuccccuuuccacccagcaguaaccccuuuuagcugccaugaggcccaggucacugacagaaacucagucaucucugggcuccaguucacuguuaauggcuccacucuccuuguagccugcuccucagaccucuucaaaugcacauuagauuguccauauggcacauugcccaaccuuugacuuuguuauuguauuuaucuauaaauauguauuuuauaacacguuauauauuauauaaaauauggcacugaauacauguuauauaaaaguauaauauguaauauauuaaguguauuuuaaauauauuuuauauguuaaacauuuuauauuagcugggcaugguggcacacgccuuuaauccuagcacucgagaggcagaggcaggcggauuucugaguugaggccagccuggucuacaaagugaguuccaggacagccagggcuauacagagaaacccugucucaaaaaaaccaaaaaaaaaaaaaaauuaaaaaaauuauauuaaauagaucauauauauauauauauauguguauguauauguauuauaaaaguucuaucuuaggaaaccacaguggacauauagaaccacucccaaacgcugcucucugggcuguaaguugcacucuggcaucucuggauucaagcucagccugaucuacagagcgaguuccaggacagccaggcuacacagagaacccugucucaaaaacacaaaacaacaaaaaguugucuaugaccaccacaugagugcacacauagauuaaaaaaaaauuaaacgccgggcggugguggagcacgccuuuaauggcagcacgccuuuaaugacagccaugacuauacagagaaacccugucucgaaaaaaaaaaaauuaaaaaaauuaaaaauuuggagagaugcacuuaagagucuguaccauuuuuccuaagaaccaaaguuugauucccaguacauaugucuggcagcuuauaaaugucuguaucuccaguuccacuaguuucugugggcaguuacacucaugugcacacacacacacauauguaauuaaaaauacaucuuuuacugauuuauauguuugguugcuuugcaugcaugcuugucagugcccauguguaugcagugcccaugauggacagaagggggcaucacguuuccugaaccucuuauccccagcaccaacuccaagucccucagauauaaacauuuuaaagggcagccugucuuuuguagcaucacugcuacaagaauuguuacucuuccaucaaacuuugcuggcuucucccuaaaagaaauucuaauuuccuaggaaaggggcuggagauauggcuauguggauaagagcacuggcugcucuuccagaggauacagguugguuugauucccagcucccacauggugguucacaaccaucugcaacuccagccccaggguacaucaccuucuucuggcuucccuaggcacugcaugcacaugguaugcagacauacaccuauacacauacauuuuuaagaaguaaaauaaaccucacuauaaaaaauuucccaaaagaagcagggugugcaguacacuccuuucacuugagagggagaggcaggagggucaagaguuaaaagccagccuuaucuauauguaaguugguggucagaguugccuaauuaaacccugccucaaaaacaaccaaagacacaugacucaguauuaccagugccaauguuuugugccauucuguacaauuaaaaagacuuuuuuucccuaaauaacuauaacucaagacagaacauuaugggcgugguggugcaugccuuuaaucccagcacuugggaggcagagacaggcagauuucugaguucgaggccagccuggucuacaaagugaauuccaggacagccagggcuacacagagaaacccugucucgaaaaaacaaaacaaaacaagacaaacaaaaacaaacaaaaaaagacagaacauuaauuaaaaaacaaaacaaaacaaaaaacaaaaucaagccaagcaugaagggaacuacuggugagauccaaguaauuucugagcauagucaacaguaagggacagcaagacggugguggcucaacccauuagggaacaggggcaggcagagcuaugugaguucaaggccagcugccugguccacagagugagcuccagaacagccaggucuacacagaaaaacccuguuuccccaccccacccccaaaaauaaauaagcaaaaaaaaaaaaaaaaaagaaugggcagacaucagcuucucaguucugaaagucugacauggugacacagacaccaacucagccacugagcugagaacagaaugaaauacaucgggcacagugguacacccuucaaucccagcacgcaggaaucagaggcugguccaucucugugagcucaaaacuagccuggucugcauagugaguucuaggccaacacagggagacacuaucaaaaaacaagcaaacaaacaaacaaaaaaccaaaccauacuuaaauuuggucauuuccuaacuucucuaggaagacugcuaaaauagggcugcaggggaggaaaagaaagaaacaggaauggagcagggagcaggagggaacacagagacggcagucaagccugaagaccugagcucagacaaccgccgggacccacacaguguaaggggaaaucaacucuccaaaaccgcccaccacacuugaccuaucacaugugugcccacauacaauaauuguauguacuuuuuuuuuuuccccaagaguuucuucguguaacagcucuggcuguccugaaauccuuucauagaccaagguggccucggauucacagagauccaccugccucugccuccccagugcugagauuaaaguugugcaucaccaccaccuggcuaagguuuuauuuauucauaauuuuagaauucucugguuuugauuuuacuucucaugguauugucccaacuuuuuguuuggcuuuggguuuuuuuuuuuuuuuugggggggguguuuuuguuuuuuugagacaagguuucucuguguagcccugacugucccagacagccuguagaccuugaacucagagauccgacuuccuuccucugacacuggagugcuaggauucgaggagugggccaccacugccuacugauuguuccauuuuuaugguuucuacccauguguguauuuguuccugcucuacuguuauaccucuggcuggcuggaaguguaugacccacaggcauauuuucccaaaucccagaggccucuaaaucugucccuuugucuacacagggcacccuagcacccaccugaccuuagauccgcuuuucccacagcccuaggaagcggcaugagaauaacuugcauaccccaugggcccuuggcaugacccucagaaaggucaggacaggaugccaugacucaccucguagauaaggaaguggggucuaggguccagaugagaauacagcucuggcaggccacagccaagacagaggcacugaggggcuuccaggccaaggcugcuacauuucgcugcagacggugcuucagggagggaacuauagugcuggauacagaggcaggaaacuaagucaaagcagaggcacggagcucaaagagcccaagucccacuaaaaaaaaacaaggugcuagagagauggcucggcgauuaacagcacuggcugaucuuccaaagggcaugggcucaguuccuagcaccuacaugguagcucacaacugucuguaacucuaguuccagaggauaaguugcccucuucuagcauggaagcaggcaaaacacucaaucacaucaaaaauaaauaaaauuuaaaacaauuuucaagaagguaaaacaggcccggugucauggcacacaccuuaaaucacagcacucaggaggcagaucuuugagugaggccagccuggucuacagagcagguucuaggacagccagggcuacacugagaaacccugccuccaaaaaaaaaaaaaaagggguggggggaggggcugagaaagauggcuuagagcucuggcugcuccuuuagaggggcuggguucaauccccagcaccuacaugguagcuuacuacugucuauaacuccucucauagcaccaggcauguacaugguacacauucauguacauucucaggcaaaauacccauucgcauaaaauaaaaugaaucuuaaaaaaaccaaaaacgguaaaacaaaagauuaaaaguaaaccaugggcuggagagauggcucagugguuaagagcacugacugcucuucuagagguccugaguucaaaccccagcaaacacaugucgacucacaaccaucugaaaggggauccgaugcccucuucuggugugucugaagacagcgacaguguacucauacauuaaaugaauaaauaaaucuuuuuuuuuuuuuaaaguaaaaccaacacagaagaaaucuaacucagggccuaaagauguagcuuagagguaacccugguacucugccuguacaaaguccugggucugauucucagcacaggguaaaaccacagggagggaggaguccauccagggguugggucaagagcacuggauacugugagacagaagcauaaauaaaguaaaacuuagauaugcacuaggagucauagugcaccucuuucaucccagcacuugggaggcagaggcagggggaucucugaguucaaggccagcagagauccuaccuuagaaaaaaagucagaugcaggaaggacauauccuguguucccaaccccaauucuggaaggagcccuauggacuagcccaugaagugccgggcccaugaagugccgggccaaggccagcaggaagugagccgggucugaaccugacccugcuugcauacacacgcacacacgcacacacgcacacacgcaccuguuggcauuauaaacacggauggagucguccagcagggccacugcaaacuuguuggugugaggaugccaggcaaagacccguaagcagcagcuggaccugcagugggaugagcacccaguuggcagcuguaccucccggcaacagccuagcaacgaggagcaaagggugcucaggccuucuucuguccuugcugaggguggguaggguggugucuuaguuacgguagauaaaacaccaugacaagaacaacuggagaguaaagggcugacaucauccgucagcucgcaguccaccauccaggggagucagggcaggaacgcaaggcaggagcuacgguguaugaugcuugcuggcuugcucagccugcuuucuucuuucuuucuggggggauggggugggauagguagcuggguggauuuuuuguuuuguauuuugaggcagugucucaguauguagcucuagcuacccacaaaucacucuguagcccaggcuggccuccagcucagagauccaccugccucugccugagugcugggguuaaagagaaucacagcuaggucagauuucagucugcuuacuuacagcacccaggaccaccagugaggaggccaucaaucaccaaucaaucacgacacuccacagcuucccucaggucaucaaucaauaaucaaucacagcaccccacggcuucccucaggucaucaaucguacaucaaucaaucaagaagguaccccacagcuucccucaagcuuccucucugcaaaugacucuauuuacaccaagcugacaggaaacagaacaggggugacaaugugcacagaggaguuuuggccuucaccucucuccccaaaggcauuuucaguucaggaauccuguccuacagggugccagaguuugugcacucaccaguuaguuacuugggcaaauucagcaaucagaucuucacuccugagcuaagaacacagcaaauagauaugacauacagaaggagcucaccuacucaacauucccagaggaguuagaccacacccacccucugagucaucacguccagcuccgcccacaaaggaaggaggcagggaagaagucaaacuuacagagagguguggaaacagggagccauggagugaggaggcgcggccacagagagccagggcccagcugcaggcugucuuuacccacucaaacacugugagguaaaagacagcucugauggcaucaugcacagggcuaugacuggcccugcucuugggugaggacagagucaaagcucuucaguccuugugcacagcaaugaaugggcuuggauaccaucucccaguacccacugugauuaucuggguacuuagaagaaaaggugacagaaaaaaacaggcuaacagguguugggaugagguugggaaguauggggaggagauaagcuuacagacagaagggacuggaggggagccuuaccuucuuccucugaauucgcaauuucauucaggacgccaaaaaggcccacaucaugccucacacggagaaagagacaaagaguuacucugacccuguaguaagucccucuaauagguuucuuucauucauucaacaaacauauacuaaagauaagaggguuggggaaugugugcaccucaauugguagaguaccuaacaugcuaugaauaaagcccuggauucaauccccacuagcauauaaaaucagaugugguagcuuaugccuguaaccccaacacuggguagguaaaacugggaauaauaaaagcugaagauccuuagcaacacaguugccagggcuggaugaagcauuaucucucuuuuuuuuuuuuuuuuuuuaaaaaaaaggaagugggguaguauucacucauggcuucaaucccagcacuugggaggcagaggcaggccgaucucugaguucaaggucuacagagugaggaacaagauagcuggugcuacacagaaaaccugucucaacaaagaaaacaaaacaaggggcuggagaaauggcucagcgguuaagagcacuggcuguucuuccagagguccugaguucuauucccagcaaccacaugguggcucacaaccaucuguaaagggauccgaugcccuuuucuggugugucugaagacagcuacaguguacucauauacauaaacuuuuuuaaacaaaacaaacacaaagacaaaaaaggagguauuauauuuuuagugaguaccaacuaugcaucaagcacuuuauauauauugcccuuuaacuuacuuaggacauuagauuauuuaucacguuaaucuaaaugacauuuugcccacuuacagaugaggcaacuaaauuucaaggacuggaggugguagaauuucugagcaagucaguuagggcuuggccaggcgugcgggcaaacaccuuuaauuccguuugcaggaggcagaggcaggaagaacccugugaguccucagccaaacugaucuaaguggugaguucauccagccacggcuacaaacugauucgagaggaggcccugucucaaauagagaaugagggagaaaagggagaggaggaggaggagaaagggagggagggagggagaggggggcaucaaccauacuuucaaacagggaauggaaagucaucaaagugucuucagcaagggaaacaaauaaucacaagagcacuucagaaagaucaguuuggacauuagaggaguccagaauggagaaagggaucaaguaagaaacuacuuaagguggcccacgccuuuaaccucagcacucaggaggcacaggcaggcagaucugucugaggccagccuggucuacauagaaaguuccaggacagccaggacuguuacacagagaaacccugucucgaaaaauaaaaaaauaaaauaaaaauuaaaaaaaagaaagaaagaaagaaagaaagaaagaaagaaagaaagaaagaaagcaagcuacuuaaggacuccucagaauaaaaggugaaguagccugaacucucaggauauaaaagagagaaguuugagaaacuuagggagcagaauacauagaauggaggaauaauuaagauaucagugggcuggagagauggcucagcgguuaagagcacugacuguucuuccaaagguccugaguucaaaucccagcaaccacaugguggcuuacaaccaucuguaaugacaucugaagcccucuacugugucugaagacagcuacuggguacuuaaauauaaauaauaaauaaauuuuuuuuuaaaaaagauaucaguaaggcugaguaauauuuugagaaacagcaaguaguaauuauaucaacaaauacaucuauaacauaccaggcacugggcuaggugcuuccauaggcaauuuaaccaucaccacaauaccacugcccaguuucuguuuuguuugcuuuugguuugguugguugguuuugagauagucucaugaaguccaggcuagccucaauuuugcaauguagccaagaauagccacgugcuuuugcuccuccugccuagugugagauuacagacauguaccaaucauaccuaguuuuacauggugcuaguuacugaucuuagggcuuccugcaugccaggcaagcacucugccaacugagcuauaccccaaguccuguauguaaaauuuggauaaaaggcuauuugacaacaacucacaaaguaacaagcaaacucaugaacccaggaacauaauugccagggauucguuuuuuuuuuguuuguuuguuuuuucaagacaggguuucucuguguagcccuggcuguccuggaacucacucuguagaccaggcuggccucgaacucagaaauccgcccgccucugccuccggagugcugggauuaaaggcgugagccaccacgcccggcaccagggauucuuuuuacagauaauggcaaugauaauaauggggauggcaaacacaucaagggauuaaugugccaggaaaugcuucuaugugcuuuguaucuauuuagucaccaugguuuaaagggguuuggcuuuaggacagaguaauuauguaacuuuuccaaacguacaguuaaaaaaaaaaaagauagcacagcuuuaauucuuacauguccuacauauuaacgaaucaauucaaccuuuuccuaacuuuccugagcuucagauaaaagcaaaugaggucggugcugagagcagguuuguaaaaucaagccaagcuauuagggauaaaugagguuucugguacacccuugaguuuuacaauaaaaauggaucaccuaauaugauuugugguaauaugaagacacagacugcaauaagcagccauucaagagcugcccaaagcaggcucgguagaccauggccuauuuaagccacuguuugcuaugccucaccaaacauugaugcaucucuuccacacuugcucacggugauggaugaaggcaguucuuguaccaugguccagccucccuggggcuuuuaggggauccuuggucagguguaggacaggaagauugauccacuauaccucagaagagagggaggcagucagucucuuccccaaaucuuaacagaacuccuugccaucuccaaccuauggcauaagagauuccacggccccauuucccauacccacaaauguaacacuugugggacagaaaauuuucaguccucaucugcaaaccacaaucguuuuucacaggguugacacuagagaagaccugauggacggcauccaucaucuucucuaccccuccuagaaccuccucacaugccuuggcaugccuaacuggguaacacaggcccuaaaauauauuucguucucuccagucuccugugggagucaugccguucccaaucacuugugagcgagccccgccgcgucgccucuauucccacuuuccgcauccccaccgcagcguucccacccggaccaccuggccccgaaagucgggaggcgggcucucauagcuguugccggucaccagcucguuauugugcucauacagggugacuugaccucuaggcggcggcggggggaacaaccccagggagcacaucuugccaguccggagagcgucuggaaucgacaggcucccggcuggugacgacugcgcuccccggaaucuuaguucccgggcuagauucgugugaggacggguagccguacaggacaaacgacugcgcgaagcugaacggaag

SEQ ID NO: 8031 - RNA, 30518 nt, Mus musculus
auacaccagagacaugauuuauuaaaaaaauuuuaauugguuuacaaaggagcuacagacuacauugaaacuaaucuuuguacaaaaggcagagagauugagauagagauauagagaaagagauacugagauccccaaaacacccagggacaaaauuagggggagagagacgaggaagauacaaaaggaacaggaagacaagagauuaacaucauacauacucaagagugagggcagagaacaagguaagugacuguuuagaaguauuuacccucacagcccuggugauaacuggauuggaacccacaacaaacaucgugagauuaaaagguuuaaaggcaacagugguacagagacugguuauugccaguauuaagaaagauaaacugguuuuaggcaccagauuggagcacuacuccucugcccagagaugacagacuugggagagggaagcaggcccuagggcagcugccuuuggcuuccucagaccauuaucaacauauucugacuuugugccuagucuuuagcuagguaagggauauuaggauguuauugggagaaaagagucaucagaaguaugaagaacugccauuacccacaauuuucaagagcaguuacuggaaaagcuguguagauagaaucaguucccuaguggagaaggcacagugugauuccugaaggcaagauauaggaaagcacacaaccaagcagauguaccucaagucuucucuaucuguagccccagccuaauuugccaggcuccucuaccuccacgagcugagacuuagaggagcugaaggacagaugaaucccaagacaaggaagguugggcuguuugauaaagaaggggcaaauuggaaaaaaagaagcagcuucucucucacaugagugcuguggagaaauccuucugaguguguggaaguuugaacagagaugacuuagggaaggaauggagccgaagacugccccucuucucucuucccagucuucaaccuacaacacaugagccaagucugaagagggaguaggaacguaaaggcugcuuaaugucuuuuugggggauguuauuuaaggaaggcagacaaagacaagaaacagcucaaccucaaagcuucuacucauccuccuagaugagaucuguaccccggagcagagccaagagacgcacagucuucuaaaccaaacuaauaaccugcccaugcuuuaucagcagcuuucaaagcaauguuuuccggguuggaaaagugccaugcccuccucucccaaaguaacugcugcuaccuuuauccuuguaaguuacuggcucuucuaagagaagaugaaacucugagauuuccaacauuucugcuuucaaccccaagaggcuacccaacuuugucuauggaaaguaaaaccaugaaagaggcccuuagcugaggcaggcacacuauccucacucccucgguaccugaucucuaaaucacuucucaacugaucccaagguccaaaaagacauuagggcacuuaaaauugaaugaaacguuaaucauguagcaccagggcuccuucaaaguguaacagaggccugauuagcaccuccaaagaaccccucaaaaaguguccaauuuuauugcggccuacaaagaucugcagcguccaguauucacauaaugugaaguauuaacaauacaaaauauauucugaaagucaaacaccugcaguucauagugcuuucucagauuuguuaaaaaaauacaaugcuuaguuuucuauauaggauauacaaaagcaaaaaauauauguauauaguagaaauaaaucagccauaguaauuuacagcuuuagucucccacccuccccaaauuauaacaccuucaucccauacuucagucuauauuuucugugauuaaagggucuauuuauucugagaccaagcugagaaagaaccauuauauugcguuuugaauagcaccccgaagggugccuguuaggaggucccugaaggaagauggugaguugguccuuucuaggaaaaagaugacacagucaaauaguuuguaaaugaguacaaaugggcagccuaggacaaggaaaugaaugcuuuaagauuacuauuucugcuagaugugguggcacacaccuguaaccccuaacacuugaaaggccaagguggacagaucgcugcauccuggacuacauauaaauucagaucagccaaggguaccuagaaagaccuauuucaaaacaaaaaacaagauuauauugguggucacccaccacuuugcaaggugccgucauuuuuuuuaaaaauuaagugaaaaaucaugaaggcuggacauagugacauauacuuguaaucccaacacuuagaaggcaaaaaaauuauucaaaauuccaggccagucugaguuaacagugaauuccaggcuagccugggcuacagaguaaaacccugucucaaugagacaaaacaaacaaaaaaccccaaacaacaaaaauguaaugaaaagaauuucagaaucaauaugcaugccaguuauguuaaauucugaaggccaaaaguuuggggaaagguuauuuuucagucaugagacccugacuagaggaauguagucucuuaacuuuagaaaaggcugagcggcucacagacagggagacaagagcggaaacugauuccauuuuauggucaaauaagacaccggagaaggaaauuuaaaaagcagaaagaaucugauguaaauuaauucaugguaauguguuaauguagcagaugcugagggucaaucaucagcuuuucacccaagagagaaaacaccaucagauaacuuauccaaaggcuuauaguccucagcaucucgaagccggcuuguaacuaaucaccucauacugaacaagauucuauuucuugaaauuuucuagcaaaauacugcacacuccacugaguuauccugcccucuuccuccagagaugcaaaguacaugauuauaaauguaaaauaacacgguuuguuugaguucugcuuuucuuuaggaauaaaaggugugaugguggcugaggacagauaacuuuuacgucaacauuaauaacaugugauuuggggacagucccuugaaauauuuccugagucuugauaacaguauuaagucugcauagaaaggaccaaauggaauaaacuaauguuaguauuucaagcuaacaauaccauaaacuuaucaagaaccuaguuuagauggaauuuacauaaaauguauaauaacacuauaaucuauuuguagccaagauagagaaguuagaauaaggaauccacuauagauuuggauguugauuucauuuucaaacacaaaaauaguuucuucuuuagaaagugcacuaggauauccccccaaccccauaacuguuaaccgauuuagcauaagcagagaacugaccuuaggaacauacccaaguuuuaugaccaauuucuagauacuggaccugaaaggcguuuugaucugaauuuauuuuccaacaauuucaaauauaaguucucaucugcauguagauauauacaggcacaaauacauucacacgcagucauacaaaaacaauuuaguuucucuaucagaucaggguaauuuuuuauugcaggucucuuuaaauauuggcuaacagaaaaccuauccccaaccuaacagaucucacacauacacucaaccacucccauacuuccucacagugaaaagcucucugacaagauagcacaaggucuagagagacaaugcuuuaauggcugggccuugaggacaauucugguugcauuuaagucucagugccaaacgcacugaguuucccugccgauaaaauguuuggaucagucucuucuggaaucaggccauagagaaagcaggauaauuucucccaguuucuccuauaauccacagugguaagacaagauuucuuuuuguucugggcuaucguucccaugauugugugcuucccuuucccuuaggaaccacccaaguauaucuaaggaagaguuaagggggacuuuuuuuuuuuuuuaaagaaccacuuuugccacuggcacaaguuuugcacucuacaggauggaaaauccaaacagguucacuggcugaugcuccuuaacauuaaaacaguaauaggaaggaacuacagaaauguucaaaagaggaaguguacuuccuuucagagugugaacucagaagcccauacauugaggcuuauagcuauuuggaagacaaugauacugaaauccgaauaauuccacuaacuucugaacccaagacuaagaguuauuuccuuuucugagaacaucuuuuucauacugaaagcugcugccuacuauuugaccauuuuggaaguauaucuccuucaaagggccucuuguacaauuccacagaaagacuucugauuucugauguuuagaacagcuaaaaaagggagaugguuuugacucuccagcacuaaggugcuugcgucaguaguauuuugaacacucccuccauagcuacuucaagcaucagacuauacuucaggcuuuuccacucuguugcuggaacuaaagucuuuaaaauauuaacacaagugccuaauccaggaaucacugucaaaaacaacacaggaagugaucgugugaggaaagggagacaaggauuaagucaggaaaggagugcaaggagcugaucccaaauaaaauaacaaaauuaagaaagaagacacauuauauauguauauaugaacuaaaagcagaaaguaugaaugcuuacucuggugggaugccaggacaacauuuauaaggaaagcuugaugugucaugauaaggcucagccauugagaaauaaggcaauuuuuuuaaaaaaaagaaaagaaaagaaaagaaaaaaagaccaagguauuuuggucacagaauggucuuuuuccuccucccagccagccccugugaaagcaucucuauauauuuuuuaauauauauauauauauauaauauagaaucuguuuuuguuaaaaaguauuucaaugaucauauauauuuaucaaggcaugauggcuuuaggaaaagggggggggaauccaucaugggagagcuaagagggaaaaacaggaagaggaggcugggguaagaaguguaagaagaaccugggaugagauaaaugcugaucaaaggguggcaccaacagaauuuucacuaauauuuuccauuuucaaggagucaccagugacauugggugccacaaucccaucucuuuuuuuuguaccaucucccaauucuuccuaccaccaagcacauuaaugccucauggcucucucuuccagaugucucuuggacccaugcuaccuugcaucccgggcuuaguggguauuggcccauaugucucuggcacugggugucuaaucuuagaaaccauugccacugauauuaauggacugcagcucugucaccugcaugacguugaugccacuguuggcaagacgggcaauacccucuggacagauggccuccauggcuaccauauuggugguaauaagggcugaaggaguggcagugccuucugaaccugccccacuguccaggggcaaugugcccacacucagggcuacaccugggccucccuucuuguucuggugagucuugauaugcuuugacaggugaucacuccucaugaaacgcuuagggcacucagggcaggcaaauuucuucucuccuaguuuaaaaaaaaaaaaaaaaaagauaaauuagccaaaaagcagucagaacaaaguugagguugauguguauccuucuggacuaauucaaguacucuuggagacacgcuuaguuucacauauacauuguuuaggaauuucaguuugcuucaugggcauaucauuucuuuuuucuuuucuuuuuaugguuuuagagcuuuauuauagaaagacagaaagagagaagguagaaagagagaggacugccauggccaaguggagaaaggagggaagggagggggagagcuggagaugagaauaagagaggugagagcuuaugagcucauuucuuucuuucuuucuucuuuuuuuuuuaaagauuuaucuauuuuauucaugaauacauuguagcugucugaagagggcauuggaucccauuauagaugguuaugagccucuaugugguugcugggaauugaaaucaggaccucuggaagagcagucaaugcucuuaaccacugagccauuucuccagcccucauuucuuuucugucuacuacuuucccuuuucccuugggucuuacucaccuguauguguacguuuaugucucugaagcucguccgaacguguaaagcgcuucccacaauaugaccaauuacacaugaauggccucuccccuguaugccagcgcaagugugcucggagaugugaggucuugccauauacuuugccgcauccuuggaugugacaaaugugcuguuucuuuuugccaggaucuccugaggcucuaaaaaugagaauauuaugauuuaucacucuggagcuagaaaguagggaaccaagaaauuagaauaguaauugucagaagcaauuacuuaacccauuccuuuguuuuugagaaagacucuauguagcucuggcuguccuggaacuuacuaaguagacaaggcugaccucagagauccaucugccucugcuugcauaaaacuagguaggauuaaagguaugugugccauuauaccugucacuaggacuuacuuuuauaugccauuccgaagaaagacacaaguggaucuucgugaguucaagggaagacuggucuacagaucaaguuucaggacagccuaggccugucacacagagaagcccuguaucugucucucuguuuguguaucaaaauguuuuuuagauuuauuuauuuuaugaguauuuugccugcacauauguaugugcaacacagcacaccggugccuacugaguuuagagaaggaugguaggucuccuggaacugaaguuacauauggcugugaaccaccacauaggguacuaggaaucuaaaccaguccucuggaagaacaaucaaugcuuuuagcugcugagcuauuguuccagccccuguuguuuuuguuguuuuguuuauauuuggggacagaguuucaauguauaguugaaaugaguuucuggcuguccugaaacucacucuguagaucaggcuggccucaaacucagguaucugccugcuucugccucccaagggcuggaauuaaaggcaggugccaucacaccuagcuuuuguuuuuucaacuuuuauuuuuauugggagcuagagagacugcucaguaguuaagaguacuuuugcucuuccugaggacuggaauuucauuucaagcaacuacaaccaagugacccacaccaccagauucaaagacucuaaagucuucucuggccuauuagcugcauauaaauacacaaauaaaauuuuuuuggcuuauuuauuuuggagacaggguuucuuuguguaaccuuggcugucuuggaacuugcucuguagacaaaaaaaaaaaaaaaaaaaaaaaagacugugggaucagaaaucuuguaaagggguaauauaguacauuugaguagguccuauuaugcagcucuuguuucugacuucucauugacucugauugcuagguaaauguucuaccauggaguucaucucaaguuugugaguuuauuuacuuacuuuugcaacaaggccucauuguauagcccaaauuaccauagaacuccuuguguagaacaggcuggcucuaaaagugggauuauccuugugccucuguuuccugagugaugagauuacagauauacacuaccaugucuggcuccacagaauguuuguuguuccagacagaaucucuuuuauuuagcucaugcuggucuuaaauugacuuuuagauuagacagguuucaaaucugcaauuuuucugcuuccaaguacuguggcagcagaucugugucaccaacaaaucuagcuucacugacuuucuuacaugaauuuuuuuuuuguuuuguuuuuugcacaaaguucuauccuauuagcccaugcucucuuuuuauuauuuuuuaugugcaugagcaguguuugcuuuucuuauggguggcuacuaauuuuaugcuggugcuggcacaugcuuuuaauuccagcacacaagaggcagaggcagguguaucucugaguucaaagccagccugguguuccacaacagccagggcuacauaaaaauaaauaaauaaauacccuaucuugaaaaacuaaaacaaaaugagccacuccuucaggccuaaauaugaagguaaaagaaaagcauggaggcuucuccuuguaaucucugcuacucgagagacagaagcacaagaaccaaaaacucaaggccaagauaggagauguaucaucugauuccauguaaauuaaaauaaggagcuuagagaagaauuauaauucagaacauggccacucuggcaagagaucauauccaaagaucuucuaggucuaugugauccgagaacucacuaugccauccccauuggaagacaggcugggauacagacaugccuuuaauccuaggagacugaggcaagcauaucucuugaguucuagucaguucuguucaguuaauggaauucagaggcaguuuacagggagagguuuccccuccccuacagagacagguugaagagaguuauaauaagcuagacacaguuaaagacagaacaagugggcuggagagauggcucagugguuagguccugaguucaaaucccagcaaccacaugguggcucacaaccaucuguaaugagaucugaugcccucuucuggggugucugaagacagcuacaguguacuuacauauaauaaauaaauauuaaaaaaaaaagaacaagcuagagaauaaggagucaaaaggccgggcgugguggcgcacaccuuuaaucccagcacucgggaggcagaggcaggcagauuucugaguucgaggccagccuggucuacaaagugagcuccaggacagccagggcuauacagagaaacccugucucgaaaaaccaaaaaaaaaaaaaaaaaagagucaaaagauuagaacagauugcuaguuaguuugagguaaagcaaggaaauuaagugagaugcaaaaagaagcccauuugaaucagucagcuuggaggggaguucugagucagaauagcugaauugagccagcaaaaaacagcuuacucagcaguaaaucucagaggcugaagguuuccaggccuaguuuaaaggacaauuaucuggugaauaaaaguuacauuuacaggggcuggguguggucucacaccuuuaaccauagcacugcgaaggcagaggcaggagugucucaaugaauucaaggccagccugguuugcauagugaguuccagaaaaaccagggcuacaaaaagacaccuucucaaaaacaacaauaaaauaaaagcugcugagcuuggcagaccacgugacuuuaauccuagcacuugggaggcuaaagcaggagaggucaaauagugagaucuugucucaaaaaacaaaaaccaaccaaaccagaaaaauacaauacauauugcaaauaccuguuaaaaguccauucugacucuucucccccugccccuaaccuaaacuuuuccaguuuauaaucuucccucccuaagcuuaucauucccacguaacccugccauuuagacaggugcucucuugccucucauauuuaucuuucucacuuucuaccccauucucucuccuguuauggccaaguccaaucuacugguuguuauuuagucuacuuucucuccuugcucugaacucuucagugccucuggcuguaccuuaccucauuuuauuuuauuuuuuauuuuuuguuuuucgagacaggguuucucugugcagcccuggcuguccugcaacucacucuguagaccagguugagcuccaacucagaaauuucccugccuccgccucccgaguacugggauuaaaggugugcaccaccaagcccggcuguacccuaccucuuuaucuacaauaaaaaccuuccccucaacuacaccuuggagaagucauaguccuguucuuaacuuuaucucaaaacccucauuuuauuuauauacucccuaugugggguuaaauagacacaugugccaggugugguggcacaccuuuaaucccagcacuugacaggcagaagcagguggauuucuuaguuggaggccagccuggucuacaaagugaguuccaggacagccagggcuauacagagaaaccaugucucaaaaaacuaaaaaaaaaaaaaaaaaagacacauguacuuauuauaccuccucaggaaaagucugucacaaaacaugggauuacagacacgugugacuacaacugucacucucuuucucuucagacacaacagaagacaacuugggauaccauuacagaugguugugagccaucaugugguugcugggaauugaacucaggaccucuggaagaacugucagugcucuuaaccacugaaccaucucuccaguccucuccuaucauuuuuuccucauauuuuuauaagaaagaaaaaaaaaguaaaagaaaaauucuauaaucaagaaaaugaacucaccuucccucacugucuuugcaauaggggcauguacaugcuucccgacgaguccugcguccagcuugggguuggagaucagagcuauucucuccuucuccaccugcugucucaucauguaucccaucaccaccagauccaugaagaccaaguugaguuccaugaucaccugaaauaaaaagacaaggagaaaggugaaaaggcaggacuaaauagcuaccgaaauuucacaacagagucagccacgacuggcucuuuuuuuuuuuuuucccguggagcacacuuuuaaucccagcacucaggaggaagaggcagguggauuucugaguucgaggccagccuggucuauacagugaguuccaggacagccagggcuauacagagaaacccugucucaaaaaaacaaaaaacaaaacaaaacaaaaaaagcgugugccaccaacugcccggcucuaacuuuuaacuacaguucuuccaugagugauauguguaggaugcuugucuaaaucaaaggacaacuuuuggcaaucggcuuucuuucuaccacauggguuccaguaaccaaccucaggcugucagccuugacagcaagugccuuuaccugcugagccaucucacuagcucauaacacaccauuucuucaagaucugugugugugucucugucucucucugagauuuauuuauuuuauguauaugaguacaccacugcucucuucaugcacaccagaagagggcaucagaucccauuacauaagguugugagccaccaugugguugcuaggaacuuaacucaggacacagacagugcucuuaacugcugagccaucucuccagucccgucucucucucucuuacuuuaaucugacauaaggucaugcuauauuugcccaggaugaccuugaaguccuagguucaagcaaucuucugacucaaccuccugaauaaguaccugaaagacugccaagggacuacagguuuaaguuuacauagcaguuccaggaugaccuuggcuaaagagugauacucaugccaaauacgaagccaaaaugacaucaauaucauucuggaaucuuuucuccaccccuuuuaauaauaguuuuagaacaguuuacucuuaaaacaugguacuacuaguuaagcaaugagauaaauuaaagauuggccuuccugugaugaaaguagauaggaaaccagaggcacaguguaaugacagucuuggccaaacccaacuguugccucuagcaucaauuucugaaacaacuauggauguuaaacaucuuuucaguuucuucuaaguaaagaaguguggcuaaagccacaaccuuccaagaucacuaagagucaaaaccuuauucuuuggggagaaaaaaaaaaaucuugggaauuacuaaaguaugaugaagacaucaugaacaucaagaacuguaaagcaaaaacaaaacaccuucuagaacugauccgagggccuccacacaauagacaaguauucuaccauucaaaaagcuaguuucuauauauuucuaaaaacuccaauuaggcuucuagauucccaucucucaucuugcugugaaaaacacgacaaaaacaaaaaaacaaaacaaaaaaacaaacaaacuuggaaauuaaaggguucacuucaucuuacaacucuuaggccauacuccauccugacagggcagaaugaggcaagaaccaagaggcaagauugacuuaaucuccaaggcuucgucauccugcuuacaccauacccagcucccacugugcuggguccucccauaucaaguauuaaucaagaaaccuacagacuugucuacaagugccuuuaaucccagcaccugggaggcagaggcaggcagauuucugaguuugaggccaaccuggucuacagagugaguuccaggacagccagggcuacacagagaaacccugucuugagaaaaagaaaaaaaaaaaaaaaaaaaaagaaaagaaagacacaccagaagagggcaccagaucccauuacagaugguugugaggccaccaugugguugcugggaauugaacucaggaccucuggaagggaaacuaguguucuuaaccucugagccaacucuccagccccaggaccuaguucuuauaauaggucucuuaacaaucuuauaguccuuagucuguaacuucagcuccuggguauccaacaccuucuggcuuacacacacacacacacacacacacacacaaacacacacacacacacacagagguagacguacaaguacacauaauuuuuuuacuuccucccuucauguuuaucucucucucucucucacacacacacacacauacacauacacauuuauauacacacaccaacacagaaacacaagauuucaauauggaggccuggaacuuagugauucaccagcuucugccucccucauaccaguauuaaaagcauguccaagccuggcggugguggcacacgccuuuagucccagcacuugggaggcagaggcaggcagauuucugaguuggaggccagccuggucuacaaagugaguuccaggacagccaaggcuacacagagaaacccugucucgaaaaaccaaaaaaaaaaaaaaaaaaaaaaaagcauguccagucccgggauaaaaaaaaaaaaguucaccaugagcaggaaagacaacucaaucuggagucccuuuacagggauugccuaagaccaucagauaaaaagauacuuacauuaugauucauaauaguagcaaaauuacaguuauuaagaauugaaaauaguuuuaugauugggagaucaccacaacaugaggaacuaucauaaagggcugcagcauuaggagaguugggaacuagcucagauuauuggcugcucagaggaccugguuuugauucccggcacacucauggcacuucacaaccauuuauaacuuuaguuccaggguagucuuuccaucaaaucuaaauauuaauuuuaguuuuguuaauguucccuaacuaaggcuugaguuuugacauuuaucauuaauauaaaggcaaaagcugauggcacacugaugauacucuccuggacuccucugguacucagcacccauguacauaaacauggguguacaaacacagucaggcaaaacacccauacacauaaaauaaauuuuaagcuuacaacuaagaaaauccaugcuaggaauaguagaacauggcugucaucucagcacuaccaggcaggugcaggauagugaaaucaaaaccaaucugagcuauaaagugagaucuugucaagcacaugaacaacaaaaaaagcugaguucauaagcaugaugggaagccuuacuuuuccccuuguaucuucuguaauuucucuguaguuaaaacauuuaggggguaggguaugggggacuuuugggauagcauucuaaauguaauugaggaaaauacauaauaauuuaaaaauauuaaaaaaaagaauaaaacaaaaaaacauuuagacuguaacauucucuuugguauauuacuuuuuuuuuuaaaaaaacugaaaaacugccuagguaugguuagagaaggcucagaggguaagagcacugacuguucucccaaaggugcugaguucaaaucccagcaacuacaugguggcucacaaccacuuguuuuuuuuguuuuguucugguuugguuuuugguuuuugguuuuuuuuuuucaagacaggguuucucuguguagcccuggcuguccuggaagcuggccuccaacucagaaaucugccuguuucugccucccaagugcugggauuaaaggcgugcuccaccacugcuaggcuucacaaccacuuauaaugagaucugacauccuccucuggugagucagaagucaacuacuguguacuuauguauaauaauaaaugcaucuuuggaccaaagcacgcaaguggugccaaccagagcgaaugugguugaccagagcagagcgaguagagguccuaaaaauucaauccccaacaaccacaggaaggcucacaaccaucuguacagcugcaguguacucauauaauaaaauaaauaaauaaaucuuuaaaaacaaaacaaaacaaaaaacuaccucaaagaaauggguagcuuuccuuagagcuaaguaaucagcaaagcgguguuaauggcuuucaccaguagaugucacugugacuaaaugagacagcguuuuaaaccuaccagaccuuuaagagaaaaagggacugcucagauacuagaaacagaagauauuuugaaagucuuuccaucaaaucuaaauauuaauuuuaguuuuguuaauauucccuaacuaagacuugaguuuugucauuuaucaugaauauaaaggcaaaaaaagcugauggcacacuuuuuauuacaguacuccagaggcagaagcagguagaucugaguuuuuggccagcuugguagaguugaguuuccaggaaauccagggcuucagagaaaaaccggucuuuaaaaacaacaacaacaacaaaaaaaaaacacaacaacaacaaacaagcaaacaaaaaagagaaaaaauguaguucaugaugcugauugucuauaauuccagcacucaaaaagugcagcuggcaggaauucaaugagucacacagauagggucauaaacaaaacaaaguaagacaaaaaccugccuuaacuucccaacugcaaggaugauaagcaugugccauuccuggcuauuguguacuuucagugucaauucauucucucucacagcagaagcacaauaaauuuauagaaguaaaaaugguacucaaagcuagguguggugguguaugccuugaaucccagcacugggaaggcagaaggcagacagauuuaugaguucaagaccagccuugucuauauagggaguuuuaggacagccagggcuacagagacacccugccucaaaacaaacaaagugaacuauuuccagcacucaagagacuaaggcaggaagauaaccacugaagccaaguaugggcuacauaaaauccugucucaaaaaauaaguacacaaacagaaguauucaagugaacuauucuagguuucauugcgaaccugcagcuacaacauggaggcuuaaagaaccaaacuuagggguuaaagagaugguuuuauucuuuaaaaaaaacaaaacugccuacucuuucagaggacucaggcuggauuccaaguaccuacaugauuucucacaaucaucuuuaacuccaauuuggcuucugugggcacauggugcuaagacauacaaaauaaaauaauuauuauuuuuuuuuuuuugcuuuuuuuuaauguucaaugguguuuugccuggauguauguacauguuagggugucagauagcccguaugggagcugcaaugugggugcugggaauugaaccucuggaaaagcagccaaugcucuuaacagcugaaccauggcuccaacccccaaaauaauuaaaucuuuaaaaauaaaugaaaaaaaaaagaaauaaaagaacugaaacuuaauuuuuuuuuguuuuuuguuuuuguuuuuuuuugaguuaaaauacuucuaaacuaggcuggugagauggcucaguggguaagagcacccgacugcucuuccaaagguccaaaguucaaaucccagcaaccacaugguggcucacaaccaucuguaaugagaucugacucccucuucuggagugucugaagacagcuacaguguacuuacauauaauaaaaauaaauaaaucuuaaaaaaaaaugggaugcagaguauuucuuuaaaaaaaaaaaaaauacuucuaaacugaacuuccaaacuguaacaagaaacuugucauuuucccauucauaagcuguaauucuuuucucuagguacauucuuagggcaugcugagcucaguauuucugaagaguauuuaauuggcucuuguaauauacccugccuucaucagaggcaucaugauauauuacuaauuccuucagaaaaaguccucacuaaagacuuuuaguggacagagggucagagacugccugccaaggaagccaaauuaauuuccagcaucuaccucaaaccucuuugauuaaaaugguuugauacacacacacacacacacacacacacacacacacacacacacacauugauuaaaaugguuugauacacacagacacacacacacacagcucaacaaucaacaaagacgggguugcacuugccacucuuguacaagaaagcucacaaccauuugaaacucuggugcccggggaucugaugacacucucuucuaaacucaaguucaaggcacaaauauggugcacacaaacauacagguaagacacucacacaagcacauaagaauaaccuaaaugaaugaaugaauaauacagugaaggaucuaaagaagucaccugaugucacuucuggcuucuccauauuccuacacaccaacacagaguugggguaugcuagacaaauacauuacaguuacaggccccucaaaaaagauuuggggaggccgaucucaaaggaguaagccagagaguaauuggaggacacucaauaacugcucuggcuuuccugaaauuacaugcacacccacauaggcacauguuacacacacauauacacucucaaauauuaaaaaagaaaagccgaagccggccaugguggcgcacgccuuuaaucccagcacucgggaggcagaggcaagcagauuucugaguuugaggccagccuggucuacaaagugaguuccaggacagccagggcuauacagagaaacccugucucgaaaaaccaaaaagaaaaagaggagucaggcgugguagcacauaccuuuaaucccagcacucaagaggcagaagcagacugaucucuaagucagaagucagccuggucuacagagucaguuccaacacaaacagagcuacacagagaaauccugucucaaaauaacaaaacaaaacaaacauaaaaugcuuccaauuucagcacucaggagggugaaauagaauguccaugaauuagaagacagccugggcuaucacgaaauccagucucaaaaacaaaaaaauauucaauaugguaauauaaaccuauaaacuguugucauauacacuugggagaaagaggcagcaggaucagaaguucaaggucauauuuguuacaucuugagauauaacuauaagauagccucaaaaauuaggaaaaggagaccugaaggcaauauccagaaucacuuagaaaacuggugaaaaacaauaaaaguuuauuuguuugguuuguuuguuuguuuaaagcuuuacuuaugaggccagccuggucuacagagugaguuccaggacagccagagcuacacagagaaacccugucucaaaaaaacaaaaacaaaacaaaacaaaaaccuuuacuuauuuuauguauaugaguacacuauagcugucuucagacauaccagaagagggcaucagaucccauuacaggugguucuaagccaccaaauaguuguuggaaauugaacucaggacaccuuuggaagaaaaaucacugcuauuaaccacugagccaucucugcagcccaaaaguuuguuaauaauagcuucucagggaaaaaaauaagaaagguagucagagguuggucuguagagaacguacacagcauacaugaaguccugaauuugauccucaguacugcauaaauugggcagaacuuugggcacuuacaaacucagguccuagagcuagggagccagcucaguggguaaaaaaaaaaaaaagagauugugccaggcaugguggcucacgccuuuaaucccagcacucaggaggcagaggcagggggauuucugaguucaaggccagccuggucuacagagugaguuccaggacagccagagcuauacagagaaacccugucucggaaaaagagagauugugguauaaacaugaguacaugaguucaaaucccuagcaccauaugaaaagcuauauauaacagcacauguuuauagauccagaauuagcaggaacagagauaggcagaaccugauaauucaaugauucaccagccaaccuagcugaaaauguaaacuuccaguucagacagagacucucucucaaggcaauaaggcugacagagauaaagauggcuauauaaugaguuugagguuagucuagacauuauaaaacccuaugucaaagaaauaaaauaaaauauaaaagagucaaaggcuggagagacugcuccgugcuuaagaauacuagcuacucucccagaggaucuugguucaauuuccagcucccacauggucagucacaauaucuauaacucuaguucugggggauuugaauuccuccucugcauugggcaccaggcauguaauaaguguacagacauacaggcaaaacaccucuacccauuagacagagacagagaaaagagucaagaaaacagaucacauuggauacaugcuuuuaauccaaaggauagggaggcagagguaagcagaucucugaguuaagucuacagagugaguucaggacagccagagcuauauaaagaccauguuucaaaaaaacaaaaaaaaacaacaaaaagaaagaggacuccuuaaacaaaacagaggcaucucuauuggauuuucauguucaauaguauguaggaagaggagggcuaagggaagaaagguaggaacuuuaaaauaaguuccuuauuauucucccuuccuuuacccccauccuaccucagaccaggcuaaccucaaacucagagauuuaccaguuucccaaguacuauauuaaaggugugugccacccccagacagcuauuaaguugccucauugauuaaaaaucaauuuugacugggcuugguagcacacgccuuuaaucccagcacucgggaggcaaaggcaggcggauuucuuaguucaaggccaaccuguuuuacagagugagauccaggacagccagggcuacacagagaaacccugucuugggggggggggggggggcgcaaauuuuggagcuggcaagauggcucagcggguaagagcacugacuguucuuccuaaggucuugaguucaaaucccagcaaccacaugguggcucacaaccacccgaaauaagaucugacacccucuucuggugugucugaagucagcuacaguguacuuauguauaauaauaaauaaaucuuuuuuuaauaaaagcagcugggugugguggcacacgccuuuaaucccagcacucaggaggcagaggcagguagauuucugaguucgaggccagccuggucuacaaagugaguuccagaaaagccagggcuauacagagaaacccugucucaaaaaaccaaaaaaaaaaaaaaaaaaaagaaagaaaagaaaagagcaaauuuuggggggcuggagagaugauucaaugguuaagggcucuugcuguuuuaaaagaccagaaucuaaaugaaggcuuaccaccuccucaaacaccaaguacauaugugguacacauaugaacaugcaugcaaaauacucauacacauagaauacuaaaaauaaauuuuuaaaaaaaggagcaaaucuuuguugugaccuagguauuuccuguuuaaaaaaacaaaacaagccgggugugguggcacacacauuuaaucccagcacuccugaggcagagacaggcggauuucugaguuugaagccagccuggguuaggguuccaggacagccagggcuauacagagaaacccugucucggaaaccaccccccccaaaaaaaaaaaaaaaaaacaggaguugaaaaugagcuagaggucaaccuggguuauauaacacccuggagauagauggggagaaaagagaauaaaaaggaaaccagagguauuuucaggucuucaaaaggggaaaaauucuauucagggauuuuuguuuuguuuuguuuuuuguuuuguuuguuuguuuuuuucgagacaggguuucuuuguauagcucuggcuguccuggaacucacuuuguagaccaggcuggccucgaacucagaaauccaccugccucugccucccaagggcugggauaaaaggcaugcaccaccaccgcccggcuuuauucagggaauuuugguuuuuuguuuugaguuuuaaguuuugccauuauugaaaauaagggcuagucucaaauuuacugucaacacagcugaaaaugauuuugaauuccaaauccuccagucucccaagugcuuuggauagugcuaucauauuguaucugguuacuuaacugaguuaaaauggccacacugcaugcauaaagcagcaugauuuaacaaugaugucauuuagacaaagcaauuggaaugaacagauaggaacaauugaaaugaagacugucuuuucauaucuuacugcauuucaaagcaauaaaaguacucauauuuaaaauuuuucucuuuaaacagaagucaucaauuaaaaaacacuguuggggcuggugagauggcucaguggguaagagcacccgauugcucuuccgaagguccgaaguucaaaucccagcaaccacaugguggcucgcaaccaucuguaaugagaucugacucccucuucugaagugucugaagacagcucaguguacuuauauacaauaaagauaaaaacaaaaacaaacaaacaaaaaaaaacacugucacuucaauaaacaaguguguuagauaaaaaauauaguaacaggagucauuugauaaacuacauuaucuuaaaacugaaaugucucucauaugagcuuuugcacaaaaugcuaauucuggauaaauguggaugcucauaucuguaaacacucauugguugaaacaggaggauuaccauaaauuugcagccagcccauagucucaaaccagucuaaacaacaaaaaacuuaaucuccggagggaaaaauacuuuaaaaaaauuuuuguauuuauauuuuaauuucauaaacauuuuaugauuucuaaagugaugcucacaugcacuagucaaaaacacaacuuuugcugagcggugguggggcaugccuuuaaucccaacacucgggaggcagaggcaggaggauuucugaguucgaggccagccuggucuacagagugcguuccaggacagccaggacuacacagagaaacccugucuccaaaaaaccaaaaaaaaaaaaaaacaaacaaaacaaaacaaaaccacacacacacauagcuuuuuaacaaauuaggucuaagcaaucugagcccaaucucagcuagacugcuggcaaaccaaugccaguaucacauucaacucaacugugagacaaaacauguuccugaccccaaugaaacuuagcagauguagaauuuuuauuuuuagugccugaaguuuucaugagugaauuguagacaucaagauuaucuguucuauucucaugccaaacccagcucugcacuauuagaacucccaagaagccaaccacauucuaugauucaaagcugccccaugcacacccaaggcaaguuucaagaauugacugaggaggaagagaugugaaguuuaagacuacaaaaugagagcguaaguucucauaaaaaggaaaagguauuaaaaaaaagaaaaaggcuuuggguuauuuaaaagcaaacaaaaacaacucuaggaacuuaccuaucauuucacuuuuggaaacuaaccucaguuaacagaguggucccuucccucacuaccacccagcaggggcaaagccugaaaaguaugggacacagaaguagggguuuuaucuagguucuacauuaaugccuuggcuuauauauuuaacauaagaauuaaaaaaaaaagucaauagaaaauccaaagcauuuuuuuaaaauaugacuuuaaaaauaauguaaccagaaugagcaugaaacacuauuauaguucucuuccccucccccucauucccuuuuuuuuuuuuuuuuuuuugagacaggauuuccucuguguagcccuggcuguccuggagcucacucuguagacaaggcuggccucagaaauccaccugccucugccucccaagugcugggaucaaaggugugcaccaccacugccaggcuuccuucccucuuaugguguuugauuuuuccagacaaggcuucccuuuguagccccuggcuuucauagaacucagagaucuacuugccccugcugggauuaaaguccugauccacuacagcccagcucgcucgcucgcucgcucuuucuuucuuccuuccuuccuuccuuccuuccuuccuuucuuucuuuuuuuaaagcauuuuugauccuagaacuugggaggcagaggcaggaggauuucugaguuagaggccagccuggucuacagagugaguuccaagacagccagggcuauacagagaaacccugucucgaaaaaaacaaaauacuaaaaaaaaaaaaaaacgaaauggauuuucuuuuauacuguacugugaaaaggaugaaaguauuguuaauguuuggguuuucuaauacauaccuaauccuguaucagaaaagaggguaaaauaagauauucuguaacaaccaggaagucuaagucucuagggaacuauaacauuuuuuaaagauaaaauuugaacaauuagccgggugguggcgugcgccuuuaauuccagcacuugggaugcagaggcaggcggauuucugaguucgaggccagccuggucuacagagugaguuccaggacagccagagcuacacagagaaacccugucucaaaaacaaaaaacaaaaaaacaaaaaaauuuaaaaaugaacuacauguaucuucaaaaacauauuaaucaagaaaacauucuuauuuuacaaaaugugcuuucuaggucaaaaugcugagcaaaccuggaccagcucaacacgugaagcccacauacugguggaagagaaucaauucuacaaaguuguccugaccacuagauauauuaaauggcaaacuucccccaaacacgauugagcaauggaaaugcuucacaacuguuuucuagauccuaaguuacaaaccuuucagaaaucaaaauggccgggcgggagugguggcgcaugccuuugaucccagcacucgggaggcagaggcagguggauuucugaguuugaggccagccuggucuacaaagugagcuccaggacagccagggcuauacagagaaacccuguauggaaaaaaaaaaaaaaaaaaaaauccaaauuucuagcugguaccauuguaaucagguuauccuuggguacagaguaugaaucugugccucaucaccaaaauauaauaguuccauguugaccuacaugguaauuuuuuaaaaacuuauuuugggggucacuacauagcucaaaccagcacugauccucuugccuuggcuucccuuaggugcugagauuacaagggcagagaauaagcagccuuauaaauugacaaauucuaaaaaugccuucacuuuuaugguucugacuuuuggcucucuaaaaucuuauuguugguuuuagcaggguaguuuuuguuuuguuuuugagccaaggccucccaauauagcuagcagcuaagguuucuuagccuuugauuuuuuuuugguaaguuuaugguugggguggggcguuuggaaacaggguuucucuguguggcccuggcuguccuggaacucuauaaaucagauaagccucaaacucaaaaaaucuaccugccucuaccucccacauacuaggauuaaaggcaugagccacuacuaaguagcaacuagacagccucugaacucacgauucuccaguacaaccucccaaguugugggauuacaagaagaggucacuguaucuauauauucaaugcuuacggaagguaggguguuaaagaccaacuaggaaaauuagauaugcaauugcacaccucuuaauuccagcacuaggagacagacacgcagaucucugaguucaagguuggcguggucuacauagggagcuccagguuagccagggucucuuaguaagauccugccucaaaucugagcaggaggauuucuaaauucaaggccagucugaucuacagacugaguuccaggacagucagggguacacagagaaaccuugucuugaaagaaaaaaaaaaauuccugccucaaacaaaugaacaaacaaaacaauaaaaaacccaaaacaugaccacccaaaacaugaccacccaaaacaaaaaccagaaacucaucuuguuaaaaaucuuucuaagcaggcgugguggcgcaugccuuuaaucccagcacucgggaggcagaggcagguggauuucugaguucgaggccagccuggucuacaaagugaguuccaggacagccagggcuauacagagaaacccugucuccaaacaaacaaacaaacuuucuguucugaguucgaggccagccuggucuacagaaugaguuccaggacaggcaggacuauacagagaaacccugucucaaaaaacccaaaaaaaaaaaaaaaaaaaaaaaaaaaaaucuuucugaggcuggagagaugacucagugguuaaaggcacuagcugcucuuucagagagcaagaguaugguucccagcacccauuuauuucagguggcucacaaacaccuggaauuccagccucaggaaaucagaugaccucuuccagacuccaggggcacccacccauccaaacugcauaaauauacagauauaaacacauacauauaaauaacauuuuagggaaaaaaagcaagaaagaaaagaucuuucugaaauccauuaagccauuuuucccucaguucaacucaugagaaaacuguucaaguugaaucaucacaaucuguaaccuacuuggccagaacuagguuccugaaccaaaauguuaaggaacugcuugcugccuccugcuccugacacuugagaagcagauacuaccucaguuguaaugccuucuccaccaagaugggaguauauuuaauacuuuuaaucagauaaaacugccaaccaaaauaaaccuccugauccuuaaaggacaaagaaaagcacagcacauuggugcaagccuaaaaucccagcauuggggaggcagaggcaggcaggucuauagaguuaguuccagaacaagagagcuacucagaaaaacccugucucaaaaaauaauuucucauauggugcugaacauggauccacagucuagacucgugcuaaauaagcauuuuacugcuuagcaucaauccuagucuugguuucacauucuaguuaucuuagauuuuauuuuuauuuuauguguauuaccuaaauauaugacugugugccacauucauacaaugacaaguaggcuagaagaaggaggaguuggaucuccuuggacuggagucacaguugucagauaccacaugggugcugggaauucaaucuagguccuuuaggagagcagccacuuuaacugcuaaaccauccaucucuccagucucuguuuuacaaucuuuauuuugagacaagguaucccuacuuaguccugacuguccaggaacuacuacuuagaucaggcuggccacgaggucacacagacccaccugucucugccucaugagugcuaggauuaaaggcaugaaccaucacaucaucaggauccauuuuuacuuucuuaaaaggguguuucugaaaaccaauugcaaaccaaggggucagagaucuaacaacgaguguacagaagauucagaaggccauguucaaucccuaucauugcuggaugaagggaaaaccaaaaagaacacgaaauauaugacugagaauccacauggaucacuaaggcauaaaauauuuaauacuggacccuaugcagaaagcacgccaagccuuaguuugugguaccaagacacuaggaaguagagaccacaggaucacucagaagugcuccuuucucaucagaacauauuucuauugauuaaguuccaaaugucuuaacuaaaaaacaucuuacacuugcuuggguguuuagccuugaguaaacaucucagaaaguucuauuucccccuuuagauucaauaguaccagggaaguauuaguuugugauaaaugcaaaggaaggaugucuuaccugggguguuugcuauagccaaaggcaggccuggaagcuggugcaccuggaucccugaaguacccaaugcacugagguuaauggucuggaggccuggcauggaggagaguugagcagcauucacagugacugugccagcaggaauggaggcagcugaggcaauggguguuagggugguauuacugcugcuagucugccccaaggaaacacccugcauaggggccaaggugauugucugggcuuguggguucugaacuugaagauucugcagcugaagggucugccaacugaccuguccauugggccccacgguugguguccgaaugaugaugggaccagaguuuugaacagccugaagcuggagguucugaaggguuuccugggaaauagcuugaguugugaaggucuguccggacaauggugcugcuugaagggccugaagagcuuguccuccuugaacuagcugaggcugaauaaggauuuguuguugcugugucugcugacuuugcucucccucuuucugcugacuuccuugcagcgagccuccugaugucugguucugcuggauguucagagaaucagacccuuguagcccaccaacccucuggggcgucuggccuugagaacuagucccugaugagccacugcugguaaaguucauaauucccauguugcuggugguaguaguuguugaauaacuauuggcauugguaaaaaaggagcuggaacuagcuugugaugacaccaagcuggcagaacugauggcagucccugaggugacaggcugugagcugcucuccugggauccagagcugcugauagugccugccugagagcugggagucaggguagcugcagaaacgcuguugacagguagcaaggugauguucccauucagggccacugguacauuggucacauacugagucuguccugagagcacauuauuagcaaggccuugaagggggacagccugcuggaguagauuuggcauagcagcaauaauguugcccccacuuccucuauuugggaugaucuguugguuugcaccugguaugaucuguauuugaccagaaccauccugcugcacuugggccccaguggcagcaaacugcagcugcugcccaucaacagucuggaacugugggauuacuugauacugaauauuaggcauuacuccagggagaccugucagaacuugcugguucuguaaguuggggguagcagccacaacauacugcccaccagagacugugcgguucuuggaagacucgcugccauugguacuguugccacucuguuccuuugagguagggguagccccagaggaggaagagaugaucugccagccauuggcacccugugaaaguugugcggcugugaggucaaguucaccugugcccccugacugacucggacccugggaguuguugcuguucucauugggugacucaauucugcugcagguugcugccagcagagccaaaggagauggcugggauuccuggccagaagagaggaaaggaguuaguggcacccaauagcuggccuagggggcaguauucaacagacaaaacagcaacaaugcaggaauauagagcaaaaaccagaaacaaaaugcucacuuucuguauacuguuccaacuuucguaucuggggacccucuagaucaccuaucuuucugaguguacuucccuacuguauuuuucuucccagaauuuuugguuaaggaaguuucuaagaauauuuauacccuuucaacacauuccccauccuugaucacucaccugcccuccuccgccaccacugcugcugcuacugccugugcugcugcuucgagucugagaaaaggcggcaccgccaccauugccgcuacccccauuauugccaccaacaucuuuuucaaucuucaccacagcugucacuucauccauggagugaucuuggucuaaaaauaauuacaaaagaaauaaauuaaguguauguguguguguagggggggguguguuaaaaacaacauaagauuuaaaauuaaggauuugaccgucagcaaugacugacagaacaguuuuuaaaaagaucuuagccagauaggucuaaauauggugguaagccuaaaaucccagaauuuggaaguggaggcaaaaguucaaagaaauccucagcuacauaguaaauugggaugccaaagccauagacacauagcuuaauggugcccaagacaggccacuauuuuccuaugcacaaauuaaccccagaaaugacucaaaaauugcuuuggaagcuaggcauggugacucacaccuauaaucccaagacuuggaaggaugagccaggugguucaccaguucuaggucuuccaggccuacagaguaagaacugaucccaauacaaauagcccuuuugagaaagggaauuuggaauuucagugucucagaaauaaagaguugcuccuuaggguugauagcacucuuaaucccagcacucaagaggaagaggcaccuagacagcuaaaagucugagggcugcaauaguaacuucgaguuacuacgaauaccacauagaaccuaucucaaaaaagaaaaaaaaaaaaaaugcauccuggaaggaaaaggagacccaacauguggguggauggaaagugugcuaaaauuaggacuauaagagaugaagaaagaucuaguguaaacaauaacaggaagggacugagaaagaguaaauccuaagagaaggugaggaaacaucugagaggacagguaagggucuagggauuagaacccagguuuggggcugaggaggcgguccaaagaaggaaggggcgguuucggggauagaggcguggcaagggcgggucggaugggggaagggaaauuuacgggggugcgggggagggcccggggcaggcugcgaccggagggcgggcggaccggggaggcgguuggcccaggcggggccugcacuggucgggccgcccccgcggcgccagcccccgacgggaggagccucaggcggccggccggguagugggggguaaggcccgucccucguggccggggcgggcagggggcgggcgaggccacgcugcccccucccccggggcggguagcccaucccccuccuccuccgaggccccgccacugccccuucucccucccuucccuccgccccgggcgggaccaaggccgccgccgccgccucccgcccgcccccccucacagcggggaccgcccggucgguccucgcgcgcgcccccucacuccccucccaccccuaggcucggaguggacucauccuuaccgcucaugguggcagcugaggggcgagcucaaggggguccuguacggggggguuggggggggccgggaaaaacgcggacgcugacgaggcaagcgaacccggaccggacagggagggggggguaaggaggagggagcagcgcaccacaagcccggccuaauccccgccccuuaucuacugccccgcccaaugagggagggugaaaggagggccuugcagaggaaaggcgggcugccuacccaaugguaggacucgcucucucgcugaggcguguaagagcaaguugcguacuugguuuccgcccagaaaggccgcccucucaguuuuagcaaccaauuagaaacucaggaagugguggugggcgggaugagaugacgauggacuugcagagaaaccagucaaccuccaggcgggcuccgugagcgguagggauaggaagagcuuaaguaagaaagacaggacaacgaccaaccagaauccugggcaugccugggcaaaguccguguagggggaagaguaagaaauaggccggaau

SEQ ID NO: 8032 - RNA, 19659 nt, Mus musculus
cguguccgucccggggggccaggggcgggggcuuuggaaggagcgggaguucaagucgaguggggacggggcuucgaguagggggugggggcuaaaagcuggggcugacacccguacaccugaguuccacacgagcaucgccggugacagcucuccagguccgguggagggcaacggggggaggagggaaggaggaggaggaggaggaggcgggagcagcauccggagcggagcugcagcagcgccgccuuuugugcugcggccgcggagcccccgaggugagagccugggcgacuuguggggguggggggcagggauggguucgggucuugggauccuggcguggagggagggucgggauacaauuguggcguggugggggaggaggugacucgaggaugcugaagcugugguaugaaggaacuagagcccuggacccgacgccuggagauaggaaggaaccgggcgaagcugagggaugcggcggcccagcuuggagaccaagagccuccaaagcugugguggauuaugcgaggaugaggguggcuaggggaagaccuaaaggacagcgggcaagagcacguccucuccuccucaaccucaggaccuagaaaggagggagaauuguggcccccuccagggaagggauggaagggcaaggccuaauauacccaccgccccccucccccacuccugcaccuaauaggcucuaccugaaaauuaggcugcaccuacaccugcaugcccuggcagggcccucucccccguccaucuguaaucccucuaaucuccagcuguggcauucccuaccguccagcuguugcaccccguccuccauuuggauguaguuuucucucucuucugccugcucgucucugguuuccuuaacccauuucccuagucaggcgcuucacaaaccucccuuuuucucacacacucaccaaacuccuuggcuuacaaucuugguaggcaaggcuuuggcugaggguagaaagagaagagggguggguuccauaaacaguaguagggcugcagggaggagccuugcggcucucugucuucugccucuuuggccuucaaccaaaagagcaugcacaugaggucucacacaccccaggcaccuggagccucacucuaaacucucuucugauucucccagccgccucgugguuuucaggcagagggucaucccaagcuuacaccaguagcaagaauuuggaaaggaaacagcccaaguucccucugggccuugcuguccaaacauuaguguuuacaaguucaagagugcugccaucucucauggaaaguuaucugggccccaaguugggucuaaccaacuguugacuuccaggaagaccccaagguccaauacuugccaaguccuagaucuuugguggauggagguggaagauggaagguguggcugggguuuccuagacuucuucacaagagcaaaacccuguuaaaagcaguuacugcucugagucucugggaauggggguuaauaauaaaaugauagagaacacgaaauuccagcacccaccucugccuuugcugcccaugccuagggaguaagagaaugggagguggcagcuuuucuagaauccauugaaaggaugccagcagaggacaugguggcuuuaggagaguuuguccauuugcccucagaaagcccggucaugugugaaccaggauaggggccaugcuguucuggggcauagggagcuccagagaagagcccuguucuucaguuuuaucuauuuauucaugguauuaggaauugaccccagggccuacauucugggcaagcuuucuaccaccaaaguacaccauuggguuguuuguuuguuuguuuguuuguuuauuuguuuucaaauuuuuugagacagugccacuaaguuaccucucagggcuugaacuuuaaauucuccugucucagccucuuaaauagcugagccuuugaggccugugcugacagaccuggcaggucgcauuuuucuuuauuuuccuuuuuucuuuuuuucucuaccucccuuucuuccucauuauuaccucuugucuugaggagguaaacaaaggaagcacagagcaugguggcugguagaagccucagcacaguggaggcagguggagacaaguggaucucugugaguucaaggccagccugucuacacuacaaguuucaggguagucaagacuacauugagucugucucagcaaacuaaaaagaaaagacaacuuuguaucagggucuaguggugguucaggugguaaaggccugacaaacaugcaugcaagaagcaaagacaagacucuggguuccaucccuagcauaaagccugccugccaugaugcuucacuuucuccuacacugggaaaguaaaggcaggaguucacggucauauuucaccacauugcaaguuuaaggccagucugggugacauaauaccuuguuucaaaaagaaaaguauuuuuuucuauguacuuugugugaaacaucaugguugcugucuauagagugcauccugugugccagguuccaggccgaaaacuuguuuugguuacuucagugaugccuauaacaucaucaaguucugcugucgucacuuuagggaugaggacacugaaaugacuuaguuauucaagacccauuaaauagucuugguggcguucguguuucaguaaucagcgggcuaaaaagucaaaaaugcaaggaggaucaggacuuugaggccuggcauggcaugauagcaaacaccuuuaaucuaggaccccggagugcagaggcuggcagaucucuaagacuagccugguccacacaucaagcuccaaccuagccacggcuacauaaugagagccccacccacccacccaccucucucucucucucucucucucucucucucucucucucucucucucucuuaaacacacagacacacacacaaggaaagaagucagcauauggcuagagcugggccuaucccacaaccucauguaugacugauauaguaucacaguccacauuuagaugcagaacagcuuuguuagcagaccuuauauacuauaggucacccagccaaucagaagcagccccagccucugcugguccugaggccuauggcucccucaugccuagaccaggggcaugaauuaaaaaacauauaaaaacaaaaccaucaucuuuuaugauaaaggaaacucaacauuauuacugaaauaauauagacacgccaaaagaagagaguugguaaccgacuugugguacaugacugcaaucuuagcacuugggagaagagacggaaggaguucaagucuggguugugcuauuugaggcgccaucuuauuuaaggaagaguuucaccugugaccuuuuuauuaauuuuuucaaauuuacagacauugguguucugccuuaauauauguuugugugagagugucagaucuucuggaacuggaauuagucacaaacugcuauaugcugugcuggagauugaauccaguuaacucuggaaaagcagccagugcuucuccaacccccuucccugauuuuuuuuuuuuuuuuuuuuuuuuuuugguuuuauuuaugugaguacacugucuucagauacgccagaagagagcuugugaccuaccaugugguugcuauaaauugaacucaggaccucuggaagagcagucagugcucuuaaacauugagccaucucuccagcccuucuguuacguuuuuuuaagacaaggucucacuauguagcuuagguuggccuuggacccaagauccaccugccuuagccucucuguuugcaggcacgucuuagcucauaugguuacuuucagauaguuuuaaaugcaaauucaguucugguucuguauauucaacuucuuccaugcuugacuuacugucugagagagacugugacccaugacauacuguuccugcucucugcuuuuuaugaucugagcaaggaugagagcuaauuucagccaugccaucagaagggcugacauuauuucuucaugaaccagagggaaccagcuaggggguaagaacgaggugcaggacuccaggccuucccugcaguuugcagaagcaagacagcaaauauggcauuuccagcaugucuguugucacaugaccacugaaaccuaaaagugucauuggucccgggguaguaaaaggucagagaccaagucccccuuucuucugauuaaacaggagagcuggucucccuugaauccauaaagacauggugucuagcuaguugggaagacagaacuaaucuaggaaaauggccagcacagcucacugcacccucucuccuucuccuaccccucuucugcccuuaaggccagguaagagucucacagagacuugacauaaggcaaggcugcuccaccaacccuucucccugagcagcacccccuccccagcccccucacuguccaccuuacuggcagaagugugagaauagggaaccccugggccugaugggggagaaccuggggaucuauguucccccaguucucaaaagguaacucccuauuuaaaaauaaggccuaaaagagugggcauucuucccauguggggagaacucugggguaaggacaauggauccugucagaagggagaguaaaccugcaggcaggcagaaagcacagcugcauucauccgaaacaucuauccuccaagggucccaaagguagagaaccaggaaucccaagccauggccacuuucuccucugcagccucuccucagacuaauuagaagagaguggaaccucccagccugcaggaaaaugaaguccaagcaggcagggauaguucgguguaagaacucaagacacaggcagauggccacaccucugagcaaagcuuccagcacuggcccagcacacaggccauuggaugcugcuguuaaagcaauagagcuagggagagcucacagaguucaccugcuacagccuugcugccuccucuggcgggaaagccuaggaggacugaggcagaggugaaggcgacuugcauacaggucccgacucuguagccuuccugugggacccugaaggaaccaucuguaaagcaggagagcuggcugucuuuagagccucuccauugguagauaaaggcagggaccucuguucccuugcagucugacaaagaugcuguccacauuuaauccuugugguucagagugacaggcgaaucccuccucuaugcucccccccgcccccgcccccaggcacugcauaauugauggccagggagacagguugcccucccccagggugaccgaaugucuggggccccggggcuucuaguccaccacucccaaagucccagcgccaagacccagcuuggguuaaugagacacagcuggugggucaggaauaaaggaagcagaaagggggacauuugcugggaaagaggauucuccaguuuaccauggcucccuggagacccucaacccucccugucuucuuucaggucaaucuggaagaucugucaucagccugaggggugguagggguacccggagcauaacugaauacccuaccugggucucaucucccagcuucuucagcuauuaccacugcccuaaaagucgagcaggugaaauggcuucucugcucuccccaucugcuggcccuggauaccacagggcccucuggggaugccugugugaucugaggcaggcagagcugcagaccguuucugaggaugucauccucuaugacuaaacuaagcccagaugauggagguugguggggggcacacaaaccauuuuaaaaggccugguguuauaauacccaaaacucaacuucuagauaggaaacggacuagggaagggagagucgaucuguguuuuucaucuccaucuucccugaguucucugcuuuucagaccggcuuuucaggccauucuccagguuugaagcuguuggccagucucucaccuaguuccuuugacuguuccuuucuugucccaucuccauuucuuaacuuaugugugguacuguaucccaaagcaaccccacgagucuuccccuccaaucccugccacuuuuucuccaccaggugccgagcccaaguaacugaggucagaggaaggugggcuucagaucacccaggugggggaugacuucgggguccgcaucugcauacgggcagcaaauauagccugcccaggucaggggcgggcuccuacgcggccccgccccugccucgcguucacgugacccugggcuaaucuugucccggugacuucacgggcccaguagucaugguuacgccgcagcgcccagcccuucccccagcuggcugugcucucuucuccccucuuggaccccucccacagccgcgcccccagccccgcaccacgugacggucgggaaggaggucgacaggggauggggcgccguggcaguaaccccuuccacuccgcuugccgcggugcggucacugguggccaggcgguccagcaggugggccgagagcuugcgagggggcuuuggugagggaggcggaagccuuggggucguuugcaggaaauucuccggugcguucuggugcaggcuggucugugcuuguaauuuaccuuacaauagacaccguggcucuccaagccgcacauuuuguaggcuaugacagcaauucagaggcugugguuccugauuucuggaccuugguuuucucuagaccguaggagaacuaauaaugccuucuuugcuaggcuguucugagggugcagggaacugagaaauacacggagcaugugcggcccuggguggguagagcagugcuccuacucugguuggaagcugagcgggagccauggagcgggaagcucaggcuuugcccacccagaagggaauuaacuaaucaggguuggaacuucacagaagacuuccagguugaagugaaacuuggaagacaagaaggguaacccuuugucgccaguggggcuaauaaugccaacuguauuuguauaauuuuuaguuuuuuaaugacaggguguguguguguguguguguuuugagcuaauggcaccuugcacuugcagggccuuggauccucuggaacaggaguuauagggguugugagcaccauguggaugcugggaauggaaccccagucaucugcaagaacaguaagcacucuugacccuuguccaucucuucacccccuuagcauauguuaguuacacauuuuaauggguuucacuguuacauuuucauacguguguguaauguacuugaucacccauauuccccauaacucugguuccaucguucccauagccuccuugucuccuuacauugucauaucgguuuuuguuuuguuuuuuguuuuguuuuugugacccacagaguuuaacuagguuugcaaauaggaucaugaaugaggguuaauuuacaguaucacuagcaccuuaucaauggcuauaccaucaaagaaaauggcuuuccuucuccccagcaaccauuagcugcauguauagucucaacaauagaggaccagagggagggaagaggugauguggugugagcccuccauaucucaggauugcauguucacauauccaauaugugauaaucacuauauuuuaugcugauaaucacuauaucccuagaguuuauggguuuguuuguuuguuuguuuguuuuuaagacaaacuuucacucuauagccuaggcuggccugaaacucacuaugaagccagagaugaccuugaacuucugauccucucaccuccaucccugagugcugggacugcugguaugugccguuaugugugugcuguugggagauugaacucaaggccucucccaugcuaugcaagcacccuaccaacugagcuauauccccagccuucccaccuuagagugguauauuguacugaggauuaauuucaguaauauguuuauaccaaaugcuaacuuacauaauaauuucuugaaaaguucacauugucuuuggacaccauaaaucagaacccugauauagcgucguguccaggguagccuagauaucaacauaaauaagccacuaagguaucuaaagcaaacggggcugaugaguuuguguuuugggucuuucagaagcuggauaagaaauuaagaaagaacuuaagaggcauuugguggugacagcugaugaagcacuauaaggacagaaugacaaugugucauuuauuuuaaaaauuuuuuaaauuacuguauauuguguaugacuguuuuaccuguaugcauguauguguaccaagugugugcccguuggauucucuggaacugggguuacagauaguugugagcuaccauguggaugugacauucaaagccagauccucugcaagaacaacuaaugcucuuagacacugugcccagcccaguauguaggauuuucaaauguacuagacacagaaucaacugaggugcuuguuaacuaugcagaucccaaacaaaccccguccccagugagagucuucaagagcaaggacugcagaugaugguuaggcaagcuaagacuuucccaaacuuccuuugcaucaugcucugagcauacuccucugugacaccccacacacacugugguucguucccaggagaguacugcaggggcugaagaacuugccucagaagcuguuagauuguugucagggaaccuugcaucucauccuaugauauccaacuaaacauguggcuggaagaauaguacgucucuuggagucaaguucugaaguaagccugaaaaauugggagaguuuguugugccugagugcuguuguuaccuaguucagcucuuuguaugacuggagaaauugacacuuaacuauacuuuacuugaaucaaauauaaaacuuagaauuuuugcuguuguauuuguagugccagcuagggacuagauccauggccugugccuguuuguauuuuauuuucuuguuugcuucucuuuuucucuacauaggguacaauuuuauguagccaaugcuagcuucaaauugaggcucuucuugccucuuccucucacguccugggauauaugguacauaccacagacccagcuggauguguggauuuuauuauuuuuggagauagggucuuugguagcucagacuggccucagauucaucacuacuuagccaauugaagauagacagggucuuuuguagcucaggcuggccucagauuccuacuuaccaauggccuugaauguuugauccuccugccuccagcucccaaguucuggggugaugagccugugcaccaugcuuggguuuaugcaguccaggaccuuuugccuucuaggcaagcacucuaccuaaaccacauccucaacccauuuuuauuucacacagggucuccuuuauucagaccaaccucaaauuugcuguguagcugaaaaugaccuugaacugauuacugccuccaccuccccagugcuaggauugcaggcaugcaccaccacagcagguuuauguggugcaagggcucuguguaugcuggggaagcacuuuaccaacugagucacaucccacuuccucaacuugugauuuucuaauuagugcuguuuaaguagcacacagcuacaaacugggacgaauuucuauugccuggggcugggcgugguggcacacgccucuaaucccagcacuugggaggcagaggcaggcggauuucugaguucgaggccagccuggucuacaaagugaguuccaggacagccagggcuacacagagaaacccugucucgaaaaaaccaaaaccaaaaagaaaaauaauaauaaaauaaaaaaauaauucuauugccugggaagcugaaucuugguuuggggagcuagggguagaagaaugaugcagaaggcuagagcuucucacaaccccauuggauaguucugcccucaaccccuuuauuuuuccaguugugccgaggggauaguacagcucugugguuaugguuauagacacaagaucacaucccacuggagaggccuaaguagguaccuguaagcacagagaagagagaugggcccagauacuagguguuccugggaaggccucagugacuguuaacuagggaagcccaggaacaucaucuggguaacugaguagaaagccugccaguaucauucaauauaagggagguuuaggugcauuaccaccaugugcccaagauuuagauccaggguaaagugauuccuaggcuggacuuagugauacauaccuuuaaucuuagcgcaaaggaaagaggcugguagaucucuguuaaguucaaggccaagcuauuguuccaggacaaccagaccuauauauguauauuuugugggaggggggaucugauuucauauaauaucuguguuuuuacagucaaccucagcugauaagaaugggugcugcagggguuaaugacaacugcacagccaagaggaaguauuucaguugcucuuuuuuuuuuuuuuuuuuugagacaaggucucacuguacaaacaaugcuggcuuugaacucugccucccaaguguauaugccacuacacgaggccuaguuuuauuauuacuaaaaaaaauacguauauuuuuagauuuauguguauuggugucuugccugcaaguaugucaaugcaucuuguauguacagugacuggagaagcuagaagagagcguuggaucaccuagaacuggaauuucagaugauugcuagucauggaguaguagguucuaagacccaaagccagguccuuugcaagaucaccaaguacucagugcugagccaucucuccagcccucgcuuuuguuuuugaucuugccaugcugggcaugaaaccugggcaugaugacgccaggcagugguggcacaccccuuuaaucccagcccuugugagacagaggcaggcagauuacugaguucgaggccagccagggcuacacagagaaauccugucuugaaaaaaaccaaaaaagaaagaagaaaggaaggaagggagggaaaggaaggaaggaaaagaaaagaaagaaaauaaauguugcaugauggaacuaugauaacaccaccgccaucucuucugcagcagcgguuagucccgugccuugcacauguugaacgcuuugcauuccacuacucuagccuuuguacuugaguuugauacuuuaaaaauugugggggugugaaugugcuauaguacaugagaggccaggacaacacuuuuggggguuggcuuuccuuccgcugaguaauucacuaggcuugcaacagcagauuauuuuacccacugagucuuucuuuagccaguaccugaguggguuuuugcuucccucugaugauacucaaguauauuauuuauauacaagaguauuguugaucacuaaucagugccaagaagcagcuccucuguauuagguuucccauaggguacagagaguugacacucaggccaacuccagcuagguaccgugagcucuugcaguaacuggcugauggcccuucccuccuuaauuccuuacagggcccgcugcucagcacaccuggcuccagaggccauggccugccuccaugaaacccgaacacccuccccuuccuuugggggcuuugugucuacucuaagugaggcuucuaugcgaaagcuggauccagacacuucagacugcacccccgagaaagaccugacgcccacccaauguguacuucgagauguugugccucucggugggcaggguggaggaggacccagccccuccccagguggagagccucccccagagccuuuugccaauaguguccuccagcuacaugagcaggauacaggugggccagggggagccacugggucaccugagagucgagcaucuagaguucgagcugaugagguacgucugcagugccagaguggcaguggcuuccuugaaggucuuuuuggcugccugcgcccugucuggacaaugauuggcaaagccuacuccacagaacacaagcaacagcaggaagguaggccagaucccuguaagaacacccuccauuuccuucaacaguccuaccaaaccuuccuaauccgcuuuauuuuccuuuacauuuguuucuggugcuaggauuaaacacuacaugcuagauaaguguuuuacuuaaucuucagcucuucaguauuuucucacauugugcuaggaaacugaacccaggaacuuggguuuuacacauccuagccaagugcucuacaaaagaguuuuauauauguguauauauauauauauacacauauacacccuuauguccaccuagcuuuucacaagaccacccaaguauuuccuuuacuagacuuuucagccuacuuuguuuucucaucauugauauauucagccaacccuugagugucucaaguucagugcagaucugucugagucuguggcacugugccuccuaccuacagaccuuugggaaguccccuuugaggaaauccuggaccugcaguggguaggcucaggggcucagggugcuguuuuccugggacgcuuccacggggaggagguagcugugaagaagguucgagaucucaaggagacugacaucaagcaucuucgaaagcugaagcaccccaacaucaucacuuucaagugagguccagggcaggggcuggggguaccaugacacauaggacuccccucaccugggacuauauccccuuucucaaaggagacccagaaauggcauggguagaaauguaggucccagguacacaaggcagauaauuaagcuuuaccccugucuggcccucagggguguuugcacacaggcccccugcuacugcauccuuauggaauucugcgcucaaggacagcuauaugaggugcucagagccggccgcccugucacccccuccuugcugguugacugguccaugggcaucgcugguggcaugaauuaccugcaccugcacaagauuauccacagagaccugaagucacccaagugaguaaggaugcaagcugaugugcguguaggucaccuacccauggcagccuggccaacucccuauguuuuagauucugccuuaaguccaucccuucuucccaguggcaguccccuggagggcuguggugagccucucuacuuuaggugugucagauauuaucagaaaguaagagcaguuagaugggguauggaaggauguggauccuggcugacuacacucuuuaccagcaugcuaaucacauacgacgauguggugaagaucucagauuuuggcacuuccaaggagcugagugacaagagcaccaagauguccuuugcaggaacaguagccuggauggcuccugaagugaucagaaaugaaccugugucugagaagguugacaucugguaagcagcaggaugagacagguacagaggucaugcaggucuggagagaacccuuccaaaugauguuccuuccucagguccuuugggguggugcuaugggaacuacugacuggagagauucccuacaaagauguagauuccucagccaucaucuggggugugggaagcaacagucuccaccugccuguacccuccagcugcccagaugguuuuaaaauucuacuucgccagugcugguaaggaugggagcugggagacuggacugacaaaaguuaaggaacaucuagaacucaagacaucuaggcucagauguccuuagcaaaagcaagccaaagcuuucuaaucucuccaagguccaggacacagaauguguaccaagggaacuuaacuuacaacugagaacaggcugcacuggccugcagaaaacacauuaaagauuugcaucauaucuucuuugaacauguaucugacuugaugcaaugagcaauauuuacgaugucagguugcuguaaagcagaacgaugucacugaccuuaguccccaaggaaggaagacugaaccuguuacugacauucccaguguuuguuuccuuugauggaaucauuuaaaaguuguggggaaagguguggcccuggcuggcuuggaagacacuauguaaacaagaauuaaaggcaccacaaccagacaccaaacacuuuacucggguauaaauauuaaagccaggaacugguggcacaugccuuuaauuccagcacuugagaggcagaggccagccuggucuacaaaauaaguuccagggcagccagagcuauacagagaaacccugucucaaaaaaaucaaaaggagaaaaaaaacaagccagguuaaauagaccccucucugugguauuuugcuguuaacaauggugucagauuaggugcuaggaaaagaugcucugguuccauucuaauccaccuuccuauuucacaacuccuuuaggaacagcaaaccacgaaaucgcccaucauuccgacagaucuugcugcaccuggacaucgccuccgcugaugugcucucuacaccccaggagacuuacuuuaagucccaggugugcuuuggguggaaaaacagaccuuugacccuugcagccauggcagcuuuucaugugaccaguuaaugugacugaauagauaaguccuuagagaaacauccauucccuuuuguaacuuacaguggcucaggcaaccuuccaauagcacaggucugugaagugacagggacauaguccucacccccucccccgugucucuccaucccuaggcagaguggcgggaagaaguaaaacugcacuuugaaaagauuaagucagaagggaccugucugcaccgccuagaagaggaacuggugaugcggagaagggaggagcucagguaugugccuauuuaggaaagugaaucuuaucuaaacagcaggaaccauucaucauggagucacagagaacaggguccauuucggccacaagcgaacccagcucaccgugggaaaaucaucugcccuuucagacaugcccuggacaucagggagcacuaugaacggaaguuggagagagccaacaaccuguacauggaacugaaugcccucaugcugcaacuagaacucaaagagagggaauugcucagguagguaaauaacccuuaagacaguauaguacauuccuaguuuucaugaaaauaaccaauuuaggagacccauacugagucuggauuuuuuuaggcgagagcaggcuuuagaaaggcgguguccuggucuacuaaagucacacccuucucggggccuccuacauggaaacacuauggagaagcucaucaagaaaaggaacgugccacagaaacugucgccccacagcaaaaggugagacucacaugaggacauugcaggagggauccuagcaaggaucucuuuaguggggggagacuuaccacuguuaaugugaacauuauacuuucccucccuuaccaggccagauauucucaagacagagucguugcuaccuaaacuagaugcagcccuaagugggguggggcuuccuggguguccuaagggccccccuucaccuggaaggagucggcguggcaagacccgucaccgaaaggccagugccaagggcagcuguggagaccugccugggcuucgugcagcuuugccaccccaugagccuggaggacuaggaagcccagggggccuaggagugggcccuucagcuugggaugcuugccccccugcucuccguggacuccaccaugaccuucuacuccgaaagaugucaucaucauccccagaccugcuaucagcagcgcugggagcccgaggccgaggggcuacagggggagcucgggauccuggcucaccaccuccaccccagggcgauacuccuccaagugagggaucagcuccugguuccaccagcccagauucgccugggggagcuaaaggggaacccccuccaccaguagggccuggagaagguguggggcugcugggaacuggaagggaagggacugcaggccggggaggaaaccgggcugggucccagcacuugacccccgcugcgcugcuguacagggcugcugugacucgaagucagguaaaguauggggauguucuucuaccccacaccaaauuaaaauccuuuaaucuccucauggguccaagugcuaacuauaccccaaccccacucaacuauguauccuugcccaauucuuaaugacuuaccauuuuuugacugguuuacuuacaccuacccacacccaucucuacuguagaaacgugguaucucaucugaagaagaagaaggagagguagacagugaaguagagcuacccccaagucaaaggugaguggugcuguaauggcaucuuucacuuugggaacuuuaaaggacucuacacaagcuguaaccaugacucaacauuuagguggccucagggcccgaacaugcgucagucacuaucuacauucagcucagagaacccaucagauguggaggaagguacagcuagugagccuuccccaaguggcacaccagaaguuggcaguaccaacacugaugagcgaccagaugaacgaucugaugacaugugcucacagggcucagaaauuccacuggaccuaccuacuucagagguggucccugaacgugaagccagcuccuugcccaugcaacaccaggauggccagguaaguuugaguugcaaccaccagacacugaaaagugaacugggaucagaaacccagucauuugagaaucuaaaaaucauuauuccauaaccauuaaaacaaauauccauguaaguaguaguugagaauuaaugguuccgagcauauagugccugauguuuaauuuguguggcagcuuugaugacaguagucaucaagguauccuaaaaggaaucuagcauagugccuuggaccuaugaacagauuuaaaaaaaaaaaaaaaacuccacuguuaauguaaaagaaggguccccaaggcucccccaccucacugcauuucuacucuucacagggccccaauccugaagacucagacugugacagcacugaauuggacaacuccaacagcauugaugccuugcggcccccagccucccuuccuccaugaaagacacucuuauuccuuguacauagagaaauauuuauauaaauaauauauaugcgccacauaaucaacagauagauggggcuuucuuagccuuaagccaggcuugagagugaacgacgccccugaccaauuaccgaauaaguucuggggacacuggcagcuguggaaaugaaugacuccgaguacuacccuagagcuauaaagaaaggaagcuggccccuucuugcuucaccccauuccuuauguugaacaagcaaguaggcaauagaaaagccaggcuugucucuauacugucuaucccugaacacuggaggggcagguagaggauucacuuaaaacugcacuuuuauuuuccguuuacuguuuacacauuuugcacuugggaggagggaaagaaacuaaggcugggucaucccucugagguuucucagguggcaauguaacucauuucuuuguuccuguuucucugcccaaacccuggcuuugggccagacgacuaacagcaugugauggcucaggcugaagaacuggggugcuguuaguccccacuguuaucuuggugccugguagggguggggacugucauauuguaaccccugugaacaaccuugaaauauaaccacuccaugcaggcccaacugucgaggguuuucuuggugaaugaguagagugguauaauacaugguuucaacuuggauuuaagauuuuaucugaggaauuuggacaaguuauuuucuaaguuaacauaaaugauagcagguaaacuuuucuaaaugauuucagaacaaggaggucucaaaacaccuauggagaaaacuaaaugaacaauuacuagaacuuuaaaguaugcaagguagaacaaggggcagccauucccaaguuuacuauccuuacuauccacgaguuccugcccagcuccauaaaugcaccagcugcucuacaauccuaggguaaguguaauugucaaucuccguaaacaaguuuucagaggcuacccaguaucauggagggggaggugauugagggcaaauuaaaaaaauuggagugguaaaaaagggaagaaaguccauuaauucuauugaaacugaaucagggcucucuggaaguuaaaagguauaaaaauaacaucagacaggaacaacacccacguaagucacuguggcauccaguuucuauucacaaagaaaaagcuccaguccaucuuuuaauuuuuuuuuuugaaaaauuccugacauuacagaacuaaacugaaauguauuaauaauccacucuuacauuuccaugacaaacaaaaauucaugagccaaacaaaaacaaaaaccaaaaaacaaaagggggagaagcuuauaaaacuaaauauggauaucucagcguaacugcugaacagagaaaggaauuaaaacacuuuaauuaaaaaaucaugaguggaugauaaaguguguagaaacugaaaauuuacaaacuauuuuaaaaccuggagucgcugacuguucagaaacuacacagauggaucauggguggugaacagcaggauuauggaugggucugcucuguucuagcugcuccccaugccaccugucuccgaggaaagccuguaaaacacaaagaagaauaagucagcuuaccuagcuacaauucaucacaccaagguauuucaagguuucuuagauuagcuaguaccauagugcacaagguuguuuauguaacaccacuacaaccaagguuccugagguguucucagaagaacauaacaaaugauguuaaguuggugacacugucucuucacguuuuacucuuugcaaacugaaagcauuucuagagaacauuaggcuucaaggaguugauccugucguguuuacacuagaacagcccaccaaugugaaggaacuuuguguugggagccuaacauuuaaagauauuauguaauuuuaacaauacuuaaagggaggagcaagaauaggaacuauagugaaaaauugaauuauuguuuucaagcuuauaauuuuaggacaaauaccaacaaaaaaacaaguaucaaagcuucaauucaguuccuuagcucacucuucaaaauccaaaaccuguggccuuacugguaccaaauucuccuuguaaacauaccuggcuacagugccuuucuacuuguuucaaauaggucauuugagguccuggaauacaauuaagcuuugagagaaaggcauucaguguacauuucauuaucacuggguagcagcaaaaugccucauucugaacacaacuagaggugucucagguccacaccacaagcuuaacuucacaaagagccaacugacauccauuugugauguuuggcuuaauaccaugugcacuaaauguacaaauaccacaggggaagggguauaucccggaaacuagaagucauucuucaauuaaaauauguuuucuuuaacgucagaaauuauuuguccugucuauguuacuaccguaaugugccuaaacuuuaaauauacaugugagaucucaaacuaugcagagugaagccucucauagguaaaaugcagcauagaggggaaucuuuaguuuuuucaaaaggaaggaagagauguucaagcaaugaggaccugcccacaauauaaaaaugccagaaguggcaauguccaccuggaauaccaaugcaggggaaguggagaggagg

SEQ ID NO: 8033 - RNA, 5487 nt, Mus musculus
gggaggaggcggugcgcaaggaggaaggcgggaaugacauuaggaaaaaaaaaaaaccaaaaaaacaaaaaacccaacccacucguaguagcuugggaagcuuccgccgagggucugcuccucccagaaggcggugcagaugcccgggcgagucucgcugaggguuguggggcggguagcucggauccauaagaagacacaaggagccgagugggcgggggacuccagaucccagcaugccccgcggcgggcccuaccggccgcgacuccgggcuuggccccggcccuagcuccucggcgguguacuggggugcguggaggcuguagucacgguggcgcccgcggggacggaggagggaaugagugaagaggaucagggcuccggcacuacuacaggcugcgggcugcccaggugagcugccucgcuuggauuccugaaggacgaaaagugugagguggugaggaggggcggcggcgcggccccagcaugcaccuggccugaggguuguucccagcaagcacugggguagugggcagagguucccggcaugcacuggggcuguggccaacgccuccagcucuaguuugggguuggcuugauucccagacugcacuagagcccugggcuuuaugccccgacguucaguguauuugguggguacuggguucccgaauuguauugugucgggggaaaugcacguucaaccagcaccacggcacaggaucccucgccuuaacugagaacaguacauucuccacuugccuugggaccuugcuuucccucaugcaccuuaacuuuuaacccagccaauggaugcuauacugccugggaauucauggacccuauaauguggcuaggucuaaugugacagugauuugccaggugggugccgaaaggggaagugugauguuggucugugccccuucccagcauagagcaaaugcuggccgccaacccgggcaagaccccgaucagccuucuucaggaguaugggaccagaauaggaaagacgcccguguacgaccuucucaaagccgagggccaagcccaucaaccuaauuucaccuuucgggucaccguuggcgacaccagcugcacuggugaggaaggccugggcagccuggcuggggugugcauucacagggcccguggcuuaauaucaugcgaucaccucacaguccucuccuuuaaagccagggagggauggagauauuucagggggaaagaaggauuggaacagggcugugagacgguggacgggacccgagagacucacuggcgagaacaggaaaugucacagagaucugcuacuuuaucaccccagaggaagaguaaaugagacauugaacuccucguggguauuagggggagcacauacucugcuagccuucaugccucacauugaacacgaagaacuuaguaugagaaauuaaaugguaggcuccaguucacauguaauaaguggcagagcagagcuuugacuucagacccucaguugucucuauuuccuauuuaccgagggaagagaaaaggggaaagaaagacagagcaaaacaucccuccgcaacccaccaguguuggagcucaaaaauccugccuggcacaguuucauuacgggagcugacugaaagaggagguguucaaggcccauuucuguugcuguaguaaggcuccgaaacuaaaagcaguuuagaggaggaaaaggguugauagguuuacaguucagguuacauucaugacuaagggaagcuaaggaagaaacucacauuaucagucaagaccaaagaaaauaaucugauucuugcuacuucugacuaaggaacucacuucacagccacagaagcacagcaggaacaauggcagauacuccaugcuggcuggcuggcuuauuuauacucuacuagauuucuuacacaguucaggaccaccugccuaggggugguaccacaauagugggcugugcauaucagcaucaauuaacuaucaguccaucccccccacccacccccagacaugcccucaggccaggcugauguaggcaauuccucaguuaaggcucuccuuucagauccuuuuagauccuagguugugccaaguugacuguuaaugcuaacuaggaaaaaggcuaguccaacaauuaguagaacccuuccaguucugacaggggagguuggucagagggcucuucucacucccucuggcuaugaggagauaggcugugggggcugguuucucugcuguccugccggugaccuccaguauugcccacgccccuuuucuuaggucagggccccagcaagaaggcagccaagcacaaggcagcugagguggcccucaaacaccucaaaggggggagcaugcuggaaccagcccuggaggacagcaggugagggaggaacagccaaggcacacuagaagcccgcugagaacccaggccucugcacuaucuacuucucucccuaagccuggucuggugacucauggccacccucucguggccccuuccugagaauuuccucugaagcugaacaggguguuucuagagugccucagaguaauagccagcccccuuugaugggugguggcugcucuggggcaugagaaaagggcauaggggguggaggcaaagacugauaaaguugguccuggcaugcccccucuuucuagcaagauggcuuucccucuuccacauucagguugcagcuuguuggguagaaagagacucuuuucugagcccccacccuaaccucagugcuucugagccaguguggggucagcagaggaucccaggaggaagagcuguugcugaggcucuccgagucugcaucggggggaaggaguucucaggggauggaaaggucagaaggaccucacacccucauucccuucuacaugggugugaauccaagaccuucuuccccucgggaaguucuuuuucucuccuagacucuucaccgccugaggacacuccugucguugcugcagaagcugcugccccuguuccaucugcuguacuaaccagguaucuugaguccccugacgucuuggaggaaggagggggucuuggcuucuagucucauagcucuuggacucaggcaggucaggaugaggaagccugagaguaaagacagacugguguaauugaaaaauuugcaccagcugguugguaagccugagcuaggagguaauuuaugaugauuaaauagccaagcaaugaauguuagauuguuuaaacaucuuagaggcuccauguuugagacccaaaagguacuuccaggacuguguguacagcuccuuuaccuccaucacagggacauugcugaaggauuuccacaucuaagugcuccugggaaguagcagagccucacuuggugggguguggggagggaggagaaaggcuagauguuuggacagauagcugccugccuggugaggaauugggaggugguaguggcuggcacuugauccaugaccaggacaggaggaaccucugcauuuuccucagcacuggccugggcccuuuuuucuuuaggagcccucccauggagaugcagcccccugucucuccucagcagucugagugcaaccccgucggugcucugcaggugugccucgucuucauugucaugugugcuaucuucucugaaguagggcugaggcaggggcgugugcacuuguggguagggugguccuccuucucacucaaagguggaggcucuugguagaaggccauuggcuaaggacccuuuccucacuaagccuuggacucucuuaugguuuucuuucaaggagcugguggugcaaaaaggcuggcguuugccagaguacauggugacccaagagucugggccugcucaccgcaaagaguucaccaugacuugccggguggagcguuucauugagauugguaacuggggaaaaggggguucacucaccuucucucuuugccacacuguaaccccaaacacaaggugguucuuugccuggcugugcucugucccagcuuccuuugcuuugcagguccuugcucagcuccugccuuccugucucucccuugucccugcccaucuuucccccucuuaucuggcucaccaacuccucaguuaaaaagaucaggccuugagcuccucuuugcagugguaucucauugggugacugucuaaguuaaccuagagggaaagcauuggucuguuaggaauccccaaguugaacaauuccuuccccacccucaggcaguggcacuuccaaaaagcuggcaaagcguaacgcagcagcuaagaugcuccuucgagugcacacuguaccucuggaugcccgggauggcaaugaggcagagccugaugacgaucauuuuuccauuguaaguggcuugugugggcucgacaugugguucacacugcaggacaugguacggaauuggguugggucugugguuuggaagugaguaugggccugcuuuccuucccagggcuccuugaaccugugcgcccagaaguccccucagccuauauguagggucacuagugaaagcuggccuagggcaaagccccuauaggcaacuuuuccugggaugaggaaggcugccaggagucagagcauaauacccaguucuugggucccacaguccuuagcugcuuucucacucuuaucucauuagggcgugagcucccgccuggauggacugaggaaucgugggccaggcugcaccugggauuccuugcggaauucugugggagaaaagauccuaucccuucgcaguugcuccgugggcucucuaggggcucugggcucugccugcugcaguguccucagugagcucucugaggagcaggcuuuccaugucagcuaucuggauauugguauggccaacuagagacuggggauggaggggacuggaucaaagcaaguaugaaggaguugggagaugggugauguguacacuguuuggugccccuuccccaccagugccucccuucucuuucuugguuuccagaggaacugagccugagugggcucugccagugccuaguggaacuguccacccagccagccacuguguguuaugguucugcaaccaccagggaggcagcccgaggugaugcugcucaccgcgcccuacaguaccucaggaucauggcggguagcaaguagcaucccacugcagugauggauaugcaucuuuuacuucuugcuccuucugccccuggguccauguauccaccuagcucugguacccuccagaggugccaucucuaccucugacacagccugucugccuugagacugaggaaggcacaggcaagcaaggagccaugaaccacagggccccagccagcacaggauuuguccucauuccgugggugauggaugaaucuauuggaguccugaauaaaugcugcucuuuggcuuccaaaacccugcucucucuggccuugggucaugaggguauaaggaauaaacauggugagcuuguucuccuuuugaac

SEQ ID NO: 8034 - RNA, 833 nt, Mus musculus
ugacucugggggcagcaaauaccugcaaugaugacugaguccguucgggcugggccaaauuucagugucaucucaugcuuauguuuaugaacugccaggugguccucauuuguaaaucucugaaaugaaauagaaauggagaugugaaaaaaggcaggcauugcuucuccauucagggcucuuuaaaauggccgacuaaacaaaaggacauuacagugacacuggccccuggaaaagaagagagaggaaaaaccauggaaacgauagaagagaugaagaauaauggcacugaaggcggggaagagaggagggaagauugcaucaccaacugcuuuauaucaucagguacaaccaggaggauagccuguugcugagguggggucuaggcauggaaaugcauuaagguaaacuuguaguaaacaagggugaaacaguuucuaauaauaacaaagagagggaaaggcugggcacucaguggucaucacaaaaucaggaaauuucagaacgaagcccucugugguggggcugaauuagaguauuuuaugaggggacuaacagggagauaaauuaugcaggauuaggagaaccauuuaacuuccuggcccccacagugcugcagcaggcgccuuugcggcuauuuggcucacaguuuuaaugagccaggacggaacuguagaugacagaagcccaauggccagcaauaauagcauacaccagcccuacuagccaaaugcugucucccuucaucaggcagccugccugggcuccuguagccguaaagaggccaguacaaugcuguuggcuguauaaugacaaaauuaaaaaugcaagca

SEQ ID NO: 8035 - RNA, 388 nt, Mus musculus
uuuuucucuucuccauuccuccgccaucgugcgcgcuauucuugauucggcuucucgccaugucuucucacaagacuuuccgaaucaagcgauuccuggccaagaaacaaaagcaaaaucgcccuauuccucaguggauccggaugaaaacuggcaacaaaaucagguacaacucuaagagaagacacuggaggagaacgaagcugggucuguaaggauucacacaauggcaagacugaggauuuauacugaauugucaucaaucaguccuaccagauggauuucaacauuuaaaccuggagacuuuucgugucuugaauuaggauguuuguccaguaauaaaauauagaaccuuucaaaaaaaaaaaaagaaaaagaaaagacaaac

SEQ ID NO: 8036 - RNA, 16244 nt, Mus musculus
uagacagugucgagucauagaagaaccacaagccccagaagcucucgcgucacucuuccccuccccuccuauagucggagugcuguuuuuguuguuggugaaaggugaggggaacagcugauccguccgugggguaagaaacuuggccuaacugagggugggcuuacgcggggguggucagcccgcuucucagccugcgaaaggcuaauccgagagaacuguagaagaggacgguaggagcguuuagguuuuaauacuuuacgcacuaaggaagccucccccacguuucgguuuuguugguuucaaggggggccuugaggaguagcccgcauuguccucacuuucuugcggggccuccucaguaaagcucgauccgauuauggaagcuugaagggacugaaauauuugcuuaaucuuuuccaggcaagucuuugcccucacagaccuucucucucuuacccaaauccaaagauccaaaggccuuuacuacgcugaaucccugaggggaaaacuuccaacuuguggaacgccaaaacgcugagagcccuacaguggagaggggacacacacacacacgcacacacagagagggagagagagagagaaugcauuugaacaucagcaucugaccacauacacuuucaguucugaagaauaucugcagcuguuacagauugucuuugugggaaaggagggguuugggguucucaacggguagaacuuuagagacagaucucacucuaaccuaagaagacuuauauugaagaaaacacggaguagcuguaaugagagauuuuucauagaugaaaaaaaaaaagccgacaaagaaacuguuuccuauugcauugcuggcccaccuuuccuucuccauggaguguuuaauuucuuuuaaaguuccucccccacugucucagccugguguggguuugugauguuugggggugugcauaugacuaguggugaugucugauuggacacaucagcugcaccugacacaggaagcagaugugugggcuagagaaaagggcugccuccccgcucuggacugagguguauuuuuuuuuuaaguuaauauacagugaguuucauuucaaacauguacaccauccauacuuuguucuuauucaucucugaguacuacucuguuuuaacuuuuuuuuuuuuacuucugugugugugugucugucugucugugucugugugaagauagguguacagaagucugagcacagcuuggggauaucaguucucuucucccaaccuugaguugguggcaagcaccucuacccacccaacuauucuacccccugaacucuugauuguuguuguugcuauuauuauuauuauuaucuauuuuccaauuaguucucccuagcuaacuccauuuuaucugcuuaucuccugccauuaacccaaacauaugucaagauuuggacucuuagaauugaggcuaagaggagccaacaagaaaauggguauaggguacuggagcugggcuaacacccaaacaaaucauuagcuuucuagcucugcucccgucaagauggggguggggggggggagaauguuucucguugaucucugccuuuucucaacgccgaauguauauuuccccuucucagggccccugacuuacccuauuucuaaccuguuucccugccuaagggcggggcuuuccuggcuccaggcccccacauuccaucucugcacaccaccaccuuccuacugaauauuucacuccacccuugaacugccaccuccagaaguuuugauuuccuggaauagaaguugaaggacagaaccugucuuuccuauuauccuccccuucucuagccuuggaggaaagccaaagcucgccuucuucugcuucccuagaguugaucgagauaggcaacucacggaucggugcccccaagagcaggugcuccaagagcagaggacccaggauuagguuguugaucccccaaaccguaguccccucugaagacccaucaucgugauugguaaagaagguugaacaagcuuaggcauauguaagcaagaccugcuuaaacugagagaggcccacacuuccauuggauuuugaauuuuagagccagacauuauagggggucaguuacaucgggaaaccaaaagaaucuggaauucccaaggauguugagagaugaaagggagagacagagaugggcagagaccgagaugcugggucaguggggcaaugaaaaggauuagaaauuagacaggugagggccuguaagccaaagaggauacaacaugacaggguaggaaguugacuuggaagaccuauggcccaggaauuaaaagugauaccuuaaaaaggucccacaaccuugggggccuggaaaccuguuuagugacagggacuguggguuaggcacacaggggucaaaggaaagaagcaauggaaaaacaagucuaucaacccuuucuuucauaggacaucagccaucuugaggacagcauggaagagucaucacuaagccgggcaccaucccgggguggagucaacuuccugaauguggcccgcaccuacauccccaacaccaagguggaaugucacuacacuuugccuccggguaccaugcccagugccagugacuggauuggcauuuuuaagguaucccuagacccucuucuagcucaagauuaugggacacagguugguuagacuaugaggaguggcuaaguccuuacauucucagguugauagggggaaagaugacacagaggcagucaguauaaaguucaucuuugcccaucucucuccugguaguauaauguccuccaaccuuaccugacucuauuauuauuauuauuuauuuauaauaaguacacuguagcugacuucagacguaccagaagagaauaucaggucucauuacgggugguugugaaccaccaugugguugcugggauuugaacucaggaccuuuggaagagcagucagugcucuuaccugcugagccaucucgccagccccuuaccugagucuuagcauccuugguaccauuuguucaguccugcccuugcccacccuucuauuucucaccgauaacucugucauccugccuuucucuucuagguggaagcugccugcguucgagauuaucacacguucgugugguccucagugccagaaaguacaacugauggcucccccacccaugccaguguccaauuccaagguauaaagaaagauggaaugccggguagugguggcacacaccuuuaaucccagcacuugggaggcagaggcagguggaucucugaguucgaggccagccuggucuacagagugaguuccaggacagucagggcuacacagagaaauccugucucaaaaagccaaaaaauaaaaauaaauaaauaaaaaauaaaaaaaauaaagauggagaagccaaaaaaguggugguuugggggaaggcggagggcuaacagccauaaaaagcacagaggauaaggaauaugagagcacauaacuccuaauugccacgccuaaugguacuccaaugucaucccagcuaccaaggaggcuagggcuggaagauaacgugaacccaggauaucaaugcuggcuuaggcaacauggcugaccccgucuccaaaagggggaaaaaaaaaagacuuugugagacuguguccaacagaguucagcaaguuaucguagggucggcaccgguaacuuagaggauacuguagaaagauagaggauguuaaucccauucauuuacacaacgaaagaggaacucccaguauaggacaagggaaagugugugcuaauagcagucugagcgaccuggauucaaaucucagcucccugcuuuacaagcuguuuggcauugagcagguaaguuagaauagggucccagcuuguaggaucccuacagagauuuuuacaugaccuggggaaugcugaaugugugguguguggugcaugccagcagacagucagugccagcuagagucaaugugaugaagaggaagaccggguaugaauaaagcaggugucuagacaggaaggaggaaggaccguaucccaaggaccgccacaagggaguggacaguagguagcauggggauacucguccuccucaauaggaacaggaaccuguuagcacuugagagccagagaucauacuggguuucugggcuauucuucccacagccagcuaccugcccaaaccaggagcccaacucuaccaguuccgguaugugaaccgccagggccgggugugugggcagagcccccccuuccaguuccgagagccaaggcccauggaugagcuggugacccuggaggaggcugauggaggcucugacauccuguugguugucccuaaggccaccgugcuucagguaagaaaaaaaaaaauugcagacuuguuccagggccagggacaccaaggacagcauugcgagagccagccuuuucaaaggguggcugccugcccuaaauccuacaggagagccacaagguggaggaaaacugccucaagcaacccagggaggaaagagugugggcacagcagggcucgaaacugucccauucaguaccaaaggugcugaccacauagggcucuuuggcacuucagguaugacuaauccaguuugagguauaaucacaggaaagauagcauacuggauuucaaacacuuuguaucucaacauuuauuuauuuaguuguguuuaucuggguauguguagauauguauauacguaagugcuugcaugccacaacucguguggagucagaaaucagcuugagggaguugguccucucguccuuuucagcguugguuucaaggauccagggaccaagcucaaguuuccaggcuuggcaauaaguauuuuaucucaucagccaucuugcuggccuagccgugguacuuuuaacuucaaucccucaauuaccuuccccagcccaggugugugugcguacguguggauacagaggccagaagguugugugucauaggauacucuggagcuggaguuaccggugguugugagccacuugauguagcugcugggaacuaaccucugguccucucccagagcgacaagcacucuugacugcugagcuguuucuguggcccucauauacuucuuauuaaaguggaugcuagaaaauucaaacuuaaaaaaugugccagaaaaaauauauaaauauuuccaccaggccagagaagagucucaggagcgaaggcagauacuacagagacagugagggauaggcgggaggcaguccauccauucuccagacgggagaacagcugcucagcaggugaaaacugguagcuccucagagauuuggaccagucuccgcucuccagaaccugagccugauaaauacauggaccaacaugauaggagggauaacacaagcuucuacccaguguucuggucuuacauugguuauucucauuuaaaccucacagaugaggaguuuagugguuuggcuaguaaaaacuguaucucagauuuacucaaaucugucugacucaauagagauaagguaaacuuagaggaggccccuugucacugugcccugucagaggaaagugccagaccugggcugaaaggugauugagggccggcaguuaaggucugggccaugcugacuugguuucucugccccgaggugucuauaauggugcuugcgcgcgcgcacacacacaacacacacacaauggugcuugugcgcacgcacacacacacacacacacucucucucacucucucucuccccccccuucuccugcccuuguagaaccagcuggaugagagccagcaggagcggaaugaccugaugcagcugaagcugcaguuggaggaucaggugacagagcugaggagccgagugcaggagcuggaggcagcucuggccacggccaggcaggagcauucggagcucaccgagcaguacaaggugggaguuggagcuggugggggugggggggcccagacccagcaaagaggagaaaggaaagaugucaguggaguuuuuaagaugguccuugcauggaggaaauaggcuuaaggguaacaggugagacuaagcuuugaaugauaagagguacaucccaguuuguaacaagacucaguucucugcauccaggaaugguggcguaaugccacauucccaggcaacagcgccuccacucagcuuucccaaggaagguggcaggacagaggcggggcauacguauaaugguaagccugagccuguccugacccucugucucuuuugguggaaccuugauuccaggggcucucccggucccauggggagcucucagaagagagggacauccugagccagcagcagggagaccauguggcccguauccuggaguuagaggaugacauccagaccaugagugacaaagugcugaugaaggagguggagcuggacagguaggggaccucccuagccugaggguggccucuguccccaaauccuccaucccaucccccuggccucugcuucccaaggccuccacuccaguccuugcuacagauggguguaccugcugucuggcccuucacagucgcauacaggguauccugguuacuagggcuuuccuucugccagcucauacaucucuguggugcuguucuaggccuucagaaagaucaguugcuauuuauugugugguagaagcuaagcagaacuggagauggaauaucuagagagaucacuugagucuagccugggaaauauagccagaguucauaauauauagucauauaaauaaggauauauauguauguguguguaugauacacacacauauacauacacacacacacauauauacauauauauauuauuacauuaaguaaaaaaaaauguauauuuaaagcacaggaaaggcauuagguucuguucuuguuguugggaauguucagugucacagcucagugguagaaucaccuuuuaaguguaugcaacacccuaacuucagucccagcacuauaaaaaagagacagaaauguuggagccagugauccaagaguacaagaaaaucucucccuugagaaaaaguauaaaccacagggaucuuuuguuuguuuuuguuuuguuuuguuuuuuuuaaaccgagccuuacuauguagcucuggcuguccuggaccucacucuauagaucaggcuggccucaaacucacagagaucuuccugccucugccacccaaauguugggauuaaagguaugugccaccaugccuggcuaaaucacagaaucuuaacauuaagaguggcauuaagguauuuaaaagaaagucacuuuugguccagccucuuucaguaucaaacagcuaucacuuuugugucuguuguauagagccaaaaucuucccaucgggaaaacagagacaggaagaucaccaguuaaaccuuccuaggcuacauagugaaguagagaccaaucugggcuacauagugcauuauagaccagccugagcugguugguguguguguguguguguguguguguguaaaauaaaauuuuaaacaacaaaaaccuuucuaaaggaaagagauguucugcccaaggcucagggcaguaagcaaggugauccaagggguugcuucaucauguacugggcuugcccuaggucaggacagaugucuguguucucagagucuauguuucacaugcuucgucuagccuaccuaccaccuguuguugcaagauuugguccccagugaucagauaaaagaacaguacuauuuugugauaauaaaaauaguaugagauucaaaugucaguguuuauuagauaagguucucucaggcuccaugcacaucccugcacacauuuaccugcagccucuucugaucuacagcaagcucaggguuaauagugacugcccauugucacugaaagauuggauuucaucuuguaauugaguggaaacagggagccacuggcaucauccuguacagcgauccauaaagaggaaagaagcugggcauagugucacacgccuuuaaucccagaggcagaggcaggcagaucucugaguucaaggacagucugguguacagagugaguuccaggacagccagggcuacccagagaaacccugccucaauaaaugacaacaauaacaacaaaaagaaaggaaagcaguggaugaucauguucuagaagagcgugggucagaggucugaguauuuccacccagcacugucaucucaucaacaggguuagagacacagugaaggcccugacacgggaacaagagaagcuccugagacagcugaaggaauuccaggcagacaaggagcagagugagguaagagacuccuaguggguuugcuugcuuucuuuuugguuuucgagacaggguuucucuguauagcccuggcuguccuggaacucacuuuguagaccaggcuggccucgaacucagaaauccgccugccucugccucccgagugcugggauuaaaggcaugcgccaucacacccgguguggguuugcuuucuuaguuauacagcuaguguuuguugagucucuucugaaugcugggcacacacaagggugagaugugaaggagacccugugcacccccugccccacaguguaguaccugcccacaucacaagcagucaaaagugcaauauaaaugucccaagaaaagccuaauacaaccucacaggguccagaaaggugggaaagaacaccucuuauuagacuuagaaacagcuguuaagugaggaccuauagugcugguguaagaggagcccugggacuggccagccagucuagccaguuggcagguagagaacaauuguggaagacacccaagaucaaccucugguccaccuggcucaugugucugcacaugcauacacgcacacacacaaacacacacacucacacaagcacaugcacaugcauacacacacauacacacuaaugcaaaggcuauaaaaaaggaggaaauaagagccagacaugauggugugcuuggcguuuguucuaucacucaggaagcugaggcagaaggaucuuuuacuucaaggccagccuaggcugacacuaugucaguagguaggaaagaagaaaggaaggaauucauauuuuaaacacuuugugucacagacaaguaaguagucagugauaaguuuuuaaacugucaacuuuacagcuucgguuuacucuucaauuugcuagaaaauacaaaagaaauuuaauucugaauuaaccuaaaagcacacaucaguggauuagugcucuccaguguguucacuguguccugacagacuuuuaaaaacaguuuuuaaucauuuagagcaaguucagagcuuagauuguaguucaguguuaagcaaggcaaaaaaaaaaaaaaagaaaaaaaagaaaauagaaugaauucaaauaaaauauuugcagaaccuucaauggcuuucucagaaccuugggcuucucucgaaaacugcgcagcagugaaggauuggagcgggaugugaugguucuuuaauuccagcacuggagaggcugaggcaggagaauugccacaaguucgagguccugggcuacauagcaagauccugucuuagaaauauaaaacaauacaaacaagcauguggguugaguuaaguagaacaaagaaggaugcaaggagcagcccgagggagcuugugcagaacugagguaaggugcagaggucugcaguugaaccucuucccuuuagcagggagacauaugcuggugggugucagguagaggaugcacaugguugaagaauuguacugaaagccgggugaugguggacagcacaaaccuuuaaucccaccacuagggaggcagagacaggcagauuucugugagucagggccacccugaucuauagagcaaguuccaggacauccaggaauguacagagaaauccuuucucaaacaaaaacaaaacccaaacccaaaaaaccaaugguacugagaaacacugacugccuaauccuguuuucugaguaacugguuacaacacuauccggucagcccacaagaacagccaugccugaacugacauggucauggcaguaauagaaaagauagcugugaccaggguggagaguggaaaagcuaucgauuucuucugugaacugcuggggagaaaagagagccaagaauaacacccaaguguccaguuaggugaagugagaaguacucaguacagcagacaugagugacagaagucucaggaaaggcuaagcaugguggcaugcaccugugaccucagcauuagagacagaagcaggcggaggaccagcuacauagucugacugcagggagagggaauagagagaccgagccuugggggaggggaauagaagggagggggaagaaaaggucuaaggugggaggugcaguauucugagcuuuaggggccauccagacuguuuugacuuaaaggaaaagugggaaagcaggguugccuuaauagccugggacugagacccaagaagacaggacaggagugauugguuccacuugugcuaaaucuaagaaauagcccucucuccucacaguaguagcaggaaggcagccugcccguggcugucugaacacucauccccugauccuuaccugccuguggcugucucaacacgcauccccugauccuuaccugcuuuccauuugcaccaggcugaauuacaaacgguccgagaggagaacugcugcuuaaauacagagcuggaggaggccaagagccggcaagaagagcaaggugcucagguccagcgacugaaggacaagcuggcccacaugaaggacacccugggccaagcccagcagaaaguggugagugaaggccuguaggugguaggaagcagugcgaguuccaaguagucuugacaaauuugggugugcagagaagaggcagagguggcuaaagugaacagcacaacccaguugaggggcucccuggcucacacgugguugccugcgggaucugaucuccugucuucuuuggaggccgagcuggagccccugaaagagcagcuccgagggguccaggaacuugcagccucaagccagcagaaagcggcccuccuuggggaggaguuggccagugcagcaggagcuagagaccgaaccauagcugaacuacaccgcagccgacuggagguggcugaagucaacggccgacuggcugagcucagccugcacaugaaggaggaaaagugccaguggagcaaggagcggacagggcugcugcagagcauggagguaggggugaccccccccuacgucugggacuccaacuguaaguuggguguucgggaggagagaagagugggugagauccugggagguugaggagagaugcccacugugcuuuccagacaugaaccaacccaacaaggaauuccaguccugaucaccaaaaucccuaguuuaccauccuugguguagaaacauuugcugucaugggcaccaggcccugccauaguaccaguucccgcuuucaggugacucagaagugaggaaauuggucagaaacaauuuggucccccagacauaaaagaaagacccagagagggcaaugcuauuuuccugucauccuuugccacuucuccuccucccucccaucuuccccugcaccauccuaggcugaaaaggauaagauccugaagcugagugcggagauccuccgacuggagaagacggugcaggaggagaggacccagagucacguguucaagacugagcuggcccgagaaaaggauucuagccuggugaggugccugccuccucggguucagaccuauguccugauguauaggucugacuauacaucgacucugaaguaccaugggcugacuuggguaccucccagcccucuugguuugaaugugugcauuccauuccuguucauagaaugcaccucugggcucugggaugacauacgagaauuacaggguggcuuccgguauuaccuaaaccucuucaccucaacauaagauaguuguuagcuagggcagcauuugagagguagaguuuaggacuuuggccugagcccugggugggggugggggugggggugggagggagcaagacaagggccuugaggaagaaacauugucuauggagcaagagaggacauaguuuaacuuuuggaccagguucuuggugacacauugcaggcuccagguucuauuaccuuuuccucucaggugcaguugucagagaguaagcgggagcucacagagcuacggucagcccuccgugugcuucagaaggagaaggagcaguugcagacggagaaacaggugagggucgccuguugccguagaugagacccuggaugccaaagccacgggcuugggugcuuaaauucuguaucaucugggcacuaucuuggcucagaaacuagaaucucuuugaggauacaaagguugaaaaggggcccugacccuucucagaagcugacaucgugcuggggaggaacaccagaagggaaggaggcgcacgauaaagaacuacccauuagugaggaucugccuugugugaccaccaaggaaaggcccagcaagcagcaaggcaggugucugcaggcugcagcaucugcuuccccucccccaacugcaggaacugcuggaguacaugaggaagcuggaggcccgccuggagaagguggcggaugagaaguggaccgaagaugcugccacagaggacgaggaagccacugcugggcugagucuguacccccagucuugggacaccucuucugcuccccgccucuuaugugcuuugaagcagccuggcugucccuucccauucccugggcccucuguaguugaagggucucccuccucagauucccaugguugaccuuuccuuucuucugucugccuucccucucaggcugcccugcaucucugacagacucagaggacgaguccccagaagacaugcggcucccauccuauggcuugugugagaguggaaacacaagcuccucuccuccugggccucgggagccuucuucucuuguugucaucaaccaaccagcacccauugcuccccaguucucagguccaggggaggccagcagcucagacucggugaguagugagaacccacauggagguagaaagcaggggguagggucccaccuggaccacagagaaagccugcaccguacucugggcucguucucuagcacuuguacuccgggcuggaggaggcaguccuagcuucagacucugcacucagagcucaaggccagccugguguagauggggccagccaagacuauacggugaaaucuugucucaccuaaaacccaggccagugcaauagccuugaugcucccagguccugucuugucucuguccccuugcccaaccuaccagcccuggcaaagcccuguucugcuucucucuuccugccacucugcuguccgggaccagccuuggcuucuccacccuuacuugcuacuugcccaccucagaacccaucccaauccuccccccaucucuuuccaggaggcugaagaugagaagucaguccugauggcagcggugcagagugggggcgaggaagccagccuccugcuuccugagcucggcagugccuucuaugacguggccaggugagggcagcacaaagaggggggaggucagugugcaagcagccuccgcgccccgcccuaacucccccuucuuggcucagccaagagaagguaccagugugguugacaggaacgccaggcucccuccacaaaccccagguggcuucacauucucucucccucccuccuuugacuggcuucuguguuguucuagcuucaucuuccguggagcccaaauuguccugcucccccucucuccugcccccuccccuuccccaggcaccagguagguaccuagguccucugggaggaagaggauggagacugagagaaggaccgccauccagagcaucugucuggcuaugcuagagauguugcucaucccugacuuccugggaaacucuaggaggggaaccugcaguaugggcagggaccagguggugccuucugccuggcucucuaguccuagucaggccgacagggccucagggaaaagagcaucauggccuggccccccaacucugccuggcguguggggcuuggggcagaaagggccagugcugucauucucucucucugcuggagcaggaagaugaagaacagugucagacucauuuucagccccauuaggcagcagacggagauggagggaggagagcgggagacugggggauggguucugcacuacagaugccagcagggccucaugaagagaggacuuggguaucuggagaauauuuuaagcagaagaagccauaggagaggcuugaacagagagugaccaggauggcauguuaggaacaaggaaccacaugggucguguucccugagguccccgggucaagaaggcagcagaagcugcagugcugccugaagucugagccccugggaggggaaggggagacucaggaauucaggaaccuuccauugcuauaugacaaguuugaggcuuauaucagaaauaaaaauaaaggcagcagagaacccugacccugucugucuuuccucaucucucuuuagugcuuuuacagugaguucccugucagaggccagcccuggggucccagccaacccuccauggaaggagugucccaucugcaaggagcgcuucccugcugagagugacaaggacgcccuagagggccacauggaugggcauuucuucuucagcacccaggacccuuucaccuuugagugaccucaccucucccucuuauguagacacacgugcacacacacagacauauaugcaguuuggucucaugcuuuuucuuuuucuuucuuucuuuuuuuaaaucacaccaggcuuuauaauguucuguuccuacagaccaugccugcacccugcuuucaucccaagccuuacaacuccaucuuccauccugaugucuuugucccaagcagcaaucugucuuggaagcaguggcugaguuuacuuuucugaaaagguuuagaggaaccaggauggagaugacuuucccuugcgggaauagaauuauucccacaauuuauuuacugcuagcccaaguacacacacacacacacacacaucacucccuucugaugccccaaagccaacuccugccaccccacaccgaaguccucaaacggaaaagaaaauguauuugugccuucugugagggauaggggacaagggaucccagguguccccauuucccgcccccucaccuucuccagccccgccccccacagcaauaagaacuuucucucucccuuaaacucuccucuuauuuguaguuuggacaaauauauuuauaugauauguguaaccauugucaugacguauguucuuaucaagaggcauugcuacaagaaaagaagggcuucaaauuccuggucccugucaggagggaggagagugauagauuaaguacauucuaaccaggccuucuggugugcuagccaccugaggccacgggggaaaaaaaaagacacuguguaucuccggccuggagcacacuuuuaaggagggagcaaacagguggcugaugggauuggaagggacacacaaagaccaucagauuccauggucauccuugcuauacccuacucccaucaagaacacauaucuuuggguucugccaaaugagaugugcucugagcucccuaccaccauuguuuacaucccauacacccccgugcacuccuugacaacaaucagagcaacacauccauccaccccaaccaguugucuagguagcacagacauccauagcagcacagagcauauauuaaggaccuugugcucacugaugcucucugugugcccuagcagggcauacacccauagcucucucauucucugucccaaaacacccuugucagcaccuugcauccguucagguucgcucacuggaccacccccauaguccugucuuuaccugaaacuaacccauccaccaccaccccgcuuccuaccgcaccuggaugacaaucuuacauccaucccgucuucuucccucaugucugucuccuagcaaccccaucucguucccugaauccuuuccaaggaaauuggagauaauggaucucucuccucucuccaucucaaccucucuuuauugauccuccuuuaaugaaaguuaauuauaacaaugauuuaauuaauag

SEQ ID NO: 8037 - RNA, 4344 nt, Mus musculus
uagauucacaaacaagaauuuauuugcauuuguaagcaaggcuuucauauauccuacauaaagggugugcuuuucugaguucauuuagucacguguaucuacauucuguagcauauggaacuauugcaugaaaugcacccaaauauuacuacagcaguaaaaacucagaauuauaucacauucuuacacacauacaaagugcauaucagccuaguauaugaaaaaauauguaaauuauauuggcauauucuuuagaugcacauauuauuugugguauacauuucucugaagauuuuuuuaaaaauaaauauuggagccagagcugaagguaugggaagguagaccaucucugccgugcugaaugaagggaacacagccggguuuaaaagagucacccaaaaucaggaagcaaugaugacauugguaaugacaaacuccacugguuaauugguuuuuucuauuuguguuucuauuuguguuuuucuauuucugccuaguauuuuugucuuugaaauagccauguaugucagcaaacauuguuguauaaauggucacuuuuaguuuccuguugugucucuugucugaagcugguaucuguugagaacauauuaacgccuauuugcaucaagauucacuauggaaucaugauuauauagaauuguuagagcuauuuacuuaugcaucucaagacacauucuuccaagacuaaugcaagcauguuauagcaaugcucuaugcaggcagauaguuaagggguggacagugaucuggagagcuagguaaggguuaggguuaggcuccuuuagguuaggguuuguaaauauauauauauauuaauauuauaaucuugagccuaagcagcauuaugaaguaaggccugaaccugggcccauuccccuucucccaggaagggcaaaggcuucauucaggccuucucagcugggcuuugauuuugauccuaacacuuagcagucagaagccaauuugugugucuacaguaacagcagagaaaaccuauuccauaacccaaguuuuugcagaauuuucugacauuguacuguguugaggcuuaugaaaaagcaaucuuauuugagucuuucaaauccuggauucuaauaggcacauaacuauagaaaaauucuuuaagagacagugcacucacaucugcagacauauuguuuaugaguccacagguuccguguguguagacacagccauauuuuacaguccaaggaaucaauuaauuagugccucucaguccccccagcucagcugcucggcugagugcgugugcgguggagauagaugugcguggucagaucgcuggucauguuaacaagccucgucauaaagauggggaugauaaggagagcaaaagaacucaggcagccugcgaagaggguuucaaggggcgagcccccagccuucaggacugugccuauccugccacugggguuugucuggaguuccuuccaucuggacccggcacacugugagcuaugacugguccucuuccgguccucugguccacuggccuauauuuugccuuuucuucauugagcuccaaguugaaauuuaaaaaacaacaaaacaaaacauaaaccuuucuccgugcgugucuucuguccuucuaccgauguuggggaccucugccgguuccuuuuucuacauuucugggugguuccuuuuggucuacguuggcgcugacuuccuuccuuccgcucuuacucucucugccuuuacaguugcuuuucuaucgugcuccgaugagcuuguaaaaaauauaaauaaacaacuaugccccgguuaucuugcaccagaaugaacaccccaagauaugccagacccauggaaggaagaaaaaaaaaaccaccuuggguauaauugcugguuugaguuguagcacuuaauucuguuuauucucgcugaugugcauacuuaacagagagauauugauauuaaagggcaggggggaauuaauuuuacuuuuauagucaucuauuaagagcacaagaugaucugagucuccuuuaaagggaccaaaaaggggggggggagagaaagggagagggagggagaaauaugacugaaagggaaacaaagaucuuugccugaagaaacaauguaacacuagacagaacuauaaagucugggaauguaggaacaccggacucacucagcucccucucccuguguggaauccuguccccuccacuuccggcugaaaccccuacccugacuacacagugguauucaaggaagaauucaugcaauuaucuggauaauuggagggagagagauggggagggagagggagagaauauagaagaaaaauaguuacucuuaaaacaaggaggucgggcuuacagauuugaacacugcugagaaaugaugagaucuguugaaguacucugaucucugauccaguuucauuuucauuuuggauacuagcuuggauucacuaugucugcauagaccugccuccucuaauauuguaauuaucacaaguaaguagauaauagauaauuauagggugucaauaauauuauuuuauaacuacauaagauaugauuagaguuaauguuagaggcuuuguuggaagcuggaggcaagguagagaggccuuaggaauuuuuuucuuuccuauuuuuaccugugugggaaucuccagaaaucccuaagacucuaaauucauccccuggauguuuuaagggaaagcucuaggaucuuaggguauauaaaauccaaagaccaagaugaggaaacacuaauuugauacucagccccucuuagccuagaggacaauggaagccccucuuaucucauuagaagacuuaguucccaguacaaguccacuaggguuugggagacuugguuggugugguccaugagagcaagacaggggcuuaucaaaaucaaguucauugucaaccccacauaggaacuaggcccagaaugaagcccucuuuuauccccaauuugucuuuccuggaguccacgccuuaacaauacuggagucaagacaaacgcccagcuggagcuagggaggucaaauuuaaggcagggaucagggaaagauuuuaaauuuugcuauuguuauuuuggaggguugagaaauccgaaggcuguaggaggaagaggggaagaaaugaucacagaagcagagagugaggugaaagagaguugagagaaaguaugagaccgugaguaagguagauauaaaacaaaaaggaguggcaggaauaaccaggaaauaaaacauaaggaaagaaauacaagaaaaagguacaaacgggaagggaaggaaaagacugaaagaggcacgaagaagacagacaagggucagucuuugggcugacucugccuggcggguuugcagcagucugggugggcgggggcaccaugacaaagugaaggucaaguuagcaucguaccuuauaaggaaggcgucgguccuccauuucagccuuucucucuggaaggacuuagcgcuggcauuucuggucuuguaaacacaggacuuuuuuuuuuuuuuuuaagccuccuuucuuuauugagagugaauucugcagccccgggaagcuguggcuguggacugggaagucaacuaaugaagauggcaggaaacuuuucucuccuuuucugccucuggcuccacucccugccagcuggggcggcccccaucucuucugucuucuguaucuuucaccauugucucuaaaucugggcacgauuucuuuacucccugacuccccugcagacuuguaaaacccuuccauuccacagcagcaaaguggagaaggacuuuaagaauuggagagaaaauuaagcaucauaaagaaaacuucauuuacagcuuaauugucugucugaguauuacaguuuucuucugaaaacaaagcgauauauucgguaaggaggagugaggucacagggauggggagggccaguguagcgguagacuuggauuuauuuauuucucaauccugagguggaaaggaaagaacagaaggaggggagugagagagaagcauuuuaaccaugaaacuaccaaaggugggugcagcuggugagauuggaagcaacauucuagcugcacggaccugguacucaccccagccugggccuuggguguggaaaagcuaguauauuaggucguucuugguuucagagagcuaggaagcagaaauggaggaaggcuaggcuccgggagaauaaggcagagcaggagacaggccuugaaagacagaguagcggcagucagucacagucagucggcugguagugguuacagccaggagggagagagggaggaaggagccuaagcuuggauccuugauucuu

SEQ ID NO: 8038 - RNA, 2277 nt, Mus musculus
agacuaagacggauaacgcgucaucucgccuucccaaaauuuccccccucgcuagaucggguccaaaaccuccagccggaggaggcaggagaagagaacgauguuuaacucggucaaccugggcaacuucugcucgccuucgcgcaaggagaggggcgcugacuucggcgaacgagggagcugcaccuccaaccucuaucugcccaguugcacuuacuacgugccugaguucuccaccgucucuuccuuccuaccccaggcucccucucgucagauuucuuaucccuacucagcccaagugcccccgguccgggaggucuccuacggccuggaaccguccgggaaguggcaccaucggaacagcuacucgucuuguuaugcggcggccgacgagcuuaugcaccgggagugccugccuccuuccacagucacugagauccucaugaaaaaugaaggcuccuacggcggccaccaccaccccagcgccccgcacgcggcccccgccggcuucuacuccucagucaacaagaacagcgucuugccccaagcuuucgaccgcuucuucgacaacgccuacugcggugggggagaugcgcccgccgagccccccugcuccggcaagggcgaggccaagggggagccugaggcgccccccgccucgggacuugcgucccgggcagaggccggugcugaggccgaggccgaggaggagaacacgaaucccagcucguccgguucuucccacucggcgaccaaggagccggccaagggagccgcccccaguagguagcagcggccgggaacccgagggcagcgagggagggagcggagagggagggcuggaguagugggggggggcaggggagcgcggacagccucguguuuugggucagucugauuuuauguggaguuuuauaagcauucaaaggauuuuauuauaaccuacaaagcccucucucccaacgacucgacuuuuuacgauggagaagggguggggagggagggaaaggggcucuuuggaaaagccgggugagccccccuccuccguuaucucccucggucugugaaauuuuuaaaagugccaccauugcgggcgauauuaacuuugaucgugaacuuagaggagcguuuaagaaaggauggggagucggacugcugggggguugggagggaggggagggguggagggggaaaggggagggcgagggacagacugggagaaauccagagaaggggagagguaaggaacagaagcgacgcggcagaacuggaguccagggaagcucuccaaggccgcuccucuucuuuuuaaaacgacuuuuaaaaauguucaaauuacguguucgcgggucuuugagaagaaaccggggcaagccgggguuuggcgguggcaggagaguggggaaagaaucagagauucccuugcucugcaggggaagguagcgguggcucuccaggguccgaggccucucucuggguaggcccagccugacuguacgcaagccuggggcaggcaagcggcugggugucccagggcgccagggcaccacaggaggcucguagguguccugcuaccucuacgggcuaguuugcucccgauuccucacugcucucuccugaucucacuccuucgcgccgauucuccgcgguucccuccgauuucuggaggaagggauccuggauuugcagaagcauuaggagggcggcuuggaaagggcaagggcagcgaccaggagcagacagagcaccccagggaaagcacguggcucaggcaggcuuuccuccacccucagaccuugucagcuagggcucuggccugaggggcagggggaacuagguucucagugaaccuggcggugggaucaaggcuugccccagcgcagcggauacggaagaggagccgccggccuagagggagggcugcccggcagcgggacugggagcuguguagcugagcuuucagcgacuggguuggcuggggucucccggggucucacgugucucuuuccccucuccucgcacuugcccuuccccucccuccagacgccccccgcacccgcaagaagcgcugcccuuauucgaaauuccagauccgggaacuggagcgagaguuuuucuucaacguguacaucaacaaagagaagcggcugcagcugucccggaugcugaaccugacagaccgacaagugaaaauuugguuucagaacaggagaaugaaagaaaaaaaacugagcagagaccggcugcaguauuuuucaggaaauccacugcuguaac

SEQ ID NO: 8039 - RNA, 2277 nt, Mus musculus
guuacagcaguggauuuccugaaaaauacugcagccggucucugcucaguuuuuuuucuuucauucuccuguucugaaaccaaauuuucacuugucggucugucagguucagcauccgggacagcugcagccgcuucucuuuguugauguacacguugaagaaaaacucucgcuccaguucccggaucuggaauuucgaauaagggcagcgcuucuugcgggugcggggggcgucuggagggaggggaagggcaagugcgaggagaggggaaagagacacgugagaccccgggagaccccagccaacccagucgcugaaagcucagcuacacagcucccagucccgcugccgggcagcccucccucuaggccggcggcuccucuuccguauccgcugcgcuggggcaagccuugaucccaccgccagguucacugagaaccuaguucccccugccccucaggccagagcccuagcugacaaggucugaggguggaggaaagccugccugagccacgugcuuucccuggggugcucugucugcuccuggucgcugcccuugcccuuuccaagccgcccuccuaaugcuucugcaaauccaggaucccuuccuccagaaaucggagggaaccgcggagaaucggcgcgaaggagugagaucaggagagagcagugaggaaucgggagcaaacuagcccguagagguagcaggacaccuacgagccuccuguggugcccuggcgcccugggacacccagccgcuugccugccccaggcuugcguacagucaggcugggccuacccagagagaggccucggacccuggagagccaccgcuaccuuccccugcagagcaagggaaucucugauucuuuccccacucuccugccaccgccaaaccccggcuugccccgguuucuucucaaagacccgcgaacacguaauuugaacauuuuuaaaagucguuuuaaaaagaagaggagcggccuuggagagcuucccuggacuccaguucugccgcgucgcuucuguuccuuaccucuccccuucucuggauuucucccagucugucccucgcccuccccuuucccccuccaccccuccccucccucccaaccccccagcaguccgacuccccauccuuucuuaaacgcuccucuaaguucacgaucaaaguuaauaucgcccgcaaugguggcacuuuuaaaaauuucacagaccgagggagauaacggaggaggggggcucacccggcuuuuccaaagagccccuuucccucccuccccaccccuucuccaucguaaaaagucgagucguugggagagagggcuuuguagguuauaauaaaauccuuugaaugcuuauaaaacuccacauaaaaucagacugacccaaaacacgaggcuguccgcgcuccccugcccccccccacuacuccagcccucccucuccgcucccucccucgcugcccucggguucccggccgcugcuaccuacugggggcggcucccuuggccggcuccuuggucgccgagugggaagaaccggacgagcugggauucguguucuccuccucggccucggccucagcaccggccucugcccgggacgcaagucccgaggcggggggcgccucaggcucccccuuggccucgcccuugccggagcaggggggcucggcgggcgcaucucccccaccgcaguaggcguugucgaagaagcggucgaaagcuuggggcaagacgcuguucuuguugacugaggaguagaagccggcgggggccgcgugcggggcgcugggguggugguggccgccguaggagccuucauuuuucaugaggaucucagugacuguggaaggaggcaggcacucccggugcauaagcucgucggccgccgcauaacaagacgaguagcuguuccgauggugccacuucccggacgguuccaggccguaggagaccucccggaccgggggcacuugggcugaguagggauaagaaaucugacgagagggagccugggguaggaaggaagagacgguggagaacucaggcacguaguaagugcaacugggcagauagagguuggaggugcagcucccucguucgccgaagucagcgccccucuccuugcgcgaaggcgagcagaaguugcccagguugaccgaguuaaacaucguucucuucuccugccuccuccggcuggagguuuuggacccgaucuagcgaggggggaaauuuugggaaggcgagaugacgcguuauccgucuuagucu

SEQ ID NO: 8040 - RNA, 1908 nt, Mus musculus
cuuuuuuuuuuccuuucggagauaccuggauaugguccagagcagguuguccgcgggagggccccgcgagcggcagcgugcgagggagggagggagggcgaaggagggagggagggaaggagggcggguggcggcggcugcgguggccagggcuucccucccugggcgggaggcugcugcccugccucuguggccguggggagccaagaagcagguaaaggaggcuuucugaggcgguauugcaccaagcccaagguaccaagucuuccgggccucugcuuaagguucuggcgggagagaagguagggagaucggcgcccaccaggccuggaaaggaggccucgggauguucaaccuguguaugauuucagucucacacucauguuguggucugucugcauugggagacgccgcuugccugucugucugagacuucccaaacccgggcacuccuuccaaaggcucagaaaaauucgucgucggaauguguacuuucauucauuggauucucugaaacucggcagggcuggcuacgacaacccagguugggagggagcauucuuccucuuuucuggauguguaguccuuuggcuccuuggucacaggcugaguuuuccgguucuagguucgcgggucgcccugauguuugaagcuagacagcuccagucgguuagggagggcggggagggacccgcggcuguggcuccuuaauuguacuucgagcccuuauugucucuccuuucgccaccuccgcuuccucagucugggcuccaaagucacugcaaauuuccuugcgauacauacaucacacaaaagaucagguaacaacgcgcucagagccauugaaucagagcacagggcaacccugguucuggggaggcuaccucuccagucacuccccaggcuggaaaaacagacuguguugggggagccggaaauaaccccguuugcugcggagcggcagggcgggggcgccggcgcaaaggcaggccgggcaggccauggcguugagagggccacguucacaggcccuggggguuucacgcuugcggagcuugggggccuggcucuuggugugguggcagggaucccagauacccaccuuggguggggguagcacgcaguucuccucgcagcaagcaggagaacucaguuucugcuuccagcucaggccuuagcuaggaggaguuguguguggguguguuuuucccaacaaagagggaucaggagagauggggggggaacuagaagggaaccagggaggggggcggggaaggcgagagggcagcggagggacgaaaugagcccauuucagggggagaaggaaaaugaaagcaaacggaguagggccuccucgguucagggagggugcugaggagcagagagcgggcucucugccugcggcggccgggauggcccgcugggggcacagaagaaagccuguuuuaaauuuaauccgaacuugacgguguggauugaaccggagggaauuuaaaucauuaaaagggagacacgcgguagggggagggaggaggaugacucuaaccuaucuguuugucuguccuucccacagugcuagcuuggcuguuuucucaguugcccagguuugaggugauagagguuugcccaucccccuucaggggacuccucuccugugcccacuggaaucuguuggggguguaaggugaauacagaauagucagcuagaacugggcuuucuuccucccuuuccagcagugacucccaguuuccucaagucucucagguugccccauugaugcuaagaacaauugaaaggaguuggguaaaugagagaaagucuuagaauaaaauaggagauucagugggaguaacugaauccccaagaugagaccuugcuucuucgcauccaugucuuugcccuccaua

SEQ ID NO: 8041 - RNA, 8663 nt, Mus musculus
cucccugggcgggaggcugcugcccugccucuguggccguggggagccaagaagcagguaaaggaggcuuucugaggcgguauugcaccaagcccaagguaccaagucuuccgggccucugcuuaagguucuggcgggagagaagguagggagaucggcgcccaccaggccuggaaaggaggccucgggauguucaaccuguguaugauuucagucucacacucauguuguggucugucugcauugggagacgccgcuugccugucugucugagacuucccaaacccgggcacuccuuccaaaggcucagaaaaauucgucgucggaauguguacuuucauucauuggauucucugaaacucggcagggcuggcuacgacaacccagguugggagggagcauucuuccucuuuucuggauguguaguccuuuggcuccuuggucacaggcugaguuuuccgguucuagguucgcgggucgcccugauguuugaagcuagacagcuccagucgguuagggagggcggggagggacccgcggcuguggcuccuuaauuguacuucgagcccuuauugucucuccuuucgccaccuccgcuuccucagucugggcuccaaagucacugcaaauuuccuugcgauacauacaucacacaaaagaucagguaacaacgcgcucagagccauugaaucagagcacagggcaacccugguucuggggaggcuaccucuccagucacuccccaggcuggaaaaacagacuguguugggggagccggaaauaaccccguuugcugcggagcggcagggcgggggcgccggcgcaaaggcaggccgggcaggccauggcguugagagggccacguucacaggcccuggggguuucacgcuugcggagcuugggggccuggcucuuggugugguggcagggaucccagauacccaccuuggguggggguagcacgcaguucuccucgcagcaagcaggagaacucaguuucugcuuccagcucaggccuuagcuaggaggaguuguguguggguguguuuuucccaacaaagagggaucaggagagauggggggggaacuagaagggaaccagggaggggggcggggaaggcgagagggcagcggagggacgaaaugagcccauuucagggggagaaggaaaaugaaagcaaacggaguagggccuccucgguucagggagggugcugaggagcagagagcgggcucucugccugcggcggccgggauggcccgcugggggcacagaagaaagccuguuuuaaauuuaauccgaacuugacgguguggauugaaccggagggaauuuaaaucauuaaaagggagacacgcgguagggggagggaggaggaugacucuaaccuaucuguuugucuguccuucccacagugcuagcuuggcuguuuucucaguugcccagguuugaggugauagagguuugcccaucccccuucaggggacuccucuccugugcccacuggaaucuguuggggguguaaggugaauacagaauagucagcuagaacugggcuuucuuccucccuuuccagcagugacucccaguuuccucaagucucucagguugccccauugaugcuaagaacaauugaaaggaguuggguaaaugagagaaagucuuagaauaaaauaggagauucagugggaguaacugaauccccaagaugagaccuugcuucuucgcauccaugucuuugcccuccauaucuacaagccuagauuuagggaaaacuugaaaguccacuucacaguccugaccugcuagcuuuuaaaugugaaacaugagagucacaaccuauaugaaggaccugggccuaguguccucuggacucccagucucuuaucagaccccuuccuuuaggcuaccucuuucuaggaggcauaauagaaugggacauugguaaggaggggccugugggcaaggccugcuuucugguccacagcugugcugacuucugaguggggagggucuagaguucuugcuuccaaaaggaaggaaaggcaacagucucucuccugcuuccugggggauuugaggacagcaggaaucccuguaugguaccccugacuacccagcugccacagccucugcaggguaggcaagcugggagugcaggcugcccaggaguugaaaagaaggcaguguucaaaaggagaaggggagaagagacucucauuacagucaagaugccuauaagaagagcuuuuccaaauagaagaggguccuuaaggacuucuguuucagaacguugagguaaaggcagacaggcccuguuguauagugaagaugcagagaaagagcaggcaugauguuuccuuccucuucuauuucuuccucuuucacuagaauguagcucagcccccagcagccagagugacugcuaggcuaauaucagauucggugucccagaggccuaguauacccaccggagcaggucucccagaggggauggaaaggaggccucuuacuccuuuguguccagacagaaguggccgccgcgccggagcggucccgcggcaaagcaccggacugcacaaugccauggcugcuccuccagccugugcccugccccguucugccugccucucauugccugacucuccuuugcuuuuugaaagucuuccuuuccugcucuuaagucucuuuaucuugccugcuuucuuuccuuuaauucuuaucuuuuucuuccucucuacucuagcccuucuuuucuauuuuuccuuccuucagccuagugaccuguuuaaauuggucucaagcucugucccuugauauccucuuggucucagucuggccccgggccccaugaagacuaaaugucugugcuccuugcuggcagcaacugcccaugagccaggcuagguccccaggcacccaugcuugggggaggugcugacuaagcuggggggggggaggguugaagaagaaagccucugcagcaggacuggaaccuccuaucuguucuuugaacuagugagggagauuuuuuuugauugacagcuaaccugacuauauuaagggcaaagaaauguucuguuucuuauuguaauuuggauuuuccaaauuacaguccagacauaaggagaaggcagugagagcugaggugaauuaaucugagugcuucuuccuaaccaaacacuuccuuguacacacacacacacacacacacacacacacacacacacacacacaccucaaaaaaccucagcccugauaaaccgaagaaaagagaagaaccagaggagggggacauagagguuggggagggcuccugugguucuugagucucuccuaaauacugcaguuguacccucuccccaacauuuauugcccccccccaacacagacacacacaccauccucucuagcacuucccuaccuuggaagaaagagagagagaaacauagaagaaaaccagcuuccauucccacacuuuggucugguucuggaggcuggagagaggaauaaaggcagacuuggcugggucugggaagcccuuuaaccagcugccuucagagcuugcauccuagccucacucccugccuauuuccccucgcauagacucuuaccucugacucugagacuacccuuccuucaggcucauucugcucugucugggagcaguaagucucugaggauaucaccugucccuccauuccccaccaaccucuuugccccuucuccugcacccauacuuaagauuuuucugcauacccaaagccuuccuuuugcuaaaccaccaugggaggucugcugaaaaccuaggcuguaugcacaacaaaccccaaauucaagggggugaggauagcagucaacuuauugggaggguguaauccaaguugucugauauuuccuuucaaucacacugccaccuucugaauucuuccauccgaccccaaagaaauugccuucuuccaucccuccguugcuuuuuuuuccguuccaaaaacagccuacaauuuuauuuaaugaaagacacauuuaugaacaaucaaaugauccucauaaaaauuuuauugaaggacguaaaaacaagcuacuugcccacgaccgaggucgcucucucgauuugccccguucucacccuggcucucugcagacagaaccuccgagugacuucuuuggggggaggaggguguugcagagauggaccugggggcaaaggagggugagcaggcagcugggauggggaugccccgcuuaaguuguguagcucucuccuccacuucuucaggcuggcaaagaaacagagacaauaaauuuuaaauaaaggcuuguacaucugugccaaagcaagaggagacuugugagguugaugauaaaggugugugagauucccaagcuucacuccucccagcucacagaccaccuuucucaagcuucucauacccuagauuugggaaacugagcugaccaggggcagaagaacucuccccuuucccuccuucccucccuccaucccagcuuguucaguccccucccacucucccucccucgcugcugcugcugcugcugcuccugaaagaaauacauacauacacaguauuuaaaaacgcauuuuuaaaagccacguuccgaacugacaaucgcugaucuccguucacucagagacugcaggagcgucggagccgacagagacagauuacgucaagaaauaguuccuccaccuaccucguccggccuccccgccccugaggggcuccccgagcccaucucagcucuggggguccaggaacccuggcuucugggacuggcauuuucaucuuguuuuuuuuuuuuuuuuuaauccucaugguagggggagccaucugcuuuuggcugcacauggucaaggggggggggucccugaugagauaugauucguccggggagggggggcugucuggcgccuuggguccagaguugcaaaucgccaggaaaacgcaggucgcggggaucagcaaagagaagggggcgguaaaggggggaaaaagcaagggggaaaaaaagccccugcgcauugauccgcgccguauuuuuggguaaauacgaucacgugggggcuggggaaccaaugagcugccgggaaaaggcuggaaaaauaauuaccugccuugauuguucugugagcagauaaaaaguacauauacaguucauacaauaaucuuauguauguaaaacccuguuacgaugucggcgacggggcccaucaguaacuauuacguggacucgcucaucucucacgacaaugaagaccuccuagcguccagguuuccggccaccggggcucacccugccgccgccagacccagcggcuuggugccggacuguagcgauuuuccguccuguagcuucgcgcccaagccggcuguauucaguacgucgugggcgccggugcccucgcagucgucuguggucuaucacccuuacggcccccagccccaccucggcgccgacacgcgcuacaugcggacuuggcucgagccgcuguccggcgccgucuccuuccccagcuucccggccgggggccgucacuacgcccucaagcccgacgccuacccggggcgccgcgccgacugcggcccgggcgacggccgcagcuacccggacuacauguacggcucgcccggggaacugcgcgaccgcgccccgcagacgcugcccucgcccgaggcggacgcgcuggccggcagcaagcacaaagaggagaaggccgaccuggacccuaguaaguugggagcaauuuuccuuuacaaccagcucgggaggggaggggaggccaggcggggacagcuagauuacagccccuccgagcggcgcgggcagcgcgggagaggagcgagggcgagggggaugaggacucaauaaaagcgaauuaccuuggggagcucucaagagcaggaaggucugagaagggggcccaggcaaccagguugggugagggccagccagaggggcuucucucccagaggcuggcuuugaaggaaaacuccugagucucccucuuagcucaguuuuuuguuuugggguuuuuguuuuguuuuguuuuuuucucaguggucacuuuggggggugguggugaugcaaacagggacaggggcugggcuggagggcugagauucauuuugugguuugagaaaggacagggcagaggugaaaaggauacuuagagcaaagggaggagagauauuaucccuaccucucacagccagaguggguagucuucaacccacuagggguuaauaaaacagaagguccacugacuucucccccaggagaagaaucugggggugcacagccuagaaacuuaggucaggacuuccagauauaaguggaggagaaguaagguccgaguuuccuuaaacuugaaaaccuacuuuuaaguguccacaggagagaaggaguuguaaauggggaucaggaauauauauaacaaggaaagaaucuucagauaugagagagagagagagagagagagagagagagagagagagagagagagagagagagagagagagaauucugaguguugcauagaauggggggguugcugacuagguaaagaggugggggcagguguaagcugcagggucaaagaaagggggagaggaagaaggagaaacagcaggggagggguacagucccuuggaugagaggaagugucugggggauccccgggaggagacuucaggaaaucuuuuccucuagcucuauaaggggccagggccuaauuauaccccucugaagccuucccucccugcucucagcuacucccauaaaccugaaauuggaggguugucuccugcagagcuguccuggggcuggcuggaggaggggggcacuggaguccaacauaugagggagccuuucuccaaggccagcagcucugugaggagaggggaagauuuuccccauccugauaacuucacccuaauaauucgccucagcaggguugaauucugagccggagauggguacuggaaagaagugaggguucagggacucucaggacuuggucgugucugugaggaugggagggggcagaggaggagggagguggggaggagagggaccuugcuauaaaaauaaaaaacaagagagggaagcguuuaugggccuaugaaaugguugggaauuuggacuuuuuaugaggauauucucgaauuacuacucuugaagcuaaggaccagacugugggagcuuugguagcuuaaauuuuacuacaguuuuaggugcuggaagcugaacagggaggggauauagggagggggcuggaugcaaaagagaaaggaggagaugccuaaagcaaaauguguccaaauucagguucaauuauugaguuuggggagcuugacuaaaccuagggugggaugacagagguccugagcuggaagggaacuuuacugacccuugcccguguuugucccuccaggcaaccccguggccaacuggauccacgcccguuccacaaggaagaagcgcugccccuacaccaaguaccagacgcuggaacuggagaaggaguuucucuucaauauguauuuaaccagggaccgucgguacgagguggcccguguucucaaucucacugagcggcaggucaaaaucugguuucagaaccggaggaugaagaugaaaaagaugaauaaagagaaaaccgacaaggaacaauccuaagcccugccccagccugcugccucggcacagccaagggaaacacaaaaacccccacaaaaaaugccccaacccaggcgggagaaagcacgaaaagaaaaggaaagaacaagauagagaaaagcccaccgucuuaaaaagaaaagaaaaaaaaggaaggggaaaaaugcaaacucuugcgaugugggaggguuaaguguugagaaauugguguuuagaguuaguucuauccaucgaggaggaggcaggagagaaacugcguucucuuccccagcgcaacugaaauaaaugacacacacaaaugugaauuuuuuuccuucuuucuucagagaagccaguauuugaaaaacucucucucucucucucucucucucucucucucucucucucucucucucucucucucucucucucccucucucccucucucccucucucccucucucccucucucccucucucucucucucauauuuggucugggccauuccuuccugggccuugggcgcucugcgggcagauuucauacaaaaagacacacaaugaugauccccaguccagagcugagggccggacugcgcugcuggcuggaucaggcugcaaaugcaggcugcugccucaggcauguacagagcaguguucuuaacccagcgucccuccccaucguccgucguccuguaauguuguucuguuuguuacaguagaacucuguuaauauaucuaagucacuuggaaaaaaaaaaaagaaagaaacgcauucgcaucuagcucucaucauuuuauuccuugugauucugucgaagaggcaagugcuuaaauccucuaagggaaacuggaaccagagaaggggcucccucuaccuuggaagggcaaaugccugcagcuucucuucaggcagggcagaauggggggugggggcucuaggggagggguggaggcugcugaggcagaggccuccuugugc

SEQ ID NO: 8042 - RNA, 8663 nt, Mus musculus
gcacaaggaggccucugccucagcagccuccaccccuccccuagagcccccaccccccauucugcccugccugaagagaagcugcaggcauuugcccuuccaagguagagggagccccuucucugguuccaguuucccuuagaggauuuaagcacuugccucuucgacagaaucacaaggaauaaaaugaugagagcuagaugcgaaugcguuucuuucuuuuuuuuuuuuccaagugacuuagauauauuaacagaguucuacuguaacaaacagaacaacauuacaggacgacggacgauggggagggacgcuggguuaagaacacugcucuguacaugccugaggcagcagccugcauuugcagccugauccagccagcagcgcaguccggcccucagcucuggacuggggaucaucauugugugucuuuuuguaugaaaucugcccgcagagcgcccaaggcccaggaaggaauggcccagaccaaauaugagagagagagagagggagagagggagagagggagagagggagagagggagagagggagagagagagagagagagagagagagagagagagagagagagagagagagagagagagagagaguuuuucaaauacuggcuucucugaagaaagaaggaaaaaaauucacauuugugugugucauuuauuucaguugcgcuggggaagagaacgcaguuucucuccugccuccuccucgauggauagaacuaacucuaaacaccaauuucucaacacuuaacccucccacaucgcaagaguuugcauuuuuccccuuccuuuuuuuucuuuucuuuuuaagacggugggcuuuucucuaucuuguucuuuccuuuucuuuucgugcuuucucccgccuggguuggggcauuuuuuguggggguuuuuguguuucccuuggcugugccgaggcagcaggcuggggcagggcuuaggauuguuccuugucgguuuucucuuuauucaucuuuuucaucuucauccuccgguucugaaaccagauuuugaccugccgcucagugagauugagaacacgggccaccucguaccgacggucccugguuaaauacauauugaagagaaacuccuucuccaguuccagcgucugguacuugguguaggggcagcgcuucuuccuuguggaacgggcguggauccaguuggccacgggguugccuggagggacaaacacgggcaagggucaguaaaguucccuuccagcucaggaccucugucaucccacccuagguuuagucaagcuccccaaacucaauaauugaaccugaauuuggacacauuuugcuuuaggcaucuccuccuuucucuuuugcauccagcccccucccuauauccccucccuguucagcuuccagcaccuaaaacuguaguaaaauuuaagcuaccaaagcucccacagucugguccuuagcuucaagaguaguaauucgagaauauccucauaaaaaguccaaauucccaaccauuucauaggcccauaaacgcuucccucucuuguuuuuuauuuuuauagcaaggucccucuccuccccaccucccuccuccucugcccccucccauccucacagacacgaccaaguccugagagucccugaacccucacuucuuuccaguacccaucuccggcucagaauucaacccugcugaggcgaauuauuagggugaaguuaucaggauggggaaaaucuuccccucuccucacagagcugcuggccuuggagaaaggcucccucauauguuggacuccagugccccccuccuccagccagccccaggacagcucugcaggagacaacccuccaauuucagguuuaugggaguagcugagagcagggagggaaggcuucagagggguauaauuaggcccuggccccuuauagagcuagaggaaaagauuuccugaagucuccucccggggaucccccagacacuuccucucauccaagggacuguaccccuccccugcuguuucuccuucuuccucucccccuuucuuugacccugcagcuuacaccugcccccaccucuuuaccuagucagcaacccccccauucuaugcaacacucagaauucucucucucucucucucucucucucucucucucucucucucucucucucucucucucucucucauaucugaagauucuuuccuuguuauauauauuccugauccccauuuacaacuccuucucuccuguggacacuuaaaaguagguuuucaaguuuaaggaaacucggaccuuacuucuccuccacuuauaucuggaaguccugaccuaaguuucuaggcugugcacccccagauucuucuccugggggagaagucaguggaccuucuguuuuauuaaccccuaguggguugaagacuacccacucuggcugugagagguagggauaauaucucuccucccuuugcucuaaguauccuuuucaccucugcccuguccuuucucaaaccacaaaaugaaucucagcccuccagcccagccccugucccuguuugcaucaccaccaccccccaaagugaccacugagaaaaaaacaaaacaaaacaaaaaccccaaaacaaaaaacugagcuaagagggagacucaggaguuuuccuucaaagccagccucugggagagaagccccucuggcuggcccucacccaaccugguugccugggcccccuucucagaccuuccugcucuugagagcuccccaagguaauucgcuuuuauugaguccucaucccccucgcccucgcuccucucccgcgcugcccgcgccgcucggaggggcuguaaucuagcuguccccgccuggccuccccuccccucccgagcugguuguaaaggaaaauugcucccaacuuacuaggguccaggucggccuucuccucuuugugcuugcugccggccagcgcguccgccucgggcgagggcagcgucugcggggcgcggucgcgcaguuccccgggcgagccguacauguaguccggguagcugcggccgucgcccgggccgcagucggcgcggcgccccggguaggcgucgggcuugagggcguagugacggcccccggccgggaagcuggggaaggagacggcgccggacagcggcucgagccaaguccgcauguagcgcgugucggcgccgagguggggcugggggccguaagggugauagaccacagacgacugcgagggcaccggcgcccacgacguacugaauacagccggcuugggcgcgaagcuacaggacggaaaaucgcuacaguccggcaccaagccgcugggucuggcggcggcagggugagccccgguggccggaaaccuggacgcuaggaggucuucauugucgugagagaugagcgaguccacguaauaguuacugaugggccccgucgccgacaucguaacaggguuuuacauacauaagauuauuguaugaacuguauauguacuuuuuaucugcucacagaacaaucaaggcagguaauuauuuuuccagccuuuucccggcagcucauugguuccccagcccccacgugaucguauuuacccaaaaauacggcgcggaucaaugcgcaggggcuuuuuuucccccuugcuuuuuccccccuuuaccgcccccuucucuuugcugauccccgcgaccugcguuuuccuggcgauuugcaacucuggacccaaggcgccagacagcccccccuccccggacgaaucauaucucaucagggaccccccccccuugaccaugugcagccaaaagcagauggcucccccuaccaugaggauuaaaaaaaaaaaaaaaaacaagaugaaaaugccagucccagaagccaggguuccuggacccccagagcugagaugggcucggggagccccucaggggcggggaggccggacgagguagguggaggaacuauuucuugacguaaucugucucugucggcuccgacgcuccugcagucucugagugaacggagaucagcgauugucaguucggaacguggcuuuuaaaaaugcguuuuuaaauacuguguauguauguauuucuuucaggagcagcagcagcagcagcagcgagggagggagagugggaggggacugaacaagcugggauggagggagggaaggagggaaaggggagaguucuucugccccuggucagcucaguuucccaaaucuaggguaugagaagcuugagaaagguggucugugagcugggaggagugaagcuugggaaucucacacaccuuuaucaucaaccucacaagucuccucuugcuuuggcacagauguacaagccuuuauuuaaaauuuauugucucuguuucuuugccagccugaagaaguggaggagagagcuacacaacuuaagcggggcauccccaucccagcugccugcucacccuccuuugcccccagguccaucucugcaacacccuccuccccccaaagaagucacucggagguucugucugcagagagccagggugagaacggggcaaaucgagagagcgaccucggucgugggcaaguagcuuguuuuuacguccuucaauaaaauuuuuaugaggaucauuugauuguucauaaaugugucuuucauuaaauaaaauuguaggcuguuuuuggaacggaaaaaaaagcaacggagggauggaagaaggcaauuucuuuggggucggauggaagaauucagaagguggcagugugauugaaaggaaauaucagacaacuuggauuacacccucccaauaaguugacugcuauccucacccccuugaauuugggguuuguugugcauacagccuagguuuucagcagaccucccauggugguuuagcaaaaggaaggcuuuggguaugcagaaaaaucuuaaguaugggugcaggagaaggggcaaagagguugguggggaauggagggacaggugauauccucagagacuuacugcucccagacagagcagaaugagccugaaggaaggguagucucagagucagagguaagagucuaugcgaggggaaauaggcagggagugaggcuaggaugcaagcucugaaggcagcugguuaaagggcuucccagacccagccaagucugccuuuauuccucucuccagccuccagaaccagaccaaagugugggaauggaagcugguuuucuucuauguuucucucucucuuucuuccaagguagggaagugcuagagaggauggugugugugucuguguugggggggggcaauaaauguuggggagaggguacaacugcaguauuuaggagagacucaagaaccacaggagcccuccccaaccucuaugucccccuccucugguucuucucuuuucuucgguuuaucagggcugagguuuuuugagguguguguguguguguguguguguguguguguguguguguguguguacaaggaaguguuugguuaggaagaagcacucagauuaauucaccucagcucucacugccuucuccuuaugucuggacuguaauuuggaaaauccaaauuacaauaagaaacagaacauuucuuugcccuuaauauagucagguuagcugucaaucaaaaaaaaucucccucacuaguucaaagaacagauaggagguuccaguccugcugcagaggcuuucuucuucaacccuccccccccccagcuuagucagcaccucccccaagcaugggugccuggggaccuagccuggcucaugggcaguugcugccagcaaggagcacagacauuuagucuucauggggcccggggccagacugagaccaagaggauaucaagggacagagcuugagaccaauuuaaacaggucacuaggcugaaggaaggaaaaauagaaaagaagggcuagaguagagaggaagaaaaagauaagaauuaaaggaaagaaagcaggcaagauaaagagacuuaagagcaggaaaggaagacuuucaaaaagcaaaggagagucaggcaaugagaggcaggcagaacggggcagggcacaggcuggaggagcagccauggcauugugcaguccggugcuuugccgcgggaccgcuccggcgcggcggccacuucugucuggacacaaaggaguaagaggccuccuuuccauccccucugggagaccugcuccgguggguauacuaggccucugggacaccgaaucugauauuagccuagcagucacucuggcugcugggggcugagcuacauucuagugaaagaggaagaaauagaagaggaaggaaacaucaugccugcucuuucucugcaucuucacuauacaacagggccugucugccuuuaccucaacguucugaaacagaaguccuuaaggacccucuucuauuuggaaaagcucuucuuauaggcaucuugacuguaaugagagucucuucuccccuucuccuuuugaacacugccuucuuuucaacuccugggcagccugcacucccagcuugccuacccugcagaggcuguggcagcuggguagucagggguaccauacagggauuccugcuguccucaaaucccccaggaagcaggagagagacuguugccuuuccuuccuuuuggaagcaagaacucuagacccuccccacucagaagucagcacagcuguggaccagaaagcaggccuugcccacaggccccuccuuaccaaugucccauucuauuaugccuccuagaaagagguagccuaaaggaaggggucugauaagagacugggaguccagaggacacuaggcccagguccuucauauagguugugacucucauguuucacauuuaaaagcuagcaggucaggacugugaaguggacuuucaaguuuucccuaaaucuaggcuuguagauauggagggcaaagacauggaugcgaagaagcaaggucucaucuuggggauucaguuacucccacugaaucuccuauuuuauucuaagacuuucucucauuuacccaacuccuuucaauuguucuuagcaucaauggggcaaccugagagacuugaggaaacugggagucacugcuggaaagggaggaagaaagcccaguucuagcugacuauucuguauucaccuuacacccccaacagauuccagugggcacaggagaggaguccccugaagggggaugggcaaaccucuaucaccucaaaccugggcaacugagaaaacagccaagcuagcacugugggaaggacagacaaacagauagguuagagucauccuccucccucccccuaccgcgugucucccuuuuaaugauuuaaauucccuccgguucaauccacaccgucaaguucggauuaaauuuaaaacaggcuuucuucugugcccccagcgggccaucccggccgccgcaggcagagagcccgcucucugcuccucagcacccucccugaaccgaggaggcccuacuccguuugcuuucauuuuccuucucccccugaaaugggcucauuucgucccuccgcugcccucucgccuuccccgccccccucccugguucccuucuaguuccccccccaucucuccugaucccucuuuguugggaaaaacacacccacacacaacuccuccuagcuaaggccugagcuggaagcagaaacugaguucuccugcuugcugcgaggagaacugcgugcuacccccacccaagguggguaucugggaucccugccaccacaccaagagccaggcccccaagcuccgcaagcgugaaacccccagggccugugaacguggcccucucaacgccauggccugcccggccugccuuugcgccggcgcccccgcccugccgcuccgcagcaaacgggguuauuuccggcucccccaacacagucuguuuuuccagccuggggagugacuggagagguagccuccccagaaccaggguugcccugugcucugauucaauggcucugagcgcguuguuaccugaucuuuugugugauguauguaucgcaaggaaauuugcagugacuuuggagcccagacugaggaagcggagguggcgaaaggagagacaauaagggcucgaaguacaauuaaggagccacagccgcgggucccuccccgcccucccuaaccgacuggagcugucuagcuucaaacaucagggcgacccgcgaaccuagaaccggaaaacucagccugugaccaaggagccaaaggacuacacauccagaaaagaggaagaaugcucccucccaaccuggguugucguagccagcccugccgaguuucagagaauccaaugaaugaaaguacacauuccgacgacgaauuuuucugagccuuuggaaggagugcccggguuugggaagucucagacagacaggcaagcggcgucucccaaugcagacagaccacaacaugagugugagacugaaaucauacacagguugaacaucccgaggccuccuuuccaggccuggugggcgccgaucucccuaccuucucucccgccagaaccuuaagcagaggcccggaagacuugguaccuugggcuuggugcaauaccgccucagaaagccuccuuuaccugcuucuuggcuccccacggccacagaggcagggcagcagccucccgcccagggag

SEQ ID NO: 8043 - RNA, 589 nt, Mus musculus
aguucggaacguggcuuuuaaaaaugcguuuuuaaauacuguguauguauguauuucuuucaggagcagcagcagcagcagcagcgagggagggagagugggaggggacugaacaagcugggauggagggagggaaggagggaaaggggagaguucuucugccccuggucagcucaguuucccaaaucuaggguaugagaagcuugagaaagguggucugugagcugggaggagugaagcuugggaaucucacacaccuuuaucaucaaccucacaagucuccucuugcuuuggcacagauguacaagccuuuauuuaaaauuuauugucucuguuucuuugccagccugaagaaguggaggagagagcuacacaacuuaagcggggcauccccaucccagcugccugcucacccuccuuugcccccagguccaucucugcaacacccuccuccccccaaagaagucacucggagguucugucugcagagagccagggugagaacggggcaaaucgagagagcgaccucggucgugggcaaguagcuuguuuuuacguccuucaauaaaauuuuuaugaggaucauuug

SEQ ID NO: 8044 - RNA, 4017 nt, Mus musculus
cgccugucuucaugucguggauugaugaacgcgaaucgcguguaagcgccgccaccgccgggagucugaggaauucgccugggcuguuagaggaaagagcuaagugagagcgcgcgcucuaccuaccgacagugagcagagagcugcagccgcccgagcccgcagccggcaccgcgcccccaccugcccagcccccagcccagcaguccagcccgggggagccggccagcuugggguucggucccggggggaggggaguuucggggauacccggcgggggagcgugauccaaggggagggggccgcggguuuucauguacccagcaugagcuccuacuucgucaacccccuguuuuccaaauacaaaggcggcgagucccuggaaccggccuauuacgacugccgguucccucagagcgugggcagaagccaugcgcugguguacgggcccggcggcuccgcgcccgguuuccagcacgccucgcaccacguccaagacuucuuccaccacggcaccuccggcaucuccaacucgggcuaccagcagaacccaugcucgcugagcugccacggagacgccuccaaauucuauggcuacgaggcgcuccccagacagucccuuuauggggcucagcaagaggcgagcguggugcaauaucccgacuguaaauccuccgccaacacuaacaguagcgaaggacaaggccacuuaaaucagaacucgucucccagccucauguuuccauggaugagaccccacggugagaagccuuuucucuuucccccuuggucucccgcgcuccggggucuuccccccucccucgccuccuuuuugucugcccuagcucgcuuuccuuccuggcuuugggggucucucccacuccacucccgugccuggguggguuccugggagauugaaaggcuuggcuggggguggagcguggggugccugagacauugugcuuguuggggugaaggugggggaaaggugacuugugggugcaaaggguuaaaaaucguuuucucuauuccuucugucucuccuucuucccaucuguaaagccaaaguuggggagauggcuggcaaggacacccuaaguaaacugagguuaucagucuuugggguugguagccaguuuucccaaagacauuucccaacgccagccaucccaagacagugaccagacuguugggugaaaaggagacccuuugcuaucucccccuagucagggagaggggcaagaccuccccucucccaaggacaagcauucugccucucuaggauugucacuucuuccccucagagaagcagccugaaggccacuaccccaacuuuucuguacuuccuccaauugaagagaagacugaaagcccgagaagaggaaaaugauugcucaaaaggagagaggggucauaccaaguaggggccucugagauccaggguacucgagucaggcuacccgccaaucaagaacuauggagucucuuggaaagcuguuuaggucaugagccccuccaaggguggcccuucauggcccaauuucgaaguacagggggaagagauaacgacaaguuccggcagggauggcccuugauuuauuuuuggucuccaguuagcaaucaggcagagcagugauacauuccagaagaucaauuauuuuucuuauuggaaaagcauuagucagagaucggcaaggagggggcaauuggcacagcccccucuccuuuaaccccagcccuuuuccuuucuuuuggaaacagauuauuucccuaggccgccucacuaaaugccauucugcacuuguaaacaaagcugcaagggcuaagcuguaggccugagggacccugauggcuuccuuguccaccucaagcccuuacuuuucagacaaccacgucccagcccccaccgucacccaccucccaaggugaaggaagucaaaccaaaacagcuauggaaacuuuuccugcccuugcuugccuucugcagucggccuuaucggcaggagggagggagaacugggaauagcagagagggaaguuuguggggcuguguuggggggcggagcccccacccagacauaaccagacugggguucuguucuguucagcuccugggcggcgcagcggucgacaaacuuacagccgguaucagaccuuggaacuagagaaggaguuucucuuuaauccuuauuugaccagaaagcgccggauugaagucucucacgcccugggacugacagaaagacaagugaagauuugguuccagaaucgaaggaugaaguggaaaaaggagaacaacaaggauaaacugccuggggcccgagaugaggagaagguggaagaagaagggaaugaggaagaggagaaagaggaggaggaaaaggaagaaaauaaggacuaaggaaaaaaagagagagaaaaucagccccccccccagcaacucccuugaaguuucguuuuaugguagcagauaaauugagaaguuuacgacugucauuugcuuuuauagagaauagaaugacacucacaacucuaacuaccugucagauaguugcagcucugcuuuuauuaccuuugggcuucccccacucuuuauuugucuggggguugggagggggaaccugagacacagggaaaaguucuguucuacuccaugcccagcauacacucucuuguuccugcucccaccuucugagcccuuccccauaaagucuaacccuucacacacacacacacacacacacacacacacacacacacacacacacacacacuucucuccacacucccucuucacggugcuucucugguauuuauuuuaaaagggauuccccugaagauauagaagaugauuccuggcuuugcuuguaugcugggaauuagaauacuggauaaacaguuuuuuuuuaaugaaaagaaagaaggaaaaaaacaggaaagggggaaaugaaaggaaaaauuaaaaagaaauaaaagauagcaaagaagauuccccucccccucugaggcucuuuccuuagaaaaacccccuugacuuucuccaggaaucugcuggaaaucaaggagauguggguuucucuacccaccuccuuccugaggggucuauuagaacuggcaauggucucugaaauccuaccuauccaucccauagucacuuggguccaugccuuccuugccuugccuuugcuguuugaucuuuugggcccccggcuuccucugagcuguguuaguguuugugcucagaagucaccauaaucaugaaaauaauauacugauaauaaaucuuuaacauacuaccuaaagggaaccugcaauaaucuugggggaaaaaaaaaaaagaaagaaaaauuccuaauacaggagggagaaaaaaaaaaagaaaaaaaaagaaaaaaaagaaaaaaggaagaaaccuccagcguauuuuaucacuaccuauagaaagaaauccugcuuugagaguauuuguaaugcgguuuuguuguuguuuguugcugcuucuuucacuaagaaaaaaaaaaaucccaacaacugagacugccuagcccgccggucuugugcgcuuuuauugugcuucuaaccccaguagaguagaacuaaacugcacugaauguauaguuacucugucuugaauucucuguuuaugcaaugugcucgaaaggaaaaaaaaacguuaaaauauaucuauaauaauaauuuuggucauuugucuuuauguccagcuaugaauguagauuuuguguccugaaagcucuguuccugguccaaguacuuuguauuguauacgugagucauaauaaaaaaaaaagaauuaaaaaguagagcuggaaugacuugcuguuucucuauaacucuuccccauuuucuacuccucccucucuuuauucccuuucccagcucugcaaaaggccccgcacugaucuugcuuugggugguggaacuuggaagugggguggagagggcaggcauagcagguagggcagguggcuaguggggggaggaggaggaggaggagga

SEQ ID NO: 8045 - RNA, 562 nt, Mus musculus
uaccgucuaaauccugaauuauuuuauauuuuauuuuauuuuuuugucccucagaaaauccagggagcauaaggugggguuuuacugcaguacagaaucuguggagccgcugggguaccucagccggcaucuuguuacuggggaggggaggaauauggguuagccaacggucaguaugguaauccagacacaauaaggccucucacaacaauggacacauauuuuucuucaguggugucagaagggaagcgcuuuguacugaaacauguuuccgaaagagaaaccagaucgagauuuagaaaggagaugggguguggggcagcacgcagagcagagagcguuuggaugcuggcaagagguggucagaaaacauaagaauaaaacugggaccaagggaaguccagggcagagccuuugggcuggugaggcaggagguaggaggcaggagagggaagcacaaaggagaccaaaggauauacuggggagggccucuuuaguacccccuuccucaccaguuaagccccugauaagugcaagaguccucuacaggaaaagauuuccu

SEQ ID NO: 8046 - RNA, 6225 nt, Mus musculus
ugugccccagcccacaacauucucuggaccccuucugggcagcgcucaggacccccacuugucggaaagggaggaugaggguccccuuagccccaccucccgcgcuauuacacccccccccccuccggagccgagggacagacagagaauugcaacuagaaauucgaucuauugguacgagacaccacgugcucgcgggcuggccaaugaccaggccgccccggaugagcuaauaauggaagcaauuuguaacuuucaguagcucucuaggccuagguaccggugggagggaggcuggcggagggggagacagcaccccccaguuuuuuugcccagccuguuugucuagggaaacucggauccccgggcccuccuuuuucuuuacagcaguguucuucguuccacuccugaccgacagcacagccagguaagcuggucccugcccaucaacacccacuuuuuccaagcaccugcagacuagccucucuucuuguuccaucagacaacugaaauccaauuuuguuuuucucuuaguugaaagaagaauucucuuguuuuccuuagcguaauccuauuuggaggggaauuaggcucguuguacuuucugcgggggcgggggcggggguagggggaggcagaggauuggcgaugcuuuauucuuucagaagucuuuccucccuucucuugggaaacucuacuccgggaguguuuacugucccuggggaugaauuacaucuuuguacacuaguucuuuagcgaugucaaguucaccucgcuucuccaccccccucuucaggucagcauuuacaaauaaacacuuuccauauuuuaaauuuucucuuucccuacuaguuuuuaugcgguuuagcaucuccaguuuuuuccccuccagguggacugggauuuaguuuuguauuggucccucuuuuuguuuuguaaacgacuuuauuguuugggaaaccuuaggggaggugaacaagcucuuugguaaguuccaguggaucuaugggaauaacaauguggaauauuuuacacauuuucuucacuuuuaaaaaaaacuuugacuuuuauguauucacuucaauuuaagaauccugaccuuguagccuuuguaagcuaagccuuuauuauuauuauuauuauuauuauuauuauuauuauuauuauuauuuccuaagccucaccaucuuacacauuucucccuuuuccuccgccccccuuucuaccccagacucccccccuuucuaccccagacucuuccaucucagaagucacauuccuauuccuacacugucccaauuggggacaccucccucugcuuccaaagucagcugagauaggaaggucagaguguccuccaacuuuuaauuuuagguugaauuucuuuucauuugucuguucuuuggcacacagaguugaauuuuuaguucuuguuguuuuuuuuuuuuucccuuaaguuuuagaaaaaugcaagcaaguuucauuucugccuauugggccuuuuaucuucugcgggagaacucccagaagagaaauacaguguuuacuuucacuuuacauuugaucaagcuggugucugcagagguggggguauuccuuuuguguuuguuuuuuagacaacauuuuacuauguagcccugucuggccugaaagucaacuauguagaccaggcuggccuccaacucucagagaucaccugccugugccuauauaagugcugggauuaaaaauguaugccaucacuccuggcuaauucuuccuuuuuaaagauguuacuaagaagguaaacugauaaaugugaaaucuagaguucuaaucuauucagaauuauugaagcuacaaaaguaagauugcaagaguaacucacgcucugggaagaugggaagauggcccaggugacuguaugucccuugugccucugugcugggcagaagaagaggagcugcuccucccucuggucccagcuccauugucacauugacauucugggcacauguggcccagcccccaccggcuccuccaaguaugaaucuaaauuacuauuaauaaggggcugcuccaagcuaauuggcauuaaaagaauucauuucaauuuguuaauauuaaaugaacacucugcacuuuagcucccuuccucgcccuggauucccagaugagugaugggaagcagggcgggggagcaggcaggauuuuaugucuggcuuucuagcuuggccacuguugggccuucccugguguugugagaccaggcaagguggaggccugauggggggaaauccaagggucuuauucuuuaucauccuguaaagcgggagcuguggguaagggugagugaagggggucaaaagagagacauaaaaagguuuaggggauagugugguggaaaaaguggcuaggagacugggaagguaagucaaugggcugaauagaaauuugaaaacacaaggguugugggcaaugggugagauggauuuaggaagaaaggcccgugcagcugaaaaucugaccccaggcuuagggcaagcagccgggguuuugcagcugcuagcaagggacccuggacuuuucuaucauuucaguuucuuggucugugaagcaaggauuauaaaaugaaggauaugucuuaggguugucugagauuccaugaaacacacaugauguguucugcagcaugcuggguacauagguaacacuacuacauguugccucacuuucugauccaguaauugauggauuggacucucagaccugccuugaauuaguuguaugcucuccaagcaauuauuugagcagugcaugccuguuuucuuauugguaucagagucaauagcuucugggcucaggcauggaagauagaagggaauuucagugcaaagugccuggaacaacucaagucucaucaugcuacaugaaagcugcuauggacaauguugcccuuugggugagcaaggugagaauaagcagguugagaaggcuccccacagcuauauaaggagcugcacauugaaaguugaguucuaaucuuuuuuccuuuauuauagaaaaaaauauauauacaagaugguuagaugcuuaaacuauaguagccaugaagacuuuucuuuuggguuuugagacaggaucucuugcagcccaagcuggccuaaaacuugcaaugaaacaaucaaagggugaccuugaacuucugguucaccugacucugcuucucaagugcugggcuuacagguaggagccaccaugacuagucuauagaaacauagcuuaaugucuuccugugcuguacuucugaaggaggcaguaaaagaauucaaccugaaaggaaaggcaguacacauguaaagucagguggaggauggggccagaucacuacagcagauggaguggcaugugggugggugggugggagauaguauucugauauuccaucugagaagauuucccagaggagguaacuauagguuaggauuccaguggaugugaaagauaauaggaauagaaaaauauagggaagaaguuauacauugaugagaaagaggaagaaucaugccaaggccggcuaagaguagggagauaaagcauaauugucuugcugacaccaaaucaaaguaaucaccacucacugaaggcauacugugugcaaggcacauaagauugugcaagguacauaagaaucacuacucacugagggguuagcagugggcaagacuaugugagggaguugcggucagacaguggagacaggaacuguucucauaucuacaugaagaaggaugaaggaaugcucuauggacagagcugcuaaguuacucuucugggacugcuguuuguggaugaaucacagggcccugacugggcugcaacacuuccaggugaugguuuuaauggcuuuccccuggggacauccagugaggauuugaguccucaguaaagagugucaguugucacagaagucuuauucucuuuuuguaugacugcagggccuucuauuccaacaccucuuccagcgaccuggucagguguggccaauggaagcaagagcccagugaagucgccuaaguccgagggcaugguaaguucuuugugccccauuucucaugucauggaugauacugagaugaggucuggcuggaagcuugaagagcaaagcgacaguguugagaggaacccaaguccucaagcaaccgguggaagagagcugacugcacuuugccugcuccuuuguacuguuacuucuguggcagauacacuguuuccucugcugcuguuugagaccuuuuuauuguaaccuuucucagucagccuuccuaauacacuuucucacaguacaccugcugacuuaaacucauguuaagggucacacuuaaggugggauggugauaaugaugacauuaguugagccagaggcuagacuaagaugucuaagucuguauagcccugacagcccucugagaaaguguuacaauuuccaacugacaaauaagguuuaaagaaaauugcaauucccgccuuaugaauaagguuuaaagaaaguagcugagcugacuuacaccuuuaauuuugcuuuuuuuuuuuuuuuuuuuuugagauagaaucuucacucuaucagauaggcuaaccuacaaaucacuguguagcccggcugaccuugcauuuacaucaguucuuucugcuuuggccuuccaaaugcuaaauguagaguugugagcccucaugacuggugaucuuugagggauauugauauguagucuagguuaaccuugaauucauaauuguccugacucuuaagugcuaagauuaaagaugcgcuccaucaugucagauucugggugcacgccucaccuugggucaaauccacucuucaggucagaacgagaggggacuuuggcgagcaacacauuaccaaauugucccuugacaguuaaucagagaggucugugaguuccagugcuucucucaagaauguuuacucaccuuaaauggugggaugcuauaaggcuuuagugaagagaaggggcucgauaugguggcacagaccuguaaugcaagcacugaggagguggaggcagcaggaacaacuucagcuguacaaguugaucacccuaucucagaacaacagaagagccaggcauugcaacuuguuaaaaaccuccaauagauacgauucucuccgugucucuggauagccugggucaucuagaaugaggggugugcauguguuuuuccuucaccagaucuugggaggucagaccgaauuuggauucucagguuccuucuguuggcuaucugcccugagcaggggugguguguaccuuuccuccacccuccuugucaccagaugcuagggaaggcaugcuggggucagauccaaagcaggaaaaggcacccuucagccccucucuagucucugcacauuucuauauggaacugggcccuuucuuccccuaagccccaccucuuagcccaccaggaaggagaaagggaaacugccauaaaucccccuauuuauacaagaagacaguguguuucucaugccagaaaaaacacagaaagggagcugucagggaagaagggacccagccccagaucuugaggggucaauuuaucauccccagucauggcuuggggacuacugcaacacuagcugugggagaugcaggcugggaguuugggggcagccuggauagcacugccuggccuuuguuucugaccucagccuuucugcuucaucugagaggcccccuucaccugaugcucuuuuucaaaacaacuuuccuaagguguaacucacacggagcacaacccuacuuggaauggaccauucguggcuuuagaaucuugauggacacgagcaacugucggcacaaucuauuuaagaguauucugagcccucagagagcagccuucugcccacaggugaccaaauccuuauccucaauaacccuucuaacugagcagccaacgagcugcccucuaccuauucaggacagccuaggaauggcuucaugcaguagguggccuucugugauuggcuccuuuuccuugguucuuaugcguugcugugucaaagcacgcauccauucuccuuccuucucauggaugaguuacuucaacgguagacagaccaccuuccagguauguguucaucaguacaugggcauuuagguuguucccauguccagaaauuaugauuuucuaugucucuagacaguuugaaucaucuagagu

SEQ ID NO: 8047 - RNA, 2321 nt, Mus musculus
ggggacccucauccucccuuuccgacaaguggggguccugagcgcugcccagaagggguccagagaauguugugggcuggggcacacccgccggggcagaaauuggaggacaccaccgacgucgacagaauccuuucuauccuuccuuucagcugcccgguguucuccaccccugcguuagcacucuguagucuggggaccucccgggaacgucccggggcuagcaaccaagggggcucucggaugcucuguggaucgccgcuucgcccuuacuuuggggacggucacacgcgucccgcuucccccggucgcuuuagaucaggcgucugcgcccuccccggcuccucacccccacccccagagucaaaugugggccucuccuggaaauccuuugcgaaggggacaaacuuuugaguggacgaaaaucuauuggagccuguccagagcaggugagcggggccuggagcgcgaagcuucagucuggaaauuugcggcucugguucucucucucuuccccuuucuccacccugcuuucuuugcaggcgaacucugacccgcgcgucuucagcccuucgagggaucugggcugggggugggcagccauaaguuuugggcuuaggacaucuucuccuucuugaguuugggcacuaggguggcagcuggcaggggugggaagaguagggaugcuucugagacgagggaagaaaagugaaaauuggggcaaagagaccuagagucugcaggggauucuuuuccccaaaugcaacuugaaggaacuucaaaaaguuuuuuuuuuucccaagugcuugguggggagggaaaacagaguugggguuugagguuuuagguaagggguggugcgguauugcuagcuccagggucuggacuaaguacauccaaagaaccuaauaaucccaaaccuuuucgucccaauaggccuuagggacccuuggacuuccccaggaacagauccacagaaagggagaggacccccagagaguuucuggcagugcugggauguaggugggauaaggcccagccuuuucugggaucccucuacugauuuuaauuuaggagaggugcaagauggaacacucacagugccuuuacuauuguuucuaaucuaguuugacucagagacccauuuuucuaggguguaugcaacuuucccucccccuucuggcucuauaaccuacaaccuuccugcagucuccaguaccccaaggagacuagggaaaggagagauacccuacaggaagagaugagaagguuuucaaagggaguuaagaucagaaguccuucagagagcuacguuggagccggacuagagcgcaggacggcaggugguuuaagggguagugggucaggcaggccaucgaaagugcagugugaauggucaccuaacugguacccgggguguaccugcacuugagguuuuuaggucaggguccucugggaaccugaggcuggaugaaucaggcuaaauguaaaugcaaaaacuaaaaauugcauuuggagcaauuugggggaagggcaguggguuacuuggaucgaauggugucucuggcccugcaggccacuaggccccacuuagacuggagcaucugugggggaggggaugcuuuguccaggaacuggguucucccagaccagguuagaacagcuucgggaugugggguaggggguuggaguugggaguggaguaacugccuagaauaaguuugccgugguuggcuaaaucuggacuuugagaggaacccuaaagagguaggcaccaagggaguggcauucaaauaggagugugaucaggguuaggguuaggguuaggguuaggguuaggguuaggguuggugauggcucaugccugcaauccuagcacucugggaaaaaccaaaaccaaaaccaaagcuuuucagagaaaagcacagggucauuggcuucccccucccccuucaauuaaucugcucccuuugcuucugucuccucaacacccccacucacccccaauguggggccugucucuccuuuucucuuugcauuccccucaugcucuuuuuucucuuaggauugauggagccacaaacaguuuagaacagcuuuccuaagccuauagugagucccacccacugggacauguuaaguaaggggacacccaggaauagggucccaaucugaggggaauugagaaagaacagugugaaggguggguaggugggugcugaccaggccuuccucuggggaaggguccguugaugccaucuguacacuguaggauagacuuagaaacaaagaaagauagcaagaugugccaggaaaaugca

SEQ ID NO: 8048 - RNA, 525 nt, Mus musculus
gcuggagguguuuccucagaacgguucucagaucaggggucuaggggaggaagacaaagagccagauuucuggccaaaacgugaauaaccgcauaagaaacugcauggaaccggacuguaagugaaggagucaggguuccuggacaagcaagugcuugucccucuugggggucaguucugcagagauagaagugagcauucccaggccugucagccuuucugcuaccucagaguuugaaaagaucaaguuccuuccuacucccccacccaucaagaacuucccuggauuccuggaaaucuuuccuuaaagagacuagaccuuacuauugcccagucuaagguauguagcuucuggggaaaggguguagguuccucucagauccucaaaggccucugcauccucccugacugggguugucaggcugacugguaggcuggaggauuccugcuugcacuguguguauaauaaccuacccuggauacgugaauguugaacccagagacacacagauaaaucccagaagc

SEQ ID NO: 8049 - RNA, 23761 nt, Mus musculus
ucugccuccgcccgcgcagcccggcagcgugugguccugcugcccgcgccgccccgccuguuccucuucggagcuguccugggcuccuuacuuccaaagccuaccuaccuuaauccuuuggacagagcgcccagcccucagugcauugcugcuuuucaccugcuggcugcauccaccucugaccuggaccccuuuuggccugugcaauuccgcucuaucucugggucacuggcucugcacagcuuguguuucucucugccucaguuuacucucuuaggccuccugugcccuuuaccuugagcccuucccuuuccucuucaagccuacauccuagcaccagaguaagaggcuugaaggagaggcagaagguggugguaacaagugcaugguuggaagagguggcuucuucucuguauccuuucagcauagaaaggaccggccuguucauucaggaccaucagacggcuccuguccagaaguccugagauugauagauguggguccaucagcccugagguuaguaugaaaggggccacuugcugaagaaccaagagcagccccaccccgagaucccugaucuucugaagacagaaucccaggaagacagaaagcaagacaagccauuucaugucuugugugguacccgacuccccuguuucaucuucccguucccucccuugcauaucuguguucugccccccaacauauggaaccuggcauuuaccauaugcugacgacccaggcagauuuagggaagaucuuuccuggcagacaaacagcaaggggaaacccuccugcgagcagucuggcaugcuggaggaauggcauugaggccgguauggcuggagcagggaaaauaaggaagggaaugagcuguggcuucuaagaggucacagaaagcuaaucacgaucauguggggacuaaugagucacagcuaaacuugcacuuccacucugaauggacagggagccauuggagagucagggccugagagugauaugcauacuccccuugacuacucaaugcugucauguugagaaugcagugggaaacaaggacguccaagagugcacuguagcagcaaggagagaguggggccuggaugaauguugcagagucagcucgggguggggguggggggugguugcggugagucagaugggaaccguggaagcagcaucaucaaggaaaaacuaagagguuuuuguguuguuuuguuuccuaccagugaccagaacauggaacuugucauuaccugguaucauggaauaccaaggagcuggcaucaggagacaugcuuuggacacauuuagugugagaugccugcuaaagauccaaguagaggaggcucaugggucuuaguuuccugugaagacuaggcuggcgauagagauuuaggaguccucagugauacugggugugauccuucagggguccaaagacaagagcacagauacuucaauauugcaacagaauggaaaaaaaaaaaaaacugcugaggaggauuugggggagagaugugggaugaggacucuugacuuggccauuccucauucugagcagcccucauuggucguuuucuauaugguccuggcuucauuccccugggaacucugcacaacagccacucugggcacuuugugccacucacuguugaccagggccugcaagauuccagaugcucagccuucuagaccaggaaaaacagaucaauagggucugaaauccugccuccucuuuaaagcuuugccaauagggaaacugaggccuugagaaacaguuugcuuggggacuccugccagcaagcgaccaaggccccuagagcagaacugaauguuccuuguguaccugcacugucacaggcagcagagggcuacugagcacaaggcuacacccaugagacagaggcucgaaggagacaacagaggcaggagauauucucacuccucagaaacuuucacuaaagugucuucaguucuuugcuuucauucuuggugacuucccaguguggucucuccucucuacccuagauccuuuuuguccuacaaaccuuacucugaccagaucuucuagaaccagucccaagaucuuuagauugcugauccugucagguggcucaggcccugaaugaacccaacagccagucaucuucuuccuuucuccugaguucuuaauacccaggccaguauguauucacaugauucagcccuauuaucaaaauguaacauaauucugagcuacggacuucacucucuccacuugaagaauuucaggcaaagcuaguuuuguucaucuauguuguugacugcugcagacuccuaacugaucccccccccccccccuugcuggucccauucugcaugcagcaaucacucucacccaaccccugagucuguguguuccuuacuuuucucccgguccuucaaccagucucaaccaguuccuacugguccccuguccugugcuuacucuguuaggcggagccugucuccacuguuucagucucuggguuaaagggggcugggagagacugacacgauguuaucucuaggagaugugggaagccagaguggcauccuggagggggcccuaauaaagaggccaaagggguauagcucaaugauagaguucuugucuagcaugccuaaguuccugggucccucucaacauuggggguggggaacacaagcuugagugugccccuggaaugguagggcacauucaggaguuuccaccuuuugcucagacccccugccccccaucuuacuguuccuaaugaugucugcuuuuugauccaaaggaugaaucuuaucagccucagggaugagagagucuucaguuaaauaaggcccuguucuguggagcugggcuuagacaacuaggugagaauaaacuuguucucucagccuggccacccagaccuaggcauccacagguaucugucuauuuauuuaauguguaugucugugugccauguucaugucugguacccaugucggcuagaagaagaaaguauaggcuccucugggacugacguaacaucaucaugagcuaccauguggguacugggaaccaacggagguucucuaaaagagcauccaguucuccugucugccgagccaucucuccaguccccccagucauucauaguuuuauucuccagugccuggcauccuucacucagcaggugcuuauuccuugcuuaucgaauaggagcuuuaauaaaugaauggcuugggcacucugccuguggggucccuggucugccuuucuggaaguguaggcuauggcuuucaacuccaaucaccuggggauugcaagcuuugcaugggacagaaugggucuggggcagagucaagaguuugcuuuuccugcagucuucuggacaugcauguguggauguuucucaggcuacauuuugagggaccauucucaggcacaaggcacccucagccuaaaauuaagagauuacagacugagggagagagacagcaagagaagagccaaagaagcaccaaagcucccaaagguccgcagaagucccuagcuggacaguuugaggaaggccgggagcaccuauagcacccacuacaucacaucaaagccucuuucucaaaggcccucucuacccaugacgggggucagggcucuugaagugacugcagucccccagucccuaguuggucuccuuacucugggaacacugugaguuacaaagagaaaauuaagcugagcccagguguguacuuuucauucuaaacccucaaguguaacccaaacugccucucagaccaggcacacaggugaacucaugacagaggaccauccagggaggagggagaaacagugacgaaguacagaccgcagauggagcucaucugguggagugcgugaggccuuagguuugacuccccagcacugcacacaauggucuuggagguacacagcugucauccagcacuagagaggcagaggcagaggcaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaaaggcagagaggcagaggcagagaggcagagaggcagagaggcagaggagaggcagagaggcagagagagaggcagagagagaggcagagaggcagagaggcagagagagaggcagagaggcagagagagaggcagagaggcagagaggcagagaggcagagagagaggcagagagagaggcagagagagaggcagagagagaggcagagaggcagagaggcagaggcagagaggcagagaggcagaggcagagaggcagagaggcagagaggcagagaggcagagaggcagagaggcagagaggcagagaggcagagaggcagagaggcagagagagagaggcagagaggcagagagagagagaggcagagaggcagagaggcagagaggcagagaggcagagaggcagagagagaggcagagaggcagagagagaggcagagaggcagagaggcagagaggcagagaggcagagaggcagagaggcagagaggcagagaggcagagaggcagagaggcagagaggcagaggcagaggaagaggcagaggcagaggcagaggcaggaucagaaguucaaggguaucuugacuacauagugaguucuagggcaaucugggauaugugagauauugggugcuuuguuuuguuuuguuuuaaagugagagaaugagaaacaugggagggauuuaaauucugacuugagggaggauggagagacuacugaagaggguguggggcccugggaagaggggugagugugugcuagaacagcgaaugggaaucaggugauccgaggugucaguccuguagaaggugugggguauuguuuucauuugauuuauuuaguuggcugcugguaugcuaaugaucagaagcagcuaggaacagcaguguuggguagaaaguagagaaacgggcuggcaggggcuuaguuccauaugggccauuugggaguguguguguaguggcguggggcaggaaacccaccggagaacuugccuuccccuuggggcuucucugcucugggaaggcuuuuguggggcaccaugaugucuaucuccuccauuucuuucagaucagaccuugagcucuuucaacccagcugccuuccaguuccacaacaaagguucucugccucacaucucaagaaaaaaaaucuagaauuuguauagugaugacaguaagcuaaauccuugcuguugaucacaguuuuucuuaucuauauuuuuaauuuugagagagauuuucucuguguaaccauggcuggcuuggaucucacagaaauccuccugccuccaccacauuguaaaagauuuauuuugacguauuuugaguacgcaugugucuguauguagguguguguaugugaaugaggccaggggagggagcugaagcuggaauuacaggugucucgaauugcccaacaugcugggugcagaauucauguccucugcaggaacaguggccaccccuuagcugaugagacauccugcuagcccuuccuuucauuguuuucuaaacacuuuuaaaauauuuaucuuauauguauaaauauuuugccugaauauguguauguauguguaccacauguguaccuggugcccuuggaggccagaaaagggugucagauccccugaaauuggaggccagaaauugagcuuauggagggcugugagccaccauguuggugcugggacuugaacucaggcucuuugcaagcaguaagugcucuaaucacugaacaaucucuccaguguguguguguguauguguauguacaucauauguguguguuucuuuaauuucauuuauagguugaagagaugucuaagugauuaagagcacuuacagaagacccaguuuugguccccaggacugauauggugacucauaacugucuguaacuccaguuccaggcgaucagacacccucuuaugaccuccauggguaccagagauacacaugguguacaugcaugcagacaugcagacgugcauacaucuauaaaagcacucauacucaucaaaguagguacaacuuuaaaauuauuuauuuaucauuguguauacacguguguauauauugccaaugaaggaucauuggaaggucagaggacaacuuuacagaauccauugucuuuauggaaaccuuuaucuguauuccagggaucuaaccuaggucauaaguacuuuacccagagaaccaucuugcuggcccugccugaucaugcuuuugaugcauggcaaggaauugguucuggaaacaggauugauaagccuucugguaugggggagacuuguuuauuauuugaaacagagucucagguagccuagaacccauuauguaucuggagaugaguuuuaacucccgauccuccagguuccaucuccaaaaugcuaagauugcuggugaauaccgcccuguguggcgagugagauuuuuaaugcugcuaucugguucccuuuauuuugauguuaggagucugugauuaagcuuuggguuccucuucaguagcuguacauuccagguuuuucuucccaggaacauuucucacuccacuucuucauuuguucugguucuuucauggguggguccuagauggcaggccaucucugguccucugggguggaaaugggggagacugagguccugaagaugcgacaugucaccugucacauuguaccacagcagcugcgugaugugauuucaguuggguugucaccuuccagcucauucccaagugaaggggcuccagggucuaugcagucagcuacaccagguucugcugcaaaugccuggaaagugaacagaaagccagcuugagguucgugagguggcgugcuaggaaaagagaagugaagauuggacaguagaaagagagucaaggaaagagguacaguggguaggggcauggaauuuccuggccucacagcacaaggccuuagcuugcuucuugcucugaaaugugugguggccauaaugaguaaggccaugcaugcugucugagucacaaggguucuuuguagaugugaagacccuucucuuuucuuugcugugguaacugcuauguucccggaggucaacaugcugaugaggugggaucugccagaaggaggcugacucucugggcucugaucuaccuuggggcucuucucucccuaugaucugguacccagagucccagcaccccaggcuuccucuggcaggcuugugguggugggagggaggcugagagaagccaagcugaagaugaacugugaggaggccagggagccaacuucagaucaugcucaggcagaagccuugcaucucugccuugugguucccaccuuugucuuaagccuguucucuaacucuugcuucucuacuuuccuggcuuccauugcucucaguacaccuacaacucuagcuccucccucauuccagcuccugugucucuggcccauccuucucucucuuuuucugcucuaagucugucauguuuucuauuccuguccacucccaucuuccuuuuaugcuucuagccuucccuacauacgucucuccucuugcaccucauuaucagccacacuauuggauccaggaaggugcuggcuagauucaggguccaugcuuaaccuuuacuugcucaccugaugaagucauaguaacaacagggcuaaauuuaaucagcacuuacuccauccagagcuguguacagucucguguaauucucucaguaacuuugaaaaauacuauuauugugcccauuucguagacgagcagagcaggucuagagaagcaaaaaaaaaaaugcuugcugaaggcuuuucagucaaucacauuggacaggcaaaugcaggcugcccaccuaaagggcucuaucagaaacccgggagagguugguuucacucucacagugagacugagaaucuuaaccucaauuaauuagagucugucucugugucugugucugucucucuuacguguguguguguguguguggggggggggguccuggcucugugucuguccagucucugugucucugugucugucucugucucucucacauauguguguguguagucugucucugugucugugucucucaugugugugugugugugaaugugugaaugugugugucugaguggaggcuagagguuggcuucagguaucuucucaccuugcucuucacuuuaauguuugagacagucucuuacugaaccuggagcuuuucagcuaggcuggccacggagcacugagaucugccucucuccaccuucgguacugggguuacagccaugccuggguucuauaugggugcugaaaauccaaacacuuucuuauguuugcacaguaagcauuuuucucacugagguaacuucucagccccuuccucuuucuuuaagcauccucgugguaccccuagaaucuucgaaggcucugauggccccuccuuccuuuaaacacucccagcuuggcucugagagucuguucuguaacgugaggcacagagcugggcacuguaucucauuuagucacagaaacucuaggaggugucugcuggugagacaaugguauuggggacuugccuaggggccacacaauaagugacugagcaaggaucugaccccagggaacuuuggcuguucaaaaccugucauuagagacucccuugcacacagcccucaaaacagaguuguggcacccacugugacuagcccaaugcuuuaagcuguucuuguaguucuaccccagcccuuggcuacagccugcuucuucaagcacugcccacuguggcuuccucugugucaccagcacuaaagucuguugagacugcucgaccuaaugggugccugggggggauuuauagacagggaucccccaggaagcagggacaaguguuuuccucuccagccccacugugcagccucccagcccaacaucucccucguuccggcccaucgcagcagcugauuuaacucaguggcugggggauuuagcuucaaugcugguuccuacuauaaaucccugggcaaauaaccaaguugugcaucaaaucugcccaggagagaguaggagcagaugcucgugugaccacaguacagggcagguggcaaagacuccaggcuuuaccauccaucucuggccauaacaccaggccauaccuuguucaggcccacuguccagucagucagaucuuacuggcccuaugugucauccuucaggcguaggcucuggcugguggcagacucuggucucuaccauucccauuuggaauuugcucacuugauaccccuccccaaucccgaaaaggacaaaaccgagacuacugcucuagggucuggucuugcuucccaguugagcuuugcuuggucuuucccuggcugaccaauguaggcucagugggaagggguaagauguuuagaauguagagaccauuggggcugaggcaaauuugcaggccaggaaagggugggugaaccccagaggguagagacauuuccugagagugaaggagagagggguggguggucauaauugggaucccaaacuuucuauacuuuggccuauauucagguaggcaaugaggccucuguggucugcauggaucuggggaugagguagcauugggugggaucacauucugucuugucugcuggcuucucugaugcuucugacaccucucucgguuuuuccaguggcuccccucgaggcuccccucaccuccccucugcuucuguguuuuccuguucuuuucccacagcuuucucccuccagaccuugaaagcacucuucccugggcugaccagcuaguggugaugggcugguaucagagccugguucugguucuguucccuagaaagccccucauccugagccugucccuguuguccaugauaucucccuccucauccaucuuccuuguccuccucccugccccugccgaccgccuccgccuuggauauugcagacacugaaucagcagccuuuaccaggguucugcugacagggaacuuucugccucugagggcuccugggugggaucagucucucuccuggagccugcagacauggaguggggggaagaaggaaggaaggaaggaaggaaggaaggaaggaaggaaggaagaaacagguagauggagagggagagaugaagggcaguucguaagauggcaggaaggaacuuggagagacagaaggagaagaacagaggggacuugggaaaacauggggugguaugugaaaacacugauguggacuuagauuccagcagaggcagguggaguucugugaguuucaggccaggcuggucuacauagagaguuccaggacaaucagagcuacauggccagacccugucuugaaauaaaagaaaaacaaacaaauaaacaacaacaacaaaacaaaaauagggcuggagagguugcucagugguuagagcuggguucaguucccagcacccacauugccgcucaacccaucuguaaagccaguuccaggguuucugacagucucacacagacauauaggaaaugcaugcaccaauguauuuagacauacagacacauacauguaccaaugaauauaaaauaaaaauaaaguaaaaaaaaauaacuccucaccucauugacaggacaguaaaggauaauuaguuaaaaaaaaaaaaagagguacaugaagaugggagaaacaugcaggaaguaagaggcagaggacagagagggugggccacccuugggcccuacagguaccuuggaagcccagguucccuaggucuggguugagggguacaggcugggccugcgguucuccccuguaccucccucucucccucucacguggugguuuguacuucaucuuguuugcggggcggcugggccugcucucgggguuuaaugaucugugccauuauuuauagcuuugcacgccgagaaacacacugaauuuaucgcuugcuucuauaaauaacccuggcaaacgggugcccagggaugagggagggagggaggagggagaagcaaagaaaggagagguaggggguagggcaggggaggucucuguggauucugucccuaaaacgggggugauaugcuugcacaaugagagcagaagcugaggagagcguggguguguguuuaagaacaaguuaauaugagcagggcggccugugccucugugaggaggugaacagaugcuccuguguuucugaggacgcuuguggguugaugguuacugcuuguguuuguuucuggugccauguuggugacagugagauugaaacaacacaaaugagcuccaagaaauggcucuuucguacauggcugcguacaagagcagggguaggcaagggagagucugacuccgacuuccuucguuauaauuggggugacagacugucgaauguauuuuccccuucuucuucuggguguucaagggcauaggugggaagaaaugaggccugaggaugccuguuaagccagugagagggagggagcucccaguguccuguggggcagagacuagggucauccuucagaccacagcuuuugagcuugggggauggagagauggggguggggagaggagaauggugcacuuggcaccagcguuccuccugcugguccugguccugacagaagcaaagcuaugcucuguccagucugcccaagaauugucaaaugcccuaugcaaagacuugcaguagcagaagccugcugguugcuguccuuugucccugcaguaggcuccuccccauuccccucccgaagccugccagggaucagccuuggggggauggagagcccuggcacaccucuucuccuucccacagucccugaucagcacaucuucgcagaaacacugcagccauuagcucaggaagugcucugcauugcuaaugaguacaucugcauauguaaugaagacccuucacagguguuggggaagucccccuccucuucccccuuucuucucucuugccagcugccacuuugaccuguggcucuggggcugaggagggaguuccucaucugguuuggaggugugccaaggaguaagaggcaaguaaggggggggggggagaguuccuuuaccugggucagaaacagucaaggugaaguccuucguguuagcgacagguccagggacaugugacuguaagccuguacacacucacaaaaauaaaguacaagguccagcucuuccuugggcacugcagcacauuagguaaucagugcaaguguucaaaacacauccugggcuguagccauacccuguguacaacugccagcacauacuucuucauacacacugucuggcauggccuggcacagcggggcaugcacauggacaaucagggguugcacuuguauugggauuuccucaguucagcuucuaccuuagguaucagcacccaucuacucuggccagaaaacugucuucaucucauucagacuagguaaagauacaagaggccauuguccuuuaaaaagagaaaaaugaugggccuaaaucaaugacguguaagggcaggagaaaaugcuagagcgccagggaggugggccucagaugaggagcuggaggcagauggaaggaugucuugggagacaggguagcgccaggggcacuagagucccuacaaggucauucuuagguuauccccaacagcccucaacucuccugcuucagcccagccaaucccuagcucugaggccuccccucacgcuccuauuggucccucccagucaugugacucuucccaucucuggcagcugccccugaugauggaugcugcugcuuagcuguaccuguugggggacaaggacugcacggcuccuaauuaccuccuucuagaacaaggacugggggcugggcugugugaggcagcuuccccucugggggccagggcugccauccugagcuagaggcagguguuucccccagugccccuggugaugggguugcaggggcaucagucagggguaugaaaugaggggagcuauucugcaaggcugguaguaugaaagcuugucggagacaacagugcuggcgaccugguauauuggcauaggacuuaaaaaauaaauggccucuuccucguguccuucccacagagggcaagaucaaggagagguguuacagagaaaugccugguauaaucagggauaaggcacauuugaaaaaaaaaaaaaggcagacgugagggacuaggagcaugguggcacuucugaggagguggaucuccuucucuuacccagcaggucacccacaggccucagcuguagauagucuggaguuggagcaggagggcaugaggaaaagucccaggcuuuuccucaugcccuccuuuuguuuggaagggaggagugggugaugcuggcuguuugagaagggggccugucauaugcugaugccagaggcucuggucuggguugacuuggggagggaagacagaccccaggauugaaaagaugguaaagcuccugcugacuucccccaggggcaccaaggucuuaagggucaaaaagcauguauucagcaauucuccauguccagagcuugaggaccaagcagacugaaaugggggauaugggaccuccacgaggcuugcugcuucugagcuccuguuaucuccuaagugagaauccugggagacuggggaagggugagugaagagcugguacccaaccugugucuguucucuggggugguagaggcuauggugaggcagauaugauaacugcuaaucacugcuaacugauacagcucagugaugacuaccccacccaggauucacuauuugcaguuaccuaucuuuggggugaaggagaaaggauaaggacuaaccuaagcaccugggcaaccaggucucaaaaaaaaaaaaaaaaaaagguggaagaaaccagcuguccagcauggagguaugauacuguucucgugaccacaguaccugacaaucggcugaaaggaagauuuauuuugacucguggucuaauccaucauggugaggaaagccuggugaaucagcuuaguucacagugggaggggugggaggaggggcuugguagauguccuucaugucacagcagagcaggaagcaaagaggaaccgguggcuggguauaaacauccaauaucuuucccuugugaccuaucucaaccagguagguccacccucugugcaugcguuugcauucgcacaugugcaggugcauaucuguuggugcauggugcacgugaguguaucugcauauggaggugagaggucagcuucuaguggcuuuaucucuuugagacaggaucucacuggucggagguugccagugaccuagccauagcauccuucucucuccguguucccauugcugagauggcaagugugugccaccacaccuggcuuuuuacuuagcuucuggggauugaucuuaggucccccacauguguguggguugagugcuucaccgacuaggccaucuuggcaucccuggcuaggcuuaccuucuaaagguuccaagcuucccaaaguaacacuacuagcugggcaacugagcauuugaaaugugugccuguaagggacauuucagauuuaaaccaugccagugggucucccugacuucagugaggaguggagggggguugggcaggaggucagucacucaugucccccacugauuucucuucuggauaguuccccaacucuacuuauaucuuuucagucauguccccaccucagaguugacacaguccccucaguuguccugccuucaucagcaauguccuuccaccucaugaaguacuggacucuucacuacuuuuuggaggucaucaucagacugaaggauggucagucuccaucucaugcugagguggugucagccacuacuggcauuagauuucggagcauugcccggugggggagaugcucacuuuguuccuggcuguguaugugucugcggaaguaacugcagaagcagacuggaguuagagcaggaggcugagggagagccuggauacacaaggugccuggggacaugggggagggaagaugggggugguggggggugguaguggugguguggugguggugguagggaagggugguggcugcauucuugcccagccagguaucuaggaagaugaggaggcaaagggggaagggaaguccaucaccuccccacuacagcggguugggguaguuugguuggaagcaggcuuucuuagaucaccaggcuuaugugugcauguaucugcaugugagagcacacacucaccuccagagacaguaucacaccaacauucuuguugcuucacauuuucucacaggcauucugucugauuugugagcugcuuccagggcagagcucuaauccuguugcaugagacucucuuucacaccggauagaaaccuucuguaauuccccaguuccgaugaaaaauaguugacuuccagcuggaauucacagcuuucucugaucuagucccaacuugccuccagccuuaucacauacaaagaugaagucuccaaugaagacuaauuauuuauauuugcauugccucugccugaguggucaaagugccacucaauagcugcugguuugugccugucucuuccaggaggcauaaggacaggguagaggaagcauuugguguuauuucucaggcuauuuccaccuuuaaaaaauauuucuucuuacuuuauauguggauguuuuuucugcuugucuguguaacauguaguaccuagagaggccagaagagggcacaugauccucugaaacuggaauuacaaaugguugugagcuucuaugagguuacugggaauagaaucuggguccucuggaagagcagcaacugcucuugacugcaaagccaccucucuaaccccucucuagcccuggcugucccgugaaucaauguauaaaucaugcuagauuuaaacucacagagauccacuuggcucugccucucaagugcuggggcuaaagcaugcuccacuaugcuuagcucucucaggucccauuuuuaaggcaaggucuugcugugcaacccagacuggccaugaacuccugaucuacuucccucccucuugagugcugggauuacagaagcaugucgauauacuugacaccgguuuguuuauuuguuuguuuguuugaaagggucucauguagccccaggcuggccuugaacuuaauauaugacuuaggauaaccuuaaacuccuguccugcucuuauuccccaaguuucaggguuacauguguuuaucaccacaccugguucaugcagcgcugggcuuuaugcaugccuuuugacuguucuuaggaauuggugcuuugcauuuggagaggguauguucuuuuggaaguugauguggaauaguucccucuccuugcugagccucagaagcagggcuccuauuaauuuccacuucccuggccuaccauggugccuggcaucuauguguauaacuggcugagagccugacuacagaggagagcacaccaaugaacucguucaagucccugcucugcuucuuucuagcucugugauccccgagcaagcaguuucucuggucagcuuuguaguuguaccaugaggugcuggggccucccuguucugagauucuguguauccauggugguaagacuagagacaggcccagcggcagacugacacacagccacuuccuagagggaagguuaagugguaagccauggaugguguugaaauugaguugggcggguuauagauccagagaaaguaggugagugugaauucuaggcauauccgcaugaaaugaggacacuuucuuauugcuuauauuuucaauuuauuuauauuuaaaagguugagaacuaaacuaggcuugguggugcaugccuuuaauuccagcacuugggaagcagaggcagggggagcucugugaauuugaggucacuuugaucuacauacugaguuccaggacagcuaggacuauguagaguauugcaaaaagcagacagacaaaagggggagcuuaacacacagaguacuacaagacuccacuauuugagguuugucugguccucucaauccccucgugugggcucuauucuguuucucuuccccuugacaacugcugggggagaaucugcccuuccaucccuuagaaccagcccugugacuuggcaucaggccuucucagguccccacugggaugccggggcugcagaagcuuggcaaguuuccagugggcgccccuggugaggucugcugcugcugcuaccucagggaccggaguuucccaucacccuggguucccauacuucugucuuccggcccacagccaagauauccugccuuccauccccgacccugaccucuggagcccuucuuagccugagaacaggcuccuuguuuuaucacccuacucugagaauacugaggcuggaauucuaagagaccagaaaaacucuuccaaagugugaagaagggggagggcuccugagugaaugagacccccauccuacauuucugcuucugacuagcccucauuuucccacaucaccccugggagaggaguugguggaggcugcagagaguacccccaaacuucugagcuucacauaccuuaccgacaggagauguuccuugcagggagcugaaggggagucaguaccugugcaaggcacccuaggguccugucccuuacaucucccacucucuuguggucccuaaggaucuuggauauauccagagaccaaggagcggcugccccucaguccugcucuagagagaagaagagaaaggccaugggaaaaucccugggaaaaaaaaaguuaaggaagggugguggcucccuccucccagcagccuaauaaaauccaccuuugaagacaggcagaagaacccagggggugaaguugagggcagaggagggucugugguugcugggggcugaaauugcucuuagugaguccuggcaagaucccaaaaaggaaaaugccagggcucuguaaguaaaguuuggcugugagcaugaauaucagagaaucucaucuugaguaggugugagggccccagaggcuggagcugagucacacauuucuuacuuuaugagauauuugcuuacaggagacccagagagggaaaagauccaggcugagucacacagcauuuguguguuccucauuguuggcugggccuggcuuucuccugcuuucucucuuuuccuucauauaaauuuaaaaauacuucuguucuccacucucagcaaacacuaugcuuauuccaaacacucuuccuccucaauaguuaccugugaacuuugaccucaggaauccacuuuggggagggcacuuggagaaaacaagauagaucuccuuaacucucccaagggcuugcagguggccugcuaaauugccccuucaaaggaaaauuaaagcaauguguguuuuauggagugcuguuuugggcuguagcuaggguggaguuacaggcucaggacugaggcaugucggggugagauaccuggaccagcagagcccaacaugucugcuucacucccugguaccccacuuccugucagaguagacaagcccaaagaaccuaccccaggaacuacuuccuguaguauuuuuuucucucacaaggaagcccugggaagcacauguccccucuggggccccaccucuuggauuucugagaccacauugccagggucuaagccugggaucuguaacaccccaggguauuuuucugacaggcugccaguguagagaaaagaggaccccucuguuuaggcuccaggccaucuugcucuuggcccugcaguguuuccuucugacagucaaacuaauuuuuuguuucuuuuccuuuuucuuuuucucucuauuuuuggcuuugcgacagggguucauuuaacccaugaugguuuggaauuugauauguagccaaggauguucuggaauuucugacuccuaccuuuacuuccugagugcugggaauacaugcuuauaucgccacacccaucuuauaacguggugaggauugaacccagggcuuugggcauuuuaggccaacacuuuaccaacucuucagcuccuagguccccguuuguugugggauucagagugagucauuuuguuuuccuuuucguucuuuauuuccagggaggucuuuuugaaaagaggaucuaaaguaaucauuccuaauagaaugcucguggcagaggaagccccagucugcuuguuaugguuuuaauaugaaauauuuccccacaggcuugcauguggaaccaauugguccccagcugggggcgcuguuuuagggugugauggaaacauuaggagguggagcuuagauggaggaaggcaacuggggcauaccucuggaggguccuguuccugguuuccauaagcugaguaacucuguccucuacaucaucacagcuaugaugcucugcuccacuggacacaguguugcccaggccauaguuaaaggccugaaacugugagcagagacauggccuuugaaguuguuccucaagucauugucucagugacagaaaacccaacacuaccccagaugaauucuucauuguucaacuaagggcaagggcaugucucagggaaagagccuggguaaaagaaaaucuagguucugauucugacccaagucucuucuuuuuaggccuuauuuuucccauguguaagacauggagcuggaauccgugaacuucaaagguccuuuagagguggcugaaagccuagguaaaugagugcaggacaaugauaauagccaauguauuugaccccuagaaugugcucgguccuacguguugugcauuuuccauaggcuguccuauuuaagauucaaccacaugauuauauagcauuauguaauugcauagugagacuuguucuccagaagaaaaaguccuaugaguaaaauaagacacagagaagcuaaguaacugaggacuucuuuuuugguuuuguuuuguuuucuuauuuugagagagggccuuacuguguaguucagucugauuuugaaccggagauccuccuucuucagccucccgaguccugggauugcaggcaugugcugccauaccaagcucuaaaucguggcuucuuggaggaggccuuguaaagcugagaggagguuuagcuuuguagagagggacuccaggaagcucugaggguuccuggccagagcaucacacguauaaugcuauagaagagcucuucccuggguuagggauguagcucuacgguagaacacuucucaagcaucagugaggccuccaagaacugagaaaagaaaggcuugcucuuuagccaaaugugguagcacacaucuccaaucccagcacuuggagucuuaggcaagaggaucauggguuugaggcuggccucuguuacauagugagacuuguucucuccagaagaaaaaguccaaagcccuuguuugucucucaucugcaccaggaggcccugugccaggaacuggaguagcccagcccacagaguccugagugcugcuccuaccccaccccaccccacacacaguuccucuuccucucgguacuccauauugcggccacuucugcaaggcugggcugcuugaacuccguguuggauuuggcuucuuccucagaagacaauuuauggcgacaugucggagacucuguuuuaaugaaguugcaaaaguagguuaaugggcuguggguguuuuucauccccucccccugccccaucuccaccccugggcagaugagugauguaucuaccaguaagaggcagagucggauccagccuggacuuacaagcucacacaucuauccuuggucucccccuaggcuccucagucucagucgucuccgccacuagguaggagcucggaaugucuagcccuaguccguccgauacuuggauggagcuuccucuccugccucgagggagggacaggucauaaggugagugaggauucuggaaagaagaaagcuagaauaaaggagaaugcgugucuuuggacaucagaagccaggguguguagagcuguggugagugugaaugucagugaccuugaaugucaagguagguuuuguuggaggaggaccugaguuucuggagcucuuccaggugcugcccuugccucucagguucaugucuuugccuccugguccagugccugcuguauagcugcucuuacaauggugcauaggaacaggaggcucuuucucuaccccaagucuccagggcauccuuguuaccucugaauggcccucagcuugcuucucauagacugucccuaugcaauuccccacccaaucccugaccauacauacaucucaggaaguuugacaggauuaagcuguggaaaacuucccuguuugcuugccuggauauucagugaaggucugucauccuggauguuugggguuuccuguaagaagguuccagauuuuucccauggacucucccuguguugggaauacccaaggcaggacucucagcaagaugugggagcucaaagcuugcuuaggaacacauaaacauacccuggaggaucuugcugauaaccacaccccucugccuaguccuuccacucugcaggaagucagucugcucugcagucagccagggcagcaaggguccuccuccaguuuaaggccuuucacagcccacuaaugaggcuguggaucacauuuuggauuuggacacuaaagcaggguagaacauugcccagcugccuggcuauuuggcaacuucauuucccaucuccuuuggacaccuuugucauccuuuccaaggccccucauugucuccugccauuacaaacucuucucccuagaucucaaacacugccugcaacugagcaccggcugcuuuggaugggcucucccuccuaugcuuucuccccagcccagauaggacuuaacuuuuccagguccuugcuuucacugaguauugcugggggugaggcauggcguguucacagagugccccugggcuggugcaggacuucaguugcgacugcaggauccagucggugcuaccuugucaggugauccaaggagcucagcaggagucagcuggguuugguuguaucuggagauugguggcaguauggcaucucuuucucuggucccaguugaggggcuccuucacucaugaugcuagacaggacucaagagcaaggcaagucaggugucuccuggguauaaagugaaacccagaacuaugcccguguccccuggagcuucugugggauuuccccugaugcagaggaccaggguuuccauggccaugcaugcacacauguguggagcugucaggguguggguuuguagggaagggaacaguagugaagacacaggucacagggaacagaccccaugucuggugagagaaaacuuaggaauggcucaaagguauucagggagagacagaagaguagaaacaaugguuuuaauucaggaggguuguguggaggaggagagcuggcuucaaauugagaaugaaagacaucagcaaagagaaugcuugagacggggcaagcacuugaagcugaaucagaagacuaugggaucccaguugacagcugcuuccaggguucuuuccuccuuguuuguaaagaggagauaaacgcaugcgauaguccugauuuuauuaaaaaagcgcucucucaguguguguguguguuugucuguaugaaaauuacucuacaggaagcuacuugggccugagauuuaauauauacaaacacugucagcuccucccuucacgugacagagcaaauauuaauauagcuaggacagcaguccaacauuaggucugccaccaaccaguucauucaagaggccucaguuucuccugaaucaaucuccuaugauaauuuauagaauucaagguccuuaccagugugggagaggucguaaguuccaggagucuccgaggacucuagggaagggcaagggcuccuuggugggagaaccagaggcuuuuacaugacuacggaucucagucuuucuagaccagaccccuggcaggaaaaugggcauguagcccaccccuugcacagccuguacaccaaggcuacauucccuucccccuuccccagccacucaggauggagaggggggugccgagggggugggagccccccccccaaguggcuuugagccggagcacagcaauuacgcaggaggauuuaugucccucugccuuuaaucggaaacuccgugucaagaagaaaaaucugcacuguccucuggcccagcuuccugcuuuaucauuauuauugcaggaagguugauuuggaaacuuaaagaaaagugggguugggggugggagccacccgggaaggggaggugcggggcacaaugauggccuucuuacuguuggcccugacuugccucucucuauuuccagacccucacugccaacagaugaagcuguggaccaugguuuagacuccaauaucaaggcagacuggagcagggccagggugccugcaaccuccuugucccuuucuccuggacaccucuguccuucacucuaagccuccuagcuaucucuuacugcuauagacccuucuccugcgagaucucaaacuuucagagaugagagacuuuuaucauggacccaagcaaaca

SEQ ID NO: 8050 - RNA, 10194 nt, Mus musculus
cgggaagcugguugcauaacccagugggguguuuggcaacaaugcuuguggcuugaccugaugcugcugguggugugcacauacguaguggagguggguuggacuggggugacagguuaacuauuuagggguugggugagcagcaaaaguggaaaauguuaauguaaaaaaaaacuacguggccgccguucuaucuguagucugucucugcuaccuuuguugagguugaagaauuguggagacaggaaaaucuuagucauuaucacuuggccaagucuaugcaauccacucagguggcacuccccuaacacccugcagauuguaagucaagccaaagaagcauuguuguagggcauugacuguggacacagggaucucuggcagaagggggcuaaagugaaucaauccccuucucccugggguaacuuugaggcagggcacagcccauaaaccacaggacagagcucugccuugggagggguugaggugaagugggcuguaaugccucaggggagaugggcaacuuacuuagcucauuauaccuggccacaucccaacaaauagggaguaaaggacuucaaauacuucuaguagugucugcaggggagacuauacccucucuaguuugauucucagaagccuuacucuccagccccuguuaaauuguacaguacuccuuaucccagauccuaggaccuaggaaaauauuugcugcuaggugacauuccccagccccugggguguuuaggcuuaucaccuacuugucaccucaugcccacucuagaaacaucuguauuuuaugcuucagcauauccacaccuuugcuagaauacucuuuuuuuuuuucuccacagcccaagucuacuggaaagccuugcuuggauuucaccaaguaggauuaauuucuuucauugcacacugcuucacauagacuuuuuguguuguuuuguuuuugaggcaaggucuuccuauguauguauguauguauguauguauguauguauguauguauguaugugugaggcuguccuggaacuuacuguauagaucaggcaggucuggaguagugauucuuuugucuuuguuucaugaaugcuuuuuucuuuuuuaaacaguguuucacuauaugucacaugcugucuuggaauuuacuauguagcccagguuggccuuaaaaaaaaaaaaaaaaaaaagucugucuuccugccucagccucccaagaacuggauuuuuaggcauguguuuucauguccacuggcuauagaucugagugggugugaaaacauggacugucuuagucauauuuguguuucuggaguagaaaauaaauauuuuugaaugaauaaaggcuaaggucugucuauguuguauauagauauaucugaaaugccauacacccuguucaugaauuaucuguaaucugauauuauacaaacaacugcaugugugacuguuacuaucucuuaucuccuaugaggacccuaauaaguaugcaagggcauguaugugaccuagauucagucucacacuaggccccaagcccacauccagcaugcaguaaagucauuggauugccuccugacccgcauaaacuauacaggugugugugaucagguuggaaugggaaguacucagccuuaggucuagcugagugugggaaaucucagagauguuagcuugaugggagguuccuugugguaucaacacacuaagucauuacuugcuugacuauguugccagguuguggaagauaguggggagaacuagaguggucaaagaagacacuuuugugaucgaacaguuggaaggcucccagcagcuguuguucaugcuucaggccaauauagucccacuauucuaacagaaagcacaauccuauccaaagcguuagcagaaugacaccucuaccuugggguaggacucaccugcuuuucugccuaucuuauuaguuuguuuuucagagacagggucccaugcacaucaggcuggccucaaacucaccacguagccaauguugaccuugaacucaccuuuccucuagcucuugaauacagggguucuaggucuuuugucaaauacccagcuuugcuucuggucuaaaaauguuuccaaauuaacuugaauaucagugagaaaaacaauagagaaaaagugguguaagccguaucaaucagaaccgaaguuagauagaccaaaaagacauguuccuuuggucugaaaguuacugaagcagacacagugagcacuccuauaauuccagcacagggaaagcagaugagagacuucugggagagcacaguugucugauacagagcuguuguguacuaggagaugaaucugauguacauauguagccuggccugcaagaaaaaaagaucccuuuuagggagacuaauuauuaaccaacaggacagucucccaccuaaggacccucaccccacacacacuggcaauaaauaaauaaauaaacaaacaaauaaauaaauaaauaaauaaauaggacaaaaaagaauccuuuguccuagagcaucugaggcagggguuggcgggguaacucauuaaaggauaccucuaagcagcuagcagccucucauccccaaaauaguucccuuagagcccaggcuuucuagaagugaagguuguugcccuaagcaaauuggacucagauaccugguucuuacugccugcugccuuuugccuuguuaugacuuaguuucccugucggucuuuaggagacaccaccugaaagaaagaggaggcugcgggccauguuuauuuaagcuuaggagucucuugugaguggaccaucgacugugaagucagcccgaacaaacagggaaugaacuguccuggaccagcuggagagggucugaagccugugagccccgggugcccccgcugccacagagaggcgggggcggggugcagcagaaaccacaccgggcucaaguuuccucucuuggccagaaggggcaggaggagaagagggccacggggaaagggaaggguuggaggaagcacugguaacuccgaccgagggcuucggagagaccgccggugcgcccgcuucuaccggggccaaccggugcuccgcgcccagccauggcccgggggcggggcucggcccucaguaguacucagaggcagcgcucagcgcccaggaggugucagcucugacccagccucucagggacacuacccgcagccucaucucucuccucgccgggcuuggaauccgccacaggugccugaaaggcgagucugaagggacgccucagugggcucuggggaggucaggcugggcagguggaggagguacagggaggaauaccuaaguuucugucuggauguuucuaagacaucuuccuagacuauaccugguguaggaaacugauacauuaggaguaauaauacuacuuggagauacuuuuagaugacuuccuggcuguucuaggacccuugggguggcuggggugggagguuguaggugggggggcuacacaaugcuuuacuaaauagcacccuggaggagcaggggagugaacaggaggaacccuucaacuggccugcugacugggggagcuaguaggcuccaguaauauggugccaccuuguacccuuccccaugguauucuguagccccgaccaucugagauuugggggaagcgaagggaccauaaauaugggaugucugaacuucugaaaaaccuuguuacagcaagguggggggguuggcugagugguuccccguugccucuccuccuguacaguccuaagcuggaccugaaaagaggagggcauucaaucucaguguagaugcuucuauggaaacucuuggcugcuaguagcaggagguugagaugcuaugggagaaaagagagccaccagaucugcggacugcagccucuacuuauugcuuccaaugagccagaguucuagggauagagucacuggagagcagaaauucauucccuuuuccuuguuuccaagcaucauguugauauauauauauauauauucccaggggacuaagccuucgugguucaaaucuucccucuucguucuauugacuucuucucuauuuugccucugcgugccucucccuuuugagaaauucuccguaaucuuuguaacaagguugcuuaccugcuaauuuacacaccaaguuuuacucauaucucucuaauccuuccuuugucuguguugacaccaagagaggugggguaaccuaauaagccucaauacaguacccugaagcaagcucccugucaaagaaguucaaagucuuaggcuagcaguggaagccaaaaugucuucuucuaccucuccaaaugauccuguaucccuagaaaguuuuguaaccugugaagucuuuggaaucaugagaagaucuuuggaagauucuaaggauguagcuuggugguagaguguuggcauggcauauucaaggcucuggguuggucuggaaggagggaaggagaguaggcagguaggaccaccagagugaaaaggaagaauggaaguuucugcaguuggcucaaguucuaccagaucuacaguguggaggaucgaaggggauaaccaccccaguagaucuggugguuuuaugaccugaagaggaaggcuaaacuguaaaacaagagcaguguugcuaaagagccccuggaaaacuagcucacauucccugucucuuuucacuacccucucugguauucuuucugucuggcuucuagucuguccuacuggcugcaagcuugcugguccucugaaaggcaggcucccaagauccaaagggccugugccugguacaagccaauggucuggugguuuccuuuaugaaccucugcucagccuccagccucuuccugcccccucuacacucuuuuuuuuuuuuuuuuuuuuuuuaaucucaggaacaagaagacuuacuuucaggucuucauaggaaagggcugauagcuagguaccacuugaagucuagcuuugccuggguuuguagcuagaugaagaguauagacaacuugcuauuccccuuuccggcuuuauguucuuuccugcaaauucaucuagauguguguuucuugaggugagucuggccuccucucuaugucuagggcauuguuguucuuaggggccugcacaucccaaggcaucaggcauguuuuccauacaccccagguaaauguggcugacuagaugcagcuuguuccuucuacaguugugaauuucucuacuccugucuccauuuagcuggaaacugugaugcaauuuguccaaggccauacaucuugaaggcuggagaaucuugccuacuagggcaagaucuuuguauaguaccucagauucagauccaggaagacaggugagacaaagagagguagacugggugaagaacuuugaugcaacaguauagucccugccuacccaaaaacuccuucuucauucacuaagccuuugggcaauuuccgccagaacuuggguggggaggguggaguuccgguguugaaauggcauccuggacagacauaaacaccccacccauucuacccguuggucaaaggccugucuauaucaacucccauuucuggggauggcuuuauagcaagaggguggaggcagagccucaggcagaucaguuguuaaaaggacacuugguaguggcuauacauuuugugguagguccaagaggagacuccauaaugaauagcaggaggagcuauccuugugaugggucauauaaagucauacaauuugaggucauacagcccuauccucuggucuucuguaaggcguuucuuuuauuuauaugauguguaguguggaugugaauguauguacaugcugugcugucuggcccugagauaucaggagaaccuugccaagucuacuugaaaucuauuuggacacaaagaaaacagauucagauagagaugguaucagggaauauggaggcaggaugaggagagagauggaccaagaggagaugaugaaaaccacgguaagaguuugcaaaugaccaggcuguaaggguucaaguuggcuugucuaaccuucuggcuuuacuacugggagaacuaaccaggaacagugaggugucuuacccaacaccacacugcugcuuugcagcagagcugaaagcuagaacccagauuaaaaagagggacagaaggagagcccaaagugauauugcccagaagagaaaagggccugagacacuaugggaacuugcuaagguaaauugcuuguaguggcguggguuguggauagucagcacuuugggaaccaaaggagcuuagaaugcagcaauggaugugaucagguuccaaccugccaucuauucaguaucugccuguaggaucugccuuuacagggucuuugugaagcccagccuaauaugcuuuuaaaaugcauaaaagucuugacaagugcuugcuuaaaucuuuguugaguguugaccuuggaagagagaggagcccugguuaugcugggugggacaugaccaaaugaccuuguugggauaaaggguaaagguccagugucuccuggagcccauuccuccucugccucugcugccugcagcugauaaaccccuuaucuggcccaggcaggggaaccuaaaguaaggaugggaggagagggaaggguugcuaucaccggcaggcuuggggccuaucucagagaaggggaggggcugucugacuaacacuucccacaacacacuccuugaggaucucuaagcacucacuucuugggaagaaagggcugaaauacuagguguggugguacaugccuuuaauuccagcacuugggaggcagaggcagucggaucucugugagcuagaagccagccuggucuacauagcaaguucuaggacacagccagggacacauagcgagaccuuguuuuaaaaaacaacaaugaaaggguuagacccuacgcugaggacacaagaagaaggcaagggugacucuugauguuuucuuccagaauggaaaaugaaauuucaauccccaaaccugagaaagacuggauuuugucucuggacaggaauaccauuuuuagggaguaagagaaggcaacuugcugagaaaaaguaaggauaccuacucuguguccagaggacugacuauggucagaucaggugagguagagaguacuccacugaagaaaagaacauuacaguucauagggugguugauggcaccugugagucacugacaacgcuccuuucuccuggaaauucugcacgaggacaaccucugacuuggugggagcaacucuaauaccuuucuuucuucaacacagguugcaggaauccuuugugcuuguggagaccuggggccaucagcuggcacaguaggaugcccccguguccuccucagcagaacaggaacagguuaucacagcugccuguuggggagcuuggagagauggaacugacuuggcaagagaucauguccauuacugagcugcaggugaguagggggugggcucuugccuggccagaagcagagaguaggggggcaaugaggaacaccagggggaagggaagacucuggcugggguuguaggcuucuguccagcugcucugcuuacaucucucucuaccauucucugcucuacuccucccuuuuaucuucucaucugauccgauucucuuccagcucuguccaucuucccucauuaccacuccucguccuuagcaacaaacucuuuuucuccagguagcagagccuuaguuaaagggccucagaaaggggagauagacugugcugggguccucuccuccugaauguaggacaaaggggugucuguuggucuaacaauggugccuuuguccucagcuaggcuugagcaggauagcuccacuaaguaaguugggggccuuguuuguaauauguguucuccuccucacugcaccugggacuggacagagagugaacccucagcuugggcucugugccugcuuccaccucaggaucugcccuuagacccucccuccacacacuggcucccucugcugggcacccagggaauggcaaaguccugaacuugacccuuugacucuagauagccacagcagaaaaggguucugagaguccaucuuggauaauaaugaccuugucuuccugaagaaaauaacggaacaggagccauuuggcuugaggagacuuuguaaccaguucaaugugagguugucuucugagguuucaacagugacuuuuauuccugcuuaaacagccuuuuccucuucacuacccuuuuccuucuuuuuccugucuuccucccuuccucucuuccucucgauacaggauuucuuucuuuaucucucuuucuuucuuucuuucuuucuuucuuucuuucuuucuuucuuucuuucuuucuuucuuuuucuuucuuucuuucucuuucuuucuuucuuucuuucuuucuuucuuucuuucuuucuuucuuucauucuuucuuucucugucucucuuccuuucuuucuuucuuuuuuuuuccccagagacaggguuucucuguauaguccuggcugucuuggaacucacucuguagaccaggcuggccucgaacucagaaauccaccugccucugccucccgagugcugggauuaaaggcaugcgccaccacacccggagacacaggauuucuuugaguaguacuggcuguccuggaauucacucuguagaccaaggguggcuuugaacuccgagaucuggcugccucugcauccaggguacugagauuaaaggugugccaccauacccaguuucuuucuuuccuuuucccagacagaguuucucuauauaguccuggaguuuacuuuauggugcaggcuacccuagaacgcagagauuggauuugucuuuuagaugcugggauuaaagguguuuaccaccacugcccaacauagucgaucuucuuaauccucuuuauuuuuuucuuugcagggucuaaauguuccaagugagacaucuuuugagccucaagcacccaccccauacccugggccacugccaccuccaacauauugccccuguucaauucauccagaugcaggcuucucccuucccccaccaucuuaugagcucccagcaucuacuccccaugucccagaacuaccauacuccuaugguaauguagccauaccagugucaaagccacuuacccuuucaggccugcucaaugagccccucccagaccacuuagcucuccuggacauugggcugccaguggggcaacccaagccccaagaagacccagaaucugacucaggauuaucccucaacuacagugaugcagaaucucuugagcuagaggguauggaggcuggcaggcggaggagcgaguacgcggacauguacccaguggaguauccuuacucacuuaugcccaauucuuuggcccaucccaacuauacucuuccacccacugagacacccuuggccuuagagucauccuccgguccaguucgggcuaagccugcuguccguggggaggcagggagucgggacgagcggcgagcccuggccaugaagauuccuuucccuacggacaagauaguuaacuugccgguagaugacuuuaaugaguuguuggcacaguauccgcuaacggagagccagcuggcucuaguucgggacauccgucgacggggcaagaacaagguggcagcccaaaacugucgcaagagaaaacuggaaaccauugugcagcuggagcgagagcuggagcggcugagcagugaaagggagcggcuucucagagcccgaggggaggcugaccgcacucuggaggucaugcgccaacagcuggcagagcuguaccaugauauuuuccagcaucuucgggaugaaucuggcaacaguuacucaccagaggaauauguacugcaacaggcugcugauggugccaucuuucugguaccccguggaaccaaaauggaggcuacagauugagcuggucuagagaguggacacuggugcuagagacucccucauucccuucugaugaaggcacuucuuaaucccacaagacucagaguccuccagaccaaaaggcagauguaaccauaucaccugggaguauuuggugagguuugccuggaggccagguguuggcuucucagguccucaaccccaccucuuguccaagcuuugguucauaaagagcuguguggaaauagcuu

SEQ ID NO: 8051 - RNA, 27148 nt, Mus musculus
aggcaguuuggaagagauucacuuuauuccuaagccgcacagcagcguacaagguggacuucgccugacuccauuucuugcagaggccgccuccagucugcccacuucagccagugcaugggccagaaugcuugcucagaaacguuuuuuccuaagucauuuucacagggauaugggaucagggagcaacauuacacccaagaacgggaauccaagccucagaggaaagguacugcaccagguccuccauuuccagggaagacugaugcagagagggggaacucaacaacagauuguagaaccaaagcagagaaauaugugaguguggcgcugaggagaaggaacacggcaaggccaacgucauuacggcucuuuccauccucaguucugagcagaaacuuuucuagggacuaaaguaguuuggguuccaaggucuggcuuugcuccagggugacagaggccacaggcaaugaucucacagguucuacaggcagagaggugugguacaggccuagagagauguucucaggaccaugugcagguacagcagcuuugaggcuaaaggccagaucaaaguugaggcugaggggacuagcuccaagggccuuuaaaucacuguuccucugcagcuugucccuucccuacaagcuguucccauuucuucuaaggcagaggauagggcagcaggaaggagagaagcugaggcaaagaaaguauggccucugccacuccaaacccacuugugcugaaguuaggaguccuccauuugcuggcuauaugggcugcugggaugagggcccuuaaggcacagggaagaaaacacucagcacauucuuucucuugcuuugaugaucugaaguacagccacaguaaagggccaagaaaccaaggagagaauggggggugggcgagacaaguguaaguaggaagaggguguuuccccugacucacucaaaucugcuggggacuuuacucucaugagagggaggggaaagaaccccagaaaguauagagacagaagaauccauugugguucuccaagaugacccuaaggacauaaguugggggccuggauaagaagucacagcagauguggguuuugaggggcaaggaacugggcucagaacacuuucaccgaaggagggaccacuugaucuguucuuuggcugacugcagcaccuguggagacaaaggcagcacugagggggacuugcaagccacagggugugagcaggcugaggcucuccuuccccacacuugccuucccucuccuuagaagaacaggggauagaaaaucccaaggguggaagaauaggaagaagcucucuaaggcccuagaggauugucaguuugggaaauuccccccgaauucaaauccacuggggggaugaagagagaagagauauaccugggaggaaagaaaaaaaaaagcuggggguuacuggacacacguuauagagagggaauuacacauccagauguugagggcuccuacugggcaaaaccagaaccacuuccauguaggccuccaggucaagcagacaaucuaucugcagucaagguagaaggauggaucugcaaagcccgcauauuccagaauaugcauuuucagcucagcccucauuugaauaauaagagaaagagaagugugugcucacaugcacacagaccaucugcuuaaggcaagccucugcuggggaauaaaucacugacugacugagguaucaagcagggaaggucugaaggguacagagcaaggcugacaguccagaucacagucagggagacaggggagccgaggacacuguacaaugagucccagugcucuggaauaagagggagccaaggaagcuaacuaagugugaggucucaauucagaccuggcaggucgggggcuccugcuagcuagucuguccauguggagaggaggaagaaggaagucauaccugagacacggucugcucuguaagggggacgucuucacccuguauacagagauaagcacuuagacuggaacaugguagaggaagaaguguucuuuuaaacugaaggaaaggcgaaugcccuaaccuucucggcccacuccaaagacugagccagagggacugugaacacaaaggaucauuuuauccauccuccacuuaaaggcaggaugacuucuuaaaagauuuauuucauuccaaguaaucagcaggauaucugauccucaccucccucaacucuggggugggggaccugauucccuagccggagaagaccuucccugaauaucaauauggagguggugguggagggagccagggguaguuaauggaucccgcaaggccugacggguaacgacugcauguuaauuugaagaaauaaacugcugcaacagcagccugagaagagagaggggggagcaagagggaaggggcucucucuugccacauagagacauauguuagaggagaagauuaaacuaugcaaauggagcccacggcaguuaaggaagaagacuucccauuagccagcacuggcagcuuucacucuguggaggucagagcugggacguucugggaacugguagcacaccucugcucagacauucugcaccauacaauuuacagguggauucucugcacugucaucucccagcagacaugaagacucccagcagaaauuaacucagugagggcugaggugcuggcaauuacgagguuucugagggcuccaucggagugagacacuccucugccucuggugacuggaucuaccuccaaagaggcaacaagucaaccucaaguuccuuaacaguuuuagaaccaugaauauuaagguuucuuuuacuucuuuguucauucaacauauuaaagugaccauuuuguggaaagaccauauaauaugcuaggugccacguuagaaacauaagugagcuccucugcuucucugggacauggagauguagaagccgggagaaugauacauucgugugaagaggacaggagaaggugggaccuauguauaagcugacccucagcuacacccacccagcaagccuggcuugggaggauccguggagagaugggauacacaucccugcuuacccucaaagccacccggugcaccacuugcugggggucgcucucuaggaucacccuacaaacacaaagaagacgguuguuugcuccaagggaccaauuugcuguaagucagguucacuagcugaggggcagccaccuccccuccccacuccaaauacgggcagggcagagaacucacccuccaucuacaauuucauccacagccaagaagaggcccuccauguucuccagcaaagcucgcuuuucuacauuuuuccugaauccccaaaagaagaggaaaaauuagguugugugagaaaggaauucugggauacugucuaaauaagggauccuaacccuaaccaguaacugccuccaccacccacauguagaagggagugaggugaaaaagagccuuuuauaccacugaacagugaccagagucuugacauucugggggggaucccaaacagcuaacuucugacuccuaggcuacuuauccagcaugcugcugcugcugcugcugguggaggugcuuguaaaaagacauagaagauaggaaaaaaauucauagcucauaaucuggaguuggugaugguggaaaggugggaggagugggaaugcaaaacccucugcguucaagcuccuucugaagucucucugccucuccccuccccccaggucuguucaaacccuaaaacaaaggccaaggaggggcugggaacagccaggggcugcaucuaccagccucagauccggugguuggugcauguggccugucacauccgucaguaugacucuuucucuagauuacccgaaaugaagucuauucauucaccuggcugggaaauaaaucacccccuuccugaggaaaccugagccucuggcugcuggguugugggcugagagcacccgcuguucuacuccacauggauuucuaaaauguguucacuuuuaggagcugcuguggcugaaguucagagccuugaauguuuucagagaaaguaucuuauaucuucccuugcuugugugcgugggaacagagggcuacuggggagguagagggcaaagagcacagugggcccauucuguguccagggaaagacuauaagggcuagcaauggaaaauugugguguuuccuccuuuuccaagauagggaaguuucaccugggucacugggucacuucccuggccuuccccuccuucaaacccagcggacaggccuaggaaagcaucuggggcucagaacaccaucagaguuacuggacaugacaagaguagguacaggcauacagacgagguccgagucuguacuccaaacuacucuugaagcugaagcagggguuacauguucaaggguugccuggguuacaaauagaaucuuaagacagccuggguaaauuuuuauuuguguaucaaagacucuaagguuaaaaguugaugucaagacacaaaaaggcuugaaaagcuauagauaaucaaccucucgauuauuuuagagcaucugauaugcucugcucccaacugaaucuuaagcaugauguguucuggugacaggauuacgguuccuuuacauuaguuuucagaaucaaucuuucuuucuuucuuucuuucuuucuuucuuucuuucuuucuuucuuucuuuccuucuuucuuucuuucuuucuuuuuuuuuucccccuaggaccuugucuuaaauuaaaagaaaaauaaaauaaagaaaaaguuuaggugagaagcucagugguagaacaguugccuacccuugguucuaaucaucagggcagccaaaggaaacagagaauagaguauucuuccugaaggacucucuuuccucccucaguaagagaaugauuccacaugaagaccauucucuccaccuaacccuccacucaaauuaguuauccacaaacagcaagucuaugucuuacacugaaccaauuccccaguguggcucagauuucccacuaaucccgggcucuaaggaauagguauuucccuuccaaauuuaaaaugagaauggcugcucaccucagcaucuggcucagggaaucgaagaggcaguucagaacagccauaagcaucagcuguugagaaaggagaaggaagguucaaggcccuaaaacugcuaccccaaaacagaccuuccacuuuuuauuccucaccaaaaagcauaagcuuucacaaacggccagagacauaaugugaagggcaaacacaacagcagaaggacucuggcuucucaaagaaguuaguucuacuaagcaauuccacaaguagaggcuucuuuuuuuuuuuuuuuuaaagauuuauuuauuuauuuauuuauuuauuuauuuauuauauguaaguacacuguagcugucuucagacacuccagaagagggggucagaucuuguuacggaugguugugagccaccaugugguugcugggauuugaacucugcaccuucggaagagcagucgggugcucuaacccacugagccaucucaccagcccuucuuuuuuuuuuaauuaauuaauuuauuauauguaaguacacuguagugugucuucagacacuccagaagagagcaucagauuucguuacgaaugguugugagccaacaugugguugcugggauuugaacucaggaccuuuggaagagcagucagcgcucuuaaccacugagccaucucaucagcccccaaguggaggcuucuuuaaggcagaaacugaaacaggacuuugcugguauaguccucuauagacgauuauagcacucuguguauuuacuuuuuauuaaagauuuacuuuucucucuguguguuuuacaugcaugcgcacaggagugcccauggauuccagaagagagcacuggaucuccuuggagcaggaguuacaaagaguaugagcugcccagcaugggugcuagcaaccaaacucaaguacucagaaagaacagcaagcauucuuaacacuaagcaauaguuccaccuguguuuugcuuuuuugagguagucugucacauagcccccguuggucuugaaccaccuacguaacugaggucaauccuaaauuccugaugauuauccugccuauacuucccaagugcugggauaauaggagugcauugccaucccucucugccucuaagucuuuuuaauaauuauuuuauuuaauguauauacaugucugucuaaaacuauguguguauaccacaugugugcaguacccaaagaggccagaagaaggcaccagaaucccugggauuggagugauaaagacagucaugagcuccuguguagguguugggaaucucccagguccucuggaagagcagccaaugcucuuaacagcugcccuaucucuucagccccuaccccuacgccuuuaccaaacugccugauggaaacaacuggaaaaaaaaaaaaaaaaaaaaaaaaaaagcugccugauggauuaguaaagagagagaucuuuaacuaauuaagagcugaaaucagagggaggugguuggaaaguccuuguuaaaaaugguacucagagccaggugaggucaugcaugcuuuuaucucagcacuuggaaagaagaagcagugaaucucugugaguucaaggccagccuggucuacaaaucgaguuucuugacagccaaggcuacacagagaaacccugucuugaagaaaacaacaaacaacaaaauaaaacaaagaaacagugcuagggauuaaaucugagacuucaaauuugccauuugaacacuucacugcuaagcugcacacccagcccagcuugggcucgcaagucagaacuaggcuugaaacccagcuuguucuacauguguaaccucgagagaguuagugagcugaaucacacauacagcuauuuuuauaguuugacaaaagccaaauacaaguaauuuuauauggcucuuugagguuugguuuccucguuggcaaaacaaagacaguaaugccuccaacccacagaaaugcugccaagcuuaaacaaugcaccucacagagcacacacacagcaguaagagcucagcaggaccuggucucucagucuuaacugugauggaaaauuaucuggaggcuuauguaccagucuauucucccagaaguuguuagcaccugaaauaaaccauuucuccugcauacaggaagguuaggaauauacucacagacccaccuauaccaugagucuucaucaagugaccccuucauacuguauggcuucaccaugaacuaaagcacauuacacaugcacgcccuuaauuauaccgcagaaaucuaccuuuaaaaaacacugugggugggggcuggagagguagcucagagguuaagagcacuggcucuuccaugggaccugggaucaauucucagcacccacauggcagcuuacaacugucaggaaauccuguuccuggggacccaauaccuucacacaaaaacaccaguacauguaaaauauaauuuuaaaaaguuaaaaaacagagccaggugugguggcucacgccuuuaaucccagcacuugggaggcagaggcaggcggauuucugaguucaaggccauccuggucuacaaagugagugccaggacagccagggcuacacagagaaacccugucucggaaaaacaaaacaaaacaaaacaaacuauggguuagcaggguggugguggcacauaucuuugaugcuaguacccaggaggcaggggcacauagaucucugagaguucaaggccagccuggucuacagaaugaguuccaagacagccauguccacacacagaaucccugucuuuaaccccgccuccacccacacccacaccuacacccaaacccacaccuacacccaaaacaaaaaccaaaaaccaccaugggaacuuggcauagugacucauaccuacaaucucagcacuggagaggcugagacaggaggauugcauuguuugaggccagucugggcuacagugugacacagucucaaaauaaaacaaaaacaaagaaacaaacaaaaucuaaaccaccacuguguuggaaagaauauuaauaaaauauaaauguauauucuaauuggagaugauggugguucaugucuguaauuccagcaccuagaaaauagaugugauuugacaacagccuguguuauacaguaagauccugccccuuauuaaaaaaaaaaaaaaaaaaaaaaaaaagaccuggaaaacuuccuuucuggacugauucuuuggcugggccauuucuucuguaagacuaacagggaucucugacagaccucuuuaugagcuugcccgauagcagaggaauguggcucugcaaagccccaagccaguggcuguggcccacuaggguuucagaaguggcaucagagguaucacgcacagcgauucucaccucauuuucauaggagcugccaaucacauagaaauagagaucgaugcuacuuuuauagaccacugucaauccuuccaacagagcgauuucaccugggagaagaaagcaggaacugaauggugggagaagagucagcacgacaggacuucccacgaacuccuggggccgcugcacgggccacggaaaggccaacuguaaagaccuccccgcacugaagcuauuuauuguuuugagggguagcagaagggacuuagaaacucaggggagucuacauucucuggcucucccucccccacugcgccuacuucccucccuguguaugaggcaggauaccagccgauccaaugcagagcggucaccuuuacaggcuuccauuuaccugcccuaauggaugcgguacaauaagcagagcugcaguuaaauuugucaagugaggcucauaaauccagggacuagacagguagcuaacagccaagcuucuaguacgguauucccgagugagguacacucaccucccuauuacauuucugaagaguuuauuguaugaggggaggaggggaaaaaaagaggaggccgagucauuuuaucuuuuuuuccugcaguccugcugacacccccuucccgugguuccccgaaacacaaggaagggugaagaaugaccuacuauccguccgaugggucuuguugaaaauguucuucucaaaggccuuuugcuccuugacacugggguaggugucgucauaguacuagugggaaggaaaggagacagacagggcugggucaucauagcugugagcccacaaugauuagugaguguccuacucugggaucuuguaugaccccuucaaggcaugcagugacagaggaacacugagccagagaagcaaggacuacagaggcaggaaaugggagggagggagggagggagggagggagggagggagggagggagggagagagagagagagagagagagagagagagcaauccagcgagagauugcugccaggccucggaaccagcauggcagagggagagagcugacuccugugaguuguccuuuggcuauucuaacaaguucacacauauacacccagaaaagaaauaaauuaaaaaccaaaacaagcaaaccaaaaacagggaaggagaaggaaugugcuguaaucaauccuacaauccugugagccauuuucuaaaacucuaagggcagaggccucccagcucucuuaaggacacuugcaccacgugcuuuccaggagcuacucuugucugggacagugcuggagaaauaaggaacgcuggaugcagggaggcuuccucagacucucccucacugcaggaacaccaguagguuucuuuuuaguuugguuuauuuugagacaggguuucucuguguaguccuggcuguccuggaacucauucuguagaucugcuugucucuaccucccugggugcacaagggcuaggauuaaagauaugcacaggaccacuuggcuggaagaccaucucucccacggcagucggcacuuuacugagcccacucccaagcacucccagcaagggggugaaaauacaggcugcuaaagcgacugcucuuuaggggcuaauccguugcagucagcuggagaccuaugacaggucuggcauuuaguaacuggauaacuguuuccaaagguguccugcauaguuacauccaauuacagggaggaacagcuggugaauucuaacuaaucuccaccugcugauugauuuaugcucugcucgcccagaguuaauacuccagggacagaagauauuucuacaggagggggagaauggaggaaagggguguccuuucucuucucaauccacccaaaguuagcaacagcucacuggggcaugcagcuuggugaggucagaaacuggaggacucccugaaaaacucaggccaagugacaagguaauagggccgggggcagaagggauagauaaaacagacauagaggccucuagcauugagauaguguuuugcucugaaauuaagguucuaaagcucuuccuuucccugaugaaggugaucacagaaggcagaaaacacucuaaggaacagaaagacugccaacuuggaauuaccuggaguagucaagguaaggugaaagaauucccaaaaucaucacacuccugaagaauuugaguuagaauggccaauucugcuauuuaaguauccaauguuucuguccugcuccuaaauuaauauaaaggcaaaucucaccuuggcgaagagucggucuccaucauuguccagaaucaggauggccuugacaguguacagggagggcuccugaagaaacaugaacguaucuucaguucugagagcaucacuacuagcaagccuaauaccuuccuucccugguuccacugagcugcagagucacacagggguuuguguguccccuacugcggcaugauuaggucuaauaccuccccccugagaauaaccaaggcccagagagacugucucaggcucacagcccuucaccaugcucuuauuuccagauccuaaggccuugcaggucauuuucucagucacccagucucucuggcguccugaacacaggugggcauggaacgugaccaugcuaauaaacaggcacugcucaucugaaagaggguugaaugcccuuggaagucacugcagucccaaagcagcagcuuaaagcaagccacucuaagccauccacacacagagcaggacugugcauucacacacacugguucuaagacagacaucauccaaaaguucacauaugaaacccuuccucgauauauaugaacccucacgacuuaaucggauaggauaaaaaucaaccugaaucuuaaguguggcaaacagaaaaauauuugagacguccggagucugagagguagcuaaaauaacaaggggaguuuucuuccacuaccaagaauggaacuaaguacucagugccauggggcauguuugugugcagggagcccugggucccuguaaaacagaacaaaaccccagaaugacacagacuugcugauacuggcucucaugaagccaucacaacuuagcuguaaugguuacacuuuaacaccuuucuucaauugcaaacagaugacuuaggaaaagcuauugagccugguguucucuucucuauucucacaacuuucagaaggaaaaaggaaagugagagcagcuggcauugugcacagcaggccuccgccacucacagaauuugaggucucaccaagacuacuucucacuaccucugguccaaggcaagacuaucuaucugcuuugcucuccuggucuuagaaaacucacccaucuucaaaaauauaaguuuaacaaagacaugaggcagaagaaagaauuacugcaaaggauccagagacugcagccugacagagguaaagugaggcuccuggagagguggggcuucauaaaaaagaagcaaccuuagcucaagagaaguggguauuaacccaggcuuuccuuuucuuuuuuucacauucauucaucuaucuaucuaucuaucuaucuaucuaucuaucuaucuaucuaucuaucuaucuaucuaucuaucuagauaagggcucucaauauguagcccagcuggccuugaacccucaagacugcuuccaaagugaucacuccccgccccccauguguaugguuguuuugucuacauguaaacuuguguaccacuugcaugacuggugcccuuggaggccagagagggugucagaaucccuuaaaacuggaauuaaagaugccacguggaugcuaggauuugaaccugggucuucuagaagagaaaccaguggauuuuguugguagugcuggguuguuugguuguucuuguuuuguuguguuuuguuuuguacacagggucuuacuaugaaacucuggcuauccuggaacucacuguguagaccagguuguccuugaacucaacucaacuugaacucaacucaagguugccugccuuuugcuuugcuacugcugguauuaaagauguauaccaccagacccugcuuaaaagccaguguucuauuucucuguauagcuguggcuguacugaaacucucuauguacugaaacucucuauguagaccaagcuggccuaaacucagagauuugacuggcuuuguaccggaagucacugugauuaaagguaugugccaucaccacuagacagaagccaggacucuuaacugcuggccuauuucuccagcucacuaacccagucuuuugaaaaugguauaagagcccagcaguucuggcucagaacuugggaggcagaggcaggcagaucucugaguucaaggcuacaaagcgagucccaggacagccagggcuauacauguaauuauugucucaaaagaaaaaaaaaaaaaagaaagaaaaugaccuaagaaauguaagcuuugagccggacagugguggcgcacgccuuuaaucccagcgcuugggaggcagagacagguggguuucugaguucgaggccagccuggucuacagggugaguuccaggacagccaaggcuauacagagaaacccugucuugaaaacaaaaacaacaaacaaacaaaaagaaacguaagcuucguuuuccccacuuacuuuuuuuaucagguaggcuaugcuauguagucccaguguacagucaaguauaaccuuaaagcuaauccaccuacuacuuccuaauuacaggugugugucuucaugugcauaugauuugaauuccuaaugaugguaauuuuugaugagguccugucucaaaaaacaaaaagaaacaaaccaagacauucaccaauuuuuguauuuuguucauuaauucaucucaagugcacagagcaaugccuggcgaaucccgagcucucaauauuuguucaaaguugagaauaaaguuuaaaaagaaaucucucagcacgaugauuuauuauaacuggauuuugcaucuaaguggauuuuguagugagauuguucuacgaugauauuauugccaacccacccucuccucugacacacugaaaacugccacccuagccacacugcucucuggaauaaaggacaagagcauuuccucugcaacuggggaacugugcugucuggcauagggaagucuucucaaguauagucuaagagccaccaacagaaguuguucuacuaacuccuagcuccauacagaaagaucaccccacagagcaggcucuguucuacagccacuuggcuguucaaguaccaaaauggagcccucaaugggaacgaguuuucuuaaugggaaaaaaaaaauccuaacagaaggaaaugguugugccccuucauccacacucacagcaaccacacagggcuagcugcccacaaguugcaacuggaccuuaaucuggcauuggugacuguuguugcagccagagucugguauuccuggaaggaaugggagcacacacccccacccucacagaagccaaaaucccuaauggcaaccugccaagugggagagccaguguucuuguggccagcaaugucuaagcaccuacacagccaugcuaacaacagaauacaacccaggauucugcuccugacucuuucacugguugccuagaagauaugaucaaagaaaccuuaaaacagaaacacugggucuuccugagcaagauaaaagacagguuaagggagaaaggagagaccagaccagcuuucaggcacuggaguucuggaaaaagagggaaggcagaacaaagccugaccguuucaaacuugcaaaggaagacccacaacaaggaaagcugggguauucggcaggagacagaaugccacuuaaaggcaucaccaucaugcuguaguagagccagcucuccucacuucuguuguagcuggccccacuccacccuaugccuuuaccucucaggaguggggaagccugagaauucccuucauaucagaaaaccagccaguuuaaaggcucuagaagccauuacuaauaauguaacuucauucuaagcuuugcaaaggacauguuauaaauaacucccaggugcuaagaaaugagcuuccuggacaaugggacugggcuuugaccuugugaugcauuaaauacugacucuugaaaaagacccuacaaucuuaggaccauauucaaaggacugaaaagaucuauucuucccucucacuccccaaaugggcagcugcuagaaagcuuucgagacaaaguucugugaugcacugacuuucagagccacagccugaguguauaacagaacuucaccucaaaugcuaagggugccuguaagugguggguaggcagacuggcugugggaggaggaguggcagggauagauuuucgugucugcuuuuauuaucaagaaaacuagaaagcugucuuugggacagcugaaacgucaugcagaaagcaccuaggcugcugcaacuaacucucugaucuccaucagagucuccagaaaccuggugggaacaucaagucuggagcaccaaggccuauacugggaaggcuagaggaagaagauuccuucccagugcugcccucuguggaccuccugccugacacacagcuuccucaggauuacagcccaagcaaacagugccagaaaggcaaugguuuggggccuaagcuguuugggcagagugcucaccuaaggugugagaccuugugcuuaauccacacacaaaacaaacccccaccaaacucgauuuguauguauuuugcauuuuaaauaaaacuaauacaaacagguuuguaaaagaaaacacggaaagcuaacgguagugacacaugcuuguaacccuacaugcaggaggaucagaaguucacggucauccucagcagcuugucaaauucuaggacaggcugggacaaaugaccuugucucaaaacaaauacaaaccaaacuacggaauuaagucuauuggcuuaacuaauauauaugggauaguaagugaauaguuggguaagaucacuguaugagaucaaaaagcuuggaggaacagugucuacauagagcagagagacaggauauuuuagaacuacaaguaacuauuuaagucucuuaggucacaaaaccaaaaggccuaagaauccaaagaaacagcucagagguuaagagcguuugcugcucuugcagaggacucagguucagaucccagcucccaguuccagggaguucugacacccucuucuggccucugaagguacugcaugcacacggugcccauauaugcauaaagacaaaacacuuguauauauaaaauaaaacugaaccgaaaaaaaaaauauauauauauauacacaugcaugcaugcaugcaugcaugcaugcauacauacauacaaacaaacaaaacaauauggcugagauuccuggaaagaucuguguucccuacuuacaaagauauucuugggauacaguaaaauucuugggcuuagcaauagaucuauuaauuaaaaacuguaacaagauggucuuucaauccugcuuauaaaaugaaauggcuggugagauggcucagugguuaagagcaccgacugcucuuccaaagguucugaguucaaaucccagcaaacacaugguggcucgcaaccauccguaacaaaaaucagaugcccucuucuggagugucugaagacagcuacaguguacacacauauaauaaauaaauaaaucuaaaaaaaaaaaaagaaaccuagagaguuaaaacuaagagagcccuucguaguacacacaccuguaacccaagcacuuagaaggaugagcaggaguugagaggccaaucuggaccacauagugaguucuaggccagccuaggauagagugggaccuugucucaaaagcaaaacaaaauuagaaggagaaauuccuagauaccacucccagcaccacagggcuaugcagguauucuguuaccuaacccugaguuaaaauuuuuuaaaauuaaaagguaugcugaguuugagagcucuaauuuacuacagaagccuacauaguucagaugaaaagaagauuuagcuaaguuuugacaaggauagcauuuagauuugggaaacacagcugaggggcuucagggguggauucugugcucagaauaugcuuuagacugugccacaaacaaaauaauaaacacauuaaaaaaagaaagaaagaaaaacucacagggcugaggacauggaccaacaguuaagagugcuuacugcucuugcaggucuggaguuugguucccagcauccacaucagacagcuuauaacugucugugacucucaauuccaggggaucugacacccucuucuggccuccacaggcacucacacacaaguggcauucacacauagggacacauuaaaaaccaaaacaacaagaagcccagaaaguaagacccaugaggcaagcauagcugcacacauuuuuuuuuuuuuuuuuuuuuuuugguuuucuuuuuuuuuuggagacaggguuucucuguauagcccuggcuguccuggaacucacuuuguagaccaggcuggccucgaacucagaaauccgccugccucugccuccugagugcugggauuaaaggcgugcgccaccacacccggcugcacaaaucuuuuuuuuucuuuucuuuuuuuuuuuauuacguauuuucuucaauuacauuuccaaugcuaucccaaaaguccccccuccccccaacuccccuacccacccauucccauuuuuuggcccuggcauuccccuguacuggggcauauaacguuugccugaccaaugggccucucuuuccagugauggccgacuaggccaucuuuugauacauaugcagcuagagucaagagcuccggaguacugguuaguucauaauguuguuccuccgauaggguugcagaucucuuuagcuccuuggauacuuucucuagcuccuccacaaaucuuaaucguagcacugaagagguagaaaaagggugcucucugaaaguucagggccagucuagucuacauaaaggguuccaggccugcuggggcuauauaaugagacccuaucuuaaaaagacccauggguccuggagaaauuaucuaucuuauaugaaaccaaauuucgguuguagaggggaaacuaaacacauauucuggagguacugauggcagaaagucacaguaggaagaaucuucuuaggaacugagacuaugguucuguuauaguauuucccuagcaugcaugaggcccuggguucaauccuuaguauuacuuaaaaacagacauggcaucacagucuguaacccuagcagucaagaggcagagguuugaagacucaaaguucaagaucaucagcuacguaaguucacaagccucugucuacaaacaaacaaaccaaaaaaaaaaaaaaaaaaaccccaaaacuggagugauaguucagcugguggaaguacuugugcauuuaaucacaugcacugucaggguagcaaagaucccuuuuagccagccagccagccaaaucaaaaagguaaucaacaauaacaacucagcuaggcagugagugguagguggaucucuggccauccuggucuauacagccaguucuaggacagccagggcuacacagagaaaccuucucucaaaacaauaacaacaacaaaacacaaaacaaaugaacaaaaaccaacuacauggcuggcugcugaggagaaauagcacccgagguuagccuccacccuccacacauaugcacacacauucauuauaucugcacacgcaugcaugcacacacacacaucuuccuaccccauacagacauacagauaggaaacauggagaguccaagcauggggcaaaacuucugcuaguugaaggagcuggcaucucugaauucuggguaaguuauuaacucaaaauuuccccucccuuucucugauacucaacuuccucauaggagaagugaaaggcuggaccuagauuagcuaggguuauggccuuuuuuaaaaaaaaaaaaauuacagcagacccuugugauaagcugauaaaaauuucugaacuuuguccccaaaaaacaaacaaacacccacaccacacaggugagacugaacuagguuuaaaauucaauccucugaagauaagauuaugugaagagcccgguuugguggccaacaucuuuagucccaacccuugggaggcagaagcagacugaucucugucagucuaaggacacacugguagacguagugagaucugggccagccacagcuacauagugagacccuguucaaaaaagccaaacagucuuuugaaugugaagaggaaaugaaugauuuucugccuucagucaguuaacaacuucaauaaaaauauguggccuuuguaaguuaauauggccaaggaucucacacagccagcagggggaguaagggucagcaccauaaaccuccagcuuucgguggccuccagcuuuggugaccaaauuguacaaguuaacaagccucaagcucuuaggcaauguagaguaccaggucuuugcuuuucuuucuuucccuuuuuaauuguauuuuuuuaaauuguaaaacauuuauuuuacauguaugaauuagagaauuuauuuuacauguaugaucuccuguggaugcuaggaaccaaaccuggguucucuauaaaagcaauaagugcuuuucuuaugugcugagucaucucuccagacccccugguauucauucauucauucauucauucacucauucuuccuuccuuccucugcuccccucccuccuucucuucgucuuauucuccccccacauccccauaacccacacacacaggguuucuuuuuguagcuuuggccuuccuggaacucccucuguagaccaggcuggccucgaacucagagauccaccugccucugccaagugcugggauuaaaggccugaacuauagcccaguucccuaaguauuuucugaaaacucaggacaccuagcugcugaagaauucccccaccccaggggucacacagcuccuaacucuucagccauuaccagugaaaaggauucacauaaaugaggugguaaugcugacagccagguaaacugaagucagauguacuccucagccaggccuaagugcuacaucagaguacccugccaccuaaauggguucuucagaagcccgcacuuaaauauuauucagcaaaggaaaaaaagucaaaagggacuagagacaccuuuuguucuuuuucuuuccaugauaucauuguacuauauccccagcccuuguguauuuugagacagggccucaguauauagccuaaacaagccuggaauuugcaacccuccagcuaagccucccaaguacuagaacgggccugugcccaugccugacuggacaucuaaauuuaaaacgcccuaaagucuuauuuucuuucucuuuuucuuuuuuucuaagauuuauuauguauacaacauucuggcugcauagccagaagagggcgccagaucucauuaugagccaccaugugguugcugggaauugaacucaggaccucuggaauaacagacugccaagugcucuuaaccucugagccaucucuccagcaagccuuaaauuucuuuucacauuuuuuuuuucaagacaggauuuuacuacaauuuucauccuggccucaaacuuuuagccucaggccaggaauccugucucugcuucccaagugcugggaguuacagacaaccaccaucagcuuagauccacuuaugguucgcccuccacccuaguuuauaucaugacuaauccugcugcccucugcuccagacaaaggaucuaaagacaaagugaacaguuucuguguucuucagucuaacuacauaacagagaagauggaggcuggguuugguggcacauaccuauaacuccuaugcaggaaaauaagacaagaggaucauaaauuaaggcuagccucggcuauauaauuaacacccucaacacacacacagaaaaaaguuggggacaauuuguuaacagagcaauuugguaaaaguggaguuauguacauugauggugaagaaaaaaauaaaagccaguaaaaugcagacuuucuacucucugauauuuauuuauuuauuuauuuauuuauuuaucuaucuaucuauuuauuuguuuauuuauugggggggguccucagauauuccagacuggccacaaguugccauguagcugaggauaaccuugaauuucugaucuuucugauucuaucuacugaguacggaggcuacaguguacaccaccuuacccaauuuauggggcgccagguaugcacucuuccaauugagcuacauuuccagcaccgagauaagcuuuccuccgcagcacgugaauuaaguuagacaaaaggauuuccugaagacacgaaggugacaaaggcuaggcaauguaaggacagaauaaaucuaacagucugcugagagagaaacacucugcccaacaccaaaagagggaaaccuggagggccuuugccaacacuggcaucucacagugcacacggacuuagccucccagggcaucuucaucagcuguauuccuucauuaguccagcguaaauggcugcaccagcccuggugaugccuguuccaucuuuacuggccccuccagcuccucuuuccuuuaguuuuucugucgacacacugccaaugccagucacaccaugccaguggaguaagaaacagcaaguagcaagaacacagaugagaaggagcccagccuugagguucccucacauagauggacagcugcacucacaaucugccuccccgggaggaccuggcuucucuggggucugcuuuucuuuauguagaggccuccuccuccucccuuccuuucagaccaugugauaguuccccaagaccuuucauauaauuuauaccuugccagggaccaacccuuucccaccacugugaaggagaggaaaaaaauauauaaauaaauacgucggaaaucuauaacgaggucuucuuagagggcaagacauggggagaguuagaagcagcgucaauuacucuuuugggguuuuaguucaagccaaggucugcuuccagcaaucaaccauuaaaacaagccggccagaguaacagcacaguuuauucugaucauuuaauuugaagugucaauaaauuaaacuucaaucaauuaaacuaggugugcaauaacccagauggacaccccgacaccaacauaaucacaauaaaaauuuuuauggcugccagggaccucaccggggguagugcuggcacagcucaagcccugccugagaaauauaucuccucggugcaggaaugaggagauugcuucuccuaacgaaauggaggggccaagcaccagcaaggacgcagcugggagaggggcacaggggacugccagggacgagaugggagugcuuugggggcuuaauguaauugauaccuuugcccaaagcagggggaaggggcacucaggccaaguaucuccacuguuagugccaaaggaauuuaacaaaagccccauuaagaugauucaggaagcaaaggccacugaaacaaugucaaccuuugagucgccaauguguccugcagcuuccuccucuagaugcauauacauccuggugcacuuuagauggccugauauuugaaugagaaguggaaaucaggauuuugucaguuuuaggaaaaaauauuaaagugagacaauguauggaauugaggucuaaucuguaaaacacuggaaacacacucagaaauuaaaacuugaaaacaggaagaaaaaaaaauaccucuguacaaaguuuuuaaggaucugaacugcuacaguaauucagcuuugagggugggggaaauaaaaaguaaaggcugaaggaaaguguaagguauuaagauuucagguuauucauggagaauggcaaccugcagauugcucuccacuaacaacugagaacgggagagccagcuaaaagagcagcagagggaacugagaccaaaaacaggaugggaacugagagacaaaggacuggaagaagauuugguaaauccaacuaugaacuaaggcugcacugcuuuucucaguauuuauuuuuaugacuguuugccugcaugugugugcaucacaugcuugccugaggcccaaggucagaagacggugcugcaggugguuaugaaccacuccauauggaugcugcaguuaaagccagcccagguccucugcaagaaagcaaaugcucuucuuauccccugagccaucucuccaucucccaaggcuggugcuuuaauucaagcaggauccacuguaaaguaccucaaggaaggaaucuauugucaccuagaaaugcccagaccaagguagauuuugacucauuucuuggcccucuagaucuucccuuuccucuucucaacauuguacaguugugugcuuuguggaggugaggccagaacauguuugaucccagagguucuaccaaaccagcaaacagaaaugcaagaggaggaaacuuggaggcggcuuaguagcauguccucucuaagagcagcuuuucaguacuauccagguacaguacgcucuucagcucagcauagauuuagcgauuucuuuaauuuuugcuugcugcuuucuuuuuuggcacagggucuuaccaugugcucaagcuagcuucgaacucaaaauccuccugccucucgaagaggacuuaaguucaguuccuaauacccucauaaacaaccaacugccuguaacuccaguuccagaggauccaauacccucuucugagcucuacaggcacccaccuacauauacauauaaaauaauaaaauaaauuuaaagacccuaccucaaaacaacacuggauaugguuuauggugguucacaccuauaaucucgucaucacuuuaggagguagacggacgcagagggucaagaguucaagaccagauuugaccacaugagacccuauucucaaaaauaguauuaaaaggcuaggugugggggcuggugagauggcucaguggguaagagcacccuacugcucuuccgaagguccaaaguucaaaucccagcaaccacaugguggcucacaaccaucuguaacgagaucugacucccucuucuggagugucugaagacagcuacaguguacuuacauauauuaauaaaauaaaucuuaaaaaaaaaaaaaaaaaaaaaaaaggcuagguguggggcuggugagauggcucagcggauaggagcacuugaccacucuuccgaagguccugaguucaaaucccagcaaccacaugguggguggcucacaaccacccauaaugagaucugaugcccucuucuggcacaucugaagacagcugcaguguacuuauguauaauaauaaauaaaucuuuaaaaaaaaaaaguacucaggaucuacuaaaaaaaaaaaaaaaaaaaaaaaaaaggcuagguguggugguacaugccuuuaauaucaggacuugugaggcagaagcaaguggauuucugugaguuagaggacagccaagacuauguaaagagggauggagagauggcucagcgguuaagagcacugacugcucuuccguagguccugaguuuaaaucccagcaaccacaugguggcucacaaccauccauaaugagaucugaugcccucuucugguguguccaaagacaguuacaguguacuuauauauaauaauaaauuaaucuuuagaccagggggaaaaaaaagacuauguaaagagaccuugucucaaaagauaaaugugauaaugaugaugguggugguggugguggugguggugguggugguggugguggugauggugguggugauggugggcacagaaacaaacaacauuaauccuaguacucaggagccagaggagaauccuuaugcauuuaaaccacccugaucuacacagcaagauccaagcaaggcaggacuacauaaugacacccaguuuccaaaaaaaaaaaaaaaaucauuaaauaaaguuggaaagaacauaggggaaaaaaaaagacaacaguuuaaucgucaagaacuuuaaaaaucagcacaaaaacuaauaccuguagguuugguuuguuuguuuauugagacagggucucucucuacauagcuuugacugucugggaacuugcuaaguagaccaggcucacuucagacucucagacauccaccugccugugccaaccaaacacugagauuaaaggugggagccacaauccauagcucccuguagguauuuuaccaucaacaaaaacuuuauacaacccauggcugaaaggaaaauucugcaaacugaagaggugcaagaaccuacagaaaccucagaaaccuggugacucugggauaagacaaauucaaacccagcccaagcuacauaaugagacugucucaaaaaaaaaaaaaaaaaaaaaauuuguucugagagaacaaggaaacaaaacuggaacgggguuuuggcacugcccuuccuuagaaagagccuuuuccuacagcucugcuucccuaaacccaguacauuaaggugcuagugacaaaggcucaguauaguuuuaaaaguaaaggugagggauaugcaggcaaguuagcaagggucuguuacuacaugcagcugguuagcucagcugcaagggggaacaaugaggaagaagcaggcugagagauaccacacagugcaagaaagagagaaaaugacacagagauuuccccauacaaccucagcucuccuagugcuggggucaaacacagggcuuuuaaagauagcuagaccauaugcucuuagcauuuacacccagcccaacagaaccaaugggaaaggaguuccccaaguaccauuuuccucacucuuuaagcugguuccacuaaauuacauuaauuuugguuuuaugagacgaggucuuauuuuguaacccaggcuggccucaaacuagcaacaauauagccucagccugagugcugggguuacaggugugagcaaccacaccugauuaagaagaccaaaaacauccaaggaaacuaguuucacagacucuauccacaucgucacaagauuuuuaaaaacucauugaccgguauaguaaauacuugaacuacucaauacauuaaacauuuugcuucaacuuguccaacacauaugaugagaauaaauucucuuugacauuugcaagaaggaaaguaaggagguuugaacagauaggucagugguuaaagugcuugucauacaaauaagaaaaccaaaguucaaauucccacauaaaugccaggugaguauagaugucugcccuggcuacguggcaaaguugauuccagucagaccuacaugaaacucucagugagaaaacuaaaacaaguugaugugguggcacauaccucuagucuccgaauuuggaggguagagguaggugguccucugugagucugaggccaacauggcuuacauaaugaguagcuagggcaucaggaaagggaaagguagagagggacccugucucaaaaaacuuuuuuuccuuuaaagaaagaaagaagaaaaagcuuuuuuucuuuuacugacaagaguuugauauguacacuuacaaggaauauaaaugaaaacaggagcuaaggaagacucuuagaaacaauccuggaguccaacuaaaggaaagaagcugggaguuaaauuccuacacuaacacacagacacagguaggcagacucaugggucucuaaacugcuggccagugucuugaaagaaaugcucugauccuguucuagggggcagaacaagcagaaaggaucaagggacaagagaguuaaaugcacuucuauaaucacaauucucauguaagcaagaaggcugaaauggaucuuacaguaugaguuccuaaagucugaaggaggggagaguaggagagaagaauaaggagucagaaaaagauauuccaaaaucuauacuagcucuaccaaguauuccugaaccuggauggaaugcugacucucaaucaugacagaauuacauacuaaggauuaacaggaaaauaaaaacaaguuuuguaaaggaacaggacauggaauugccaaaagguagucgaauucugaccaccaccaggaggaucugggacugacaaaacaccucucuucugccauugcaacuugggggacuagaauaugaggguuuggggaaacucaaguagguaugauccacaacaaaaaccaucggggagaacuugaaagacaccccuccagcgcaaucagaauucuccuaaggacccugcauguucucuucaacuuugccaccgacuccugcucucuugccggcaaggcuuccuacucuauaccgcggcucuagcucccauuguaggccacacuugcauugcacagauagcgggagcuuuggcccccgaggccugcccggaacccucucccggccccagcugaugagccccaccucccggacccccuggacaccacaacggagccacuggcccuccagcuccuaccaaaaucagcgccuccaucuugcccguagcugcugccgacguggagucgcacaagcgacgucaccgcugauuggcccugagucuucgcuaggucccgccucaaagaggcaacauugggugaagaugagccagccuucgcgucuugaccagucagcguagucacucgcuucacggaagccaacuguccagccagaagaggcagcuguuagauugucacc

SEQ ID NO: 8052 - RNA, 22508 nt, Mus musculus
cuuuggucagugggggcagugggugggguuuauugcacuugcaacagaguuuaaauaaguugggguggguucuggaggagaggggaggguuggcuagggagagaggggcagcgucagugcagcuggugggcagaacccaggucauacaggccuggggcuucccguucucucuggggaaugaguggccaggcugagguuccaggucuguuugccaauguggccugguuaggguccugggcaauuccugacuuguccuaagucagggauaaauagguuucuaagcccaggucugcagcugacccaaaugccaccuugggucugcuagcauagguucuuagaauccgagacugggcuccagaucaacccuaggccccagacugggucuggcuccauucucuuucugacuuccauggaucugggucugggccagcaucgaccuuuguuugggauuuguccugagcugguccugcagcaccauccacgguuaguguucuucauuggccuuccaggaugggggcuguuggaguugccaggucucacuccccaagucucaggcucuuagcugcagacuuccuuugguucucuggcaagaccaaagaugcaucuuugcaggccggagucagaugggaaguccuguuggcaugcccggcccagagaaccacaacuggauucccuaauuaugguuccaaguugauuucagaaaagucuccaaaaugcaaaggcugaaggaaagcuggagcuucugucccuggaccugaggcccccauccacgagagggcauguguaaacgaggguccuucacagugcauggggggaaggauccacaagcuucuugccccccagcucuggcccuucaaguaugucucugggcuaggaagaagagcuucuccccagcccucagcaccuucaggaagugccuagucccucccugucggaagguauuggacuggcucuucgggaucaugagucugagaucaggagggcucaggcaucugagguggcuggaggcuugagcugagcuuuuuccauggcugugccguaggggagggaacguuugaagaagccgagcugaugagaaaggaggcacaauuagagaucacauucucccugaccacagauccagggggaugaggacucuccugccucuauccuccccacccugccaaaguggcuucauucagauacuuucccaagggcuccaauagaugugggagaucuaaaauuagggaguuauuaugggacagucauuuaucaagguuuuaaaaugauacugaaaaagauacuaguuaagccaggaaggguaaacaaacucaacucaacaagugccacaucugagccuagcccuggcugccacuuguaggauaccaucacuuauucuuagauagauguuagaagagacgacagcacaaaugccaucauguauuugccaucugugguuuugcaauaugggcaaacuuauccagagacaggaggccucuuuguaaacuggaggcugcagacugaagggagggguccaauaggaaaaaagacaaauggggcgugaguagcuagggcauacaugggggucugugcuggaaaacagaucugaggguggccucuuugauucuacuggguaaaaggcagagucugacaggcuggaagcuaagccaaggcuuggcguggcugaccuuguagaggacguagaugagcagaccuaggagcaggaggccaaaaagaauggcuaggaugaugauccacaacgggacaccauugcugccuucugccuugguccacugcacggcuguggccaccuguggacaagccaaugacauuaagaaccugugaauucuucccggccuguuccuggcuaccucugucuguuggaucuggacccaacucucauuuuuuagcuaacagcauucugaacuuaagagucugaagugcacaaguguuucuguguucacaugugcuguuuucuccacccagaaucuucugcucuggagcagucuaguuaauuccuucaggccucaacuuguacaccacuucuuacaggaagucuuuccugacucuguaagauuggguucagauauuccuaugacauguuuccauagacugucuugccacauaucacacugaugucacugcccucuaggcggugaacacuagagcagagacacguguuaaucuggccgaucuggaccuacaaagccaggaaauauuugcacaaagcaagaccagccucuauccauguccccauccugcuucugacauucuugagcuugucuucugcgauccagacuucuaaccuugaacucaccugaaguuucuuuuggggaagcugccgaggcaggaucugguagggcaucuucagagcuucauauacagccucacacugaaggcuaaauggcugguauucccgcuguggguggagaaagguggucagggcaaccccuaugggauucagaggacacagggcuuccccacagucugucucaggaugugaucuuucccuauuauggacucauuaaucucgauguuccuuaugcgaaauaauaaauguaaaauuguguaauuaaaacuaaauaaugcauaaucagauaacuacacguucaauauacauuucuuaaugauuaauauagguuaacauccaggaccaugguuggucuauaauauguauucaauaaaugauggcuuuuuucucuuacauauagguugcugguauaccagcuaggcauucauuuauguggagguugaggauuugaagucuggucuucauguuugcaucuccccagcccuauccacucuggucuuuacacuuauggauuggguauacuaguuaugcacucuaccacugaccacugaccuacauccccacuuguuuuucuuuuuguguguguaguuauuuguuuauuguuuuuguuuuuguguuguugcuugagauauggucucacucuguaguccugguuggccuggaauucacuuaugaagaccagauuggccccagacucacagagauucaccagccucugcuuucugagugcucagguuaaaggugagccagugccagcaugcucaccacguucuguuuuucuaucagggccagaaagggaaguaguugcuaguugcuucaacaguggccaagagguggcgccaaggacacacaacuggucuaaaucagggugagggagggaggagacuuggagagggagagagagagagagagagagagagagagagagagagagagagagagagagagagagagagagagaguguguguguguguguguguguguguuuguccaguuaccaaagcagagguggaagggaugacagcauggggaaaugacagggucaguccugcuaggaccaaagguugggguccaggauggaugaagcucccuuaccugcaagaaggucuuggcccagacucggaaaugcagcugcagacuacggcucucuuggcggugcaguggcccaaacucacagcgcagccugaaacacuuggcuucagggcauuucuagcaagauagaaggagucugagcccagaauucucaccugaugacccugagaacccaaacagguguccaacacuugggacaaacaucuuucccugcagcaacuuaccagaacuuguguuccugaggcaguagaacuccucccuggagccucucguuucugcaggugguguggagaggucucuggauccaacuggaagaagaggcaucuuuaguugcaccuucugcuucauuauagcuccuaagucagccugaaccuauguuccagagccagggacccgauucugucucugucccuguguucagcuaacccaccuauugccaagagcaaaguguaccuugcucugcaccguguagauuuguaaagaaaucauuaagucuuucccgccuaagggccuuuguacuggcuguucccucuauugggaauguuuaucccuugucuuacaaggaggcuucagcuuugucuuucagguuucaguugaauuauuacuuguuuauuuagcagugcugggauugaaccuagagccuuggguaugguaggcaaguguucuaccuggcuaauggcuaccucuucaagagcugucacaagucagauuuguacccauagcacaucccacagguccacuugccugucuuccuucuuuccuucaagaauucucacuaugaggcuuugguugucccagaacucacuuuauagaucaaacuggcuuuuaauuugugguuguccuccuguuccagccacuucuaagggauggugauuaaguuuacagguguaaccaucaugccuggguagcuuuauuuuuuuauuuuuaauuuuuuuuuaauuuauuuuuuaugguagauaaguacacuguugcugucuucagacacaccagaagagggcgucagaugucauuaugaguggaugugagccaccaugugguugcugggaauuaaacucaggaccucuggaagagcagucagugcucuuaccugcugagccaucucaccagcccaucuucuuugucacuuuauacuuuauugcuuuccacccgucuuuguugucacucagggucucucucauguaaguacuugagaauaaucuugaacuuccaguccucuugccucacuucacaaguguuggggcugccuuaccaggcuucagcacuuuucuuucuuucuuuuuauuuuuuaagacaggguuuuacuguguaaguccuggcugucuuggaacucacuccguuguagcccaggcuagcuucaaacucagagauccuccccacucugccucugagggcugggauuaaagguaggugccaccacaacccgguuucuuuuuacuuuuuuuuuuuuuuuccgagacaggguuucucuguguagcccuggcuguccucgaacucagaaaucugccugccucugcccugacucccaaaugcugggauuaaaggcgugugccaccaugcccaacucuuuuuacuucuuauugucuaccagcuuucacuagaugcaagcucccagaauguggggacuuugugaauuucauuuggugugggguuuuuccuaggucuaacgcuuacuucauuaaaugcuguuuaugaacaaacacacucucaaagagggccagaggacaguucucacaggacaagguggcacagaucugauagcacaccaugagagagacuacuucagagcaaaggacacaaauguaguagaugugaaucuuuuuccuccuuucagaucuugaggugccugaaucuccccaccacuuccaauagccuccaggcaacuuuucccagcuccauagucccauagccccaccgcuccaccccacaccaugaccagguccucaccuccaggcccugugaguuggggguguaguuggaggugcaguugcugaguccugucaccuuggucacauagaggagcuguuggccuuccagagccuguggacagcugagcuccagcacacccuggcugauggagcugggccccugguugaugagcugagagaaagagcacacuuugaggaagggaaagcugauuugacaugcaggccuuggucaccacccauacauagugcaucagucugagaaaugaaagaacacccaagagcagcaaucaaguccacuucagccauuacuccaagagugagacaaggucucacucuguaauccaugcuaguuugagacucauaguaauccuccugaaauagcuuuccuuuguaaggcaauggaccaacaggccccucuucuggacaucucucacagauccucaguauucuccaggccgcccccucuucucuucaccucacccagguccuagguacugucauuuauaccggcuccuacuuucuuucccuucauauggcucgaucccugaggcuugucuuccaacccuucucaccucguagacaugguggacagcugggcccaagucuuccuccuucugaggcuggucuugaggauuccagucgcugacugggaaaaucacagcuucaggcuuggagacacugaagaggaggauaguuuagaguggacaaaaggaaccaauauguccuucucuaaaguccaucacccuccccucuaaaggucccuuucugccugggcacugacccauuaagggagaccugggcuugagccuccaccgagagugggaaggagaccacguugcuuugugaguuguucagguucuugcugugggauggaggcaagaggcaagcaguuugacaagaaucuccagguucugccauccaucccaccuucccuucuuucaccuucaacucagccccaguccagguccagucacucccuaccugaggaucugaaagucaaacuggaugguuuucuuugugucuugaagaugaggaacagugaaccgaaggccaccccagagcugcauaacaaacaaggaggagaaaggggcuguuagauaggaugucuaccugugugcuaggaccugucacaugcucuauccuagcccuuccucuucuaccccucacuuacacuggugccugccuucaugggguugcccaggucacacaccagcuggcggcucugguucacagcaaaguagucacagcucaggcuggagaaguucuggggauaggcaggcacaggccagucaggcuuuggcaccccucuggaggggaucaccacugcagucccacuugagagucccuucucaccccugggugucugacaaguccugaguacucggccucuagaggggcugugacccgaagcucggcuucauaggcaccgcccucacccagauuuugggcauggaaugucagguucagugcguucuugucacccagguacacauguuucuucucccuggaggggcacacaggguaaggacaugaaagaaugaauccauaaaccagggcaauagggccugggaauaacacaguggggcuggcccugcugacuggaccccggcucuggcaggcauaaggcgagacgcugcaugcugaguaccguguuuaauaugucuagagcuagagaaacgaaugcucccuguagacaaacccaaauccagagaugcucacggaucucacaaggccacauauagcuagagugucccugucucucugccaugugacagugccacucacccauacacauccagcugcaggucaggcacacagauauugucuucaccacaguccagcaagaucugggccuggggaguggagcagccuugagaaggguucuaccaccccucucccagggcccugccucaggggccaggccugucuucccaaguucuuuccuuaccuuguccucuauccugcuuuugcuuugguaguguagaacuggccggaggccauggcuguccaugggagcuuugggguccaaggagaaguugagggcaaugugaauuggggagaguuugucucugaauucugauucauucuagggccaguggaaagaauucaugggauuagggauucgggggugggguggggcgggguggguggcgcuuagugaccaugcuucuuagccuugcuucucccuuuaucugcucagagcccaaaucugaccucauuucucuguaggccuagacuccuggugucuggcucuucugacagaaagccuuuuucuuuacccucuccccacagucauccagccacaugcaagcacacacgcgugcacgcacaccaucacuauugccaccgucaccgccaccacaguccuuuguuuuagguggcuaucuacccaggccaggccacccucauccucaggccauacccugagguagaucuucaucucccugcaguccucccgagccccauucuggauaagcagggucuggguaaggguggccugcuuggaagucaggaacagugcccgccggaccccucccuuuugcuucugccaguccaguuggaguuccaccucgaagccuaugaccaggaaacacagugucugucuguuuuucuuaccuuccacugccccaccccucagcuggcacacucgagcagcuucucucaccuauagaguuggggacauguuuuccagaggcauugaggcagaagcuaagguugaugcuggagaaagacggaggagagagugcucagguuaacuagaacuggccuccugccugccugacucagaaagacccagacuaggacaccccuguuugucccuuccugaggcagacauggccccccugcccacuggcaggcacaaaucucugcaggcucugggcacagcucaccaggacacaggguucccuuccaggcugcaacugcgcuccucuggguugaacauggaggggaagauggugagagaugcgcuggcagauaugaugggccgcccucugccaagaguggaugugggguacauagaauuaaggccgggcaccugcuccaggaccccaguucccucugcaccgaugguccuagucuuagcaccccccucccuuucacaccugccgaaguuuuuuuuuuuuuuuuuuuuuuuuuuuuuuuuaauuuguuucucauuaaggaugguugugagccacaaugugguugcuggguuuugaacucaugaccucuggaagagcagucagugcucuuaaccgcugagacaucucaccagccccccagucuuaguuuuaaaagaaaaacuaguuguucagacugccucagucuuccugaguucauaccuguacaccagagccuuguccacaccaaaggauccaacgauuagaucuguagaaagucaagauccacccuuuauggcaagccccaaaucaggauugccuucaucugaggcuuucuaguuucauggcucagaggccugagccaggggacugcaccaucugguggcagcugccuagaauugcaucacaaagcuugcauucuaagaugaagggcaguggccacaacuuaccaggguauccauugccauccagaucucguccuccucgaagggcagagccaaagaagucugggguacggccagcugcccaaagaggcugcaaaaccugggaagguuuagugcucaguccuccugggccucccgggaauauaaauacgacucccugcugggccuccccaccaaauggagccccaauggcgacaucugcaagacacaacacacauuauuuacuagguuaggaggccagggguccaaauuucuaucaaaaaacccucaggauccuauuuuuccacaucaguuccuguucuaauaucuuuaaaccccaauaccccuggaaagucaagagggcccgguacuuuaguugacagaagcccucccacuaaguuccugaccaacuagcauccccccuacuuagccucagcacccugggccacgauacuuaccauuguagccgucuugguccaggucccccaagggugucaaggagcugccgaaucggcugaacucaucuugcccagugagggugagggugggugugggaucuaugcccgcugggcgcugcagauagauguagacccugcccaccuccugaggucucccaucagcuguccgcuccaugagcaggggugccccuaccaguaggucaucuagccugaggagaagggaagacccaagcauucugacaacccugucuugcuauaauuuauugcccuuguggaggaacuccaggcauucuggauccccaggcgcccugagggcucugauguagcauccagcccucuucuugcccugaccaaggagaaggcaaguaugaauuagagucuagaaaaaaaaauauccugagggagcagucugccugcacugucccaucccccaucgaucaggucuggaagaugcaucccuucccaucacucacccaucuccauugguaucaguggcagccacagcauagccgaaguaggaggccaucuguggggacaaaggguagcauggagucagaacaaggcuggucaguaaacaggaucaagagaggcuguaaguggacauucaugggcuccagagacgguaggaaguuugacacuguugguccagggcugcagauuagauggcaagauggagaacugaggguauccucaccuguucuccugagacguuguagagggaguggaugucugagccauuaaggacggugaccugaagaugaagauaaaggccuauagguccuggaugccccaugucugaaggucugggacacaugggacaggccuuccucaggggaaucuuagcacuccucugucuccuuccaaauuuguccucucuccaccuccagguuuucucucucacuuuacuguucugccuucuuccuuuauacccuugauggauuuucauccccagccacuagauucuagugaccagaaucagaucagugggacccagagcaugaucuuuggucuuugccucccagagcuuagcaggcagcaggcaaacagcaauacuggauacacacugggucuucaaacccaauggauucagaacucuagccaucccucacacaccagggucugcaagguacucacaucucugcugucuccucuuagcuacugacccagcagaccuccacgucucuuggaucuugcucucugcccaccccccacuguucugcugagaccugguaugaaccuucccaggacaggcuggacuauagcuuggguuuuccccacuggcacugaugccagaaagcagauggaggacugugauucccaccuguacaccccaggggcccccgcagccacugucagucccugccucuuggccagcccucuaagguucuggugucuggcccuacugccuguguuuguucaacccucccuuacaauucucacccuccuuuaccuuaugaggcugcaaacuaggcccagccccauauucucuguguucuucaugccugugccugggacucccucuugccccaucuguguggaacccucacagaaccuucucugaggcacccucucuggaaggagauuacuaauuucuuaaaaugugcuguuaucuugggugcuuuucuguaacuuccaauucagaaagaguacgagauuuagaguaugauagauauuaaauauuuauccagcugccccuaagcaacauaauugguauuuuaggacaacaguuuucuuguguguaaacugucaagauuguucuccauuccacagucccaugguggggaagggaacaccaccaugcauggacaguaccugggacaucgagaggcuaacaaacaauggcuuccucaggauuaaagcuguguguuuuagcucacauauuugacuagaagcaccuuaagagaugggauaagaugucuucaucucaucucucaccuugccucaauaaauguuguuaauugagcgaccgaguguggcacuugucauggucuaauaauagcugguggcugcacacggucuaacaauuuacaagugcuuucauuccccucacaagugccuugugaggucagaacuauuauuaccccauuguacauggaagaaacagcuuagagcggucaagcaggggacaguguagcaauaaaagaacagauucauuuauccagagucagugccagaauuugaacuugagucugacuucacacacuuccuucccuugaaccagacuucagaaaucugauguguucucccagagccuaugcucugaucucuuuccuugauauacccaacaaacuaccacacaaggcucugcacuuagccugggugagaggcagcggguggcgggcagggucuuacauagccauaggugagguuccccuugggcacgccagcaacaaagucugcaaagagaagagaaacugauggguggaggugaggacaggguggacucagaauguuguuucuggcuuucuuuucaguccccacuuuggcuugaagauugacuuaccuucugugucaucaccacugaauucacccacagccacagaguauccuggggacagaguguguggauguuagcauugccuccuuggggaccccuacucucuggcccucaaucccuucauugucagccuguacacaaguauggcagcagagcugguggcacugagugggagaagcagggaacugagugaggcuagaggccccugauuuccccucccauuuccuccccaccugcuugccuacccaaguagcugucaucauagacggagcuggccuggcgggucugcagcugccccugaacaggguugaugagauacucuggguaauaggacuccgagaucugcucuugaguggcggacaggaucuggccuggaaggggagcagggugaugggcagggggaggucacagaggcuuuggggagacugaguaggauuuuagaaguauggaucaaagcugggcagugguggcagaugcauuuaaucccagcaguugagaggcagaggcaagaggaucucugaguucaaggccagccuggucuacaaaaugaauucuucacagagaaacccuaucuuaaacaaacaaaacaaaacaacacaacaaacaaacaaaaaugagaaaggaaaaagaaaaaaagaaaaaagaaaagguuuggaucaaagaagggauguggcaccaaagcuggaagagggcagaggaagggcuuaccuugccagaaguagcuuccagguccacccaggaccacacggccagucuguggggaggugcagggaagauggaugagcauauauaucaucugguacugacccuagauccucacuuccugccuucccuccccagccaccucaccuuggugaacucagcacugaagcccccuuggcaguagcccugcccugcugcacugccaaaaucugugagagaagacaaugagaugagcuagcugcacacugaugggcugacagggaagagaggcaggagcaagaaagaagacugcucaagggucaccugagcagccuugaaaaaauauauaucaaugccuggaggccuugaagagaaagccccagguaccaaggacccucccacggagaaggcacaaugguccacuacacucuggcaccuaccugagcggcaaggugcguacuccagaauccgggugaaguuuucuguggagagguagcaggugcccacugggucauucuguggguccuuuucugugcgccagcuauacaguggagcacaugccugagggggcccggggcaggggguguucagauuuagcuuaguaagaugaccaccuuccaccccagaccaggccuggcccucuccaccacagcuuaacccuuagcuaccacaccacugagcucacucaugccucaccaagauggaggagccaugggcccgaacuguugcuccgaaccacugcaaggacuuguacuccacaggcuccucucccuuggcacuguacagugaggacuccagaauccgggagccuuggggaaguagaaaguguacucucacacuuguucucaggaaggugacccuagccuuggucuaggaugcucagcauuuguagacccugagacccacugggacaggggaauggaaggaguuuuagacuccuuuauguagcuggacuugacugguucuugcucuccuuacacacacauccacauacauauaucaacagagacacccauacccacucauacacacacccacauccacagaaacauacacacccacucauacacacacacccacauccacagaaacauacacacccacucauacacacacacacacauccacagaaacacacauacacacucguacacucauacauccacagaaaaacauauauccaccuccccacccccaccacagcuucccaaguugucuuguuggcuccucugacuuccucguagcuggaacaggacauuuucauugugguguugggggaacauuggccaagucccauggcucaucucugucuguuagccagcccugugacucuaacggccucuccuuucgccuccacacuagacuucccuuucugucucuuuccaagucuaaacucugcccucuguagcacugcuuuccugcucuucuuacucuccaccucucaggcuuuuuauuuguuuguuuguuuguuuuaagacaagugucucauuauguagcccaggcuggcuuugagcuucuggcacucuuuuucugccucagccuccugugcccucaggcuuuuuaaagucagccuuaggaacuggggcuguaacucaugcacucauacauccacagcacauguuuaccacgaaucaaacuuuggguucaaugccuaguaccccuucagaaauuagcaggcuuccacauucuuaugcuuacuucuuguccucuuaucucugaggacagacugccugaguucacagccuugcuuucuuacuaguugggugacuuaaccuugcuuccuuccucacaggauggggauacuaauacuucauacaguugcugcaggauuaagugugccaaggcacaauagugccuagcauggaguaaaagcucucugagugcuagcugaacagccucagcuuccuuagguccaucugccugaaggcugagcccccccugggggcaguggcugaaucacacugugcccagugugcacuaucacuuaguuuaggaacagaacucugcagccuccucugccuuugucugcauuauggcccuggccucccagagcugugggugauucagugaaaugagagccacauguuucugaaucaugcccgcccuucuugggcugggcugggaacauggagugagugccacgggaagcccacagcuaggagcuggauggagcaccagaacuacugcagggggaaggggagggggaggagcacccuucacccaggccccacccccaaacugcaggcccgcccacccacccucuuaugccaggcccuucccugaacucuuccagccuaccuuugcugucaaauugaaugguggugcacuggauaggacuggugccccagggacacacauagacagcaccaccuugcaguacaccuggcuggcuaguguuagccuugggugccccaaccagcacacugacucuguggaggggaaaggagaaguagauuaggacggguccuauuuccaggucagugucuggaggcaagaugcacccagaccuuugggccaagagugggggugggguagaugucccuuggguuguauuuauaucucagaagaugccacagaugccagaggcaggggcuggagucaggcauuccccaugugcugcugucacuaacucagcuccuccccuccucccacauucucuuaccuucuuccccuacuacuagagaggagaagccagagucaguuccuggaaagggaaaagaagacuagggucuggacucuggcuuuuuugucucuuccaucuacuugccaagguuagauguccagcccaacuagggcuguagcccaggaguagaggauguucucggcauacgcaaggcccucagcaccaggcuaagaaacaaugccaaaugcaauguaugaccuuugguugaaaguggauuaauguguguguguguggugugugugcgcgugcgugcaugugugugugguuuuucgagauacaguuucucuguguagcucuggcuauccuggaacucuauccuuagaccuggcugcucuugaagucacagagaucucccugccugccuuccaaguaccaggauuaaagguguaugccaucacugccuagcuaaaauauauauauuaaagggacaauuuagcuccagaaccccaggcuccuguagagccucauggcccucaccuuucuuuccaagccaaauuuucucccuuggauggaacucaggcaaccggccacuuaagucuuggggcauguuggaggaaaaaaugagucucugaaauuaggacuaugaaagcaggccacuuccugggccugguuugccccacccuguggccuauaggggaccucaccuuccuagcugggccucugacacacuuguaccucuuucccacaaauuagccccagaaaauuuaacucaaauccuguucuuuugaauccucuuccuggacacacaugucugagauggggucuuucgagggauggcuccuagcauccuucuucuaccaauucugguccuuugcuucuggggucuccacacagcucuccucuacuagccccgaucucuuguuuccagcuccuacauacagccacagccuucuucucugcuggcacucuccucaggaucuccugcaaugacugcaucuggcagucugggcagcuuuccuuggcaccccagcucugggccaguguuccugccagccuuggccucuacucuccuccccuacugccacuggcauugcuccucagccuccgccuguacccagcacugcuugcucuccugauuuauauucccagguccccuccugucuuuuuucuuuucaaauuauuuauucauuuaauguguauggauauuuugccuguauguauguuuacgugccauguggguacuuuguuccagaggagaccagcagaaggcacuggauccccugggaauggaguuagagguagucaugagcugucauguaggugcuaggaauugaacccuggucuucugaagagcagcagccaauguucuuaaccgcuucuuuuuuuccuuuuuuuuuuuuuuuuuuuuuuuuugaaauaggguuucacuguguagcccugguuguccuggaacucacucuguagaccaaucuggcccuggacucagagaucugccugccucugccucccugagugcuaggauuaaaggcuugcuccaucuuugacuggcuucuuccuucuuucuuauucucagaucguaggccuuuucaccugucuuagucaggguuucuauuccugcacaaacaucaugaccaagaagcaguuggggaggaaaggguuuauucagcuuacacuuccauacuacuguuuaucaccaaggaagucaggacuggaacucaagcaggucagaaagcaggagcugaugcagaggccauggagggauguucuuuacuggcuugcuuccccuggcuugcucagccugcucucuuauagaacccaagacugccagcgagcuguuccucagucuuuaucuguaggaacgagagcucaaaaggggacuugaggaaaagacagaugucuucugagagucauacugaggggcaagggggucuaagagcaucaaggaaggaagcccccaggacaccaguggaguauggguggagugugagaggacaggugagaauagagaaggcaggggguccagaggaguaggauggagacaaacaggaggugccuuaaguuauagagaggggaggugccagcuuugguuaccagggggacaggaaauguuuacugccuguggcuuccggucaguuuucaaccucucacuucuccauuugucucccaccucuuaggcauuaaagccaauuagagguuugagacaccacuccauuggccuagugacuuucaggugagaauucugagaaaaauaggaagcuguagccccagggcaggggugaggggagagacaguggugugguccuuguguagcucaagcugcugggcuacacagagaacuuggccacucugucuuuagcuccacaagagugagggcagagcacaggaaccagacugcuacacagggagcugagacucugguucuugcccugucucaguguaaacuuggguuuccucucuuccucuggguucuaucaggauccccaaauuucucccauaccaucugcauucauggagaaacugagaaagaagcaucugucaguccuuucaaagcugcugaaggcugaaagcccauaggccaggggcauaucuguucacugugugaagguucggggaucccagaaugcaaacagggcacaaggauccagaccaggcccccugacccaugacuuccaccuaaggcuuuagugguguguccauuuuaguaguccucauucuggcacccauacaugcuaggugaggugccugugccaagauugccauguacccugauucuccuccuaccugcugcuuccuaaaucccacagcaguagaaucuucacaguaauucaagaggguaccaagggagggucccuugggcuauuuucuuuuuuuuuuuuuuuuuuuuuuuuaaagauuuauuuauuuauuauauguaaauacacuguagcugucuucagacacaccagaagagggagucagaucuuguuacggaugguugugagccaccaugugguugcugggauuugaacucuggaccuucggaagaacagucaggugcucuuacccacugagccaucucaccagccccagcccuugggcuauuuucaauauugcagaaagccucacggaaacccugcguuuaccugauaaggcaucccaggcuaauuaaaacuccaagugcauuugcuuucggcuggcauuacaccaacuuguauggggaaccugguuaucucaggcuggucagaagcucugauuggcagcuauagauacuuuugguucauaaaagaugaaaagaccauuaauuaucauccacugaacgcagcuuggcaguuauacucuauuagaguccaugggaagaauacuuggcaucguuucucucgaagccucaggguuuggagguucuaguuagucuuuugagagggaacauccacuggcuuuaggacuaauguagaugcccuuugaguggugcaugcaguaaaggaagggccaccucaguucugacauccuucaacaaguucccaaacugcugcccuagucuuaugaccuuauuugacagaugggaaaacuaaauccaagagaagucacaccgauccagaguugcucagaaucuuucccaggaugggaaccgaagccuggagaccuguaaugcuguuuccuaggcuaguauucuguucugccccauugccaaaacaucuccuccucucuucacuaucuuccuagccaggcuuuugauuaaccaagccguuguucaauauucaguuacuguuugacucccuuggcuugacaaggucaggguagagagcauuaggugggucagggcccaacucccacaauccuaccucacuucuggccagaccagagguggacaucuacuucuggaaccccauguacaucccaacgggagacaucugauuggcugaguaagagcugccucuagcagacugguccauuuaaaagucacuuucccuccucuagccuuucuuucucagugaugaguugcuuuugagugauuccuaagcuaauuucuacuucuaaauuucuuugacuucuaaagcaauaauacuuucucuguucaacacagauuuuuaaaaaauaauccagggcuggcgagauggcucagcggguaagagcauugacugcucuuccaaagguccugaguucaaaucccagcaaccacaugguggcucacaaccaccuguaaugagaucugacacccucuucuggugcgucugaagucagauacaguguacuuauguauaauaauacauuaaucuuugggguggugcaagcagggacugagggagcggaguugaucagagccagcagguccaacuggagugagcagagguccuaaaaauucaauucccaacagccacaugaaggcucagaaccaucuguacagcuacagugaacucacauaaauaaauacauaaauaaauaacucuuuaaaaauaauucaaugagaaaugaauaugaaagcuuauaagauaaugugaggaaacuguuauaacuaucacaguuauuagcaaguacuacaagcauuguaaggacugaggauguagcccagcaaguggacugcuugccaauccugcacagaggcccuggguucaaucuccauaaacugggugugguggagggugugacagagccugcccaccauccuagcacucuagaaagguagggucagaaguucaaggucauccuuggcuacaguuucagaccagccugggaaugaaugaaugaaugauugcaaguaagaaagaaaggaaaacuuagaauaggagggugucagggaagaacaucagaaucaggaauuccuccacagaacucgugccuuguguauguugcucauccucugugggcaggcaccuuuuagcuauugucuccuucaguccuaagaaucaguuagguauccugugcaaggggaggcugaacugcaaggauuuaaguaacuugcucaagcccgggcucuuuagugaaugguaagcacucacacccagagcugccuggcuucaagcuucuucaccccuuuaugucuguguaaccucagcagagcucaccccguucucuucauuauucaauaugagaaguaaugcaggaggaacaaggaacaccaagaccacagccacaaaggggcugagagggguggaggggagucuaaaacacacaggugcugggagggaagucacaaggaaggagaaugccccagagcuuaugcccagagcaaaggugagggcggaguagaaugugagcuggacaccuggguucucuugaggaauggaggcuggggcuuguuuuagaagaaaccucagggacuggaggaucaggccaggggcuacugggagugcaaaguccaacagauauuuuaaaagagaacugacaguuuuguguggggaagagugacacccugaugggggaaaagacccuauacccccuccauccucucugcuccauuaggguugugguaagaaauuugggggacccuggcagaggcuccgggacagggugaugaaaugagguuugggcaagaggccagggugcgggguggggguuggguggggaccuugaaaagcucaaauucaacggcuguggccuaguuaucuuucuguuuuuccaucccuaagucccucagauaaaguuaaaaaaacugucccuuccccaaccaaauuagcuagaguuaaucccacccccagcccccuaauuaaauaacagcuaaaaucagaugacuucugacaaagguccaaucaagcccuaagaucccagggucgguguaggugcugccaugggcagagagaggcucagagcuaguagguggagaaacaccuacugcugucaucaaagggguucaggaauauggcaucuggggucccuuagcccagcaguugggaccgucacuuuucucuuacuuccagaccuccucuccuuauuuaaacaaacacguuuguuucaauguggccucuaauuuucccaagccucugggcaccagucuaggucugcuuacuacccggaaauaaggauucuccauagagauuuucaggaaccuucguucugaugcucuugggcccagagagccuauaucuuucucagcuuccgacccuagucccagaagucugaguucuacuacagccgacaagcuacaggaaaucagcuuuucucuuccucccaagagcuagagcaagagggaaaccgcccaccccccuucaggcgcgcgcacucacaccccucccgacacauccgugcaccgcccuggauugauccggccacuagcccuaguacccccagugccaggguucugggauucuccccaaguucuuggaucucuucgccugaagagacugggggugggaggcaauucaggagaaugaggagaaaggggagggagccuucgucuuccucccgggucuuucccgagucugaguugaugggggaggggaggaugagacuggcccccacauaaccuuccgacccucucagucugucuuuccucuuacggcacacgcuuacccagcuccaacccucucaauagccccaccgaggaucucgagguucuuccacugccuccuaaggcccugcccggccuccgcaccccccucgacucccacccgccacaggucucccgcagcccacagaucgccagagacccuaagcuuucugcgcccucuccucccgguuggcccuuagacccugccuguacuucuccagcuucuagauucggguccucuccucaugccacacaaguuucgacaccgaucucacacuccacgucggccacggucccucccugcugcagcgcgggcccccaauucuagcuugggcccccaacucaagucuuggucuuuccaaacuccgcccuccaacucaaguccuggucgcuuccaguccucggcgcgcccccaguuuccagguggcccccugcccgcuucccgccgccaaccucgccacucacccgucccuucccggccgguaaaacuccacggagaagccaaaaagggagccggggggcccggagagcaccgccggggccuccgcgucuagguugaagcccccaaccuggagugguggcggccacaguagcagcagcagaggcagcagcggcgguaggcgucggggcccccagcgcagcagcaccgcguggagaggagaucgaggcgaccguggcguccagcuccccauagugcccgcucuucccuguccuggggccaccgacccggagccgcuuccuaaaccucccagaggcgaaugacucaacgcggggaggaguuugccaaacucccggcugggcccuccccccggccgccgggccggcuggcgggggggcauuccugggucccggggacgccgaggccgcgccccgcacccgaaggggcguggggggccgcaccucugaacccuggcuccggccccagcuggaggccgguggucuggccuggcucagacug

SEQ ID NO: 8053 - RNA, 22508 nt, Mus musculus
cagucugagccaggccagaccaccggccuccagcuggggccggagccaggguucagaggugcggccccccacgccccuucgggugcggggcgcggccucggcguccccgggacccaggaaugcccccccgccagccggcccggcggccggggggagggcccagccgggaguuuggcaaacuccuccccgcguugagucauucgccucugggagguuuaggaagcggcuccgggucgguggccccaggacagggaagagcgggcacuauggggagcuggacgccacggucgccucgaucuccucuccacgcggugcugcugcgcugggggccccgacgccuaccgccgcugcugccucugcugcugcuacuguggccgccaccacuccagguugggggcuucaaccuagacgcggaggccccggcggugcucuccgggccccccggcucccuuuuuggcuucuccguggaguuuuaccggccgggaagggacgggugaguggcgagguuggcggcgggaagcgggcagggggccaccuggaaacugggggcgcgccgaggacuggaagcgaccaggacuugaguuggagggcggaguuuggaaagaccaagacuugaguugggggcccaagcuagaauugggggcccgcgcugcagcagggagggaccguggccgacguggagugugagaucggugucgaaacuuguguggcaugaggagaggacccgaaucuagaagcuggagaaguacaggcagggucuaagggccaaccgggaggagagggcgcagaaagcuuagggucucuggcgaucugugggcugcgggagaccuguggcgggugggagucgaggggggugcggaggccgggcagggccuuaggaggcaguggaagaaccucgagauccucgguggggcuauugagaggguuggagcuggguaagcgugugccguaagaggaaagacagacugagagggucggaagguuaugugggggccagucucauccuccccucccccaucaacucagacucgggaaagacccgggaggaagacgaaggcucccuccccuuucuccucauucuccugaauugccucccacccccagucucuucaggcgaagagauccaagaacuuggggagaaucccagaacccuggcacuggggguacuagggcuaguggccggaucaauccagggcggugcacggaugugucgggaggggugugagugcgcgcgccugaaggggggugggcgguuucccucuugcucuagcucuugggaggaagagaaaagcugauuuccuguagcuugucggcuguaguagaacucagacuucugggacuagggucggaagcugagaaagauauaggcucucugggcccaagagcaucagaacgaagguuccugaaaaucucuauggagaauccuuauuuccggguaguaagcagaccuagacuggugcccagaggcuugggaaaauuagaggccacauugaaacaaacguguuuguuuaaauaaggagaggaggucuggaaguaagagaaaagugacggucccaacugcugggcuaagggaccccagaugccauauuccugaaccccuuugaugacagcaguagguguuucuccaccuacuagcucugagccucucucugcccauggcagcaccuacaccgacccugggaucuuagggcuugauuggaccuuugucagaagucaucugauuuuagcuguuauuuaauuagggggcugggggugggauuaacucuagcuaauuugguuggggaagggacaguuuuuuuaacuuuaucugagggacuuagggauggaaaaacagaaagauaacuaggccacagccguugaauuugagcuuuucaagguccccacccaacccccaccccgcacccuggccucuugcccaaaccucauuucaucacccugucccggagccucugccagggucccccaaauuucuuaccacaacccuaauggagcagagaggauggaggggguauagggucuuuucccccaucagggugucacucuuccccacacaaaacugucaguucucuuuuaaaauaucuguuggacuuugcacucccaguagccccuggccugauccuccagucccugagguuucuucuaaaacaagccccagccuccauuccucaagagaacccagguguccagcucacauucuacuccgcccucaccuuugcucugggcauaagcucuggggcauucuccuuccuugugacuucccucccagcaccuguguguuuuagacuccccuccaccccucucagccccuuuguggcuguggucuugguguuccuuguuccuccugcauuacuucucauauugaauaaugaagagaacggggugagcucugcugagguuacacagacauaaaggggugaagaagcuugaagccaggcagcucugggugugagugcuuaccauucacuaaagagcccgggcuugagcaaguuacuuaaauccuugcaguucagccuccccuugcacaggauaccuaacugauucuuaggacugaaggagacaauagcuaaaaggugccugcccacagaggaugagcaacauacacaaggcacgaguucuguggaggaauuccugauucugauguucuucccugacacccuccuauucuaaguuuuccuuucuuucuuacuugcaaucauucauucauucauucccaggcuggucugaaacuguagccaaggaugaccuugaacuucugacccuaccuuucuagagugcuaggauggugggcaggcucugucacacccuccaccacacccaguuuauggagauugaacccagggccucugugcaggauuggcaagcaguccacuugcugggcuacauccucaguccuuacaaugcuuguaguacuugcuaauaacugugauaguuauaacaguuuccucacauuaucuuauaagcuuucauauucauuucucauugaauuauuuuuaaagaguuauuuauuuauguauuuauuuaugugaguucacuguagcuguacagaugguucugagccuucauguggcuguugggaauugaauuuuuaggaccucugcucacuccaguuggaccugcuggcucugaucaacuccgcucccucagucccugcuugcaccaccccaaagauuaauguauuauuauacauaaguacacuguaucugacuucagacgcaccagaagagggugucagaucucauuacaggugguugugagccaccaugugguugcugggauuugaacucaggaccuuuggaagagcagucaaugcucuuacccgcugagccaucucgccagcccuggauuauuuuuuaaaaaucuguguugaacagagaaaguauuauugcuuuagaagucaaagaaauuuagaaguagaaauuagcuuaggaaucacucaaaagcaacucaucacugagaaagaaaggcuagaggagggaaagugacuuuuaaauggaccagucugcuagaggcagcucuuacucagccaaucagaugucucccguugggauguacaugggguuccagaaguagauguccaccucuggucuggccagaagugagguaggauugugggaguugggcccugacccaccuaaugcucucuacccugaccuugucaagccaagggagucaaacaguaacugaauauugaacaacggcuugguuaaucaaaagccuggcuaggaagauagugaagagaggaggagauguuuuggcaauggggcagaacagaauacuagccuaggaaacagcauuacaggucuccaggcuucgguucccauccugggaaagauucugagcaacucuggaucggugugacuucucuuggauuuaguuuucccaucugucaaauaaggucauaagacuagggcagcaguuugggaacuuguugaaggaugucagaacugagguggcccuuccuuuacugcaugcaccacucaaagggcaucuacauuaguccuaaagccaguggauguucccucucaaaagacuaacuagaaccuccaaacccugaggcuucgagagaaacgaugccaaguauucuucccauggacucuaauagaguauaacugccaagcugcguucaguggaugauaauuaauggucuuuucaucuuuuaugaaccaaaaguaucuauagcugccaaucagagcuucugaccagccugagauaaccagguuccccauacaaguugguguaaugccagccgaaagcaaaugcacuuggaguuuuaauuagccugggaugccuuaucagguaaacgcaggguuuccgugaggcuuucugcaauauugaaaauagcccaagggcuggggcuggugagauggcucaguggguaagagcaccugacuguucuuccgaagguccagaguucaaaucccagcaaccacaugguggcucacaaccauccguaacaagaucugacucccucuucuggugugucugaagacagcuacaguguauuuacauauaauaaauaaauaaaucuuuaaaaaaaaaaaaaaaaaaaaaaaagaaaauagcccaagggacccucccuugguacccucuugaauuacugugaagauucuacugcugugggauuuaggaagcagcagguaggaggagaaucaggguacauggcaaucuuggcacaggcaccucaccuagcauguaugggugccagaaugaggacuacuaaaauggacacaccacuaaagccuuagguggaagucaugggucagggggccuggucuggauccuugugcccuguuugcauucugggauccccgaaccuucacacagugaacagauaugccccuggccuaugggcuuucagccuucagcagcuuugaaaggacugacagaugcuucuuucucaguuucuccaugaaugcagaugguaugggagaaauuuggggauccugauagaacccagaggaagagaggaaacccaaguuuacacugagacagggcaagaaccagagucucagcucccuguguagcagucugguuccugugcucugcccucacucuuguggagcuaaagacagaguggccaaguucucuguguagcccagcagcuugagcuacacaaggaccacaccacugucucuccccucaccccugcccuggggcuacagcuuccuauuuuucucagaauucucaccugaaagucacuaggccaauggaguggugucucaaaccucuaauuggcuuuaaugccuaagaggugggagacaaauggagaagugagagguugaaaacugaccggaagccacaggcaguaaacauuuccugucccccugguaaccaaagcuggcaccuccccucucuauaacuuaaggcaccuccuguuugucuccauccuacuccucuggacccccugccuucucuauucucaccuguccucucacacuccacccauacuccacugguguccugggggcuuccuuccuugaugcucuuagacccccuugccccucaguaugacucucagaagacaucugucuuuuccucaaguccccuuuugagcucucguuccuacagauaaagacugaggaacagcucgcuggcagucuuggguucuauaagagagcaggcugagcaagccaggggaagcaagccaguaaagaacaucccuccauggccucugcaucagcuccugcuuucugaccugcuugaguuccaguccugacuuccuuggugauaaacaguaguauggaaguguaagcugaauaaacccuuuccuccccaacugcuucuuggucaugauguuugugcaggaauagaaacccugacuaagacaggugaaaaggccuacgaucugagaauaagaaagaaggaagaagccagucaaagauggagcaagccuuuaauccuagcacucagggaggcagaggcaggcagaucucugaguccagggccagauuggucuacagagugaguuccaggacaaccagggcuacacagugaaacccuauuucaaaaaaaaaaaaaaaaaaaaaaaaaggaaaaaaagaagcgguuaagaacauuggcugcugcucuucagaagaccaggguucaauuccuagcaccuacaugacagcucaugacuaccucuaacuccauucccaggggauccagugccuucugcuggucuccucuggaacaaaguacccacauggcacguaaacauacauacaggcaaaauauccauacacauuaaaugaauaaauaauuugaaaagaaaaaagacaggaggggaccugggaauauaaaucaggagagcaagcagugcuggguacaggcggaggcugaggagcaaugccaguggcaguaggggaggagaguagaggccaaggcuggcaggaacacuggcccagagcuggggugccaaggaaagcugcccagacugccagaugcagucauugcaggagauccugaggagagugccagcagagaagaaggcuguggcuguauguaggagcuggaaacaagagaucggggcuaguagaggagagcuguguggagaccccagaagcaaaggaccagaauugguagaagaaggaugcuaggagccaucccucgaaagaccccaucucagacauguguguccaggaagaggauucaaaagaacaggauuugaguuaaauuuucuggggcuaauuugugggaaagagguacaagugugucagaggcccagcuaggaaggugagguccccuauaggccacaggguggggcaaaccaggcccaggaaguggccugcuuucauaguccuaauuucagagacucauuuuuuccuccaacaugccccaagacuuaaguggccgguugccugaguuccauccaagggagaaaauuuggcuuggaaagaaaggugagggccaugaggcucuacaggagccugggguucuggagcuaaauugucccuuuaauauauauauuuuagcuaggcagugauggcauacaccuuuaauccugguacuuggaaggcaggcagggagaucucugugacuucaagagcagccaggucuaaggauagaguuccaggauagccagagcuacacagagaaacuguaucucgaaaaaccacacacacaugcacgcacgcgcacacacaccacacacacacacauuaauccacuuucaaccaaaggucauacauugcauuuggcauuguuucuuagccuggugcugagggccuugcguaugccgagaacauccucuacuccugggcuacagcccuaguugggcuggacaucuaaccuuggcaaguagauggaagagacaaaaaagccagaguccagacccuagucuucuuuucccuuuccaggaacugacucuggcuucuccucucuaguaguaggggaagaagguaagagaaugugggaggaggggaggagcugaguuagugacagcagcacauggggaaugccugacuccagccccugccucuggcaucuguggcaucuucugagauauaaauacaacccaagggacaucuaccccacccccacucuuggcccaaaggucugggugcaucuugccuccagacacugaccuggaaauaggacccguccuaaucuacuucuccuuuccccuccacagagucagugugcugguuggggcacccaaggcuaacacuagccagccagguguacugcaagguggugcugucuaugugugucccuggggcaccaguccuauccagugcaccaccauucaauuugacagcaaagguaggcuggaagaguucagggaagggccuggcauaagagggugggugggcgggccugcaguuuggggguggggccugggugaagggugcuccucccccuccccuucccccugcaguaguucuggugcuccauccagcuccuagcugugggcuucccguggcacucacuccauguucccagcccagcccaagaagggcgggcaugauucagaaacauguggcucucauuucacugaaucacccacagcucugggaggccagggccauaaugcagacaaaggcagaggaggcugcagaguucuguuccuaaacuaagugauagugcacacugggcacagugugauucagccacugcccccagggggggcucagccuucaggcagauggaccuaaggaagcugaggcuguucagcuagcacucagagagcuuuuacuccaugcuaggcacuauugugccuuggcacacuuaauccugcagcaacuguaugaaguauuaguauccccauccugugaggaaggaagcaagguuaagucacccaacuaguaagaaagcaaggcugugaacucaggcagucuguccucagagauaagaggacaagaaguaagcauaagaauguggaagccugcuaauuucugaagggguacuaggcauugaacccaaaguuugauucgugguaaacaugugcuguggauguaugagugcaugaguuacagccccaguuccuaaggcugacuuuaaaaagccugagggcacaggaggcugaggcagaaaaagagugccagaagcucaaagccagccugggcuacauaaugagacacuugucuuaaaacaaacaaacaaacaaauaaaaagccugagagguggagaguaagaagagcaggaaagcagugcuacagagggcagaguuuagacuuggaaagagacagaaagggaagucuaguguggaggcgaaaggagaggccguuagagucacagggcuggcuaacagacagagaugagccaugggacuuggccaauguucccccaacaccacaaugaaaauguccuguuccagcuacgaggaagucagaggagccaacaagacaacuugggaagcugugguggggguggggagguggauauauguuuuucuguggauguaugaguguacgaguguguauguguguuucuguggauguguguguguguguaugaguggguguguauguuucuguggauguggguguguguguaugaguggguguguauguuucuguggauguggguguguguaugaguggguaugggugucucuguugauauauguauguggauguguguguaaggagagcaagaaccagucaaguccagcuacauaaaggagucuaaaacuccuuccauuccccugucccagugggucucagggucuacaaaugcugagcauccuagaccaaggcuagggucaccuuccugagaacaagugugagaguacacuuucuacuuccccaaggcucccggauucuggaguccucacuguacagugccaagggagaggagccuguggaguacaaguccuugcagugguucggagcaacaguucgggcccauggcuccuccaucuuggugaggcaugagugagcucaguggugugguagcuaaggguuaagcugugguggagagggccaggccuggucugggguggaagguggucaucuuacuaagcuaaaucugaacacccccugccccgggcccccucaggcaugugcuccacuguauagcuggcgcacagaaaaggacccacagaaugacccagugggcaccugcuaccucuccacagaaaacuucacccggauucuggaguacgcaccuugccgcucagguaggugccagaguguaguggaccauugugccuucuccgugggaggguccuugguaccuggggcuuucucuucaaggccuccaggcauugauauauauuuuuucaaggcugcucaggugacccuugagcagucuucuuucuugcuccugccucucuucccugucagcccaucagugugcagcuagcucaucucauugucuucucucacagauuuuggcagugcagcagggcagggcuacugccaagggggcuucagugcugaguucaccaaggugagguggcuggggagggaaggcaggaagugaggaucuagggucaguaccagaugauauauaugcucauccaucuucccugcaccuccccacagacuggccgugugguccuggguggaccuggaagcuacuucuggcaagguaagcccuuccucugcccucuuccagcuuuggugccacaucccuucuuugauccaaaccuuuucuuuuuucuuuuuuucuuuuuccuuucucauuuuuguuuguuuguuguguuguuuuguuuuguuuguuuaagauaggguuucucugugaagaauucauuuuguagaccaggcuggccuugaacucagagauccucuugccucugccucucaacugcugggauuaaaugcaucugccaccacugcccagcuuugauccauacuucuaaaauccuacucagucuccccaaagccucugugaccucccccugcccaucacccugcuccccuuccaggccagauccuguccgccacucaagagcagaucucggaguccuauuacccagaguaucucaucaacccuguucaggggcagcugcagacccgccaggccagcuccgucuaugaugacagcuacuuggguaggcaagcagguggggaggaaaugggaggggaaaucaggggccucuagccucacucaguucccugcuucucccacucagugccaccagcucugcugccauacuuguguacaggcugacaaugaagggauugagggccagagaguagggguccccaaggaggcaaugcuaacauccacacacucuguccccaggauacucuguggcugugggugaauucaguggugaugacacagaagguaagucaaucuucaagccaaaguggggacugaaaagaaagccagaaacaacauucugaguccacccuguccucaccuccacccaucaguuucucuucucuuugcagacuuuguugcuggcgugcccaaggggaaccucaccuauggcuauguaagacccugcccgccacccgcugccucucacccaggcuaagugcagagccuugugugguaguuuguuggguauaucaaggaaagagaucagagcauaggcucugggagaacacaucagauuucugaagucugguucaagggaaggaagugugugaagucagacucaaguucaaauucuggcacugacucuggauaaaugaaucuguucuuuuauugcuacacuguccccugcuugaccgcucuaagcuguuucuuccauguacaaugggguaauaauaguucugaccucacaaggcacuugugaggggaaugaaagcacuuguaaauuguuagaccgugugcagccaccagcuauuauuagaccaugacaagugccacacucggucgcucaauuaacaacauuuauugaggcaaggugagagaugagaugaagacaucuuaucccaucucuuaaggugcuucuagucaaauaugugagcuaaaacacacagcuuuaauccugaggaagccauuguuuguuagccucucgaugucccagguacuguccaugcauggugguguucccuuccccaccaugggacuguggaauggagaacaaucuugacaguuuacacacaagaaaacuguuguccuaaaauaccaauuauguugcuuaggggcagcuggauaaauauuuaauaucuaucauacucuaaaucucguacucuuucugaauuggaaguuacagaaaagcacccaagauaacagcacauuuuaagaaauuaguaaucuccuuccagagagggugccucagagaagguucugugaggguuccacacagauggggcaagagggagucccaggcacaggcaugaagaacacagagaauauggggcugggccuaguuugcagccucauaagguaaaggagggugagaauuguaagggaggguugaacaaacacaggcaguagggccagacaccagaaccuuagagggcuggccaagaggcagggacugacaguggcugcgggggccccugggguguacaggugggaaucacaguccuccaucugcuuucuggcaucagugccaguggggaaaacccaagcuauaguccagccuguccugggaagguucauaccaggucucagcagaacaguggggggugggcagagagcaagauccaagagacguggaggucugcugggucaguagcuaagaggagacagcagagaugugaguaccuugcagacccuggugugugagggauggcuagaguucugaauccauuggguuugaagacccaguguguauccaguauugcuguuugccugcugccugcuaagcucugggaggcaaagaccaaagaucaugcucugggucccacugaucugauucuggucacuagaaucuaguggcuggggaugaaaauccaucaaggguauaaaggaagaaggcagaacaguaaagugagagagaaaaccuggagguggagagaggacaaauuuggaaggagacagaggagugcuaagauuccccugaggaaggccugucccaugugucccagaccuucagacauggggcauccaggaccuauaggccuuuaucuucaucuucaggucaccguccuuaauggcucagacauccacucccucuacaacgucucaggagaacaggugaggauacccucaguucuccaucuugccaucuaaucugcagcccuggaccaacagugucaaacuuccuaccgucucuggagcccaugaauguccacuuacagccucucuugauccuguuuacugaccagccuuguucugacuccaugcuacccuuuguccccacagauggccuccuacuucggcuaugcuguggcugccacugauaccaauggagaugggugagugaugggaagggaugcaucuuccagaccugaucgaugggggaugggacagugcaggcagacugcucccucaggauauuuuuuuuucuagacucuaauucauacuugccuucuccuuggucagggcaagaagagggcuggaugcuacaucagagcccucagggcgccuggggauccagaaugccuggaguuccuccacaagggcaauaaauuauagcaagacaggguugucagaaugcuugggucuucccuucuccucaggcuagaugaccuacugguaggggcaccccugcucauggagcggacagcugaugggagaccucaggaggugggcagggucuacaucuaucugcagcgcccagcgggcauagaucccacacccacccucacccucacugggcaagaugaguucagccgauucggcagcuccuugacacccuugggggaccuggaccaagacggcuacaaugguaaguaucguggcccagggugcugaggcuaaguaggggggaugcuaguuggucaggaacuuagugggagggcuucugucaacuaaaguaccgggcccucuugacuuuccagggguauugggguuuaaagauauuagaacaggaacugauguggaaaaauaggauccugaggguuuuuugauagaaauuuggaccccuggccuccuaaccuaguaaauaauguguguugugucuugcagaugucgccauuggggcuccauuugguggggaggcccagcagggagucguauuuauauucccgggaggcccaggaggacugagcacuaaaccuucccagguuuugcagccucuuugggcagcuggccguaccccagacuucuuuggcucugcccuucgaggaggacgagaucuggauggcaauggauacccugguaaguuguggccacugcccuucaucuuagaaugcaagcuuugugaugcaauucuaggcagcugccaccagauggugcaguccccuggcucaggccucugagccaugaaacuagaaagccucagaugaaggcaauccugauuuggggcuugccauaaaggguggaucuugacuuucuacagaucuaaucguuggauccuuugguguggacaaggcucugguguacagguaugaacucaggaagacugaggcagucugaacaacuaguuuuucuuuuaaaacuaagacuggggggcuggugagaugucucagcgguuaagagcacugacugcucuuccagaggucaugaguucaaaacccagcaaccacauuguggcucacaaccauccuuaaugagaaacaaauuaaaaaaaaaaaaaaaaaaaaaaaaaaaaaaaacuucggcaggugugaaagggaggggggugcuaagacuaggaccaucggugcagagggaacugggguccuggagcaggugcccggccuuaauucuauguaccccacauccacucuuggcagagggcggcccaucauaucugccagcgcaucucucaccaucuuccccuccauguucaacccagaggagcgcaguugcagccuggaagggaacccuguguccuggugagcugugcccagagccugcagagauuugugccugccagugggcaggggggccaugucugccucaggaagggacaaacagggguguccuagucugggucuuucugagucaggcaggcaggaggccaguucuaguuaaccugagcacucucuccuccgucuuucuccagcaucaaccuuagcuucugccucaaugccucuggaaaacauguccccaacucuauaggugagagaagcugcucgagugugccagcugagggguggggcaguggaagguaagaaaaacagacagacacuguguuuccuggucauaggcuucgagguggaacuccaacuggacuggcagaagcaaaagggagggguccggcgggcacuguuccugacuuccaagcaggccacccuuacccagacccugcuuauccagaauggggcucgggaggacugcagggagaugaagaucuaccucaggguauggccugaggaugaggguggccuggccuggguagauagccaccuaaaacaaaggacugugguggcggugacgguggcaauagugauggugugcgugcacgcgugugugcuugcauguggcuggaugacuguggggagaggguaaagaaaaaggcuuucugucagaagagccagacaccaggagucuaggccuacagagaaaugaggucagauuugggcucugagcagauaaagggagaagcaaggcuaagaagcauggucacuaagcgccacccaccccgccccaccccacccccgaaucccuaaucccaugaauucuuuccacuggcccuagaaugaaucagaauucagagacaaacucuccccaauucacauugcccucaacuucuccuuggaccccaaagcucccauggacagccauggccuccggccaguucuacacuaccaaagcaaaagcaggauagaggacaagguaaggaaagaacuugggaagacaggccuggccccugaggcagggcccugggagaggggugguagaacccuucucaaggcugcuccacuccccaggcccagaucuugcuggacuguggugaagacaauaucugugugccugaccugcagcuggauguguaugggugaguggcacugucacauggcagagagacagggacacucuagcuauauguggccuugugagauccgugagcaucucuggauuuggguuugucuacagggagcauucguuucucuagcucuagacauauuaaacacgguacucagcaugcagcgucucgccuuaugccugccagagccgggguccagucagcagggccagccccacuguguuauucccaggcccuauugcccugguuuauggauucauucuuucauguccuuacccugugugccccuccagggagaagaaacauguguaccugggugacaagaacgcacugaaccugacauuccaugcccaaaaucugggugagggcggugccuaugaagccgagcuucgggucacagccccucuagaggccgaguacucaggacuugucagacacccaggggugagaagggacucucaagugggacugcaguggugauccccuccagaggggugccaaagccugacuggccugugccugccuauccccagaacuucuccagccugagcugugacuacuuugcugugaaccagagccgccagcuggugugugaccugggcaaccccaugaaggcaggcaccaguguaagugagggguagaagaggaagggcuaggauagagcaugugacagguccuagcacacagguagacauccuaucuaacagccccuuucuccuccuuguuuguuaugcagcucugggguggccuucgguucacuguuccucaucuucaagacacaaagaaaaccauccaguuugacuuucagauccucagguagggagugacuggaccuggacuggggcugaguugaaggugaaagaagggaaggugggauggauggcagaaccuggagauucuugucaaacugcuugccucuugccuccaucccacagcaagaaccugaacaacucacaaagcaacguggucuccuucccacucucgguggaggcucaagcccaggucucccuuaaugggucagugcccaggcagaaagggaccuuuagaggggagggugauggacuuuagagaaggacauauugguuccuuuuguccacucuaaacuauccuccucuucagugucuccaagccugaagcugugauuuucccagucagcgacuggaauccucaagaccagccucagaaggaggaagacuugggcccagcuguccaccaugucuacgaggugagaaggguuggaagacaagccucagggaucgagccauaugaagggaaagaaaguaggagccgguauaaaugacaguaccuaggaccugggugaggugaagagaagagggggcggccuggagaauacugaggaucugugagagauguccagaagaggggccuguugguccauugccuuacaaaggaaagcuauuucaggaggauuacuaugagucucaaacuagcauggauuacagagugagaccuugucucacucuuggaguaauggcugaaguggacuugauugcugcucuuggguguucuuucauuucucagacugaugcacuauguauggguggugaccaaggccugcaugucaaaucagcuuucccuuccucaaagugugcucuuucucucagcucaucaaccaggggcccagcuccaucagccagggugugcuggagcucagcuguccacaggcucuggaaggccaacagcuccucuaugugaccaaggugacaggacucagcaacugcaccuccaacuacacccccaacucacagggccuggaggugaggaccuggucauggugugggguggagcgguggggcuaugggacuauggagcugggaaaaguugccuggaggcuauuggaagugguggggagauucaggcaccucaagaucugaaaggaggaaaaagauucacaucuacuacauuuguguccuuugcucugaaguagucucucucauggugugcuaucagaucugugccaccuuguccugugagaacuguccucuggcccucuuugagaguguguuuguucauaaacagcauuuaaugaaguaagcguuagaccuaggaaaaaccccacaccaaaugaaauucacaaaguccccacauucugggagcuugcaucuagugaaagcugguagacaauaagaaguaaaaagaguugggcaugguggcacacgccuuuaaucccagcauuugggagucagggcagaggcaggcagauuucugaguucgaggacagccagggcuacacagagaaacccugucucggaaaaaaaaaaaaaaaguaaaaagaaaccggguugugguggcaccuaccuuuaaucccagcccucagaggcagaguggggaggaucucugaguuugaagcuagccugggcuacaacggagugaguuccaagacagccaggacuuacacaguaaaacccugucuuaaaaaauaaaaagaaagaaagaaaagugcugaagccugguaaggcagccccaacacuugugaagugaggcaagaggacuggaaguucaagauuauucucaaguacuuacaugagagagacccugagugacaacaaagacggguggaaagcaauaaaguauaaagugacaaagaagaugggcuggugagauggcucagcagguaagagcacugacugcucuuccagagguccugaguuuaauucccagcaaccacaugguggcucacauccacucauaaugacaucugacgcccucuucuggugugucugaagacagcaacaguguacuuaucuaccauaaaaaauaaauuaaaaaaaaauuaaaaauaaaaaaauaaagcuacccaggcaugaugguuacaccuguaaacuuaaucaccaucccuuagaaguggcuggaacaggaggacaaccacaaauuaaaagccaguuugaucuauaaagugaguucugggacaaccaaagccucauagugagaauucuugaaggaaagaaggaagacaggcaaguggaccugugggaugugcuauggguacaaaucugacuugugacagcucuugaagagguagccauuagccagguagaacacuugccuaccauacccaaggcucuagguucaaucccagcacugcuaaauaaacaaguaauaauucaacugaaaccugaaagacaaagcugaagccuccuuguaagacaagggauaaacauucccaauagagggaacagccaguacaaaggcccuuaggcgggaaagacuuaaugauuucuuuacaaaucuacacggugcagagcaagguacacuuugcucuuggcaauagguggguuagcugaacacagggacagagacagaaucgggucccuggcucuggaacauagguucaggcugacuuaggagcuauaaugaagcagaaggugcaacuaaagaugccucuucuuccaguuggauccagagaccucuccacaccaccugcagaaacgagaggcuccagggaggaguucuacugccucaggaacacaaguucugguaaguugcugcagggaaagauguuugucccaaguguuggacaccuguuuggguucucagggucaucaggugagaauucugggcucagacuccuucuaucuugcuagaaaugcccugaagccaaguguuucaggcugcgcugugaguuugggccacugcaccgccaagagagccguagucugcagcugcauuuccgagucugggccaagaccuucuugcagguaagggagcuucauccauccuggaccccaaccuuugguccuagcaggacugacccugucauuuccccaugcugucaucccuuccaccucugcuuugguaacuggacaaacacacacacacacacacacacacacucucucucucucucucucucucucucucucucucucucucucucucucucucucucucucucucucccucuccaagucuccucccucccucacccugauuuagaccaguuguguguccuuggcgccaccucuuggccacuguugaagcaacuagcaacuacuucccuuucuggcccugauagaaaaacagaacguggugagcaugcuggcacuggcucaccuuuaaccugagcacucagaaagcagaggcuggugaaucucugugagucuggggccaaucuggucuucauaagugaauuccaggccaaccaggacuacagagugagaccauaucucaagcaacaacacaaaaacaaaaacaauaaacaaauaacuacacacacaaaaagaaaaacaaguggggauguaggucaguggucagugguagagugcauaacuaguauacccaauccauaaguguaaagaccagaguggauagggcuggggagaugcaaacaugaagaccagacuucaaauccucaaccuccacauaaaugaaugccuagcugguauaccagcaaccuauauguaagagaaaaaagccaucauuuauugaauacauauuauagaccaaccaugguccuggauguuaaccuauauuaaucauuaagaaauguauauugaacguguaguuaucugauuaugcauuauuuaguuuuaauuacacaauuuuacauuuauuauuucgcauaaggaacaucgagauuaaugaguccauaauagggaaagaucacauccugagacagacuguggggaagcccuguguccucugaaucccauagggguugcccugaccaccuuucuccacccacagcgggaauaccagccauuuagccuucagugugaggcuguauaugaagcucugaagaugcccuaccagauccugccucggcagcuuccccaaaagaaacuucaggugaguucaagguuagaagucuggaucgcagaagacaagcucaagaaugucagaagcaggauggggacauggauagaggcuggucuugcuuugugcaaauauuuccuggcuuuguagguccagaucggccagauuaacacgugucucugcucuaguguucaccgccuagagggcagugacaucagugugauauguggcaagacagucuauggaaacaugucauaggaauaucugaacccaaucuuacagagucaggaaagacuuccuguaagaagugguguacaaguugaggccugaaggaauuaacuagacugcuccagagcagaagauucuggguggagaaaacagcacaugugaacacagaaacacuugugcacuucagacucuuaaguucagaaugcuguuagcuaaaaaaugagaguuggguccagauccaacagacagagguagccaggaacaggccgggaagaauucacagguucuuaaugucauuggcuuguccacagguggccacagccgugcaguggaccaaggcagaaggcagcaauggugucccguuguggaucaucauccuagccauucuuuuuggccuccugcuccuaggucugcucaucuacguccucuacaaggucagccacgccaagccuuggcuuagcuuccagccugucagacucugccuuuuacccaguagaaucaaagaggccacccucagaucuguuuuccagcacagacccccauguaugcccuagcuacucacgccccauuugucuuuuuuccuauuggaccccucccuucagucugcagccuccaguuuacaaagaggccuccugucucuggauaaguuugcccauauugcaaaaccacagauggcaaauacaugauggcauuugugcugucgucucuucuaacaucuaucuaagaauaagugaugguauccuacaaguggcagccagggcuaggcucagauguggcacuuguugaguugaguuuguuuacccuuccuggcuuaacuaguaucuuuuucaguaucauuuuaaaaccuugauaaaugacugucccauaauaacucccuaauuuuagaucucccacaucuauuggagcccuugggaaaguaucugaaugaagccacuuuggcaggguggggaggauagaggcaggagaguccucaucccccuggaucuguggucagggagaaugugaucucuaauugugccuccuuucucaucagcucggcuucuucaaacguucccuccccuacggcacagccauggaaaaagcucagcucaagccuccagccaccucagaugccugagcccuccugaucucagacucaugaucccgaagagccaguccaauaccuuccgacagggagggacuaggcacuuccugaaggugcugagggcuggggagaagcucuucuuccuagcccagagacauacuugaagggccagagcuggggggcaagaagcuuguggauccuuccccccaugcacugugaaggacccucguuuacacaugcccucucguggaugggggccucagguccagggacagaagcuccagcuuuccuucagccuuugcauuuuggagacuuuucugaaaucaacuuggaaccauaauuagggaauccaguugugguucucugggccgggcaugccaacaggacuucccaucugacuccggccugcaaagaugcaucuuuggucuugccagagaaccaaaggaagucugcagcuaagagccugagacuuggggagugagaccuggcaacuccaacagcccccauccuggaaggccaaugaagaacacuaaccguggauggugcugcaggaccagcucaggacaaaucccaaacaaaggucgaugcuggcccagacccagauccauggaagucagaaagagaauggagccagacccagucuggggccuaggguugaucuggagcccagucucggauucuaagaaccuaugcuagcagacccaagguggcauuugggucagcugcagaccugggcuuagaaaccuauuuaucccugacuuaggacaagucaggaauugcccaggacccuaaccaggccacauuggcaaacagaccuggaaccucagccuggccacucauuccccagagagaacgggaagccccaggccuguaugaccuggguucugcccaccagcugcacugacgcugccccucucucccuagccaacccuccccucuccuccagaacccaccccaacuuauuuaaacucuguugcaagugcaauaaaccccacccacugcccccacugaccaaag

SEQ ID NO: 8054 - RNA, 9559 nt, Mus musculus
guaaguuugucaaaggaaaauauucuuuauuuaaauaaaagcauguuaagaugacaaucacaaauuuauuaaaaguugagaucuugcuaggguuaaaaaaugacuucuauuugucugugggcauuuuaauuggcaaugucuccaucaguuuuucugcccuguggggagaaaaaaaaaaaaagauugaaguagugucauuuucacagcuugagaugugccaguagcauuuagaaacagccuuuuucucagucugauuagaaguccccgggacuugaccuauguccuacugugggucaaggaggagcagaauaauauuucccccugggcacugaaccaggaucauuuacauaugaggcaaugguguuaucacuaagcugaaucccaagaccaauguuguuguuauuauuauuauuauuauuauuauuauuauuauuauugagucaggaucuuauucuguaacccugacuguacuggaacucacuauguagaccaagcuggacuugaacucacagagaucugcuugccucugucuucugaguuuggggauuaaaaaugugcaccaccacacuccauagcuuuaauauguguguuuagaagaaagauuugucuaagaaucuuuucaaguuuaggucauaauguuaaaaguuugauguuaacccaacaaagguuauuuuaccucuuccccaagacuugaagcuguuaggaugcuuaucagccauagccucuuguaggucucucgagucacuauagagagaaccacaagaaaguuaauagggaggcagaaauggggaaccuguugauauauccaguuccaggcagucagaauuacauuauccaacauaauuuauauuaauuacuaaggguuauaguaagaaucauuugauuucugucuuuugugucauaugguuccucuaugccuuccauucucaugugguaggcgacuccauuaguggcuccuauaacccuugugugugcucucucagcuuguuuggcuagggauccugagcuguuuguauauagauggucuccuuaagucugagaaguugguauuuuguucuuuacagaauuaugaccauuguauaggccuugauagacuacagucuugagugaaguguugagaaggaaauuacccagagacacacacauuguguguguguguguguguguguguguguguguguguaucuuugugcuagaggucaguguugaauguuucuucaauuguuuucuacuuuauuuuuaaaaaauguaaaauuuuauguauauugguauuuugucugcauauacgucugugcaccacacgugugucucgugcccauggaggcaggaagaugauguuggauugcuggaacuggaguuacaggugaccugugaucuguugugggggcuggcaaucaaaccuggguccucuggaauagcagcaagugaucuuaacuccuaagucauucucuagccuccuauuuuaaaguguguguguguguaggucaguggacaauuuaugggaguaguucaaucaccaucugggucuuggggaucaaacucagggugccagccuuggcaacaagcacccuuuaacccucuggaacaucucaccagaccuccacauuaugaugaugauguuguugaugaugaugaugaugguggugguggugguggugauauggggucucuuacugaaccuggagcuugcugauuugguuagacuacuuaaccuuguucuagggaaccuccuuucucagucccugcuuucucagugcugugauuauagguauacaccaccauaccuuacuguuuuguuagccugggaucugaauucagauguuuguggagcaagcauuuaccagcugagcuacaccaccugaucacaaaucuuuaaguuagugacugaagcucauguauuuugagccuauggccuaauggccaucuucccuuuaaaagacuaacuuuaggauuggugaggugauugagugaguaaaaguaccuacugccuugggccuuacaaccugaguuugaaacccagaauccaugaaguggaaggagaaacuggugacagcagguuguccucugaccugcccacauauucccuggccauacuaaauaaacaaucaagcaaacaaacaaacaaacaaacaaacaagcaaacauuaaaaaagucacacuuguuaacuugaacgauggcgaugagcauauacuuuaucuuaccucucacaaacuagcuucuuuggagcaaaagucucaagaacaaaugaaggaaaaugaugcgcaugaucuagaaaguaaagaaugagaaagaaacacaauuccugagcauuuucagauuguuguaggaaaggcuagcugguagcagacccuuucuuuugucuucuguauaacuguugcugggaagcgguugcucugacagggaccacauauucacccccuuacaguuagguaugaguauacaguuguuuuaccaggggaauaugaaugcaaguaucuuuucaaaucagguaccuuuccagucuccuuuugugucaucuuuggaaacuaaauuuggaagguugacagccacaagcugaaacaagcuuguauccucaugucauuauuagcgacugaaucugucucagggucuuuauuacggugacagugaacaaaagugacuuggggaggaaaggguuuauuuugcuuacacuuucagguaucagugagggaagugaggacaggauccuagagacaggaacuaaggaggcggcuugcuggcuugcucagccugguuucuuaggacacagaaccaccaguccaggggugaaacuacccacaaugggcuggagccuccaacaucaaucacuaaucaggaaaaugaccuucaggcuuacuuauauccuguggaggcauuuucucaauugauguucucuccucuuacauuacucuagcuugugucaagcugacauagaacuagucaguacaguacuugcacugacauuuuaaauuauaacauuaacaaaauucagagcuuauauuaugggaagaaguauuguuccaacauguauacuuaauuauuuuuguuguuuugcagugcuggaguuagaaccuaggacccuguggauguuaggcaugaacugugccccugggacaaagcucuuuccuauauucaauauuaaguuugauuaugagacagacucuuuuuuuuuaagguuuaaaauuucuuuuuuuuucugcauuuuuuacuauauauuuacuuuauuuacauuucaaauguuaucccuuuuccugguuucccuuccuaaaacccccuguuucccuccccccuuccccugcucaucaaaccacccauaccaguuuccuggcccuggcuucuccuacacuggggcauagagccuucucaggaccaaggaccucuccuccuauugaugauggauuaggccauccucugcuacauaugcagcuggagccuugagucccuccuuguguacucuuuaguuggugauuuagucccugggagcucuggggguacugguuaguucauauuguuguuucuccugcggggcugcuaaucccuucagcuccuuggguccuuucucuagcuccuucauugaggacccugugcucaguucaaugauaggcugcaaggauccaccucuguauuugucaggaacuguuggagccucucaggagacaucuauaacaggcuucugucaguaagcacuuguugauaucuacaaaagugucuggguuuggugauuguaugugggauggauccccagguggggcagucucuggauggucauuccuucagucuuugcucuacacuuugucucuguaacucccuccauggguauuuuguucccucuuuuaagaaggaucgaaguauccacauuuugggcuuccuucuucuugaguuucauguauuuugcaaauuguaucuuggguauucugagcuucugggcuaauauccacuuaucaguaaugugcauagcauguguguucuuuugugauuggguuaccucacucaggaugauauuuucuaguuccuuccacuuuccuaagaauuucauaaauucauuguuuuuaauagcugaguaguacuccauuguguaaauguaccacacuuucuguauccauuccucuguugagagacaucuggguucuuuccagcuccuggcuauuauaaauaaggcugugaugaacauaguggagcauguguccuuacuacauguuggagcaucuucugaguauaugcccagcagugguauuagugggucuucagguaguacuauguucaauuuucugagcaaccacuaaacugauuuccacagugguuguaccagcuugcaaucccaucagcaauggaggaguguuccucuuuuuccacaaaugaagcagacuuuuauauaugggcauuuugaaaauguguuuaagaaaugacuucauucagacugaaaacugaugaugucuuuuuauuuauucuguuuuuaaaauuaauuaauuaauuaauuaauuagacauuauuuccucuaagugguccuauuuguccuggagcuuucuguguagaucaggcugaccuugaacucacagagauccuccugccuuugccuccugagugcugagauuacaaguaaguuacaaugucuggcaagaugggaaacccuuaauuuuuauauguaaguuuagauuuuagcuagauuacuauuuuuuuaaaaaggaacaauagcuauugaauauacuuuuguguaagaaauaguuguucauugaguacauuagaaaagagcagagggccuaggcaguaacaaaaauaccccuguagcuugagacuguacauggaguugcagggggugaugucuccaacuggggaugugcuuacggccaguuuuuuuuuuccuuuuuuuuuauuacauaucuucuucaauuacauuuccaaugcuaucccaaaagcccccccccuccccuacccacccauucccauuuuuuguuacggccaguuuuugauaguuuccuagcacguaauuugcacuaugugaauaaggaccuauguguugagucugaauuuucagcugcacaaucuuuaccauguaaaucaggaugauuuagccucuuuggcugaucaagguuccauccuugucaaaggcugugacaauggcaugcuggccuacagcucgguuagacuacuguuuuugacugggccauccuucuagagacaggugacauucuuagucuuagugauuuguagaguguuguuuuugugagaagagcauaaguauuuauuacuuaggcuguguuuacuaucugcuaguucuaaagcacacuucugcucacaguucuguuccguuucacccuugcucacccacguuccagacaucagggucaggaaauugacucccagcacuggagaaguuuucauuuucuucaaaaacugggugaguaaucuuuugaagguuaaguggcucugaaacaaaguagaaaagaaguucuugaaguagaauauaaaaucaaacuuuuaucugcucuguuugacuaaggcuucaaaaucauccugagauguggggauguuggaagccauagaaauuuggucuuaucuaccugaucucaagugaaaagcuuaccaucauccacugcaguccuguugauacaguuggccucauguuccuugagccuuuugauugggaccacaugacaagcauuauauuugcaguuagccaucuuuuuagcuaucuuuggauuuuucuagaaggaauaauucuuguuagguuuuuuuuccuguauuccauccuucacucauuucugaaaauuucugaagagaaauauaucucaacuuuaagaacaacuaguuucuagcuaugaucagaagcaaaaagcaaaaccaaauguaucuuuuuauacuccgaaauuuacaguuaauauuggggaaacuuaccuuuuugcaugaugccagaugguacuguaaccugcuggcagguauccugugguuuggaucauaaggacauagcucuauggauuccaacuccauuaguccuaaaagucaagaaucauagguuagaaaaggaaagauuaccacuuaagaucagucuugacauaggccuauuuucuauucuuaaaagcaaugugguauuagggcuggagagagaugguucagcaauuaagauugguuucugcucaaucuugaagccuggaguucagaucccagcacccacacuggaugacugacaaaugcuacucccagggaucccacaccuucuucuuucuucuucuuucuccuccuccuucuucucuuucuccuuucucauuuucuccuuucucuccuuucucuucuuuccuuucuuuucucuccuuucucuccuccuccuccuccuccuccuccuccuccuucuucuucuucucuccuucuccuccuucuccuuccuccuccuccuccuccuccuccuccuccuccuccuccuucuucuucuucuuaaagggacaacauuuauuccuuuuccaaauguuacaguaaauccgaguggaagaaugguuuuagcaguuagaaaaaaaaaaaaguacaaaucugggguuuggccauuaaaaguuauuuacaacaaugggaaggagaaaaaaaagacaacaagaaguuguuucacauuacagaccucccucccuccugaagccuaacacuugcuuaucaagucagagacuugguugauuucacaagcuggagguuugaacuugaguaagacauuuauaaaaacacagacggggcaauguccuccccagcccaggugccacuaggcacagcauaagagacuaagaauucaacaggggaaaggcuggacacucaggguuugggaguauaagcccccacuucuggcucaggggguugagaagcaggauaaacaaaaugaacuuggaaaagaauuggaaacccagcaauuugccuucuacagggauggggcucgggaaggagguagggacagggcauuucacaucacuaaccuaacgugggaaacugcaagggaccaucuucaacuggccuuaagaguaagaccaaauggcugaugggagaauccacaggagggcgaaaagggagcauggcugggaggaggcaacaagccccuuccuuucugggcacaggaaggcagccaaggcacaagguccaggcagugaccucacaaggacagcacaguuuuugcagcuuagaaaucacccaccuguccccaccccuacucauucugcucagcacuggcagguguggggccacucucuggguccgagggaguggauggcucugcagccuggggccuugccuuuucuucugugucuccuuccuuggaggcagcacuagccucugcccccuuggccuggggcucuuggcucucaggguuggcagcggccuucccuucuugggcagugcccuuguugcugcagacgcucaucucccccugcuccugcucuucuucuguuguccaggaggcugaggaaucacccccacccuccuuccgauuucuguugaaggacaggccacucaauuugaaaggcuucuugaaagagaauuucuucuucuucuugggggucuccuugggggcgaccucccccuuggccucagcuuccuggcuagggggcgcuggcucgauggcaucaccaguagccccagcugccucaucuguuccguucacggauggugacuccccuucacccuugggggguuaagucuccauugcuucucacguggccauucuccuguccguuggccuucgcuggggaagcacccgcugccuccucggcggucacgucgcccccccccuccccgccccacaccuucuucuuaccauuagggauacucacccucaagugugugaauguacgugagcacacacacacacacacacacacacacacacacacacacacacacacaccacccacacagacauauuagaauaauaauaauaauaauaauaauaauaauaauaauaauaauagcuuagcugguuagaccauaggggaaagucucuguucuuuguuuuacuuuaacauuauacauacuuguagguugcuuuaaacagagugcuuacuucucaaauagaauauuaaacaggcaagaauuccuggaaaaauccacagaccuggauaugauuaaauucuacacuugugcgcuagagaaagcaaggcucgggaagcugcuuccuuaaggguccaucacucuucuucaucuucaauuuaucuaaaacugagcuacuaauugucagguaagucagcauaaccacugagaaggaacagaagaaccacaauguaauauuugagucuaggcuacuuauauuaccuaagaaacuagccugaaaucucuaaacuuguggaugucaacauaugaagacuccuaaaagugaacuaaaaauaaaccaucucaaauuugcugcauuuuacugccaauaggaaguacucucccccucauggcuagcugucuuuagcuauccaaguagacauucauuucaaggacuuccaaguuucuaagcagcagcuauagcugagauuucuacaaagcagugauguauaguuuggugguggugguagugugugugugucagaaaagaucaaguaugagugguauaagcgauaggguuagaaaagugcacuagaauagcacauuucaauuugucuguguaccauggcuaaggcauaaacaaagaguauggagguagacugcuaaauaucagauuuucccagggcauuuuagugauuaaaucuagggauuaagacugagguagcuugggcaggagagauggcucagcagguaaaagagcacugacugcuuuuccaaagguccuguguucaaaucccaccaaccacauggugguuuacaaacaacugacacccucuucuggcaugucugaagacagcuacaguguacuuauguauaauaauaaaugcaucuuaaaaaauuuauauauuaaaaaaaaaagacugaggugacuuugggaacacaagccagggugauucuuuauguuuucauuggauauuaaugaauauauuagaaccauggauacuuauaaugaagugaacugacuuucuggaaaauuaaagcucauaaaaccugcuauuauaaaugauuaucuuuagauuaaaaaacaauaauggaaaagguguuuuaauaauucuauguagucuucagaaaaucuguuauuucagccaauggcuuagguaagcaugaauuuuggccacacuuauaagucugaucuuaauaagccaaauaaauaaaucaaauaaauaaaaaaagauuguuggaggauacacagugacaacagauaauacugauuuguucauuaauuaaaaaucccuuuucccauggagggaggucaugacuugauagaggccauuugauuuacuauguuagacuccuugaagccaccaucauacuuaaaccuagcauaaggaucgugagauuuaccuuauucucgaaguacugugucaaugcaagaaguuuaggaacacagagagcagagcacccuccaguuaacaaagggaaucagcuugccguccaagcuugccguucagccccucuccucucaccauggauucuauguuucucagaaguucagaacgcuuugaugucaua

SEQ ID NO: 8055 - RNA, 419 nt, Mus musculus
aagggagaugucauaggaagucuguguauguuaaggaguugauacaguuuuagauaguauguccaugguguccaccuugaaaaaaaaugacaucugaaugaacuccugaaacaacuauaaagccagguaugguaugugacugucugggaacaaucacucuaugcagaauaaccaguauuuccaaggcugagaugaaggcauacucaagggacaaggaggcagaguggugacagaaacagaacccuagugaucugggugggacgugagguuaaacagcaguggagcaacugugcagaauauuguaaggacugggccacaucuagauaugcagacuuugcuugucuggagcaaagcuguaauaagauuuguauccacaguuugcucuggcuuuaucaacaugaaugagaacagaagcagga

SEQ ID NO: 8056 - RNA, 7737 nt, Mus musculus
caguccccaagcggagcggggcgcgccgagccaggagcugcaagccgagcgccgggcuggggccagggccggagcgcaacagagagggagcgcgcccgccccagcccgagguccgccgcugccugaccgggagccauggagcccgacaacagcccacggaagauccaguuuacggucccgcugcuggagccucaccuggacccggaggcggcggagcagguacaggcagggcggggcagcaggacucggcgaaggacuggggaccuggccgugagacuugaaucccugccuugccccagcgcggcaccacaccucuucaggaacgcacucgcccaguuuaugggggucuccauacccucccccaacagcgaggccacaccucggucaccaguaugggucccuguggcgggugucuccaagagcaucguucacucccagcccagccauagggacacgaccccuccucccucacuggcgaccuuacagccccucacacccagucaacccccagaguuucccggcuaaguggcauugguaagcugaaggguacugccgggaggauguugcgggcggggggcggcgagugagcagaagagacagcucuccuccccuccgugucaucuggaggcugaguguggcacccaaagggaugagaacagcuauggaggaguuuuagagcaaggacgggggaggguggaggggucugcaagcugauguucccuucugcaagucagagcacgugggaccuggguauaacucugcccuauggaguagggagugggggugagaugcggggcgcagcgcggcgaucuggagcgucugggccugggguccaagcuuagccacgagcaagccaccaagaaagcuuggcucaucgggugggagugcagggcccuggcccagccuccuggccuggccuauuuuuagcucugagcagccuggcagaggcggcagugugugagugagcagugugugucagcgucagugagcguauggaaggggcuacuaucugcagccugccuucuuuugcauucccuggauugugaagaccaucccuccccaagagcauccagcuccccaggacuccugcccccagccacucacugucaagcucuccaccugaaagaaucagaccucuggggaugagcaggagaaaaagguuuccacauugcuagagccgauucauagaauuggguguggaugaaaagggacccagcagguguacacuuugaaacuucuacuucucagauccagggaggagcagguacccagcuucuccucucccuaccuggggaccaaggggcuggagagggaguuugagaccucacacacaugagaugaggagaaugaagacuguuucuauggacuaugccuaugcccagaaacagcagauuggcucagacgacuuuugaaacaggaaagcaggcccagaaguggagacugugggagccagagguucugagaucugccucccaauggcagacaggaccugacaccugcuucuguuuggugucaaagggguuugaaggggcuggugagauggcucaguggguuagagcacccgacugcucuuccgaagguccagaguucaaaucccagcaaccacaugguggcucacaaccauccguaacaagaucugacucccucuucuggagugucugaagacagcuacaguguacuuacauauaauaaauaaauaaaucuaaaaaaaaaaaaaaaaaggggguuugaaggagggcuggccagcugguuuacagagcuggggacaagggaacacaagagggcacaugacaguguuggggagucaaagugagagaaaagcugggacucugucugcucuuuucuagucuucagaaaucugucuccuggcucugaaaguuugccccgguucuuccugcuguuaccaaguauguaggcaaaagcaccaaacauagcaggagcuccuaccccaacuuccaugggguggaagugggagggugaagaaaaagugggaagcuaaguguacagcagaguguggggacagcccuccuccacaaccuucagauguccuugagagcuagguuagguaggggcagaaacagaaaagagccaucucucuugggauccagggagucuccuccugccuccugccuccugccuccugccuccugccuccugccuccugccuccugccuccugccuccugccuccugccucaacaccacaauucucaaagacucagagugcuucaaaucccugucugggguuggggguugggggagucuguuaaguaagguaaguaagagucuguccaaccucagagcccugcugaccuuuggucaugggcuccuuggguucccaauacagguacugcaucaagucacugauaccccuuccacagucucagucacuuccacuacucuccaguggcaaccccacccccaccaaaacagaaagaaaguaagggaucaaagggauggucccacucccacauacacgaagcaucuuguaccaggagcagccagagacaauucacauucaguauucacacacacacacacacacacagaggucuggcucugcugggaccuugaaaugucacuaaaagcagaugccacuaguuuucccugaagcaagaagucacucuguuccauacaugcuguuucuuucuuuggaaagagcccccucucuggcucaaacaguccuuccuacuauucccacuuucuagguaucuugucaccuccagccaccacugccaaugcugaugaugacaagagacaaauaugaacagaucuaaaucugauccguugcguccucacuggacccugcuuccccaggacugcuagcuuuaucuacccacagcccugagagaacagcaggagcucuacccaugugaugccucucucuuccaaaccuuccccagaaaaggaaaaacuacacauccuaagagucuauaggauucagcaacaaucagcuuaauagauagcaggacaggaagaaaagccagcagcaggaggggggcauucaguuggaacucaugccaccggucugcuuuauaugaucauuuccccuggggcuggccaggauucuaccuccucaaguccuguucaccauuaggaccacuuccccuauuccuggccaauuaaaaagccauuguguccaaggcuagugaaaccuuagaguauugagggaccgugguggccaggggaauggugcacucagcccuuccuucaugguggaugaaccugagggaggccuucugaagacagguaugagcccacaaaggguuaaugucugcuucagggguggacuggagucugagggaaagcccucugaucucucauguuauuucugaccauugauccaggauggacagaaaucaaugcacagaguggacagaguuuccgaaaggagagcuggggaggacaaggagaggaugaagagacaguacaaggaagggacuguguaguuucuuguguccccaagagcagcucaccccugaagaagggaaugggccaauggaacuccagaguaaccaguaacuuuuggggggaugugcagaaucggacuggggggggguauuccuagcgaacuugaccucuuauucuuccuccccuaacccagauucggaggcgccgccccaccccugccacacuugugcugaccagugaucaguccuccccagguaaccccuuguaagaggggaugggugcuagagagauagggcagaccucaguaguagagauuuccccgugcugacucagcaagauuuauuuugcuuuuacaaacauggaaaucugcuaggcggggaggggacaaccugauuccuaagcccccaggcaucaggauggucaauuuagugcagguugcugugacaacagccuuguaguuuucuccagcaacuaagaugucugcuauuuccacuccaaaugcaguagugacagcugugagggggagagauugucuccaucaucuagcaucagguccccagagggugagguuagaaacagcucagggagcagcuagaauucuggucaccagacuccccaccagggucugaggacacaaggucuuagagaaugucagaggagcuugguaaguguaaaaaagugaccaggcuagucugaaaucgggccaaagucuccagcucuccccaccccaacuuucauaaauggugcacaucuauggacccugaccagaaugaguuugcuauucucucucagggagcccugcuccugugaaggcucagcucuggucuggggguaaaagaaugacuagaagggaaaagagaccuggaugcugcagaggaggaaacaaaaacaaaaacaaaaacgccgaagggccacacauuugccuucacagucuucagagccugaggccaggaugcaggcuuaggcuggucagaggguccacucuguuuugacaaagccaagccacaguacagggggaucugcuguguaccuucuucuuaagaacucgggucuugaggaaacuuuuggguuuccugcucuuaucacuguuuuuccccuacuucccccagaaauagaugaagaccggauccccaacucacuucucaaggugagcuggccccuaccauucagcccaggccucaaaagccaaacccucauccuccagaucugggguguagcucgguaaagagagcaccacuuagcauauacagacccagagcacccaugaacccaaaacaaaagccuuguaccucaccaguaggaccuuugauguccucuucuaugcaccccaaaaaaugcaugccccccugccaucauacacugucuccaagcucacccuguuggaaacaagaauuuccucucgcuccuaaaacccaccugcccuaaucucuaauccaaaaucaugccaaagcagaaaagggugggaagagcuggcacccauccagacucuguguccuucacaguccaccuugucaaugucuccacggcaacggaagaagaugacaaggaccacacccaccaugaaagguuuggcauccccuucccaauuucucaucuggcugaaaguggagaguagaucuaguaacccuuugcagggagucaaugggagguuacugggucugccuuuauuugaguggaguuauugcgaugugaagaaggcuccuguagcuugaggaagcuggucccuagaccaaaccagaauaccaccuccucacuaugacagagaaauaguacauguaaccucaucagcacagcucaugcaagguacuauauucccugaguccaaauugaggcuucucuccugccucuaaggagagaccacagguccuagugcauuaggagugucuucugcacugaaaggcucuuccccucuguuugccuuugaaaagacauuaugcuccugcuuucaucucuccuuauugcccagcaaauguuccuccuaauuuagagcccaguucugggaaauuaaagcacccagcaacaugcacagacccaauggugggacuagugaauuuaggagaccucucacaggagauuuuaggcaguuauauccaauguuuccucccuuucucucugccuccagagcuccagacgaugguugaacaucaccuagggcaacagaagcaaggggaagaaccugagggagccacugagagcacagggaaccaggaguccugcccaccugggaucccagacacaggcucggcgucaaggccagauacccccgggacagcacaaaguauguacaauccugggaggguaacagaaugcaguuccccagccuugcaggaagacagcuuuacccacugggguauagggaggaaucacagccugagaggguggaauaauagcuaaaagcccagucaaggacauggguguauuccauacagcaugauuugacucacuuugucuaauuguaguuaccaccuuagaccccagagauccugcccuggcuggaaaaggagggaaaccccaucagacuuagaucaguacuugacccuguaugggagccagggcuacaguucugccuucaccgcuggccacuuuaccagcagggcuggcgucuauuuugcuggaguuguuuuggagucuuccaaugaguguggcucaacaccugacacauacaaagccugccauacaaggaauguggugcugguggugcuaauccacagccacauucccuucucccagaugcguuccagaauucagaccauuuccaauugugugaaagugauauaguacacacauuuccuguuacauaacacacccagcagagcauccuguaauuaagcacacucuuuuccuacaauccagugucuaacugggauagguaacaucacuugaguuuaaacucuaauuuuuuuuuauuuauuuacauauuuaguuagugaguuuuuaggguuugggggguucguuuuguuuuauuuuuacuuuuuaaucucugguuacagggggaaaauagugaagcuaucauaauaacugugaucagaaaaaccccagacggcaagguagaucugcucccaaugggucuugggcccauucucagcagcugcacaccuuuauaaggguugccucucccuccauggcccacuuucccucccuagagucugcagaauccaaccccaagacucaggagcagugugguguggagcccagaacagaggauucuucagcccacaugcuaccacuggauucccagggagccagcuugguaagccccuuggccuagacuuuggggccuucaggagagcaggcuguauggguuaguauuugaagcaaacguguagacaaagaagcagcuuuauuuauucacuaaaaaguuagccuuugugcuaagagacucccucugacaaagagaggagggauuaggugacugcggagaggaucaaacggagaguuuguuguguagaccuucuggaacaggugauggaaauagagcauagacuuaauuuuauuuuuuaauaaggggcaguuggaaccaaaguacugugggccuagaagagauggggcucggacugagauccacagcaggacagaaggugaauagcugggcuggccaggaagaaggaugaaucuauggcccucagucaccuccccuuuccucccccaaaacaggucugacagaaguugguauccggggaucaccacugcaguguggaaauucauggacacuggauguuucuuaaucucuuguuuuuaaaaagugauaaauuugguguuagguccuuggagcuuuucuucuuuccagcccggggaucccuuccuccuucagcucuugucugcaccccacugcccccacccucaggaccgauuaaggaaggaaauagcaaacugacaaaagccuagccuccacuagcaaaauagaaaaauagacgucuggaaguaggaggucgccucaagguuuuccuuuguuacuguggaaagcucugcccacagagcagguuagccuacuugggagacugcugcucuaaagcggguacccagaccagugaggguuugccaaagcgccaucugcuggacauaaaggggaagugcaucuugucccuagcucccugagaaaccuccaauucuguggccacuguuccuuguacaaaccugacacaaagacugucagaaaacacuguggcuagaaacccaaagggccaccucucccauuguccuacauccuaaggucagagcaagacuaacaccaugcacaaauagagaaauggucugugauccuagccaggcuucugcugcugauucugauuuucccaaagaauuaaagcgaugaagggagaagacaaga

SEQ ID NO: 8057 - RNA, 1989 nt, Mus musculus
aaccugaguauaugacagcggcaguuuucacggacucuaagauuucagaaugacuaccaucuugacuuccacuuuuagaaacuuuucaacuacaucaaaaugggcucucagaucuucuauaagaccucugagcuguucuucccaacugcagucugccacagcuguccagaccaagucaaagaagacuuuagcaaaacccaauaugaagaauauuguggugguggaagggguccgcauuccauuucugcggucaggcacuucguauaaagaccuaaugccacaugacuuggcuagagcugcacuuuuaggcuuguugcauuggaccaauauuccaaaggauguuguugauuauaucaucuuugguacaguuauucaggaaguaaaaacaagcaauguggcuagagaggcugcccugggagcuggcuucucugauaagacucuggcucacacugucaccauggcuuguaucucuucaaaccaagccaugaccacagcuguuggucugauagcuuccggccagugugaugucgucguggcuggugguguugaguuaaugucugaugucccuaauucgucauucaagaaauaugaggaaaaugaugcuugaucucaauaaagccaagacucugggccaguaccuguccuuacucaguaaauucagauugaauuuucuguccccugagcucccugcaguggcugaguucuccacuaaugagaccauggaccacucugcagaccgacuggcugcugccuuugcuguuucucuaauggaacaagaugaauaugcacugcguucucauagucuggccaagaaggcacaggaugaaggacaccuuucugauauuguaccuuucaaaguaccaggaaaggacacaguuaccaaagauaaugggauccguccuuccucacuggagcaaacggccaaacuaaaaccugcauucaucaaacccuauggcacagugacagcugcaaauucuucuuuccugacugauggcacuucugcaaugcuaaucaugucagaggacagagcucuggccauggguuauaaaccaaaggcauacuugagggauuuuauauaugugucccaggaucugaaagaucagcuuuuacucggaccaacauaugcuacuccaaaaguuuuagaaaaggcaggguuaaccgugaaugauaucgaugcuuuaaauuucaugaagccuucucagaccagauuuuagcuaacuuuaaagccauggauucugauugguuugcacaaaacuacauggguaggaaaaccaagguuggaucaccuccucuggagaaguuuaauaucuggggcagaucacugucucugggguacccuuuuggagccacugacugucggcuggucauggcagcugccaacagacugaggaaggaaggaggccaguaugcuuuaguggcugccugugcagcuggaggacagggucauucuaugauuguggaagcuuaccccaaaugauugcucuagaaggaggcaacuaacugaucucuucagcacuugcacugggcaaugccauuucaaugcacuaccaagugauaccugcaguuccuagcucuucuuaggaaacaacauuuguggccuucucuuaaauacuuuucgauccagccuugccaguguucgagguuuucgauaaucacagcuucugcucucuaaguuccagacuauuacagauguuugcucaguuccuguuauuucuuuucacaaagacuaauggcugcuagccacuuggagagagagaggcuagcugagguuuaaaaucaucuuuguaacauuuguagauucuccuuauuccugucugugucauagagauaauuauuuuuuucuaaaauacaaaccgaugugccuaaguuaacuuacuauagaaaaaaauaugucuaaacaucucuuaaaccugaaaugcuuagagacauagauaccauguugguugaccuuaauaaaguagacauguauuaaaaaaaaaaaaaaaccug

SEQ ID NO: 8058 - RNA, 693 nt, Mus musculus
uagcucuugcuccuucgccugcuugcugugugagacugaguaacugcuagauccuuggacuuccauucacagcugcgacugaaccauuauugggaauugggcugucgacuguaagucaucaauaaauucuuuuacuauauagagacuauccaugaguucugugacucuagagaacccuaacuaauacagaaguugguaccaggugugguucuagaguaacagaaguacaaggauaaaucuuuuaaaauacuggaauuggcuuguugauccaccagcacuuucaacuacugaaaccucuccagauucucucccuccugggagcucagagaauuuuugaagacccaugguugaaacuauauuucaaacuuaaagaagcuaaugcacuugauuuucuugaugaauuaggugauucagugcacaaagcuuucuacaagauggggaaaaaucagaaaaugauuuuacuggcuggcugcucuuaguaucuggggagaaaaugaagaaugaaaggaaggaguugugugauaaaaucgaaaggcuccagacacaaguaaaccaucuaaaaguugcuaaguguguccuugaagagaaucuucucucuugcagcaauagagcucaaguugcagaaaaucaaacugaauuggucagacuaaauucuuuuguguaauuaaauuuuaauuaaaaugcauaauaaac

SEQ ID NO: 8059 - RNA, 641 nt, Mus musculus
uaugaacagacggguggauuauucagucauggaggaagagaucaaccugaugagaggacccucagggcugugcuucaacaaugucggugagacagaucaacaguauguguccaaggacaguggcaucuaugacagccgcaucaaagaggauggggcugcggaccaggaugggcagcuccaggagggugacuagauccucucaguaaaugaccaagaucugaagaaccugcugcaccaagaugcuguagaccucuuccguaaugcgggaugugcugugucccugagaguacagcacagguuaccagugcagaacggaccuauaguacaucgaggugaaggagagccaaguggaguuccuguagcuauggugcugcuaccaguguuugcccucaccaugguagcaguuugggccaucgugugauacugaaagcagcuuugaaaugcuugcugucuuccaguguguucaaugaacuaucucucucucacucaccaucucugacauccgcccauauucuuucuucuccacacagccaauaaacgauuuaaagugacugcuuaucaccccaaacccugcuauucaaaauccccaauucuaauggaagaguacagggguuauuugaagaaaagcuggggggggggga

SEQ ID NO: 8060 - RNA, 900 nt, Mus musculus
auccagaaagaggaggggccaugcagagcuaaggccuaguuaguguuuugagggguaacauuagggauucacugugagcaucaagauaaaugacaucuuugcuauggcacuggcauggaauucacaugacaccuaaacuuucauaucuagaaaaaggcaggcgccagcuagcauaaaaguggucaucacagacggcguuugacacagaguccuggaugcuuugagguccugguccaucacgugaccaucacagccagguagaaaggucugaggaagacaguggagcuggccgugccagcaucugcacagggaacacuucuugggcagccaggugccauggaggauagacccacagugcucuuugcgagcaucauguucacaguugcguccauagaaggaaggagggcaggcacagaaggaccccaggaugcaagucccuccauucagacagcaaguuuuauuaagcgacuuacuguucuguauccccacggaaggcacgaacuggaaagaccgaucgcguacggcagguucuuucuggucccaaaugcuguuaucucugauggcaaggucucucccagcaacggguccaaauucaaacacacuggaaauggccacaagcaaaaccacacuggaugagaaguaccccaucuucgacggcucguaaaaacguuggaggaaaagacaagaaacacaauauuagcagauggcuuuaguucauaaagccauucucgaaacacccaaaggcuaauuucacaaaaugaaaacaguagauuaaaaagaaagauaucccaaaugagagaggcgcccguccuggagagucugugggaaguuaacagccaagaaauccguguagaccagcaggggauggggccucuucuuccuauaaacuguuugugaucc

SEQ ID NO: 8061 - RNA, 6700 nt, Mus musculus
ggaaguccguccugacuagcggccguuggcuuaugacgccuaacucgcgugcugaggcuugcgacccgggcccugcgacuuaaguucugugcgggccugagaagccggucagguggcgacgcugcaggccugauauugcugagauugugaccuggguuccuccggcgggauuuggagcccggagucucucgguugcugcagccguggccuacugcuguacagaacccagggcgucucucaaggcggacguagcuggugucgggaccuaggcuggugucggggcaugacuauggcugcgggcccaagcucgcaggagccagaagggcuccucauagugaaacuggaggaggacugugccuggagccacgagguacccccgccugagccagagcccagcccggaggccucccaucugcgauuucgacgguuccgcuuucaggacgccccggguccccgggaggcccuuagccggcuucaggagcuuugccgcggguggcugcggccggagaugcgcaccaaggaacagauccuggagcuguuggugcuggagcaguucuugacuauccuuccccaggagauucagagcagggugcaggagcugcgcccagagagcggcgaagaagcagucacucuuguggagcguaugcagaaagaacuugggaaacugaggcaacaggugacagcuguuuuacccgugguuuggcccggaagucauugugcuagccucuucuguagucgaauauacuugaucguccugaguacacuuuacaggaaggagagggauuuuuuuguagcuuauccuuuccuuccagauuguucccauaugacgacaguaggaagugaggagcacuuccaccaguauuuaguuauguaguuagaaagcuucucacaggccucgugacuuugggcagacuacuuaaucuguuucguccuguuuuucuguuggcuaaagcacugucugggaauaauuuugaggacuuggagaaaaguaugucguuuggaugacaccuacugccacugcuuugagggguuuguuuugugacaaagucuuacguagcucaagcuaacugacucaguguguaguugagcuuggcugcagaacaguggugguccuccaccuucagucuccccaaauuccgaguucuaggguuacaggcagagucuagauauguagcccaggcuuaaacucgaggcaauccuccugcuucagccuccccacugcugauucccacaggcaugugccacuaucccaggccuauauuuaguggauaacacccagcauaucuuagucaauaguuugcaauacagaacuggaucucugcuaauugaacucugaaaaacagcuaagcaccgaggggcuauggucgcagccugauaaguucaccuuaucuaguagugaaacguggaagcaucuagaacaggugagugugaucgagcagaagugaggaguaucaauggaauauguugagaaagugugcauugagaguggacccucaguuuucuugcuccaucccucccccauuuucugcuaccaccuaaaaagcccuuagcauaaaacaucuucuuggccaagaccaaagggauagucugugguucucuguugaggguguguccuaagaauccuguacuaauuuccaauucugucagccccguugugaugaugagugauguggguugguucccaggucacaaaccaagggcggggagcagaagugcuuuuggaggagccuuugccacuggaaacagcaggagagucaccgagcuucaagcuggagccaauggagacugagcgaagcccuggccccaggcugcaggagcugcuagaccccagcccccaaagggacucccaggcuguaaaggagaggggugaggaacaguuaucugggcaggugggagggaggaggggcucugggauugccacucacccuagcagaaugugguacaggugccaaggagaaagaauuucugaaguuaaaguucucaguuguguucugaaaaaccuaaaaguggugguaugaauucuguaaagguuggaugggaggaaaggggaagcucuuaguaaagccauucuguguacagaacaggcaaauucuaguuagcugauugaugugggguguaugguuagaacccugucggccaggauggaggauggcucacaugccuuuacuauaacccuguuacuuuagaucaccuuagcacaccuuugcuacuuuuuguuuacugucaauccuaaaagcugagacuugcaguuggggaaugcauauugucuuauaaucugggcugcuaagauuugguguuacuguucucauuauaauuucuguuaucuuuagcauuauccgcucccuggcucucucucuucccuccugaagggaauguggaagauaaggauaugacugggacccaggugauguggaaguucucauugccuuuccccagaauuuuccuuuucuccucugcuuuuagggugggagguuccccuaugcuacuagaaagauuuuuuuuuuucugaucagauaucucccuuauuuucuuugucuuuucaacccaucauuuguaggcuucccccaugacaugaguuuucuuggcacucauguguuuuaacccauuuacuaugacucugcuugaauuauucuuaaugcguuacugcaugugaugcuaaaggagaucuuguuauuucaguugcccgagagccuggaggacauggcaauguauaucucucaggagugggaccaucaggauccuaguaagagagcucuaucaagguauaugguacaagauagcuaugagaacucggggacucuagguaagagcuucucguucugggaugauauuuaugaccagacuauccugcuucuuggacauacacaccuacuggacaugagcucugaguuuugucaauaaccccacuccuuacucuaacauuucuuauccuaauauucagauaaacaucugccaaauggcacaguugauagacuuaaugguauccuuagacuguguuuccauuguuaagaguuuaaagcagagagucugaacuggagagaacuuccaaaggcaacacaaauccucagcuucucuauguguaugaaaauucucauaauaaaaaaauggagguaauggaagguaguguggacaguaugauugguuauauugaagcauacagcaggaagaaaucacacugcugguguuuuccuccauguuuguaugaggcuacuuagagcugugaauucaccugcacugaucgugcagagcuacugcuggcuuuaguuuucuuugggaucuccuggguuacaucacuuuccauugcuguaccagcgaugacgagagauuagauugcuggagcugagcuucuguuugagucuguuuuguuugcgguugagugaguuguuggcuucucuauuuagcauagcaccgguggauuuaaaacuuuuaaucucauugucuucuaagagcccagguucuuucccaguugauuucaugguuuuuuuuuccccccagaguuuuacaguuaaauuuaguucuaccuauaaguagccaacacucuuauuauaguaaguugauucucaaagaagugauuauucuauuuuauuuuuauuuauuuauuuuauacuuauuugaauuacaaaguguauauucuaguuuuaaaaguucaagguuuuuuuugggggguuuuuuuuuuuuuuuuuuuuuuuuuuuuuuuuuuuuugguuuuucgagacaggguuucucuguagcccuggcuguccuggaacucacuuuguaggccagacuggccucgaacucagaaauccaccugccucugccucccaagugcugggauuaaaggcgugugccaccacgcccggcuaaaauucaaguucuuaaaaaaauauuuuaaaacgcauggucuuuuguaguaccuuuuuccucaagaguaacuacuagaaaugcuuuagugugacucccaaaugauguauaucagacucagggagaauuuguuucucucugauccuggcaggaaacaaggcucuguuucuuuucucuacuuaguguggugauggguuuguuucauugugaacagaguccagcauucccagucaggaggucucaagcacccacguggagcaaggagagaagcugugggauucaaguguccagaccugcaaggaaggcaugaaccccagaaacccaguuccagguaagaaguaaagauaaacaguugcucaggaagacucccaaggcuguaugugauguguggggauuugagugaauggccaguguugcacauggggagauaacagccucuuugucuccugcaccauguucuaccagcaaggugaguggggaaugugggcugcgaauuugaggaggugcuuaaucuugagcugacuugcuacauucuagucuugauucauaccaggaggggaagagcuaguuggaaagugaggugggggagcuaaaaauagaaagcacugagucuuugaaucucuucucuacgugcuucucugucaugcuuuacuuaaaaggacuggcugggaaauugagagagaacucuguucucugggcauuuugccugaaaacuauguagggauuuuuuuuuccucuguaaaauaaucuagggcuuuauuuuuucucucuuacuaggaguggaaaaguuugagaaccaagaaagaaauguugagucuguuucuccugaaaguacccauccuccaguacuauugccuggccaggcuagaagggaggugcccuggaguccugagcagggaagacuugaugacagagaaggacauugggaaugucccccagaggacaaaauagaggagucuuuagugggaaccccaaguuguaaaggacuggugcaagcaaaagaacagcccaagaaacuccauuugugugccuuguguggcaagaacuuuucuaauaacucaaaccuaauuaggcaccagagaauacaugcagcagaaaagcuguguauggauguagaguguggugaagucuuugguggacacccacauuuucugucacugcacagaacacacauaggagaggaagcucauaagugccuugaauguggaaaaugcuucagucaaaauacccaccucacccgccaucagcgcacccacacaggggaaaagcccuuccagugcaaugccugugggaaaagcuucucuugcaacuccaaccucaacagacaccaaaggacacacacuggggagaagcccuacaagugcccagaguguggggagaucuuugcucacagcuccaaccugcuucgucaccagaggauccacacuggagagaggcccuaucgcuguagugaauguggcaaaaguuucucucggaguucacaucuuguuauucaugaaagaacucaugagaaagagagacucgacccuuucccugaguguggucaaggcaugaaugacagugcccccuuucuuacaaaccacagaguggagaagaaacucuuugaauguuccacuugugggaaaaguuuccggcagggcaugcaccuuaccagacaucagagaacacacacaggagaaaaaccguauaaguguauccuuuguggggaaaacuucucucauagaucuaacuuaaucaggcaccagaggauucauacaggagaaaaacccuauaccugucacgaguguggagacaguuucucucacaguuccaaccggauucgucaccugagaacccauacaggagaaagaccuuauaaauguucugaauguggagaaagcuucucucggagcucacgucuuacaagucaucaaaggacucacacugguuagaaauuguaggauuucuuuuugccucaguuuuggcagaaaacugucuuauccagagcugauauucuuugcccacuuugguguauuuugcugguaauuaauauaaagagaaaaugggacuuauuuuaagggaggugcagaggugaaaaacuagcuuaaaacuaaaaaguucagucuucagaagaguuuaagguucuugagguagccugcucagggaugguuuccuaugaaauccauccuguuuucagaugcaucaaccuuuauuuugacccagguaugguuuggaugcuguauaagucuaguauuaaucgcaucaauuuugaggauaccucuggcuucaaccccuuauuugugacauuaagcaggagaguuugggcuccugaggcccuugagaccaaagaagggcuagguccugggacaccaauuuaaggucaacaagcccuuaaauuuaaggucaacaagaccuuagguuggguuggggaguaggggguuggguuuuuuguuguuguuguuuguuuguuuuuuuguuuuguuuuagggcccuggcugggaaguccugggcaguccaguucugccacugcaacaccccucugaguaguucgacaggagugcuuauugacauaagaggugaccucagaaaaaagggaacuggagagauagacaguuacaauguggaauccacagaugaacucuguguuuuacagauuaaggguaugugauuacagucuaccuuucuaaagauuugagacuuuauuccaccugucaaaagguaccuagagcucuguagacaugauuaugaguggaggguuccaugauuucaucagauacaaaaaaaaaaaaaaaagauccuagagaaaauaggaauuaugucuuucucuguugacaauguuuggaggauuuauaauaaauaucuccaaggaaacaugaau

SEQ ID NO: 8062 - RNA, 15287 nt, Mus musculus
uagcucuugcucuugcuccuuugccugcuugcugcgugagacugaguaacugcuagauccuuggacuuccauucacagcugcgacugaacaauuguugggaauucggcugccgacuguaagucaucaauaaauuccuuuacuauuuagagauuauccauaaguucugugacucuagagaacccugacuaauacaccaggcauggacaccaguggagcaaugggaacacuaaccuacucacaaaacuuucaacccaaaauuuauccugucuacaagaaauguaaggauggugauggagcagagacugagggaauggccaagcaauaacuggccaacuugaggcccaucccaugggcaagcacuaaucccugacacuauuaaugauacucuguuaugcuugcagacaggagccaagcauaacuguccucugaaagguuccacccagcaacugacugaaacagauguugaggcucacagauuaacauuggauggagcuuggggacucuuauggagggcuugggggaagaauugagggcccugaagggaaagagaacuccacaggaagacuaacaacagaaucaauuaaccuggacccuugggggcucucagagacugaccagcaaacaaagaacauacacaggcuggaccaaaucccccacaugugugggagauuuggucuucaugugggucccccaacagcuggagcgagacugucccuagagauguugccuaucuguagacuacaucccccuagcugggcugccuugucuagccucaguuggagaggaugcaccuggcccuguggagauuucaugugccaguguggagugauacccaagggugaccuccacucucucagaggagaaggggagggaagaugggggcagggacugugugaggggugaccaggauggagggaagcaaucgggauauaaagugaauuuuuaaaaacuaguguaaugauguguccuccuagcucacuaagagugaaauccccgugaaucucccuuugguggcuggcuggucaguucacaacuagugaacuagcuagugaggugcuagugguggggggugcacacccagacccuggagagcuuuguuuaaguguacuuguugauuuuucauucuaaagcuguuaucucuuccauacuccuucacauuugcucuuccugugucugcuccaucuuuauaaaggacacuaccucuugaugacucugguugucauccuuauauggccuuugcuuucacccugccauccuccaucaaucauagccaacugaaugauauguucuugacugccuucagaaugcagcuucagaaucccgccacgucuuagccucuugcacuaugaacauuuuggccgacaucagcaauuccuggagccagguacauuucuggauggcacucacaacuccauucuugcccuauuguacccuuuaauauuuuaacuguaccauauuauccacugauauuuuuaaauccugugauggcuuuucauauucaagaugaacugccagcccuuugccacagccuucgcacccugcacaagccagucccccucuguuccuuuuggccuugcuguuucuucauccuccuguccugucucuucgugcacucgaucugcucauugccacccuccuguagccucuacucagcucucuaggauccugguuucucacuuucaaacucuuaaauucugcggaguucagagcaacacucaaagggaagaaugcaaccauaucuguuuaucaauugacaauucauagaaacagaugagcuuggggauugguagacacuguucuuauuuacaauggggaaacuauuucugggagcauacuugcaaaguugucccuccucuaaugagagaauccacauauucaauauuuuagagauguuuauagacaaaacugagaaauuuccccuggcucucuuacucccugugccuacucagcaaacauggcuguuguggcacuaacaugcaccaaagacuagagaauggccccuuagcucuuauugcccagucccaggugaacuuuucaguuauuuagggcucccugagcuucaccuuaucuuuucucagacccacucugcucagcaggaacccuuagaugucugagcaagucaguuugcuggggcaaaauaccugauagaaaguagggagaaggacuggcaagauggcucagugguuaagaccaccgacugcucuuccaaaggucccgaguucaaaucucagcaaccacaugguggcucacaaccauccauaacgaaaucugaugcccucuucuggaguaucugaggacagcuacaguguacuuacauauaauaaauaaauuuuuuuaaaaaaguagggagaagggacuuacuugaguuuacaguuucaaauuuucauuuaugaaggggggagggguuggggauggugggggaggggcaauguggcauagcgaaaugggucaugucaggaugacuaggaaacuaagaaaauaccugugguugaugguagagugguuugaauuguuuggcccauaggggguacuguuaagaguuauggccaugugggagaaaauacguggggugagcuuuggaggucuccuccuaugcucaggcuccaaccauugcaaaagagggcuuccuccuagcugccugagggugacugucucuccaccuugccuuugaaucaagaugcagaacucucagcucuuucuccaacacuauuucugccugcaugcugccaugcuucuccucauaaagauaauggacuaaaccucugaaacuguaagccagccccaauuaaauguuugccuucauaaaaguugucuuggucaccauguuucuucacagcaaugaaacccuaacuaagacagaaggccuucuccuuaucauuguauuccaucccagcacuuggccucagggaugauagcacucacauucaggacaaaucuucucccgauuaauuaauccucccuggauuugucuggacaggcucagccuuaugcuucuucuccuagcaaugucauagucugaccaaauuaacaagauuaaucauuaaaucuggugugguggguagugcaugaugcaaucucaagggaguuaguuaucagccugguuaggaucagccugguugggcuucauagugaguacaaggccagucagagcuacauaguaagaccccaucaucaaugaugaugaugaugacgacgacaguggcgguggcuauggcugugacagcgaugacaaugaugacaacaauaguaauagagaaaaagaggacagggguaugauucagucaggcaaguacaaggaccugagucugaucccacagaaaccaccuaagaacucaaguugggcaucauguguuugugauuucagagcuggggaagcagagaaaggaggaugcuugggcuuucugcucagccagccuagccuacuuggugaacuccuggcuaguaaaaaaaacugucucaaaaaacauuaaaaagccgggcguggugccgcacaccuuuaaaaucccagcacucgggaggcagaggcaggcagauuucugaguucgaggccagccugaucuacaaagugaguuccaagacagccagggcuauaaagagaaacccugucuugaaaaacaaaaacaaaaaaaaauuaaauaaauaaguggagaugguccuaguuaggguuacuguuggugcaaugagauaccauggcccaaagcaagcuggggaggaaggguuugcuuggcuuacacuuccacagugccauuuucaccgaaagaagucaggacggaaacucaagccagacaggaaccuggagacaggagcugaugcagaagccauggagggaugcugcuuacuggcuugcucagauugccugcuuacagaacccaggaccaucaggccaagugugguaccacccacaaugggauaggcucuccacaaucaaucacuauuuuaaaaagguccuauaggcuugccugcagucugaucucagugaagcauuuuucucaguugaggcucccuccuuuugaugacucuagcuugugucaaguuaaaugucacauaaaaugagccaucgugguggugucuccucaaaaacaacccaggugguucucugaucuccaugugcacuuguacacacauuaucacagcauguuacuguagauauucauccauggacaacuaaacuuggcucaagaaaucagacacuucccacgcuaugaacugauucccuccuccugcuuuucuguuaguuccuauaaagcuuggccuacuacacaguucuuauguccagucagugauggcaagcacggagaugaaguccauucaguuuagaacuuguugauauuugcaaacuauccaaggaaaaaugggaguuguugggucccauuugaggcucuccucuccaaugauguaaugcaggaaaacugcaagucugucaucuuuauaggagaggaucuucuuucuuuugcagaguucagugaccugucugggucacaaccaccuguaauggauuugaugcacucuucuggugugccugaagauagcugcaguguacuuauauacacaaaauaaguaaauaauuuuuaaagauaaaaaauauuauaaucaucggggggaguaugcauguauaagugaggguucucuuggaguccagaaaaagguguuggaucuucuggagcuggaguuacaggugauagggaguugccugaugcaggaggugagcguguauucuauccgagagcagcaaguucucuaucgcuauacuaucucuccagcccugcuccauuacuuaaauuaagaauauaauguauugccaggcgugguggcgcacgccuuuaaucccagcacuugggaggcagaggcaggcagauuucugaguucaaggccagcuuggucuacaaagugagugccaggacagccagagcuacacacagagaaacccugucucgaaaaaccaaaaaaaaaaaaaaaaaaaaaaaaagaauauuuaugccggacaguagugguacaugccuuuaauuccaacacucaggggguagagacaagaggaucucugugaguucaaaaccagacaugucuacagagagaguuccaggacagcuaaagcuacacagagaaacccuggcuugaaaaaacucuaaagacaaacaaacaaagaauauaauuuauauuccuuucuggggcacaaggaucucuagugguauggccucuccuuuauucaugcccauauucagucuucuuuagucacauuguuaucuguauucccuaauccuaaagugauuuucuauuuggagcaaggaaaagagccauggguucaggcuucucagacuucaaagacagacccauagauucuccugcagguaaucagacaagagugggcaaaggggcaugccuugaugugaaccuuuacagggacuuaaccuuuuaauauuuugcuccucuauuuuauuuuauuuuaguguguguguaucuugguuucaugauuuuaaucauuuaaaauuauugaauuuugauuucuacuccuguauguuccuuuuccuaggugaguccugugcuuauucauuccuaaaaagcuaaaucgagaaaaaacaaaaacaaaaaaaccugaaagccaucagccuguuccucuuucugaccuagacauacaagcacugagugcaguguuuaaaaaaaaaaagcccaagugccaggcaguggugacgcacgccuuuaaucccagcacuugggaagcagaggcaggcagauuucugaguucgaggccagccuggucuacagagugaguuccaggacagccagggcuacacagagaaauacugucuugaaaaacaaaacaaaaacaaaaacagcccaaauggaaguuucucagaaaguaauagucaaagucuuagcaaagcacgcaggguggggaaacagcaaugagacuguccacuuaaaaaaaggaaaaaauuaucaacauggaaacaagugcugcugagacuucuggaucuacacaagagaguacccauuuaaaugccagaaaugugggggaaagcucggaccuuauuaaccaccaaagaacucacagcaaagaggaaccuuuuaagugucagcagugugguaagagguuccaauggaguuucgaucuuaauaagcaccuaaccacacaccaagguaauaacaacagcuaaguguucauggcaugggaaaagcuucagucagaauacaaauccucacacacagcacaggacucgggagagagagggcuuuucccuguuaugaguucaggaaaacagccagaauucccaccuuguuaaacaucagagagcacacacaggugagcagccuuagacaugcaauaugugcaagagaagcuuuugcagauggucaugcccucucagacuccagaaauaccaccaagaaagagaaacguguugguauccucugaagaaauucacccaauagagcuuggaucugaaguugagaaauucuaaauuaugaggcacgaagaacauuucaucagauauuuuggaaaugaaaacacgcuccacagagaguaaucaggguuugcucugcagggaaacucuguuacuugugcuagcugccauuuuuaguuagacaucucagaaaugcuuagcaagaguuuuaagagcauucuaaauaagggaaagagcaauuuggagauuguaucuaggaaauacuuauuucaauuuuguauaucaaaugcacccaaucuguagucuuuagucacaguacuaaguauuaguuuuggaacauacagacuagaagcauuuggagcauagacuucuaagaaaaaaaguauuaacauguauuuauguuuuuguggaaaccaugguaaugaaucauagcaaugaauuuaaugucaauguuucacugugaaauuaauucucagaucaauuauuaauuuguaugauaaagccucacucuguaucccaauuuggccuugaacucaccagccuccugccucagccacccagguacuggaauaggugugcaccauaacuaauuuggaacauuuauauuuaaacauuaugugacccuaaggaguggggucaaaggaggaguuuaaccgugcuguuugcuggccuuguuuauccaugauaaugcugauguguguguguguguguguguguguguguguguguguguguguguuucaccuacugccacaaaacaguucucugugaguaccaccuggggugaugcugauccaauucauccuucuugauaauuacaaggaaucaaaggaauugaguaaaauuggauccaaugucaccuggcaauaaaguguugguccaauguucacaacagcuuagugggcaaagguaucagcagcacacagauucacaggagaagccucagaucuccugacuagauaucguugacagauaacuggaagcuguggauccauccuuuagaagaugacaugaagacuucuccgucaaagacugauucagaaggauucccuucuccaaggucaauacaaccaguucugguuaguauauuuaaaaaacaaaaaacauugaguaugugugugugugcccuuccuauccugccacccuaagacacagugcacaaguagagaaaaaaaaaaaaagaacaacagggguguaggauuguguguguguguucuccuucuaccauguagguccagagguuuucaggcuuggcagaaacugccuaaaucuuuccugcccuucccaccuuaggacuacaaggacuacaaaugugcaugagaugccacucccagucucuguggugcugagaauggacccacgccccugugcaggcucagcaggggcucuaccagcugaaccgcuccugaaccgucuuccugugucuuuuaauuucuuaauagcuuacuuaaguguggaauaauuuuuuuugucugaauguagcaguagaucuauucacuucuuugagaauauguugguuguuucuaaguuuuggcaguuuaucauugguuaaccuuuaacugcauuaaggggcagacuuaaggacuggagacauugugugagcuuuucuaaacagaugacuaucucuugguggguaaacuuaaggacuggagacauugugugagcuuuccuauacaaucagagaacuaucucuuaguacaccuugcagugaggcaaauucuagguaaagaacacauuuacuuaacuuuuuacaacaguggucauuuugagcuaccacaaaucuuacagcgccagauccccuuacagaugguugugagccaccaugugguuguugaaacuugaacucaggaccuuuggaagaacagccagugcucuuaacuaaugagccaccucuccagccccagcauguuuucuuaaucugugccuuguauucucauugucuggaccuuuuuuuuuuuuuuuccagagcauuuuuaaaaaugcaaaaccuuuuugagcaugaacacuauguucauaucauggcuucuagcauucguauuguuauaugugcaugcagccuacugaguugauucucugcugcuucacagcuggggaggacuaucgguugcuugucuuuccuggcagcucucauagcaccuucaggugcuaugagagccuggucccuggucccuagucagguccagcucaguuccuccuaguccuguaucuaaagucucuggugucuucagcaauauuucguaccuuuagcuucuaggaggcagccaagggcauucauuggcaggaaccuguauuguucuggggagucucuuagacccuuaccaacagcucaaaaggagauugagggagccuguguaagaaagcugugaacuaggauggggaaggaugcagauguuguaccacaagguggccuuccagaaagaaugguauacuuugacaagugaaugcaauugagagcagggacaugaaggggaugccauggagcacugaggagccugggcaagggcacauggucucugugggaaaggcagaggccugacaagaaauauauguggaccuuuucacaugagcaaagaugacgacacacaacaccagguguauucccucgcuuuacuuguguuugcuuaagcuaacuguaaaugucacuuauguuuuauuugaguaacuaaaaaugagaugugcuuuguucguacugaccucagacaccuggagcacccugguaacuccacuuauuuccauuaauucaaggagacuuacucucaauggcuggggcaggucaacaaagguagucugugguuguuguuguuguuguuuugcuuugcuuugcuuucauuuucuuuugugugcuuuguauagguuagaagucaguuucuuuuuauguuguuugcuuguuuguuuguuuguuuguuuguuuguuuuucgagacaggguuucucuguguagcccuggcuguccuggagcucacuuuguagaccaggcuggccuugaacucagaaauccgccugccucugccuccugagugcugggauuaaaggcgugcgccaccacacccgacuaaaagucaguuucaagugucuuccucagucacucuccaccuugcuuuuugagauagggucucucacugaacuugaaucaauugagcuaggcugacugaccagcaagccccagagauccuaucucugccucccuaguuccgggguuaaaaacaagcacuaccauaguagugguacaugccucuaaucccagccuggagggcagaggagggcagaaacagacagaucucugaguucaaggccagccuggucuacauagggaguuccaggacagccagggccagggcuacauagagaaacccuguggaaacaaaaacaaaaacaaaaacaaaauaaaaccaaaacccaagaacaacaacaaaacauaugcuguugcuccugacuguuugcauggguacuaggaaucaaacucaugcuucuauagcaaguguuguaccaacgagccauuucucagccugaagagaacaauuuuuuuuauuaaaucuagauuuuucucaugccuucuaggcaucuugucauuuauaugccugugacauuugaguuaacuucuucaaaggguguaaggucagauggugucaguuuucuaacucccuucaguagagucuucaggauucugucuuugccuuuguaauuuguaauguugccuuccaggcuuucauuacaaauucuagaacaaauccagcccaugccggauacuacacacgcauagccuagcaaccagugacauuguucuuaaagcuggggguagaagcuuuaccaugaaacuucuuguguagaaagaagagccaaugacagaauuuauuccuuagcuacaucacugaacuguaaaaucaaguaucacuugaggccuaugccugcccuggacuuucuagcuccauggguucuaugcacuccauuuauuguuaaagcuaauguguauuggaaagaucuguuaauuauaacugaaagaacccauaaaacauagaauaauaacuaacuuauagaugaaaaucccauuucuauaccuaucuaaaagguuuuuaaaaggaauuaucaagcauacauacagguaguguaaugaaugcucuguaugccucaaauguuacauugacauggaaacuugauuuaagauuagcaauauuucucaaucuuauucaaucuauucccucaggguuaugguuuuaauuuguugugaggguguuguuugcuuuguaguauuuaaaacaaaccccagacauuacauucugacuugucaauacuuccauuuaaaagugagaauguaguauugacaacucaagccuuaaaugguuuuuugagaaggaauucucacuaggcagagcccccuuucccacaaggacaagauugaggacaaaggcagccuuucucuuuucuagauggcuuuguaagaggacccucuuggucuccugccugggguauucauuuaugagaacaccagcuaucccaaaugucucauaaugagggauuuccagaagggauacuagcugucuguaaugaucaccaaagcaacuuauuaguaacuugaaacuacaugaucuacuguugcacuuuuaaugagccccauagugacucauucauuaagaauucaguacccuugguuaauugcugguuuccuggaagccuaaagaacaaaauaaugacauucacucuccaguguacauagaacaaguccccaggagcucaguauauacuuagaauaauuucucauuauccacuuauauugacuguaaguaucuuuuuaaaaauaauguauaaaugauuaaacauuaaacuuucaauguaauuuacuucucucuuugugcucauacaccauuauacuucauaguuuacauuugucugucauguuugugugacuacuaagaaaaagaugaccuguaaauuuaauauuucauccuuaaugaagaacucaccuauccuuuagggugaaugugcauuccagcccuuauuccucuuccugggauuauucuaaaguagucacuuagagcaacacccagugugccaccagccaaaaggcuucauacaaacgucucugaaaggcucuuuccaaccagcuaauacuuaccauagcuuaugauuuaucauuuaggaaaacauacuuaucuaacuaagaguucauugcaacuugaaucccuagugcuauaagcuagcauuuauuaccuuccauaauucccaaauuauuaugcacuuacuuuugcccgacuauuuugggggggggguuguuuuucauuguuguuuuuucuuuucucugccagaggauauuugcuuucuaaagcuuccugaaagaucuaacucuguaugucgauucagucauucaauauuuuaaaauuuuacugagcacuuucuacaggcuagacauauuuuauauuugcaaacauagguuuggggcuuucgcugguuaguuguugguuggugucaguggguuuuguuuuuuauuuuuuguuuguuuuggcuucuaaagaaauauguuuugauuuaacaaaaagagaacauuaucuaagcuucuuuguguugcuugauuaaauaauaagucugauaauuguaagucuuucauuuggcucguugaucugcuuuuccagucaauuucaaauggugccuuaucuuuauuuccaguuuccccaaauggaauaaggaaaacaucuccauauauauauauauauaauauauauucaguuuuuuaaaagaauauugauuggauuggcuuagauucuaccuuuuuaaaaguagacuuaaguauucaugucuguaagacauaccaaaauauuuacagauuuuuucaaaaaaaaucuugcagacacagaugcacacaauuagauuauuaagaucuuaguaagacacagagacacaaaccaaacucuuaacaaaacuguagucacuuggccuauauguaguuaccacauccuccaauaauggagauggauccggaaaaaaaaaaaaaaguguuguucggugacuuuguccuugugcaagcaucaaaauguacguaaacuaagguagcaaagugugcuuagauuauauaauuuuauugggacacaguccugcaaguguucugugauuggcugaaguuucacaugcugcaugacuguucucucuacacuaugauugguccccagaaagcagaaagguugucacaagcagcaauauuuaaaacuguaugaugggaagaggaugcagugcauuggugaaauagcugcuuagaaugugcaagggccugaguccaguugcuuccaucuuaaacaagcaagcaagcaagcaagcaaugaguuagucuggguagugcucacgguagugcucacgguagugcucacgguagugcucgccgauauucucaacugcuugagaagcuguggcagcagaaucacaagcucaaguccugccugggcuacaaaauucauuccaccuuggauaaccugaaaauaccuuuccucuaaguggggcuggaaaugggaggaagacaggaagagcaccugccuaguguggugaaggcccuaguaccacaaaaaaaugaaaaccauauuaaagauacccaauaauaauaggcaagccaauuuucaacagaaccaaauucuaaaaugauucaaaaaauauauaaaaugguuuaucagcauacagaaagccucagacucaguagccaccaggaaagugcaaaccagucauugaaacuucacacaaacuaguguaguuguaauaauaauaauuuuaaaaagauaaaauauuggagaaaucagaacacugauagaguacuaaugggauaaauaugguaguaaacagucaaggggcuuaaaaaggcuaaauacugagggauguguggcuucaauguggaacccuugucuauuguaugugagccccugggcuccaucccuagcacuagggauaaagacauguagguagagaacaugcuuguuugcuagcccaacuaucccauugcuuuccaaagugaaaacaggucuauauaaaaaugggccuccacauuuggucaugguggcgcacacuuaugaccccagggcucaggagauugaggcagacaccugcugugauuucaagcccagaauggguaauagugugucucaaagaagauacaaaaccaucuugccccaaaguauaagcaguauuauucacaguaagccaaaaccaaguacagcucaaauguuuacugauugcugaaugaguaaauaaaaugcgguauaucacauauggugaaauauuauucagcaacuucuaccauggauuugaauugcauacaguguuuucuaauucacaaaugcuauuacucuuugcaucccauauaaggucccauaaaugauauacuauauaucacauucugaaacuguuucuacuguuaccuuuuuagucauacugaugucuacaaauguuacuaaugacagaauauuuauaugcuacaacucacucauuucccauuaaauugauuguuucuccuuuuguguuuuauuuuuugagacuauguagcuuugaucugccucuuuuuccuccaugauccuccugccucagccucccagccauuguaacaguuuucuuuauagcagugcagugauguuuccccagacccuccaugcagaucuaaaggcgcuucuuugacaaaagugaacggagugaauucaggugauguuuaaacucuggaugccaguuuccucaguagcaagaugaggaguacaucauaaaugguauacaacauauaugaagcacuucauguauuccuuauaagccuuaaguuagauuuaugacaguuaggcauuuauuuuagcucauacucagaggacccuaauauaccucucaagccccacgugcaagcuucuaacagagacauuggcuacccuugcccucuugugucucugcuauugaacucacguccuuccucucauuacuguccucccuucugcauuugcuguuucacugaugugauacuccaguuccuccaauagaagcuuccagaacugcugaaauacuuaugacccuuccaccccagaguuacaaccaugugagucuccuguugccuucaagacuggaauccugcaggaaagaauccagagucugcugcugugguacggacagacaccugugguauugcagagagcagggcuccugaugcuaggaugcccugaaauuugacuguaguugggcucucugcauccuccauuccuuuguccuguuucuuuucuaauucagauuuccauuagugagcaaacuaucuauucuuccaaaaacauuucuuuucuauuuguuucaaacaagguuugucuagaaccuaaaucaguuugugagccaagacucugaugcccuuugaaaccauagaggaaagcucuuuauuggcuugucagccugcuuucuuauauaccucgggaaccccuuuccagguguggcaucacucacagggaugauccuacaucaauugucaaugaagaaaaugcccugcaggcaugcuuacaggucaacuggauggggggcuuugcaggaaaucauagaauuggccuggucuugaauccuugagaggcaccugucauacauucuucagauuagaguucuuggcuccuggagcaccguaugccuuucaguuccugagaaacugaggcauucccucgggcaguggagcauucaggccaccuguguaucucuguguucccuagaagucagcaaagcauguagaagcuugguugggcaauuagucuuagaccuuaaucuuguguacccuguagaacuugcaaaugugauuguauccugacaauuauaacuguauucuuccuagcaaccacuaugguauucuguuucugacauggguauaaaauuucuaauuguuuucaauaaacuugucucauccugugucaguga

SEQ ID NO: 8063 - RNA, 941 nt, Mus musculus
cucagcuggcuccucuuccuuuccccagcaaucuucccagggcccccuucacuucuuuguuucuuagaguauagaugagcggauucaccaugggugugaccacagaguagaagagagaaaugaauuuuccuuggcuuugauuacugcucuuagcuggaagcagauacccauagaucgcagagccauagaagagaaacacuaccaccaagugggagacacacguauugaaagccuuucgacgucccuccacagagcggaucuucaucacugccugagcaaugaagcaguaagagaccaggaugacgcuuacugggaccacagugaagaagguacaaacaccauugagcaccgccucauugagacuugugucuccacaggccaauuuaaucauggcggguaccucacacaggaaguuguccacuuuucgguguccgcaaaaugggagcuggagagugaauguugacugaaucacggaguugccuaagccacccaaccagcuaauagcagccagcccccagcagaggcgaggauucaugacggucauguagugcaggggccgacaaacugccacauaccgaucaaaugccaucaccacgagcaguaugcacucaguagcccccagccaaaggaaaacauagaguugaguuacacacccaccauagcugauugucuugucuggcccccauaaauuuuucagcaucugagggacugaacugguaguaaaggcaaggucuagagaggagagguugcugaggaagaaguacauggguguguggagccgagcaucaaggcgcgaaagcaggaugauggucaaguucccaaccagcgucaacaaguaagaggccaggaugacagcaaaaaagaugaucuccagauggggauggucagagacacccaucagaaugaagcucccagaggagcuguugcuguccaccuccauc

SEQ ID NO: 8064 - RNA, 13513 nt, Mus musculus
guuagcaggagaagagaauaacagauuuauuugaccugggccuucagauugaggauggaaauacccauggugaauuccguucaucaaagcaugggcugugguguagagauagucagacaaacaaagcguauucucuucuucuaauggagugaagguggaagacacagugaggcccaucugcguagacuccucguugccucugcagcaguuccucuucuggcacuggauaggacucuucuggaggagaggauuguguuagucuugucauugcuauggcuaaaauaccugagggaaacaacuuaagaaugaucaggguuauuuuccacguuguuucagagguuucaggacauuguggcagagaggguuugagacggcagcucacaguccaguggacaggaagucaaggggaguaguaaccgagaaggcuacaagcaagcuguuuccccuaagggcacucccucagugaaccacuuccuccagccaagccccaccuuuccugauucuacacuuccggcgagccugcaguucccaaugcagauugugaaacugucaaugucuucacagacacacccagaaauguacuguacuuccuagucuaaucaaccugacccucaagauuaacagugagugguaauagaucuauugucagacaagacuggacagagaaguuuuucauggcuaccuaugcagaaaaucaggauggcuuuagaggaaaggaauucuucugguuucugugguccauacuggaguagaagaauucuagguuacaagugagaaugagaaauaagagguaggaggucugagagauuuacccguagaccuucacuuuggguggggaucauuuauuaccuccccaaaauacuaccaaauaauuacugucagcaguuuuauuggagugaauuauuaguaccugugggcuccuccguuuuuccuugccuuauuuuuagauuauuuuaugauaaugaaaaaacagguuugggguuuuuuguuuuguuugugaggaaauagacaugaacuuuaaagccucaaggcuaagcaaggugcuguauuuaagucgucgguauuuccugaguacucaucucacaucuguugcuccaugccggcagagaaguaggggcacuccccacucugcauccguguugaaauauaaacugccaacuucuuaggaaugugggcuaacagugcuuauuauguuuuauaagaugaaacaaacuauccaaguuagcaauccugggcuggagagagaguucagugguuaagagcaccgacugcucuuccagagguccugaguucaauucccagcaaccacaugguggcucacagcccucuucuggagugucugaagacagcuacugugugugugugucucugugugugugugucuguguguguguguguauuucuuuuuuuuaaaaaaaaaguuagcaaacccacuacuaaaaaguaauccuaagagugcagcaagcacagaaacaaggcccugcugagggauggcuuaagguuguauagaucuacauugaguuagaggccuguacaccucucaggugccuggcugucagccucucuaucacuuagucaugugucguguccccacccaugucuaguaaggaauuguaaacccuagucuacauacccaugaacuuuggcucuuccuugaaucaccuugccuagucuucagggccagaaagacucaaagaggaccauuuucaguagucauuucucuccaaccaccauacagguccuggguauugaacucaaguuuugaagcuuggcugcaaacaccuguaccugcugaaccauuuuaccagcccucauagaauuccucacagaccaccuaaguauucacaggucacuaagggcucuaaggucucagcucauacugaggagcaggcugccgugugcuaucccuccaggaacuauucuguggagacgauuucguuggaggguuccacccuuucacacaucuuuuacauaaaaaauucccacaugggcagguagcuucuuugagacuguaagugauaggccagguagccugggucccucugacucaccugaguaugcucucucccucagguacccagacucaugguaucgugauaucacauccaacaagaaguucuucucccuugcugcaaccuacagaggugccauugugggaaugauaguagcugaaauaaagaauaggaccaaaauccauaaagagguaagucugugcuccaaaagcuuggccuugugauggcugaaagggauguuucaauggggucacauugccagcgcuggccucuguucucagcagcuugugaccagaggggucagaguagcaagucaaauaugucuguauguggggguauauacuuacaaaaaccaaagaggaucccccuggagcuagaauuguaagugguuguaagaugccacuauuaaacucaugucugcaagagaaugcucuuaacugcugaacucuuucuccagccuguauuuuuguucauggaauaauauaaugaauaaguccacuaguggaccuaauaaggugagcauuuugaaguaagaacaagcagaaaugacacguugggaaucugacccauugcugugugacacgcagaugccugugauuugugcuuuuggcacuguuacaggagccccaauaaugcuguaaucuguugaggaauaugcuagguuucaguuagggauuagugaaaauguauuuucuuuuuacucaauuuuguggacuacuuaaagaacuaccucagaacccucaaggauuugagcaauuacuaagugcagacuggaagacuuuaagugcagcuaaaaagaucuuugugguugauuacagugggguuucuccuguuaauuuugguuguagcaauggaacagaauuuaguuuaccacauucaggaaaggaacuccuaccaaccagcaaaugguuuuguuuggcuuaagguuauuuuuguuucuuuuucuuuuuccccuuccucccucuuucucuuuguuuguuuguuaguuccuuucuagacagggauucauuaguuagccugagacucagauccaccugccuuuccaucucaagugcuggaauccaagauguacacccuacacccagccugcuugagguuguuucuuuggaagugagggaagugaguuuggagcagcacccuggugguagagugcuugucuaauauaaaggagacccugagucccauucccagaggaagaggaagaaacaugucuuccuaagaucccagaccacugugugcacaaacuuuauaucuuagcacauuauuugggggaggugggguaacagauauuuuaguucugauuuuuuuuuguggggguggucuuuuguuuuuuucuugucuagcccagccuuuuccugauccaccaccucacaguguucauugcuuaggcagagagaggguacucgggccagcaucccuuggauauuccuuguauugaaucuguuucaccugcccauaccuuguuucuugaugaucccucccugggacuuuuuccuagugacugucuucuuccaccaugcaugcugucugagggccucaugauuauguuuacucuuuccauagacuugggggcccuucccugucuauuuuuugggcuaccaucaucagccagggcuucuguuaacuagagaaguaaauuuauccccuccccacauuugcuuuguccagguucacuguaguauugaguucuaggcagggagcaaggagcaaguccuggcucagcccaugccuaacauauaggagcuacuugauaaaugagaagcagaagagccaaguugcccaguguccuuucuuggaagggaagccuuacacaugcuacagcucucuuauucuuaagaggugggacuaucaugagaaacucauggucagagucgggacuuucucaugaggcauuuuuguccguaaucagauagauugguggagcagcaugcuauaguauaucucagugugcugcucugcucagcaugcagcagagcaggggagagcugucgucuaaauugcucuguggucaccggcacagcaugguuuccuuuauaagccuuuaaagcuuugcaccuggucuggcaggaugguucagcaguacaaaccagacaggcugaguuuaauuccuagcacccacguggaggaggaagagaaccaacuuccguggaugucuucugagcugugcuucgcaugugcccucuccccugacucacaaauaaacgucacacagcuuuccacuaauccaccaucucacagcaugguggcugucacugcuuguugacagccuagauaugaccacucuugacagucauuuuuuuuuuuuuguuucucucuuagggugcuaggaucagaccgaugaccuuauguaugccagacaugcaaucuacuguuaagcuacaucccugcucccagccauuggcuuuuagccuguuguaaugacugguucugccauaaagucccaguccaccaucucugagauguuccucauaagugcccgaacuguagcagccuucugccaacagggccugaacuuaaucguuugugugucaguggggcucuccuugccucuuuguuaucccccugcccaccuuguggcuucccaccucaggauaugcagaguggacuuguagauaugcagauggggucugucuugagccugugcacccgaguugcccuaauuuucucuaacucucucuuuaggauggagauauucuagccuccagcuucucuguggauacacaaguugcauacauccucagucugggaguggugaaagaguucaggaaacacggcauagguaagaagcagagaguucaugguuuaaaccaccccuccccuagccaguuaacacccuuguaacccaaacuagucacuucuucugaggucuucaucuuagaggacccuuagucucuucuuccuuaucccuauuuggggacaaauccugucuuccuguccucccagugugucucccuaggacaaucucagggaagaacagaccucccuuaccucuccuguugccagacauagucgugaucuauuggcaagauauucucaguucagaauaagaaacauaaaugaagucauggcacucugcagcauuuaucagacccuuuguuaucaaauuccuaucuacucuauagagcacacagcagggaguagcaguccucuuuuuuacccaggccugccuuucccacacucucuggguucugguuuacacuuuuugcuguuugaaagguuggcaaauguccacuguggucccagagcuccuccaggauacaucucuggcccacaguggcaugcacuucaugggcucuguguagcuaggaucuuuuaggggcuuuaauaguggaagguaaccagagguugguuacagaucugggaguguaacccucuagacuccugcagaagccaugcuugcuucuauguucucuuaacugcccugcugugggaaaccuucaucuccuuucccagguucccuuuuacuagaaaguuuaaaggaucauauuucaaccaccgcccaggaccacugcaaagccaucuaccugcauguucucaccaccaacaauacagcaauaaacuucuaugaaaacagagacuuuaggcagcaucacuaucugcccuacuacuacuccauucgagggguccucaaagauggcuucaccuauguccucuacaucaauggcggccacccucccuggaccauuuuauauccuuuacugcuggaagggaucaggagaaggcuuuaugauuuccuggcuagagggcuagagaaacuguggccaccuuugggugacagucaguggcuuagcuugcagcauuguuccuugauuagcucauaguaugggcagguuggguguaccugauugguugcauacauuaggaaagcuggcacucccuggcaacuacagcccagcaaggagguuaaguuuuaacucugggcccaggauuaauucauccauucaguauggaaaauacccuguucuagagguuagcaguagacauaggagauacaagccugugcagccuguggugcagagaaggaaggaaacaauggcagagcaacacuugaguucaggccuuggaguuguuuucuccaagguguauucacucacccccaguucuccccacuaaugauguccuuguuuggugggaaggaaaucagauguuccaacagucauagggcaagauauaccacaugugccuguguguguaugugugcgcguuauagaaaugauucauuuuagaggaaaauaaaacaggaaagaggugauccaaaacuccauaggccuaguucacaugaagucaggcaggaacagucaaccagggguuagcacuacuaaaacaucuuguuggggugggcucugccccucugcagaacuaggaauacuugucauguagauccuaccccuauucuuuauucauuuccuuaugaugauuguccuauguggcuccacuacacuaauucccaaauuaauggucuauuuaaagagccuuucuaguauucucuaggguuuaauaggcccuuggcuuccaguugaaugcagugugccauauggguacaauggcaaggcagaugggggcacauggaauaucuuccuugacagagcccacagacuacauccagcaccugggcucagcacuagccaaccugagccccugcuccaucccacacaggaucuaccgccaggcccacagccugcucugcagcuuucugccaugguccagcauuuccaccaaagguggcauagaguacagccguaccauguaaugccauuggggcagccuccaccaggccucuguccucagcacuuuguggaaccuguuuuccugucugucugacuuuugcuguccuuuucgaggagcugguggccaccugccggcccaucagccugccccagcugcaggcccggugcuaugcuggcucaggagcagaauauauacuggucaucaacagguaggaacagguaggaccuggggagucugaugcuugcagcaacaagaagucucuaggcagguuacucgugaacaguucauaggggguccagaagcuuuuugaagagcaagugaccagagaccucaaaccacuugccagaacccuuuacuccuugggcuuuguguguucauguacauaugcauacacauguguacauuuguggagcauagaguucaacauugugcauuuucuucaguuauuccuuaauuuugagacaggauuucucuauguuuuuuguuuuguuuuuugagacaggguuucucuguauagcccuggcuguccuggaacucacuuuguagaccagacuggccucgaacuuagaaauccaccugccucugccuccuugagugcugggauuaaaggcgugugccaccacacccggcaugagacagaguuucuuguggaacuugcagcucauugauuuaacuggaccaacuagugagccucagagauccucuugucucugucuccccaacugcaaaccagguuuuuuguacggguucauguuuguauagcaaucauuuuuccaaccaagcaaucucuccagccccugaguggcuuuuuuucuuuuuaauguuuuuaaguaucuugagaauuugagggcauuggauccucuaguacuagaggagcaggcaguugugccauguauaugcagagaauuugacccauguccuuuggaaagagcaacaaauggucguaaccagugagcuaccucccaaggcccugaacaaaguuuuuucuuuuuccuuucuuguuuuuuguuaaaaugauggauuuacaugauuugaauauuggaaaguuacaggaagaucaaguaacuccuacucggggcuccaguuacucagcuucacuuuacaagaggcaccaagugaucugugguccaugccugccacucugacaccaguacugucaccagugcaucucuauguggcauucuccaaaguccuacauggacuuuccaugcugacaacuuuuacaggaagauaagauucugcuuugaugcaacaauuuugauugcugagagcugggaucccaggccgagagaacagagaauugcagaucuggaagagacuuggaugcugcagcauccacauagaggcuugauacacauccagaugugaaucuugacaguguuuauauuuguauaaagucccaggagagcuugguagccacugauaaaacugggcuggagaagaccucauguuuugguauacccuggcucagcuaaaucccauaggccagauagugagguagguaagcauccuaaagugccuucacaugccauacucucuuccccucaggcucuccuuuuuaccuggaguccuugcccugccuccaugcccuggcaccacccaauggccuggcaggugugucuacauucacugggaaagggcuugccaggcuucucugcuccugcuccuucagcuccuuccuacaagauggacugaauuuugcugaaaacguggacauuuugacccugaagacacaggaaccuuagaauaaagaggcacagcaaggagaaugucaguuuuuguuuaggaaugcccuaaagaaguauagauggaagcguucuuacuccuccaugaaaggcuggaaacggggaagagaaagaggggcuggcccuucacaagaauuuaaagcuucaggaaucaguccucugcauagacaguuagauggacaguucccuguucccaguguucugcccacuucuuccguccagaaggaccauccugccuguugaauccuggcaugcuccacauagcgaccacacugggagcugggccaaggacagguagcuguuggcuucuggauuccuuccaugcuuauccucuagaagcugaaacuucaaggccugggcuaaugcagacaggagguggcugagcucuguguugacaucuuugcuacuguggacccaugggaccuggccuugggaguagcagcuggugccugugguccuucagccucugcggcagaggcuucugucaguaccaugaauugugcuugcagcagacaucucaaguuuccagcaucccuucccuugugcccucaaguguuugcugucacaguccugcccagaauugcugcaguaugacaggagcccuucaggguguccacagccccucacugugccaggcugaugaaaaacagcuuuauugacaggccucauuacugagugcuuccucccucagcguccucccucagcaucuccuggcucagggcucucaggcuguagagccagccaaaggcugccuggccucagagggggaaggguccccacaaaggaauagcaaggcaguaaaguaucccccucccucaacagaacuagccagcagguagccaguccugacuaguuuugguugugugcugaggccccagcccugcauccucucccuuuucagucagugcugaucaugugauuuucauuucugcccuguguagucaaggaagagucuuccagaagguucucacuugggcauucauaaauccaucucaaaggccucuaccugucucccuuuagucccauaaucauugcaguguucagcccaguguugaacaaauuguagcguguagucucauuacaaauaaauagacuuucauuagucucauccugucucuaguuauuggcucccauaucugugcuuugcccuugugggcuagggcugaggguuggggagcuugcugccgucgucuugauggcucagcaugcaggcagcuguccugcagaagcugugaacuugaaggcuuccacugcugaaagcaaucacuggccuguuuggguuuuuuuuuuuuuuuuuugggggggggguguuccagacaggguuucucuguguagcccuggcuguccuggaacucacuuuguagaccaggcuggccucaaacucagaaauccaccugccucugccuccugagugcugggauuaaagguaugugccaccacacacggcuucacuggccuguuucuuacagguccuuagcagcugucugccagcucauaccagcacugucagcucucagcuuggagguaggaccugggccaugugggcaacuuuauaguuuucuccagucuuccuguccuccaccugcaucauagcuuagacaaggcuccaaggguaauuaagucacauggucagcagaggccuuggucauguuaacaaccugugugggaaugucccugguggauguugauguuaucuggagacaauuaauuuagguggucacagccugggagaaggcauuacugggaggcuacagaacaucacaagaaagacuugguccaaguaccugaaaucuaguccagcugaaagaaacuugugccaguccugaugggcuccuguggggccauagacucaucuaaaaccuugauggggacagugcgggguccaggccaacacaucugcauugguugguguccugguuccuucuuuaaacucgacccccauuucguccuuugccccggaaugccauguccuguuuaggccuauugagacccugcuugccugccagagcugucacuuucagcagccucucauccacaaagcuucccuggaccuggcucugacucuccauguaaccccuggaauggaugcaggacuauguuaacuggauuggcuuaaugacaaacaaacaagaaggugcaggccuuggcuuuuacugagauuagaccugaggacuccuggccucucaggaacccgauucucugcucggccugaccucccagguacaaguggcugaccggaguuugggcaggcugcaagggcaugggcauuccauuucuucugucccucucaugguucuucuuccuuccucccucccucccucaugcuuuccccagacuagcccaggucuccugcugggcaacucugggggccaucucaauggggaggacugccgcugggacgaacccuuccucaguaacacuggccuccuccuccucggccauccuuccccucuuguuccccagcccuggcacuuuggcuccuauguccucuccaaggccccagagcggguucucuugcacaagggacacauggucuccuccaaggcucuccaggaccucuugggccugagucccaagcccucggggggaccagacugggaggggacacccuuggcuggguccaugcuggaacuggaagcugaggaaagaggaaagaaaagucacucagaggggcccaaucuaaaacauuaccuugggguccucggcccuuacaaccuucaaggcagugccuccuuggcacuacuuccuugaaagaacuagugagggugaggaagggaugucagugggucaaaccugaaaugucaugaauccuucauuuauaaaaugaaggaacugaggcaaaguuguccaagguccaucaaaauagagagaauaggaaccuagaacuccuaucccagauugucuccucugccuuacacaucccaaaaggcuuuugcugugguccugagacuucaaaggacuuauuguguacauugauguucugaaucaauaguggggcacacggauuaaaaaaaaaauuaaacaagaucuuggccccuggagcaugacauuauuuuaguguguccuggccacugcauccuuuccuaguucuuggcagaaggcuaggaaaugaaaaggcccauuugaguucccuucagucuuucuuucgugucuuuaguccugccuuaacagagcuuaccuguauuucccaggcugucccugggcaagugggcuuccagaagggcugagcaauggcuguuaccuggacccaggguccccuguggcagguccaggggccagggugagccuucaggccgugucaggcugcccccagccaugagccggccuagccaguggcuuccacauuggccagcaggcugcauguggccuggcagguagagagccaggcuccggaggugucgcagucggaaguucuugggcuugcuucccugagcacuggggcccugcugcugcugggcccccaauccucccucauagauguuggguggugugucaggguggcuggggcguccuggggcccagcucacugcaucugcaagagagagagagagagcaggagggugauggccagugggaacagcaucugggggaaaugcaaguaccaacucauacguagcuucuacucccuggcuauccagucuuaguuccugucuauucccacuacuccgcugcuccccuaacagaggcgcccaagcagcccaggacuuuggcacugagaucccguugagcacuucaagcucguuuugugcucucuacucuaaaaagaguaugcuggcaccaguguauauaagcacaguggguacaagagggcaugccuggcccagucauauagccuagaucaggaguuacucccuucccaagcaugcacaucccugggcucuccccaguagcuuugggcccagguugggacaguguggcaucucugcugcugcuccucccugcagccaggcaccuucucuuauucgaagcucagagaaugcacagaccaaggcuuccauggagggccaguauggugggggaggaguggccaggccuucugugcaguagggccugcucuccccugucuaggggguggaucugcaggucucccauagcaacugguccuuaugaugucacaguaaagacuagucuuccuggaccuccuaguuugggagaguaugguaugucaggggcaaggagggaggcgggcaagggaagagaccagaaaccuaggguaaauuuguugauguuagauucagagcaagccacauaagacaaauuggcuuugguaugcuggaaagucauucgcuaggcuuccucauuuguggcagggagaacgaggauuuggagaacaaaccuguagagaucugaaucaugcugagaagaugguucugggugacacuugucuaauuauccauuuucucauagguuaagcaguauguagauaaugccaauuuuuuuccugugcauucugacaaacuggaacaauuauucugcugguagaaauauaaaacuacagguucuuuagaaucuuaacuccaccacaacucuguuucauuauagaaaauuuaguucuagguuuuacaucuagguguaugaaccauuguuuuuuacauagauauuaauuugcuauggauugcucauuguuucaaaaccauuuguugcaaagacuguucaaaugcauugucccccauguuagacuagccacgaauguauggcccuaccccacauauuuuuguccuuaaguaucuacucuuggucaguaccaccguguucuagccaagggcaccuuuacuucuugcaccuacccauuuuccuuaucgcccacccuuccuggcacagcucuccucucuccagcccugcuuuugucgcgguuguccucgacucguagcagucaccaaggagaguucucuguagagccugugcugacccugacacccuaggcgugguacaccagcacuaccucgcuccacaguuuccagggcaaccucuggcgcgcgagucugggcgccaauuuccggcuugucgggaauacugacuagcugugcg

SEQ ID NO: 8065 - RNA, 1571 nt, Mus musculus
cuggcuggccacugucagaagcaugugcagucaugcucagaacucgaucaaggaugucgcgcugggcucuugucacaagaugagguuuguguaggcucacguccucagcaaugucguuauccaggagaauguuucugugguggaaaucugaaacuucuugggugaaaaauccauccacaggguucugguaaggacagguguugcuuguucugucucucgagcccagaggaaugaauugauccuugaaggagaugauauugaacuuguuucaaauucauuggcucugauucggcaagccauacacuuaaaaacaaggaucucagaguuuuaggauggcaucuacgugucugaaaagggaaccaugaagcaggcugacaagugagacccaaggaccuagcuccagaaacaacauccugacuacaaguaugaguugggcucuuuggacaauaaaagacuuauuauauauuggggggggggggggaaacaaacaaacaaaaaccaaaacuauguucuuuugguggguagagacagguagaggugaauuauuuuuaagcaguuuucagagugaagaccuuguguaauuagagguuucaugauguauuugggagaaauucauuaugauggaaguugggagucuuaaauauaaaucaaacgccugcacacugacuggcuucaccuuucuaugccaucugcucacucuaggccggccuuuauggaugaauaugagaagguugaggaagaccugcagaagcaguaugacgucuaucuagagaaguuccggaaccuggcuuaccuggagcagcagcuugaggaucaccacaggauggagcaggagagguuugaaguaaguccuuggccuggucaccccugcagagaugacagagagcugcauguguccucagcguuugcaugugcacuagugacugagcagcaaacaccugacaccuccccagaccucacugcagcuucuugacaauagucagggcuguuuccuguuuauuuuagggagugagagggccagugucucacaaugguauccagaccagccucuagcuucagcuuccuacaugcagagaugauaagauacauaccaccaugcccagcuuaaucagggcuccauuugccaacacuccugccauacuacccccuucugguucuacaccaggcacugugaucaggaucuccuccuuucucuuuuuuuuuuuuuuuuuuuuuuguuuuguuuuguuuuguuuuuguuuuuugagacaggguuucucuguauagcccuggcuguccuggaacucacuuuguagaucaggcuggccucaaacucagaaauccaccugccucugccucccaagugcugggauuaaaggugugcgcuaccaccacccggcgaucuccuccuuucucuuaccguccuacacuggaguggugaagcagaauggcagaaacaaagaaacacuucugcuuucuuuuguugugagccugagagcuguggcugucugcacacauuuccuguguccacuguccuugcagcacacaugcugggcuucucuugugucccucauuuccuuucgaguggugug

SEQ ID NO: 8066 - RNA, 3696 nt, Mus musculus
uucagaucuaugagaaugccaugauagcagcaggacucguugaugacccccgggccauggucggccgccugaacgaccuuuuggucaagguccuggagaaacacugacagccaagacacuggauuuagugucaacccaggucuucucgggugauaauggaccugccuggggaggcaggacuuaauacacaaacagugccaccaacugcuugagcucagcuuuauuuacuucaauuaaacaguauuucuuaguccccguggcagacguuuucucuguucugagaugguggaaugcuguaguaccaaauagaguugaaguggauucuuccucaccagaagcaguauggcugaacugcucaaugacaucagauuuuucugagugucaccuccacuggguaauggucacugauggcuucagccuacagaggcagggagguggggucagagcaagguccucuauaccacagaggguaagcagguagaaagccugcuccuggccugaacugccuccacccacaucuaguauggaaacaguagcuccugcuuggcuccaggcuaaccuaaaccacacaagagagaggacacauaccagcugguuggaaaguccguauucugcuuggaaaucaaaaggaacagccgaguugggaacaacagcagccuggagcagagcuccagcaaccacaauccuguaggauaucaaagaagaaggucccucuccucuuucccacauagaguuugcugaccccaggcuccaaaugugcuacacccaggaguaccaagagaaggcccugcacuagcaggaacuaacauguaagcugcccagauggaaccccaccugcugguagccacucugacaagaaaacuaggagucuguaagaaggagagcuccugccucuugaguaggagaaggcgagugaaggcuugguuuggcuuuggggcugcucaccugucauaagcacaguguguugaugugacugugguguccgcacugucagggaucagccacuggaagauggggcuuguccgaaggcgaauggaggaccacugggaggaagugacguagcugcagccagcauugaagucucccaugaacaugauguccuaccagcagacaugccuguugguccagggacaaacagggccaauagaacccauugucccuaggauggucucaccuccaggccccacuuuugccagacaucuagguaaacaucguagagggcgucgaucucacucacagcuucuguuggggcugcaugcaagggcacgaucgcaaauucuuggaccucugaggaaaagcagacaugcuauggacaugguguccagagaccagccuggauugggucuggucugagguuacacuggggcccuuaugcagagugguuuuagcuucgagcagaggugaagauaugggacagucucccacaggcuagauauuguccuuguaguugaauguaaauucagagcacugggaguucccugagggaaugugggggcagcccugccagccacaggcuucuagaggucuggaugggaguuguaagcugugacuccaucguggccuaggcagggcugacagugaagcccaguagcacucaccaguguauggggaaaagaacuuaacaauggcuggcucucugcugaaggugucauuuccacaggguucacagccaucaucauauugauagcuguccagaauagacaccuggucaggccuagagaaagacaagacaagaggugacucuggggcugugagagcuaccugaguagauggauacccacccagccagaaccuuauccugaaguccuguaauauacauugcuaccccuacucuauaaggaccucccaaguaaaagagggucaccuggcccuccaaaccacucucauccucuuuggcacagcuuugaggccugcacaucccugaguuuauucucaggcuuuggcagcauagggcuuuaccuguacacaaaaagguacuguuccuuguagcuuuugcggcccagcggcucacugacuacauagcgguaggugucagguuugucccuggauaaaggaaaccaaagguacuuuuucaccauagagggagccuccuggcaucugauagcagggcuccaacaauagagcacagagggcgugagacuguaaaugguugucauuauacucuaggacuccaguacugucacccaccgauugaguucauccaggagcuucccaacagcaaccaggugggagucucugaccucuuggauaacagcgaugucauagcgacucaggaucugcggguaacaggcuggguaggcagggcuggaucagcagcucaagaccucagacuuugucccucccaggaaccucagagagccagagcugcagcugcugcucuuccuuccacacagcucuccugccagccauggacgguguggaccguaaucugggcugacauccacccagcuaugguaaggccucagguucacuguggucucuagcuucccugauagcacgccugcucucagacucuggccacaguggacuuacuuucacaaaguauacagagaggguagcauuggacaucuuagucuccccaaaaguccgaauguugaaggcugcaauucucagagucccagccagcugcagcagguugaccaaggugagcaguguucccauuagcccuguguaccgcauccugugagauugaauggucaggacaaagaagcagugaagcucccauccccaucaaagacuaaagccuagcuugugcugagccagugggaggcccucaguccuuccccuguacuuaccugaaagccaaucugagacggcugcagcagucagaacagaccugcucuguaugaugagcccccgagucugcacuggaacuggaugaacaaggugaguucacucaacaccugacacucacagagaugucuacagagaugaugagaauucugauacuaaccuggaaaauucugauauauauuucuucuuuugcuuuuaaaggaagauucuuuuuacaaaauguauaaaggaaaaaaccaaaaagcaguguggaauuacagaccugcuagcucucagggucgcuguccaggcaaugccaaccugccuugcucugccaguuuuaaagguucaggcaguauugaccuccccagggcgcauguguacccuucacccaagagcacagaacaauagggcugccuguguggccaucccauugggcccugggcaggcugauagcacgugcugacaucaacagacaaggugccucuuacuguaaaaacagucugauaacguguuugugcaugguuauaaaaccuuguguccuuugcccauccugcccucacuaccaggggugggucguaggaauuggaggcagggcuggcugcauuagcucaucuacuuaugucuggucuaggggguuaaugucaccuuguagccaaaagcaaauuucagacacugacauguucaccauggacucucaagacagcugcucugcucugugguuaaggaacccccaccuccaaagucauugagaugcuagaggcuccaggugggaaaugcugggcgauagaaauucuuccugaggaaacaaggagcucaagggauccccaaguaucuacaucacaagacagaguaacucaggggugggucuugccauuuuuuucaauccuugauaguucauuuguguuuauccccuagggcucu

SEQ ID NO: 8067 - RNA, 38022 nt, Mus musculus
cccccucaucacucuguuaggcuguuagccacacuugggaaaggaagcauggcgugcgagcugcgagcuguguugcuguggggccgcgggcugcagacuguacugcgggcccccgcgcuggcuggaguucggcgaggugagcgcggcacgagagcgcagaggcggcgucugaggcugugugcacacucuuagaccggcgggaggccgcacugcgccggagcugcuaaguggggcggggaguaggaccuuguggucgcuuuuggggagccgagucacgggcagccacagccugcucucgucagucccugguaguccugauugcagacgcucccgcgcuuggguugacaaguucguugcacgcggcuguucacaagcucagcucucgcagaagucaagcccugggguaacuacggugagcaaaaccaacgguuacccaggacuucagggagccagugaacuccgcguguuugaucccuggaauugaaagagaaaggaaaggagagagaauaaccuuaaucuauacuuucccaccccgcacucauguaacagugaagauguuagcguuacauacacuuaaauuauacguauuuacagcuauuuuuacauaaaagggcucaagucaagaauuaacugcgaaagaauauuaaagcuucuggcauucauuacauuuauguuucgcauaaacauagcuucccaauggcuuuccgaaguuuugucgcucucauccuccacuaaauguucucuuggccacaaauaucguuacaguguuuaacagauuugagugagcgauugcuuaaaucuuuaggaacauguuuucgguuucagaauuugcccuuuuauuucuguauuagcuaaucugccaaacuucaccucaguuuuuuauuggguguggggagggugacaggguuucaccauauauguuccgccuggccaggguggucacaaacucacagagauucaucugccucugcuccccagagugguaggauuaaagugugccacagugccuggugcucaaaauacuuuugucuguauauguguccucuaguagcaaaacugauuuacccauaguaucuuuuccaacauuugaguaugucucaaaccaaaacaacaaaaaaagagcccccaaaggcaguuugugcuuggcuugcauaggcccugaauugguccccagugccacggagaauacuaaaaaaaaaaagagcucuguguagaagacaucucuugugauuucuaucuacagagaagcugguuuuacuuaacaguggauccguaucuucucugauuucuuguguaucuuugcaucauguucugcaaacaccuucucaaccuuggcugguuugcucagucuguucccaaaguugacucuggagucuagcucaaguuuuuuauuugcaacauuggugcuccuuuucaccgacuuugccugcugcugugguggcacuaauucucccugggucuuagguggagaaaauacauacauaguauccauuuccuauuggagagauugccacuucauuaaagauuucagccugcuuccuuguguuccuucugggaaguaucagcuaucaagaaccccgugcuguugguugauuggucaauugguuguuugacucauuguuucuccagagcuucccugauuucugucuuugcugaugcuccuaaguucaugcuugccaucuauaauaaacuugucaagguaggauacaacuagaaggccagacaggaaguggcacuccauguaacuagcucucaccugugucuucuguaaauuggagauggucugacauuuguaauugauagguuauaucuccacagccagugagauaaaccagauuagauuauaguaaaggcaggucuauugggaagcugcucucucgaguucacugaccccaaggaccaaggccaggaaaguugccuugggaagggguguguguguguguagggggcagagaaagagacagagcgagacacacaucaaaaugucuagauuauauaagaaggaacgucuagaggaagggcagcccagccccugggcuggaaaguuuaggauuaggggcaggguaugccagguagggagugagauacugagagaaucuagaggccaggucugcuuuaguguguaaaauauguaccucagucucuugugccagggacugaaacccaacaagaauugcagaaaaacagccagcauaucucacaacuuagaacacugcuugccugugaguuaccauuaugagcagagcucuaguacggacaguuacagaucuguagggaaggugggugaucuuuuugaaguagaaguucacagcucauguguuuucaccccuugcucgcuugagugguuccgggugauuuuuuuuccuccucuugaaagcucaacuaagaagcuucugcagggugcccagaaccagucucaggcuggagaaaaaucugcuuuuguaauagaugcauuggcuuaugagaugaaaagcuugucucuguuguaauucaguaaaguuaauuauaucuuaacaaguuuauuaaggaaugcccuaaaccagcacuggaaugagccguauagauaggagagugaguggugaaugggagaggcuacugugaauaguggacaggacaggcuugggaggacaacacgggaggcccugagccaacucuuaacaguuccuguggaaaagggaugugguuguggcuaggggggaacaugggcacuagguguguguguguguguguguguacacaugcaugucugcaauaucacagucacauuaucagugcuacuguguaagucccaagccacccagcacuuuaacaagagacuguggccugccugccguugagguuuuuguggcuuuucauuuagggugugggggaaacgugaagacugauacuaugcagaugguguguuuagugucugauucaggcacauauauuaaguuguugguuuauucuuuagacaguuaagcuaaccuggaaucaaaucugguaucugguucugcccccccccccuuuguuuuccaaagauuuuuuuguuugguuuguuuugguuuguuguuuuuagacaggguuucucuguguagcucuggauguccuggaacucacucuguagaccaggcuggccuugaacucagauccaccuaccucugccucucugccucugcgcugagauuaaagguaugcaccaccuuuuuugauggauauauuuuacaaauauacgggagaagaggcuggugaaauggcucagcaguuaagagcacugacugcucuuccagaggucaaccacaugguggcucacaaaugaaaaaccuaugggcuggagcaagugggccagagcaagagggagaagggaaggggggagggggaagguugggcgacaccggagaaucaugcaaugcagccugugugucugcacacuccuuugcagcugggcuugccauggcagaauuuuucgucucauccguauuguuuacugugucuucugcuuuuaucuucaaaauaaagcacaccccaucucuucuacuguauugugacuuuugcuguugaaguagcacugguggcuagaccuuugucuuaguucugguuugucuuaacuggccauccccacggcacacacaccagcagcaggaaguuugcucaucugucccuggcucccuucauagagaggauaggcucaguuacagguccauagcaaucaugguaaggagcuuggugacaggcagccauggugccgagaggcagcugagagcucauaucucauccacaauuuguaaacagagagagcuugguuuuuguuguuguuuugguuuuguucuucuauuuugagacugucucccaaaauuuaauucagacuggucuuccugccuuaguucuucaagugcuaguauuacaacuaugcaccauucaaauuauuuauuauuguguguacagaggucagaagaugacucuugagagaucaguuuuuuggcaauuugcagguugcagggaucuaagucagguuaucaggcuugugguaagcacuacccaaaggagaucugucugcuuuuuccccccaaugguaaaauuacugacuuucucuuugaagucagcaaauguuuuuuuagguaacacuaauauuguauaguuguuugcugacaucugucaguaauuucugucugaaugagauuuaucuguuugcuuuuuuuaucauuccauggcaguuucccugaaagaagaagccguacauuaaaguauggauuaauacauucuagacugaagucuguagucaguuacugcuaacauuuuggcucaaaucaucccagguucuacuacuaaaaauaacuucauuucugaguucuucagggcucaccucugcccuccacagagcacuuguuccuucauugggggaugcagaauaauuccaguuugcccagggccaguguguucuugagaaagggccugucaggagugacuacuaccauuagugacuaccuaauggugcuuggugcucucaggguguuaucagucacccugggacuacugaugcauauauauagcauugacauugauaguguguguguguguguguguacauauauauaauaguauauauuauaggcaggguuagaaaauacauguggacguagaauguacucacacaggggcacacacuuguguguucacuuuuguuucuggucuacauguacaagggaucucaugguaucuucacuuaaaggguaaugaugcuggucuuaacucuucucccuuuccuuccuccagguuugagggccccggcucacuggcaguguauuaguaugcuugaccucagucuauacccaggacaguuucagccuucauaacugagucugaugaauagauuugccaaaaugugcaguccuaguggaggucagcuuuguaacaugcaguaaaagucacauuuucugcacauuucagucggcuucgaaacauuuuuaaaaucacacuggaaacccaauuaacugauaucauauucaccaaguguguuuauggugaggauagcagggacuacuguaugucuucuaacuguugugggagagagagguaugcugcuuccaugucccuaugcuugcauccugagugacagaugauaugccuuuuaugucuucuggaaauuugacaauguucuucaauauuugugguuguacuggcugguuuuaugugucaacuugacacaggcugggguuaucacagagaaaggagcuucaguugggaaaaugccuccaugagauccagcuguggggcauuuucucaauucguaaucaagaggggagguccccuugugggugggaccaucccugggcugguagucuuggguucuauaagagcaagccaggggaagcaagccaguaaagaacaucccuccauggcuucugcaucagcuccugcuuccugaccuguuugaguuccaguccugacuuccuuuggugaugaacagcaauguggaaguguaagccaaauaaacccuuuccuccccagcuugcuucuuggucaugauguuugugcaggaauagaaacccugacuaagacaaauugguaccagcauagugggguauuccugugacagccugaccauguuuuggggaggacuguggaaggacuuuggaacuuugggccagaagauccauuugguguuaagagcucugucgaauguugugaaggagcuuggaagauaauguugagaacagugcagaacauggaggccuggcuugugaaauuucaaagggaagauuaaagacuuuuuuucggggccauugcuaguuugauugugaagauucugugguucugguuagcuggggcugaagaaucagcugugauuaacaagauaccagaacuacuaaagcaaaaccuuugcauuacugggacuauugaugcugguuagcuggagcuaagaaauuaguggugauuaagacaagaccagcaucauugaggugacaucuucugggaaguguuuuuugagagcacagaggcuguguuccagagauagccaagguuguaccuugugcuguggcuggaguugguaauguguaagaguuacccaggugguacugguuuugaaggcaugaaggggucacucagagcagcugaggcuuggcacugugagagggcauggaaggccauuggugaagaugcggccucaguugcaauugauggcccaggacugaagggaucaugcaaaggaguugaggcuuggcaccaugaagagagccuaugagagguuauuggugaagccugguuacaguggaagacagcagcguuuuggagaugauuaccgagaacagcaggagcaguggaguacaggcaguuggagcuuaaaagacaagaugugugcuacaaagggcauggccugagaagugacccaagcccuuagaggagccagaagaucgugaguuggaucccagacauuggacaguuggaguuuaauuuuugcuuuugauugugacugugcccugauauuuuucccucuugaaggaagaaaauguuuuaguggaucccacaguuaagagacuuuuaauuguaaaaagacuuugaauuuuaaaagauauuggauauuuuaaaaggauugaacuuuuaauauguauagacugugggacuuuuaaaguuguauagaucuuggggaugaauaagaacuaaggguugaggcuuacuagugauguguuugugugucaaguugacaaggggucaauuguacuggcugguguuaugugucaacuugacacaggcuggggauaucacagagaaaggagcuucaguuggggaagagccuccaugagauccagcuguggggcauuuucucaauuagugaucaagaggggagguccccuuguggguggugccaucucugagcuggcagucuugaguucuauaagagagcaggcugagcaagccaggggaagcaagccaguaaagaacaucccuccauggcuuuugcaucagcuccugcuuccugaccuguuugaguuccaguccugacuuccuuuggugaugaacggcaauguggaagaguaagcugaauaaaccuuuuccuccccaagugcuucuuggucaugauguuugugcaggaauagaaacccugacuaagacaguggucuucccauuuauauccuuuagcaguggaaaucuuaaagauuuccaguaucacauuuccauagaaacucuucuggaaagauacagcaaacuccacucuuccugagugaaguucacaugcacguccgcuuaggucacugcauucaucuuccagggaggcacccuggcuacugugcuucaccgugugcauuggaauaguagcucguucauguuacuuagcucuaggauacacacaaaaguguauuuagagaugauucagcagguagaaauggucacugcucuugcaaaggaccugaguuuaguuccuaguacaccuaacuguaacucccaacuccagaucaaaugccuuugcuugagcucggugggcacuuacacucaugugcacuuaacucauucacaaauguugggagcacagagauccuugugcucacagauagcacuagagaaaacaggaguguuaaacaugcaggguuguguuuucaguggaagaguucuauaacccaguuuuccaugcaggaggcugggaaggaaagugguuaauaaccuauugaucuauauugggucaggccauaccaggcucccacaaccaggaccagaaguggcuaauagcccaggugaccucuauacuaucuguaugacauagaccacaccagaauguccccuagguccuuaaacagguagccuaucucuagaacccaucuucauggaaaaagugacauguauuuugagaaaaguuuggauguaauuaugccucauugugcacaagggauuguguugcauuguguuacagcaggaaauuuuuaucaaaauuguacuauacuuaaauaugccuacaaucaaccgccccgugucagacucuagaaguuugaaagcaccagcuguggaguuguguugaggggaguuccuucuugccucgugaauuguuacucugcuggcccugguguuuauaagagaccugcucagagacauguaugcucauuacuuaaaauaauaaaaaaugaauuauguauauaugugugugugugggugggugccauguguggaggucagaugacaacaggaguuggcucuccuuccauaguguggguucgggggauucaacucagaucaucagguuugguugcaccccucuuuaccugcugagcaaccucacuggcccagauauauuuguuuuuaaaauuacucauuucuggauauucuuuauuccuucacauguauuauaaguuaaggguggcugggcaguaguggugcacaccuuuaaucccagcacuugggaggcagaggcaauaccagugcccugugugcuagcccuuggggcugaggagugguauuggaaguauggacucugcagaguuuuuguggcagugaaggcuuaggcugauccccccaccaaguggagacaccucacaccuaguucugugccagagguuucaagacccaccaggcuugccaggaaguuacagaagcaguucugagucccuuccuggcuagacauggaucagguaaaguaccuuuugguaaaguacauuuauuuggcauucuguauauaagggaaagcuacugagacuaccugcuacagcugcugugccuucauccucacaagcaugggcuggacagauccacuguagucucugccagacaucuagacacaauguaagugagcuaggacaucugccuuaauucuuacccauuuuucaugauugucuuuucaggaaagccaguucugcaccuucagaagacuacaguccaguuuaggggccccacacaaagucuggcuucagggaucucugcaggacaguuauacagcacacaggcagccgaggacaaggaggaggagagccugcacuccaucaucagcaacacugaggcagugcgggguaagccuggagaccaugccaucugcaacccuuggcuuuuaccuacugcgcuugcccccucugguggucacccgagaagcugccaacuaaaagggaaugcugacccaacugaugugggacaggaaggccaucuccaggcccggggcugcacuucugacuuuugacggagucggacagacuauugaugcugagaagugaggcuuccuuacagucgguuuuuugaguaaugcuugugaaaaauguacugugcacuguuaaugccagccugagucucccacacacauauuguggggacucugccuccacaguuuguuggagccuugagggauaucccacaccccucuauggcugcagaguugcuucgugcccuuuaguuugagagauacuauuuaaaugucuacuucucuuagucauuccucuguguuuaaaagucagaaccuuaaacauuucagaaggcauguucucccacaaaaaauggaaaugcaauuuuauugauugugucuuugauucauuaccagguucugucuccaaacaugaguuccaggcagagacaaagaaacuuuuggacaucguagcccguucucuguacucagaaaaagagguaggauguauggccauugcucuccgggccagucagggggucuggcaaggcugcccccaucccuuccuggggaagccuaauccagcuccucugcuugcuguuaagaggaauugugcucauccaggcccuccccaauacugacauagagaucuacuuuugaucuguuucagcuggacuauugaugugcuuugaagcucuuguguuuaucuacguuagcagaacuugcgguccuguaccuguguuagagaggaauacaaaaccuuucuguuuuguuuuuuucgagauagggucucguguuguuuuguagccaaggaugaccuugcacuuaaagcuguuucuuuuucuuuuucuuuuuuuugguuuuuugaggcaggguuucucuguguagcccuggcuguccuggaacucagaaauccgcuugccucugccucccgagugcugggauuaaaggcgugugccaccaugcccggcucuuaaagcuguuucuuacaucugugugugcguugugugcaugcucgaggaugcucauagagcagucagugcguccucuccuccuccuuccaugugauugaacacaggucaucagacuggacagaaguaccuucaccugcuuggugcucuugcuggccugucugugagcuuuuuucuucuuucuuaauacugucuagggcuuucauuucuuuuagcacuuuaaggcacgaauccauagugagugggcucuggcagcucagaccccuccuguuaguccuuacaaagugguacagcaggccagcacucaguucaacauaggugccuuucucuuuggcuuccuuauuuuccugaucaguuuccuucacucauuucaggaagcugccucagcucucagaaugcuuaauauucucauuauguccacugguccccuuggcagaagucuugcauugaacuuauugcacuagcugagauuguagacuucuagguuggccacaguaacacuuauagggcauucuuuuuuauuguuauuuuuuauguauaugaguacacuguagguguacagaugguugugagccuucaugugguuguugggaauugaacuuuuaggaccucugcuugcuccggucaacuucguucacucagucccugcucacucuggccaaaagauuuauuuauuauuaugcauaaguacacuguagcugucuucagacaugccagaagagaucaugaucucucauuacggguaguugugagcuaccaugugguuguugggauuugaacucaugacuuuuggaagagcagucaguccucuuacccacugagcuugcucaccaacccggggccuucuuuuuugaccaguacuuguucccugaugucuguaguagaaccuuucuuggagacuuuaugcauguggccagaagaacaguacauguuggcuaaaaggccuggagcaggcacauuuggugcuuuuugugguuuucguuguguuugccauuuggggaaguuauuggaagauggcagcucucuaauccuugaaccuucccuucuuccacauccagcucugagcgcuagcauuagagauguguguuccugcaucuaauucuuaaauguuauuuuugaggagauuaacauucauuguugggugcacauaaucuuagugcugggaugacaaaggcaaaagaauuacagguuugagguuagccugggcuauacagugagauuuuugucucaaauauagcaacaacagcaauagcaaaauccaaggcuuggaaaaagccaagagaagugcuaccagcaggggacguuguaugccugugaccuaacgcgcaggagacugagacgugagaaggagggaaggaagacugcugcucgugcugugcucaguaacagccaagguucuaaaguagacuggcacucauccuacagacuucaaggaucucaggaaacacccacuuccucgucugcucucuugagcucuguguaggaucggggugcuuucagaccuugcagggauuuccuggccucugacguccauuucucuagaagaucaaggcuuuaguguuugauccccaguaaaugaagcaguugauuuguguuuguggugguagggauugaaucacgcccuugugugcauuggaccaucgucuuacugaauugaccaagcauucguguauugaacucacagccuucugccucagccuucucaguagcuaggguugcaaccucugcuccugggucuggcuuucuuucuucagaguaggaaagacagauauuugggggacauuuaccauccugugcaagucgauuaagaaagggcccauugcaggguuacuuuucuuauuauuguuuauuuucucagacacaauuucccuguguagcccugacuguccuggaacucgaucuauagaccagguugggcucaaacucagagaucucccuaccucuauuuccuuaaagguaugugccaccucugcccaacucuuucacagguuucucucucucucucucucucucucucucucucucucucucucucguauuucaagauaggaagacaggguuucucuauguagcugugguuauccuggaacucgcucuguagaccagguuggccuugaauucagaaauccaccugccucugccucccaagugcugggauuaaagaugugcgccaccacugcccagcucuuucacagguuucuuaaagucucaguucacauguaaguccaggcuucacugaccauccugaaaggaaagguuagcuccagaguauuuguugaagagauaccaccgaccaugggagacaggguauugugucauuaggucaucagcugccgccauuacagacucggcagucaggucucagucagugccauucguucaucucccuaccucuugcuccuauucccuagguguucauacgagagcucaucuccaaugccagugaugccuuggagaaacugcggcacaagcuggugugugaaggccaggugcugccagaaauggagauucaccuucagacggaugccaagaagggcacuauuaccauucagguacuucuguccugacaguacccagcucuuugucaagaaacagccggggugaccagacauggggaggacugcauucuaguucuggcuggacuccagugauagcugacuguuuccuuccuguucugagcacucuugcggucacucacuaacccaccuuaggaucuuagagucccaggcagaagggaagggaauuuagaguuacucaaaaggcuauggcuuuggucucucaagagugagaacuguggcaguccuggggauuuaacccagggccugugaugugcuaaacaggcccucugucacugaguuggaucuacccuugccuuaagaaagucaaguuuaccacuucuuucucuguuuuuaaaagauuuauuuauguguguguguguguguguguguguguguguguacacgcaugcauacaugcucauggcaacaugcaaucaagugcuccuuuagcucuuccauuaaugccugugauacuuucaagugaauuguguguguggugugaagucuuaaggaucccaucccaucgcaucaucuuggaaccguggucagaaauguacuagcuguugugugcauggacccuuuguguucugucagcuguaucccugcccuuaggugccuagaacaugcugccuuugcuagugcagcuuuauaaauaaucucaaauagccaguguacguucuccaacuaguucuuuugaaaagcaucccagguucucucccuuucugucaguuugucaugucauaugaaacuugggacauuuccauuggaguguggugacuaucugggaaggaagcaacguaaguuaaaagcaggaagucuguguucuccuuuauaucaucuaacaugaagguuuguuguuguuguuuuuguuuuuuuucgagacaggauuucucuguauagcccuggcuguccuggaacucacuguguguuagaccaggcuggccucgaacucagaaauccaccugccucugccucccgagugcugggauuaaaggugugcgccaccacugcccagcuaacaaaaaguuuuuaaggaauccuuagaaaguuccagugugucugguugagaugguauacacccauaauaguuuuuauuuacauauuuuauguguuuuauuauauauauuacaaauaauaauuauuauauauauauaauauaaaaagcacuggagaaacuaaggagaaucacaaauucaaggacaacccgggcuacauacuaaguuucaguacagcuugggcuaaauaucaacuugacacaggcuagagucaucugaaaggagagaaccuaaauuggaaaaugcuccauaagaucuaacuguaaggcauuuucauaauuagcaauugaugagacugugcccaguccauugugggugggacaaccacugggcuaguugucugggauucuacaaggaagcaggcugagcaagccacggugagcaacccuuucauggccucuaucagcuccugccuucacugcuguuaaugaugagcuguucuauggaccugugagugaaauaaacccuuuccuccccgaguugcuuuggucaugguguuucaucagagcaauaguaacccugacuaagacauaugugaguagguuccucagacuuauuuuuggaguuugucuuagucaggguuucuauuccugcacaaacaucaugaccaagaagcaaguuggggaggaaaggguuuauucagcuuacacuuuccacacugcuguucauccccaaggaagucaggacuggaacucaagcaggucaggaagcaggagcugaugcagaggccauggagggauguuacuuacuggcuugcuuccccuggcuugcucagccugcucucuuauagaaccaagacuaccagcucagagauggucccacccacaaagggccuuucccccuugaucacuaauugagaaaaugucuuacauuuggaucucauggaggcauuuccccaacugaagcuccuuucucugugauaacucuagcugugucaaguugacacaaaacuagccaguagagaguucaagcuuggguuauuuuugaguguucccagggauggaaccuaggccuugagcaugucaggcaagcauucuauaacuucuguagcccaggcucaccuggaacucacaguguagcacaggcuggccucaaacauccaucaguccaucugccuuauccucccacaccacaccuaacccccaggccuuuuccuuuucuuaauggccgcugauugcauagaugagcuacucuccccuucgaaggucucuguccuaucaccauccccugggagaguaggagcuagcagaagagcaguggugcagaacucagagcagaggcuugcugcaggagagaggacugauggccccauggaagaguugcagcugcuccagcgggcugcuggacccaacaguugugaccacugccuccauuguuuugaauagaagaacccccagaggauggaucagagccaggcaggcguguggccaggguguacugcucaugagaguugcaugaucagcugccaacuuguugacucagcaccuuuccgaaauugguugguuuuaugguuuggggcugaggauggaacccacaaaugaguuaaacugcacucuagcccugagguguuuucagugguaaguccuccaaccaacccuucaggucuucucugguguuguggacugacaggacuggacucuccaaugagcuugugguguacuuugaacccuagccaugagcacagagggaagacauugggauuccugguccuguccaugugcuuuggccuagcuacacagggucugugugugacaauaucucuuucuucaggacacuggcauugggaugacacaggaggagcugguguccaaccuuggcacaauugccagaucggggucaaagguagguacagcccagaaccccuccucccuucuaggauaggcacugugggaccauagagaggugucugcuagcagucuugugcuguacagagguggaagucacuuugcucagagcuguaguguagugaacagacgaguugaagccugccuguccaaauccaggaggauucauccauucacccuucaaguuaggccucacccacccacccacucagcagaggcggccacuuuucccaagcagcauuugaucuugagccacucugccuacaggugcaguggguuugaggacagccagcuauuaggggccauuuuauugucagaauauaugcugggaagacaagaugucugucuugggauccuaagcaggguccauucuggccuaaggcagaggccagaggugugcacugccuccugguuccugugugcuuuuucuguuuguuucuguuuauauaaauggugccuuugauaagccaaagugucacacaggaauucuacuuuaaaauuuuucugugcugugacuucuacuggugaaguuccuuguggaguuuuuguguaagguagucuuuacugucucagagaccagcuaugagcuacacaugcuguuuuuaaaugaauuaaaaugagauguaaagucagcucauugaucacacuagccagaugugcuggaagcugccauguuacauguaugcugacgacagauguuugcaggauguucugggcagcuggcuuaggcuggagcaguagacgaugacaaugugagaauggccagcuaagcacuggcacguuuuucagaagcaugugaucauccucugugucuaugggaccccaaagugaaaguguuuuuuaaaagugucuguccuggacacacuuauucuuuaaauaguacacucugacuguuuauaugcuggguaccauaaguagaaauuguuuucaguauggggauaggaguguagauuauauagaaaacugcucguagacaagaugcuuagcauccauggaccuuguacccugguccugggacuauaccccugggcaccaagggacaguggugcuagguuugaauuguuucccacaagguuuugagccuaggacacaugacacacagaacaauuauaauagccccacugggccugcugacccacaaggucaaguugccucuuucccuauccaguuaugaccugaaguuggcaaugaacaguauaaauaggauacagcccuaucccugccugggccuggcuguauggcuuugagcaucauguuccagauucuguugauuuaguccuuuaugagaauguagggcgguagagaaggauucguuacuugcuaacugcacucuuggcauaugcuagaggacccugcccagcacaacacagguggggugggccacccucugaacagucuucgccaccacaggccuuccuggaagcacugcagaaccaggcagagaccagcagcaagaucauuggucaguuuggaguggguuucuauucagccuucaugguagcugacaagguugaagucuauucucgaucagcagcuccagagagcccagguuaccaguggcuuucagauggguaaguaagaagaggccuacucacguugccaaugucccuuucccucauggcacucagggccuaguaucauuggcaugcaaacuagacauuaucaugcauuugacaauauuuaauaagaauugacuuagagguguugaaacagggucuuuauauuuaacacagguuauucuaaaauacucuauauagcuaagauuagccuugaacccacaacaauccuccugccuuggcaccugaguguugggaucucagaugugcaccauugcauccaagaguuaggaguuccuuaagaugcuguuguacaucuugugggcuguuuaggugaagccugacucuuuggcuuugggaacccagauagccuugggcauguauugugcccuguggugcuguacuauuugggucgggcucuuaguagugcagugaaagaacgggacuuccucuggugcccuugccugaagcuggcaucucugacauuggugcugugggaaucccuuuuccuccugacuguaaagcuuucuaaccuugacacagcagugacauacccagcucaguggaggccaguguugguguguuuguuaacuauuuuauuggguucucauaccuguaccacccuuccaaccccuaauaccagguaggagagaaagaagguuagcggggaagcagggacagagaccucuuuaggccaauuccuguugauuagggagaggccuugaguuccuaggggcaagucuagucuucauugucagaauacccagcaguccagcaacagcaagcacagcaguagggccagcaaccgcugccuucuuucuucuucgcacaccuccuaaccaucucagggcucuagcauuuauucucuccagaguccccgaaauuaaacugcuugcagcuggcaaaagccacgccccuuccaagaacacaagccaaucauagucaauggcuguagacaaacugaagcagccccauaucccacaccugggauuaaaacaaaaacauucgaauaaagugacuggguuuuuaaagaaaugaaaauucucacuacaggcaagucugugugaggccuuucccaggacagggcugaccuugucauccucuucuguccagcuaggacugcaugcucugauaguguucuucuccacacuuugggguggugucugacagaguaauaaggugaauuaaauucagacugcauuugaagagaauggggccucagacaaauuuggguucucuuuuuuuccaaacuugauuucugauacucaugguuuuuauuaauuauuugagauuuccauacaaugcauucugaucacaucccucacaccucccagacccauuucccuuuaccaacccuuucaacuuuguguccucauuuuuaaaaacacauccaauucaaccugugcugcuuauaugcucuuggcuauaugccgcucaugggugaaugaucaaacguccaggagaccugaaaagggauuuuucucuuucuauuuuuuuuucuuuuuuuuuucuuuuuugguuuuuugagacaggguuucucuguguagcccuggcuguccuggaacucacuuuguagaccaggcuggucucgaacucagaaauccgccugccucugccucccgagugcuggaacuaaaggugugcgccaccacgcccagcuugauuuuucucuuucuaaacagcucucgaucugcaaguaucuccuuagcuacugugcccacccaccccucugcuccaugcugggauuuugucuggcuugaaugaugggacucgugcaugcaguguaucuacuguaaaucaaucuguauaacugaccugcuguguauagaaaacucuguccuugcauucauccucuuccgcuggcucuuccaaccucuccauccccucuugguaaagauccuugggaggagggcuguggugcagaccucccguuugugggcaagcacuccauggucuccuguucuuugcacuucauaggucucuguguuaauugccauccacugugccuaaguaccuuuuuauugcuaugacaaacaacacaaccaagacaagguauaaaagaaagcauuuaauuggcugaugguuuuaaaggguuaaagucacugauaguggagcaaaggcaagguggcaggaauagcugagagcucacaucucauucuaaaaagcaggaagcagagggcaugccaggaacagugcaugucuguugaaagcuccaagccugcccucagugacaccccuccaacaacaccaaacuucuuaaucuugcccaaacauucccaccaagugggaaccaaguguucaaaugugagccucugggcugaucucaucugaacgacacacauuggaaacaaaagcuucuugaugaggggugggagaugggcucaacuguggugucacugaguuauuagaagucaaucuaauacugugucauuuagcaaaguauucguacuagcuucugugaucugucugcccacaggcucuuaacgcggguaauugugccagguaaggguuucagcuuguggaacaggucuuaagucuaaucggaaaguaguugguuacucccaggacauuguggccccuuugugccagcaggcuuguuuugccaagguaguucuugcagugugcagguuucacagcugguuacauggcaguucucuccuuugggagucugcacagcacccucuaucacugugaaagccagcaagucauaaaggaugucaccagucgagggccggcuucauuucuccaugcucucugacucaguauauugugucuucaguaauaagaucuuaccauaaacuuauguuguugauguuguuuaagauuuauuuauuuaauguaugugaguacacugucgcuuucuucagacacaccacaagagggcaucagaucccauuacagaugguugugagccaccauguaguugcugggaauugaacucaggaccucuggaagagcaaccagugcucuuaaccgcugagccaucucuccagcccuuaccauaaacuuuugaaggauaggaagaacauuggcaguaaucucuaauguuugggaucuaugggaccucacuagcuaacaacuuuagaaguaaccuauuccuggcacugggcuuuuuguuauccugugaaucaagcagguugccugucauaagcuaacugcauuuaaacucugugugugcauguuuuaggaagugucugcaguagauuuccaugacuuuuuuuuuucucuuuuuuuuuuuuuuuuuuuuuuuuuuuuuuaaaguuuuucgagacaggguuucucuguguagcccuggcuguccuggcacucacuuuguagaccaggcuggccuugaacucagaaauccaccugccucugccucccgagugcugggauuaaaggcaugcgccaccacgcccggcuuccaugacuuuuuuaaaauguccuuaguguuagcuacuccucccuguaucccuuccccugcccuaucgccauuuaacuuuuuaugccauuguggucucuccccuccuuugaaguccacccugcccauggcuccuuauuaguuuccugaccuuugguauuccagaaugaacacacaucugaagauucaaagcuauuauccacaaaugaaagaaaacauuagucuuucuggguuguauggguguuuguguguuuaagggccaauuagcaaggucugaggacaaguagaguaggagccccugcagaggucugcacucccaggccaggaagcuagcugcaugcacccuucuucagucuguauuucagcaaauuccccgagagcuguucauagugggcacugcacagugccagcagggcaggguugaugucagcucugacaucguuucugcucaccauggggguccccuugccauuaccaguugugaacacauagaaucagcccccauccccagcauccugcacugauauggagauggguugagccuacuuucuaaugacaugcucaggaaguucucauagagggugauggggugacugaggacagcacuuuguggguguucuugauccugaugucuaucgagugcauaagggauucugccagagucagaagcuacagagcuggauaggguggcacaggccucugaucccagcaugcaaggugcugaggcaggaggaguuugaauccagugugcaacuuagcaagauuuuauuuuaaaaaggaaaccagagaauaaugggauggucuuuauuucauuuccagucaaguguggguggcuuuugugaaagccucauggaagugguuguugaaucggcugagcagggcuuuggcugcagcaagcuaugcaacuggcuuuacucuccuucauguuuuaguucuggaguguuugaaauugccgaagcuucaggaguuagaccugggaccaaaauaaucauccaccucaagucagacuguaaagauuuugccagcgagucccggguacaaggugaggacagcuaggccugcaaagcaggaaggccugggugagaggcauggcacagcacauaagagccaggagagaacucagcccccacucaacugccauaucuguggaaaaccaguucccaccuucaggaguccugauggcugggcuuuguagcccuuguggguuugagccuguugggguuggaagucugucaugccaugagggcuugggacucugacacuugcugggcagaccuuugaaaccuagguuuucugggagcugggaaaaggugcuuccagccauuguuuugcucucucuggcugucacuccgaaugcucccgagagcacagcucuucuggcacuaggugguaucguauuuccauggcggguggugaccugagccaccucccuugcacggaauaggcaagcccucccuggauggcaggcugucagucuucacuguguuucuuucuccuccagaugugguaacaaaguacaguaacuuugucagcuuccccuuguaccuuaauggaaagcggauuaacacuuugcaggugaggcccugggcugccuaugagacucagacagcuguagaaaccuucucaaggauguggaggcaaagaugggggaagggucacugcuuagaaccacaggagagaucagaguuauggggugcaggcaguuuuccuugaaguauaaauuacauaucauaaagugcuccccuccacccaacuuagugacaauuguuguauagccagguguaucuccacagcugguuuuagaacacuuucagcauccugaaaagcauauccccacuaacaguuuucauuuccagaccuuacaacuacagucaacucuuucucugucuguagauuugccuaauuugggaguuacauuguaucaggcauagucuuguuccuuuuuaugacuauccauuucauggauagauuacaggcuugccuauuggauaguguccuuaucucugcuaaguacacucuugugugguccccuaguuaguccuucccaaccugcugucacacagagaggcucuugcuucagagccuuugcaucucucuuuuuuuuuuuuuuuuuuuuuuuuuaaagauuuauuuauuuauuauauguaaguacacuguagcugucuucagacacuccagaagagggcaucagauuucauuacagaugguugugagccaccaugugguugcugggauuugaacuccggaccuuuggaagagcagucggugcucuuaaccacugagccaucucgccagccccugcaucucucuuuuguaucacuuucaaccuacaccaaugcugaagcugucaauguggggucuuccuaggcuagucccugcuggucuguccaugagucuggguccugugcagucauugagaaacauguuucuaacaugauacccccuuugauauaaauuuccaggccaucuggaugauggacccaaaggacaucagugaauuucagcaugaggaauucuaccguuauauugcucaggcuuaugauaagccccgcuucacuuugcacuacaagacggacgcaccacucaacauccgcagcaucuucuaugugccagagauggugaggugcugggcuggucauugcauagcucugggcaagccaaagguuauggguaacucucaguguccacacccagggguucccuaagaagagcugcauagacuugccaguguauauuugccauugugaugcagggcugcagcuucugcaggcuccugcugcuuuccccucugcuuuccucucuugcagcaguacaaaaguucugccaaguccauacuacagaagcuuaguagucaaggucuacuccccugccucacuucagcagacccugguagcauccaguuuauauugcucucaaaaagggcuggguuggccuuggccuucccuaaccauuaguuaagauuuuggguacucguggaucagcaaggugcugggucucagcucacugggacuuccuagaucagccuacacugcagcugcagccaccuuacuuaggcagaguggguguuuucucaaagcgcaggguuugggcuuugcaaacccagugugagagcugccagcucugcugcaguggugagagggccucacuggucuguggaaccuuuaauguuacagcccgacuuucaugucuuccugagauaguccuguuugauuuuucccaaaaccauuuuuaaaaaaaaaaauuaagaaccgggccuggagagauggcuuagugguuaagaggacugucuguucuuccagagguccugaguuuaaucuccagcaaccacauagugacucacaaccaucuauagugugauaugaugcccucuucuggcauguagguauacaugcagauggagcacucguguacauuaaaaaaauaaauagaggccucaucuugcaauggugguagggaaacccaugcugacuuuggccuggaggccaugguuugcugauucugacuucuaauaaauuguaauucuguuuugggggcauauaagacuaguuugagguccccuguuggguauggguuggggaggcugcccuauccucuccagagcacuuauggauuccagcagagccaacacgggaggaguuguguccauucuucucaccccuggggcucaucauccaugcggccagggaggugcuacccucgguccuuccuuccuucccuuaucuggugggcucagcuggugccacccggucauaugcuuucauuucucccagaaaccauccauguuugaugugagcagggagcugggcuccagcguggcacuguauagccgcaagguccucauccagaccaaggcugcagacauccugcccaaguggcugcgcuucauucgagguacugcugcugacacccaggcucugcacuguggacggugacccaggauuccaaguggcauggccauguguccucaugcugcccacugcauuugcuuccgcuguguccuagacccuccucacccagcaggacaggcaaggaguucuuucaggguuggaaguuuggccugagcugugcugggccugaguuauaguugaguaaggaguguaagcagcauuuacuuucauagcacaaggaccagcccucuccaagacaagcuuaugacuuucuccuuuucuuuugagacaaggucuucuacacagcccaggccucggucuccgagaucugggauuacauaguagcuuaguuaguacuuuggaguugaaugcugggauguguuuggugugugccagucuugcccugagaggguuuuacccugggacugcuguacugcccacugccccugagcaggacugaggagcagcgcccccugcucuuccugcuccuccuuuaccacccauggagguuuccguuggugcagggguucuaauguuccugucuucucaggugugguggauagugaggacauuccccugaaccucagcagagagcuccugcaggagagugcgcucauccgguaagcccagacugcaaauagcagggcacuccugugguggcuggccuugacuugauucugccccgggugugcuuuucagaagccaagaccaaagggugaagagagaccugagggcaggaucccucccugaccuucuagguguucugaccuagugagcaacucauucuguagucaggaagaguuuggguuuggcugagcaacugcugagguuggaucuagaaauaguggugcuaugcugggaccaggcugaggccuacacugucaggagccucagcugcaaguaaugccuuaggaagcacuuguagcaauugcauaguuguuuauuuacccaggcucuugggaguauacguuacuuuccccauuaaauacaaauuacaaugaaugaggaaagaacuugguccuuuuccucagcccacuuugauguugcuaacccacauggagaaugggugccagggggugcaggguggcuccaggcuccauggugcuuuuccuugcuguggugaaggugggugguacaugugcaggugugggcuccaaaugucuggggagaacacagcugcauugcuccccaucaauguggacuagcuuugaagaauuaugguguugaaagauggcucaucccugccacccagccuggguauggccacaguuggagagauucuagacaccaugucucagaguugaaugaggcaggggucacccuagaaccaagaauauaguuugacuugggucugggaugcucuucuuuuuuauuuauuuauuuuaaagauuuauuuauuuauuuauuuauuuuauguauaugaguacacuguagcugucuucagacacaccagaagaaggcauuggaucccauuauagaugguugugagccaccuuaugguuguacggaguugaacucaugaccucuggaagagcggccagugcucuuaaccacugagccaucucuccagcccuggaacgcucuucugaaacuaggaggucaggccuguggagacacagcucuuagauuccuagagccgaguuagcugugcuucagugcccagucugacugagcagucauguucaugucugcccggagcugccuuagacccugaggcacucuguuccugggugccuaaguggcagagagagguguagaaccagcaccuccuuccugccuguggccaaucuuuugaagaaggagcugcuuuguucacaguguucagagaaucgggagcuucccaaguggaagauccacucugggccuucugaggcauugcugucuuccuggugccguucucugugugucggugugucaccaaccuacaaagauuucuuucuacccaguggaaccucagaagcagcaguaggccuugcuguaucauugucgcugucuguccuccagccccacugucugcagcuuuuauccuucaguugugagcauccagguuucugugauguccugugucuccugggagacauaauggcauaguggaguagagagggaccuaacagggaaaauaaagacuguugaggaaaucggguaccccuuauaagagcguggcggcucuggcagcugcaccagguccacuccagcuaacgucuuaugccauacacuucagcauuuccgagauuguguagcugugacuggagaguuguugaaaucucaagggagaguugguuucuaucuugagaaagucuugugacccucucuccuccuggagaaggaaguguagucaccauagugggagcuaucugcugucugauuuucuucauucgcugugugguugccaacugcucuauccuuugcuucugguggcaauguacuguggaggccagaggagguaaccucaguucacuugccuuucccagagggauucccuuggcaaucaggccagucacccuguggagugggccugcccuuggaaauggucgaugcucccaggaacgagcacaagagccuguccugaggguggagcggguuuggcuuguccuuggugggugauguucaccuaggggaagucuuugaggcuucucuccauucucggugcggaccgugugcaggucugugagcugguacacacacauuguuggugucuugguuuuuuuucugcuguuuuuguuuguuugcuuuacugguuauuaacaagcagacacgcuacccugagcugccuucccaccaccagugcugcuuuacuuagaagauuguagaugugauccucagcagauugucaguauauuauucauggcuuuuuaagugguguuagauugaacucagagauacauacaugcuagacaaccccuuuccaugguacucaguaguguuuuaaaaauauuuaaugcagugcggacugaugacccauuuuagucagggagcaauccauuccuguugauacauaucauauucuccuauuauucugguuuagagcugccuuugcacugacuccugucccuucagcaagccucacugggccccuugugcuaguccaggcauaccaggcacugggauccauggcucuguuuuaucagagcaauagaaaaccuaacaaagacagugacccucuuucuuuuuuuuuuugagauuuauuuauuuuacauacaugaguacacugucagugucuucagacucucagacucaccagaagaggacauuagauccuacuacagaugguuguaagccacuauguggugccaggaauugaacccaggaccucugaaagaguagucaguguucuuaacugcugagccaucucuccagucccccagugacugucuuuuacuaaagcccacuucugugcgcuugauccugauugccuuuauggauaaugcaguaaaaaauguccugauuacagagugacacuuugccaagcuauacaguguauauguaauaugcuuaguaugucccaggcuaugcaggaauucauacaccuaccuaaggacaaacagcucugcagcauacgcucagucuuuccaugaauacacacugaaguuugccuggguuugcuuggguuugcuuugguuuaguuuuuuccagcagaccuuugcuccuaccucuagaacuguuaggugacauuucuggucggcuucagcaugauccacuuuaacccugagccuguucguagugauuuugucacgugcuucagugcaggcgccucuccuuguuucucauaugugaucccugcuggugcucaggagaugcccacuacugauuguccuguggaauucaguuuguaccaccacccaccugcagagcauccuagcgagcuucucauuagggggcagcacagugucucuuguucuauaguuucccuuuggcuccggguguguacgcccgcccccuuacuugacagaaagcuuuguucacagugaguaacuuguguucuguaggaaacuccgggauguucuacaacagagauugaucaaguucuucauugaccagaguaaaaaagaugcugaaaaauacgcaaaguuuuuugaagauuauggcuuguucaugagggagggcauugugaccacugcagagcaagacaucaagguaggaugaucucgguccucccugucagccucagcccuguugcuacagaggaagcugguagaggcuguccuggauguggugacaagucacaugggcagcaguuggaacacugggcuucugggucuguccucauagauacagcaggucugcauguguucuuaccuguguuagccaggcuccaggcacugacagaacaucugacaaaagcuacucaaagccauaguuaucugcuucaguuagcuggagccgaaacagaauuccugugcguuuuuuuucucucuauuuuaccugggcccccugucuaugcaguggugccacugagacucagaaauuaacugagugcgccuccucagucagcuguggcuccuucaaguugacuuucucagauacuuugucacuggggaaaggaacagaacagagugcuuagaucuguaaaaacugcuggaauccauugauacaggggaggggcuuggagcauccuugcaggcccacguagaggugugcuuugugucuccuaggcacuucuccauccagucagggugguggucaagaucagccaucacauacccuugucucgaaguccuuaugcucuuagcugaaaggccaagucucuugacccuugacacccuggccccagcagauggcaggaagagagauguggguuuaaggaaagaacagaaaagcaguggugagauuaggguacaguuacugucuuaguuaaguuuucuuuugcuaugauguagcaccacacccaaaagucucuuggggauaaaaggauuuauuuggcuuauaaaaggguggagcucagccgggcaaugguggcguacaccuuuaaucccaguacuugggaggcaaaagcagacggauuuccgaguuugaggccagccuggucuacagagugaguuccaggacagccagggcuacacagagaaacccugucucgaaaaaacaaaaccaaaaaaaaaaaccaaagaaacaaaaaaggguggaguucuuaauacuaccauuggccaguguaauugcugaaaaggaauacauuuguucgcaaauaguuuauaaagucuggcacauggcucuucucugggccuucuucccaccagccugucagcugcuccaacuguccugucuacuuaaggucugcuuuuguuauauuuguccaucauugugacagaguagcugaggagaggacuuucaaggagggaagugacccuuugccauggauauuacacugggagcauguggugacagaaaacacuuaaacacaccuuuaaaggacacacccuaauugauguguuuauaaaaagauaaagaagggggcuggagagauggcucagugguuaaaagcacugacugcucucucaaagguccugaguucaacucccagcaaccacaugguggcucacaaccaucuguaauggggauccaaugccuacuucuggugugugugaagacagcuacaguguacucauguacauaaaaaauaaaucuuaaaaaaaaaaaguauaggaauauguucuauuccauaaaauauggggguguggugaggugugggggaagugggugccucagcaggcccaugccaaggcaucccuuccccugagggaccagacauacaccauuauaguauagaauagaguuuauucagggcauggggaggggaguuaaggaguagcagagacagagaaaggcagagagaaagagagaguagaggcuggccaugcccacguggagagagaaggggagaaggagcaggggggcaagaggcaagggagagcagcaagaguaagagagagaggaguaggcaagcagccccuuuuauaaggccaggccuaccuagccauugccaaguaacuggggguggaguccagacaauaccaacaccaaugauucuaccaccuagaccccaguccuaacgucugucacuuccuguuagccuguuagccgagagcucaugaguuucagucaugugaucuggucaucucucgaggcuucgucugugaagaccgcugcuuuggguacccagcucaugagcucuugggagcguuuaugaucaguaugugacacauucacucucuuugaccgcacuuuuuaagauuuagucaucugugucugcaucugugugugugccugugaaggccaggagcaugccugguguccuucaagcaccauaacucccuaaacuuggaacuuacauuuucucagcuugguuggaagccagaaugucccuacuuggaucuagagugugagacaccaauugcuaugugagugcugggaucuaaauuccagcccucaugaagauugugcagcaagccccuauaacauugagccuauucucuagccccuuaucucacuuuuaguuacagcaccuaauagcauuugcugagccagacaaggccuuuuccaaaugauuggaauacauuuuuugacuagguauauuuguguaagguaagagccagauguaccuaugauguggauguggccauaccugcucuuuuuguuuguuuguuuuuguuuuuguuuuuugggacaagguuucucuguauagcccuagcuguccuggaacucacuuuguagaccaggcuggccucugccuccggagugcugggauuaaaggcgugugccaccacacccggcuuggccauaccuguucuuggcaaguucugaaacucuuucucugucuacuaggaauccaaggcauaguagcgugugcauuugggucuaacucuauccauucuuaaacccuuuccuugaggccuugugcugagguggucagugcugacagugucuuagauacuguagcagccaagcugacacugcaggauccuaccucugcucuuuauucugcacagcccaugggggcugcauugcauggauuuauguccuguucccauaaggccucucucuuugccacauacuccaguagccagaacugguaaugaacacuacuggcugaggaggcugggaacugcgucuaguuguuacugaggacagagagaaggucugguauggggggguggcgggggggggggggggagguugacgacugaauauccugagguaguuuacccagcucuucaggaggcccuugaucaccuagguucaaauguuuucucaugguccuauauacagugggguucauaggcgcaucugaaacucugagucuaccauaaccuuuggggaccaggcuggggagccagaaagcugcaggcuucaccaagagucugaguuaggaaucgcgcucagguuuuggcucuggaguaagcagugacuugcccacaucugcaggaggauauugcaaaacugcuacgguaugaguccucagcccugccugcugggcagcugaccagcuuaccagacuaugccagccgaaugcaggcuggcacccgcaacaucuauuaccugugugccccuaaccgucaccuggcugaacauucacccuauuacgaagccaugaagcagaaacauacugagguaggugggcucuggcuugcugcugggccaagaauguaucuuacagggucuaagugcaugagagaaaaugacuguguuugaggcccuggaagcuauguggugugaggcaaugcccgucugugaugugguugucauucccacuagguggcagauggauuauucaugacuaauguaugcacguggcaagacagccagagccagucuuagauggcucugugagcuguugcuuaggccccagaccccaguguccauagcagugcccucugcugcuacagcugacaggcuugaaugccugcaggugcucuucugcuaugagcaguucgaugagcuuacucugcugcaccugagggaguuugacaagaagaagcucaucucuguggaaacagacaucgucguugaucacuacaaggaggaaaaguuugaggacacaucuccagguugacucccaucucucuccggggggugggggggugggggggucgucccauaugacuguugggcaggagacugucacgugucccauggggcuuucuugaccugcucaugagugcauugcauuccucacuugggcucugggucaccagccugugcaaguugcuccugcuccuccugugcaggcucuugcaggugaccagacugacaaagagcuggaaggaauugcucccaccauucuccauccuccucgcacccccugccuuuuuuuuuuuuuuuuuuuuuaaugauagucuuucauuuuguagccuagacuagccuugaucuccuaacuuacauucugaggugugcaacguugguugggcucagauuuuuuuuauuuuuuuauuuuuuugguuuuucgagacaggguuucucuguguagccuggcuguccuggaacucacucuguagaccaggcuagccucgaacucagaaauuuaccugccucuacgucccaagugcugggacuaaaggcgugugccaccacccccagcgcagauuuuuauuuuuaaaguccuaaaacauguaucgaggccaggggcaaccacagguguuuucaaugaagaugagaaguauuucugagagccucugucccuagcuucuggugagguaguaugauagagauagccuggggauaagcuaaguggaggccacgacgugggaggagcaguguuaguggcccuggguucauucacuccucuuggacagcugaugagcgccucucggagaaggaaacagaagaucuaauggcguggaugagaaaugcacuagggucccgugucaccaaugugaagguaaggugucccuccaguuaccaugcaaugugauguccuucuagagccuggcuguagcugugaguugcuggccuaguauggccccauaggaaggcccugaagccaggaugaggacucuggccacauucccaaggccaugggcacuagcaugucaccaucaaagcuuugucucaagcccacagucuguguacaucucggugcugcucuaggcccugccucagggcaggcacuucucugcaaaaccucucacaggagcagcucaggcuccgccuuuccauaccagaugguuuccucagcucugaggagaaggaucuaagccaucuaaguguguacccuuggacaucuugcugugaucuuuguccucauugacuggagacagauuaacuggagcaguagauauagagccaaucugccuucuaccugguggccuaguuaacuucacaaugcuucaggcccugucacaccccuagccccuugcuacuggguucuuccucauccuggcccuugcuugcaggugacuuuccgccuagacacccacccugccauggugaccgugcuggagaugggggcugcucggcauuucuugcguaugcagcagcuggccaagacccaggaggaacgugcccaacugcuacagcccacacuggagaucaaccccagguaggccugggcuccagcacacaccugucagggucuccugcagucaugagcauaggaucuucugucuggagagcaucuaaguguggauguaaaguuucuaugccguccgugucaggacguucuacaaggcccuuggaauuaacagaaguuaaaagguacucaccggaaguuuaaauagaacauuccugacugcuguuuguuucccuuuuccauuuccauuuguugaguucaagcacaaaccugacauucucgcacuuggccugcuagugguuuugccaucucuguccugaaagccauguuuaacuucaggaguggauccugguacaaguagaggaguacaguuuucagccagcguucacaguguggaucgccuuaggacagguuacuuguuugauagauuugagugacuugcaacuuggagcuuuuagaaacaggguugcugugaaacacaugaaggcuucucuagaaugugcaguccucagugguccaggcagugugagcugccucagccuguccccacagaaguccaggucaugaugugaugagcaccuuaccuuucgugcuuauuuguaaucuguuuauuugagacuauguagucuugacuggccuggagcuugcucuguagaugaggcugguuuacagagauccccuugccucugccucucaagugcuggaauuaaagguguguaccaccaugcuuagccauuuguaaauauauauagucagcuucaaaugucuguuguuuuaagguaucuuuugaugagaggaagaucuuaauuuuauuauaaucaaauuuagaaaucuuagcugcuuuaugguuucuguggaaucuuuucuuucuaaaaggaucuuuuaggauuugaguuaauuuuguuuuagucuggucugauuucaucucauucuguaagaaugcccagggagcuuggccucacuaauccuguuccuuccauguuuuguccauucugucugcuggaaugaccucaucuuccuugaaucuccuuggcaacaggugagacugaggcacacauacuuuuccucugugagguccugacuacuccugggucuuuacuucuauauaaauauuuaaguugagccugacaaaaccuguagauacugacauacuugugggguuuggagcuuuuuuggcuuuguuggucugaaacaguguuucuaguuguagccuggacugauccugaaacucaaaguucuucugcuucagauucccaagugcugccauuacaggccugagucaccauuuuuaguuauuugauaucuuuauuggauguuuuaaauuuuauuucuuuaacuguugaaauuuauaaugaggguaaggacuaaauugguuuuggauauagcaauaguuuuuggguuuuuuugguuucaguuuuuuugagacaggguuucuauguguaaaucuggcuguccucuggaacucucuuugcagaccaggcuguccucgaacucaaagagugaguacaauccugagugcuggaauuaaagacgugcuccaccaccuuagcaauaguuguuuuuaaugaaguuauagaauugcuaaaaauguuaucuauagcuucauuacucaccgccauaguucuucgcuugauuuauuuucauuucugaagauauauuguauuauuuuaauauauguguaugugcacauggaugcagguguucacagaugccagacuguuggauacugcuggaguuauguuguuacaagcugccuguuaugggacuugggagcugagccugcgucuucucugagaguauaugugcuguuagcuacuaacgucucuccagccugagucccucuuugaauuauguguauuugagauuuugguauagcacaucauuuauuuucacuuuauaagcauaaguuuuuauuagaaacuguguauaacuggguauuuuccuguuuucugaaucagaucauagacauuaugaucuggguugagaagucucaagcagcuugugccuagcagcagugagcugggcucccacugcuguacuggccagcaugaugcugugacuccagaguaggugauuuaauaugucagcucacuagaucuggcacaaaacugguuuuaugaguaaccaaagugccaaaggacucugguuucaaucuuguuuuuagauuugguaguauguucacaugguucagaauucaaaaaggcaauggcuggggaaaguuuucagguaauguguacuaagcagcaugcgguuccuccuugcacaggccagugugccaggcaggcucucaaguuuaccguacuguggcccagcguacacagcccaugguagagcguuuaagaauauccuuucuccagcuucguaggcuccacugugagggugcgugcaucuuagggugcucuuguugugcagaauggagcuugcuugugcucucaguccuuccuguguucuguguaaagguuucuaaauuccguaucccuguccucacuugucaaauaucuuacuuucuacuauuuucauaagugaaaaaaaaauuuuuuuaagauuuauuuuuuguauauguggguacacugucacugucuucagucacaccagaagagggcaucggaucccauuucagauggcugugagccacaugugguugcugggaauugaacucaggaccucuggaagagcagucaaugcucuuaacuacuaagccaucucuccagcuccuaaauggaaauuuacucuauagguuuguauguuuccuguaggguuacacuggaggguuucccuaugaagggaaauuuuuguaaacucagguuuguccuuuccaucuucuagguccguauacaguauguaaaagcaaacaucuguuucauaacuuaucaucaauucuagaacuggguuggaguugauuucuuagacaagaaugaauugauuuuuggcucaccagcugguacacauccuuuuuuuguuuguuuuuggguuuuuuuuguuuuugguuuuuuguuuuucgagacaggguuucucuauauagcacaggcuguccuggaacucacauuguagaccaggcuggccuugaacuuagaaaucugccugccugugcugggauuaaaggugugugccaccacgcccggcugguacauauccuuauuauguaugcuaacccaucuucuugcucaugagaugcugccauucuuagacacuugaguacuuagaucuguaggaacguuucugccuccccucagagugcccucucagugguuuuuugugcuuauuuuucuauacauuuagauuucauaaaaacauagggcuuaauuuaugaacaguucaccucuauuaguguacauugauuuuugcuacucagcaccccaucugcauuuuuugauauugacacucuuacagugauuguugaguuucugggugacuuauaacaucaggguauuuuucaugcucaacagcuacauugcaguuuuuuuuuauguucuaaugauccucauguaacagcagaagcccagguugguaacacgcagccugagcugaucucuguuggcuuccuggugcaggcacacacugauaaagaagcucugccagcugagggagagcgagccggagcuggcccagcugcucguggaucaggugaggacugacuggguuuggcauccuuuucugccuuggggguacaaagcugcucucuuccugagggucaggcguaggucaggcuggacaugagccccugauccugauuuuacuaugccaucccuguguuucagaucuaugagaaugccaugauagcagcaggacucguugaugacccccgggccauggucggccgccugaacgaccuuuuggucaagguccuggagaaacacugacagccaagacacuggauuuagugucaacccaggucuucucgggugauaauggaccugccuggggaggcaggacuuaauacacaaacagugccaccaacugcuugagcucagcuuuauuuacuucaauuaaacaguauuucuuaguccccguggcagacguuuucucuguucugagaugguggaaugcuguaguaccaaauagaguugaaguggauucuuccucaccagaagcaguauggcugaacugcucaaugacaucagauuuuucugagugucaccuccacuggguaauggucacugauggcuucagccuaca

SEQ ID NO: 8068 - RNA, 5637 nt, Mus musculus
ucuuuucgccucugcaaucaagcucucccaauaaacgugugcagaaggauccuguugcagcgucguucuuccuggccagucgagcgcgcgcaagaaguggugccgaaaacccgggacaagaaacaucuucaggcacgagcgaagacccccuacuacagggaggauucagaacugcaucgcggggaaggagcgguuaauagagguucccguaaaacagacugcugagaaggauccggcguggauucagaacucuucagcuggggagcgguguuaauaaagguuccugcaaaacagacugcugagaaggauucaacugcauggauucagaacucuucagcugaggaacggugguaccgguaaguguaaagaaauuaauguaaaucucugagaggcaugcucuccuacgaaguagauccauuaauugucgcugggauugugcugcuugcuuguuuucuugccuuaauuuuaugcuauugccuuaauugucaucgcccugggcacgaguguaucugcugggaauaauuucacguagauaacgcuuuaguccagggcgaucauggguaauggccagucuacgcccuuaguagggccggugcaagccuugcuuaaagaaagggguuuaaaaauuucagaaagcacagugagcgguuuuuugagagaaauagacagacuugcuccuugguuugcccccacugggucgcugacgcuaccuaguugggaaaagcugggaaaagauauagcaagagaggaaguagaugggaaagugaaagcagggacaaggccguuauggaaauuaauuaaggcuuguauccaggacaagaaaugugagcuagcuguuaaagaaggacagcgacuuuuacaggagcaacaggaaaguaugucagaaacagagagaaaugaaaaagaaagcgcgcgcagaaagauaaguaaagggagagaaauaaaaggagaaaaggaaaagaaaccaaaauguaaagauacaaaagauagaauaaaaaauaaagaacagaaaauuaagucaauuuacccuccucucgaggacuuugaguuguuagaauugucuagcucaguggauucggaacuaucagaaggggaggagaaaaauuuggaggaggcugcugcaaaguguaaggcagaaagaucugguccaauaggaaggaguaucacugcuccccuaccaccuccgccuuauacagauaagaaaacaauuggcuauggccacuccuuuugcacuccuaaagggcugcaaaaaauaugucaggcuuuuccuguuuuucaggaucaugcucaacagcgauauuaugagccaauaucgcauaaacaagugaaagagcuagcagagucaguaaggaccuauggaguuaaugcaucauuuacucagucccaaauugauagauuggcucacaaugccaugacuccuuuugacuggaugagugugguaaaggcaugucuuacgaugggacaguaucuagauuggaagucuauauggcaugaucuguguuugagucaggcccgugcuaaugcuacugcagggcaacaagcauggagcuuugaaaugcuuacaggucaggguauauggacaaacaaucaauuaggauacccagugcaggucuaugaucaaauuaaucaggcagcagugaaagcuuggaaagcauugccuaaucgaggagaaguaucugguaacuugacaaaaauuauucagggaauuaaugagccguucucugaauuuguagcucgcaugauggaagcggcaggacguauauuuggugauucugaggccgcaaugccauuaauugaacaauuaauuuacgagcaauguaccaaagaaugcagaaaugcuaucacaccauggaaagggaaaggaauacaagcauggaugaaagccuguagagaaauaggaggaccucuuucaaaugcagggcuggcugcugcagucuugauggcacaaacaaaagaaauaaccugcuauaauuguggacaaacaggucauuugcaaaagcaguguacaaagaguagaaagaguagguuugaaaagacaguaccagguauuugcccaaaaugugggaaaggaagacauugggcaaaugaauguagaucagucagagauauaaaaggaaggccaauaccucaguuuaaaggacaacagccaaaaaacggagugaggggcccccguccccagggcccccaaauguauggggcauuccagaccacaguguccaugaggccacccagagaccgaggagagccacuccggguucagcaggauuggacaucugugccaccuccagaguaauucuuacaccucaaauggggugccagccuauuucaucagauuuuagaggucccuuaccaaaggauacagugggccuacuguuggguagguccucuucugcuuugaaaggauugguaauacaucccggaguuauagacucagauuaugagggacaaguuaggauuauguguucugcaccccgagguauuguagccauuucuccuggagaucgcauugcucaauugcugauucuuccuaguuugcauaauauguucccuaguggccgggacucgcgaggagauaagggacucgguucuacaggaaauaauguggccuacauaucuuuagauuuggauaaucgucccacuuuacaauuacaaauagaaggaaaaaccuuucaagguauaauggauacaggagcagauaaaagcauuauaucuaguaagugguggccugcuucuuggccuguuaaucaaucaucacauagcuuacaaggauuaggauaugaggcuaccccaacuauaagugcaaaauccuuacaauggaaagauaaagaaggaaggacagggcuuuuucaaccuuauguacucccuuuaccuguaaacuuaugggggagagacguguuaucagcuaugaacuuuauauugacuaaugauuacucucagaaaagcaaggaaaugaugaaaggaaugggauauauaccuggacuaggucuuggaaaaaauuugcaagguagaauuucaccaguuaaagccacuguaaaggcagacaagaaagggcuggguuuuuucuaggggccacugaggagccuuugcccauuccguggcauacggaggacacggugugggugccucaguggccuuuacccucugagaaauugaaagcagcuaaagaauuaguacaagaacaauuagaccugggacauguggaacccacucaaucacccuggaauacccccauuuuuguuguaaagaagaagucagguaaauggagauuguuacaugaccuaagagccauuaaugcacaaaugcaaguuauggguccuguacaaagagggcucccccuacucucagcucuaccuaaggauuggagaauuauaguaguagauauuaaggauuguuucuuuucaauuccauuaaauaagaaagauaaaccuagauuugcauucaccuugccuucuauuaaucauauggaaccugauaaaagguaccaauggcggguauuaccccaaggaauggcaaauagcccuaccauaugucaguuauauguaggaaaagcuuuacaaccgguuagggaugguuuccccuccuuaaaaauuugucacuauauggaugacauuguaauuuguggaccugaagaagaaaguauacagcaagcuuauggcuugcuuaaugaaacuuuaaaaaauaaugguuugaguauugcaccagaaaaggugcagcagucuaauguuagucauuuucuaggagccacuauuacuuuacaaugugucaccccacaaaagauuaguauuagaaaagaccaucuaaagacacuaaaugauuuucaaaaauuauuaggagauauaaauuggauuagaccuuauuuaaggaucccuacuucggaauuaaaaccuuuauuucaaauucuagaaggagacucacauauuaccucauugagacaauuaacaccugaggcuucugauguucuuaggaaaguggaaaaggcgauccaaacagcacaguuaacucguauaaaugagcaagaaccuuugugccuaugcauauuaugcaccaucaaucugccaacugcuguguuauggcaaaaugguccuuuaguauggauacauccacauauauccccuaauaaaacuauagagcauuaucccaccaugguagcaaauauggcccacaaagggauaaaaacuucaaucacucacuuuggaaaaaugccugauagcauaauugucccguauacugucgcacaaaugcaaauauugugugcuacuauagaugaaugggccauucuuagaugcaguuauucugguuuaauugauaaccauuauccuaaacauccguuauuacauuuuauguuauugcauccaguaauauuuccaaagguaacggcuaauaccccuauaaagggagccauugauauuuauacagauggauccaaaacaggaguuggaaguuauguaaucaaugaaaaggcuguaagguugcaauuuacaccaggagccccucaauugguagaauguuuggugguuuuagaagucuuuaaaagauuuccuaugcccauaaauauugucucugauucuguuuauguaguuaaugcgguucuagcauuagagacugccggaaauuuuaaacaguccaguccuguaucugaaauuuugaugaaaauacaaaauuguauuuugaugcgugagcaucccuuuuauauucaacauauuagagcacauacaucauuaccuggaccuaugguuaagggaaaugcaauugcugacucagccaccagagacaugguuuuccuaucacaaaguucuauagaaagugcuaagaauuuucaucagcuuuaucaugucccugcuucuacauuacgacaaaaguuuaagcucacaagaaaagaagcccgagauauuguccuacggugugguaaauguguagaauuuguuaaugcaccuuccguggguguuaauccucgcggauugcgaccccuagauguuuggcaaauggacguaacgcauaucccaucuuuugggaaauuacaauauguacauguauccaucgauaccaguucugguguccuacaugccucucccaugacaggggaaaaagcaguucaugucauaucucacugcuuagaggcuugggcugcauggggcaagccccuaguguuaaagacagauaaugguccugcauauacuucuucuaaauuuagccaauuuugcaaacaaaugcaaguaaaacauauuacuggauugcccuauaauccacagggccaaggcauaauugagagagcccaucgcacucugaaacaauauuugcaaaaacagaaagggggaauagaggcuaugacgccaaagauggcucuaucccuuacaauauuuacucucaauuuuuuaaaauuggaugaugcuggaagaucaccagcugaaaggcacggacaauggccucaaucacccaaugaaauggucaaauggaaaaauguccuugauaauaaaugguauggcccggauccuauuuuaaucagaucccggggagcuauuuguauuuucccacagggugaagaaaauccacuuugggucccgacgcgacugacaaggaccgugaaagagcaagaugaaccccaagaugauucuccugcuccugaugauugagaccggg

SEQ ID NO: 8069 - RNA, 67757 nt, Mus musculus
uaagcagagaccagccucuuacgagucaacuucgagucuggagccggagccagagaccggggcugggaaaccccagcccgggacgggacgcagcagccucuggaucccgggaccccggaccucucaggaccggccagaggugaaggacugaggccccacugaggccuuggaccgcaccgccuggcuccuucagccgcagucgucuccuggugagugucuaggggcgagggugggggcgacaggcggagcugaucacacuggaacagcacacuagcacauucuccagugggacugcgacugccggagcgaggggcuuauccccgccucgggcgguuaccugggcgggaacguccaguugcaccccccuuccugaguggguucaggggccuccguugacccucgggagagccagggcgugcguuuguacauggcuaaccuacccgugaggcucugaguagacaaaauaaacacccccucccuugcuuccuccucccacgacugggcccucuggcgugaccaguuuuaugaaucaacccucuuuuaggggauggcccagccguagucugguuacuuuucccucacgggggucagacagucuggugcccuugugcagaaugguugcuugggauccucugggccuugucacacauggcagaagccacgaauacacaggcaagccuggagaggaccgggaauggggagauugauagguguacccccaggugagggaugaacuuuggcuaaccauaaucuuuagugcuccaguaucagcgcaucucaucucuaccaguaaugggcuuugcuugggcugcagacccaauggccuauagccagucuaguccuuuguguuccccagcuugcagcucuggggccagaggacugcuuagguuccuuguggucacaggcaggccagcugauuggugccaaccacacuaccucacccccauucguuaacgauuaccacaccagggucauugacugcuucuauuggaucccagaagcagccucugcaguagaagaaacccaaggcucaggaguucccuugcuuguuuuuugcauuaauaguaggugaugcuccaggaagaggcaccaagagagccuucuucccuaucugggucaagaguuccuaggggagagggucuggcuaaaagguaaaaggucccuucccccuaggcugcugggaaagcagagaugugggugggcuggagccuugugaggggcuacauugguaugggcagugaaggccaguauggacccagcuguuagcaugagcuggagcaggcaggugggggaugggaggguagucccuagaguuuacuguccucucccaggggaaucagcccccggggaacuucuguaaacagagugucagaggcaggaagagggcucugguaaugagcagcccaacuggauucccuccagaccauuaucuagcaucucccauccagagaggaaaggaccuaggagcacacaugccagcccagggagggggacagacgcugcuuguccccaacuugccaagccucagaguugcacaccagaacagccaccugagaucuguggguaaagagggcacuacgcagaagguuacuguggcagaguguuuggagaccacucucuggaaguggugggagaagagagaguacaagaggcuucucagacacuguaagacuuauacuuuccugagcaaguccucucuggcagauagcccuggggccaagagagauagccagacaugcaugcaggcaggcaggcagacagacagucaggcacaugcuuagguacaugcacacacacacacacacacacacacacacacacaacacacacacaacacacacacacacacaacacaacacacaccacacacacacacacacacacacacacacacagagucacugccauuccagauauccccagccuggguuaguuaggauaaguacuaaggaagagccaggauuuuuguggcuagguucaacuggagucccaggaaaguggggcuccauuuggcagcaggaagugguuccuaccuaaccacccccagcacaguucucuuggguaagugccuaaagucauucuugaccacuggcagguccuaaucuuaugugaaggaaccagucaccuuagaucccuuagagccccccgcccccuucucccagagcuguggaacccaaggcccuuguguugccaagaaaaccagcuccccucacugcuauggaauuugugugugcuuuuggaaaagggagaggugugugugugcgcucgugcgcacgcgcgcgcacacacacacacauaugcaggaguguggcccagaggguguguguguacacgugacggcagcaggccaguaggggugcucuggcaucguugggaggacuagcccuccuuccuuuuaucaguuuccacauuccagagucagcccggcugcuuuccccaaccccucagccugcuguccaggcagcaggccucccccgcuuuuccucauuccagucucccugggugugaggaggcuucuucaggccaccucaguuugggggcggcuggggaaaggcagaaggccaguucuucuuuaagguugggaacacccccucccacucccccccccccccagcuccuccuggggaaugcaauaagacucugacauuccuggaggcugccuaagagaucucauuaaggagagagcuggcuugccugagggagcugggguggguugagagccuucagccccagccacuggacaauagugacaacuguaggggcagagugugguucaaugaccaguucauagaccccagaagggguuucugugugucauacaauagcugaggguucaucugagauugcugaguaacuuguaggacaguggugugacaaauggaauagagaaaagacccuugugaggccauugccuucucagacuccugugccggggaagcuugggguggguggccuucuguggugacuaagguguuguggaagguccaggguuaauugcaggguuacagcucauucagugggugacaggcccugggcagggacaaggcaguaggaggccgagccccaggagcggcacaccugccacgcgugcugacaguguccuucuccuagcccacaucuaguugggccacagccaccacauagcuccuggggccacagguguucuugcccaacagguggcaccucucuuaagauggcacaaccugccaccccaaggguucacuuaagccagagacugaucuuagucacugaucuaucucccuuggcugacaggucugacagcagccaggucacccaccuggguggagacaugccaccuuggccacaccuacuccaagacccagaauccuuuccuggacaaacacagcaguugcccaauggauguucucgcgguccuuuuggcagucccugugcagacgacccaacagagaacuuuacucagaauauagcugcuugacucuccccacaggaaugacuuaaaaaacauagacaaagccuagggaauugcagcuuagagagcuuccuagguaggugaucuaucccugcagcucagauaggaaagcccugaguuagcuauaggcagagacgggacccaacacagggaagggaguuggggugaggucacaaagcaaaaugagcagaacuggcuugggauccccugacuuaaugaccagucugggcucugccuccuuuccucgaauucuauucgaaaaccuauaauagagacccucaacuccucuucucuguugggccaggacugcuguucuagagaggcaagaugggguggaccaaaccagagcccagaacugccuuggacacgucagcgaaacuggagccagcuauucuggccgccggcacaaucccgccugcaggaggggguugggggggugguguuggcagccuccuggggcugggcugcugccaggccuggcaggcagaguagagcccauucaguccagccccaggagacagaggcuuggagcccagagcugagaggcagaccuugcagacccuaucuauaucuagccugaagaagugugcgaagagggguggcucucaguuguccucuccaccucgaugggcacaugacuagcuccagggcugauguguucacuaaaugccuggguccuaccccacccacucucccgucccugccugaccucaggcauguguauggguggguguccacaagugugucacacacuuggguguggagggcauccuuagcccuugagaacuagaugaccaauacccuugguugucuugacucacagauccccugcuggaggucaugugcuucaggagguuggaccaaaggaccgcugaccccacauuccuuuacaaaacuaaggacuacacccccacuuucguauugccuuaagaguagacggaugccuagucaugcagcuuuggccugggcccaggggucccuagcuagcaugacagugauacagucuccacaguagauccugcucauugaggaaggcagagcuccuggcuuacaggcaauaccuccaguagcuaauaauguuuacugaccaucuggcaauugcuuugggaagcaggugcugugauuagcuccaguggaugcugagguggaguuuguggucugguucuagagccugaccuaaauaccuccuccuggcucuuggguacugagaaccaggccugucugcugugauagagucaggccgaccuaggugaggaaucuaagaagaggcagccugacccuucauagaugcugcccuccugaccccuaaaggccaggcuguuccagagcucuccccauaacuuuuacaaaggaaauggucacucuguagccccacaaggaucagauaucaaaacaaaagcgcuaguucugucagagcauaaucagcugaaagcacaggccaguagcaacucuagagaagcuaccugcccccgccuguucauacagcaggcacaaggacgggcaucccagacaagcuaaauguccuucagaacuuauuaaaagaacuccuuguuugaggcuggagaaauagcucaguggaagagagcacaggcuguucuuccagaggacccagauuugauucccaguacccauaaggacacucacaaccaccuguuccacuccaguuccagggaguccaacaacuuuucuggcuuccacaggcacuguacacaccuacaccuacacacacacacacacacacacacacacacacacgcaggcaaaauggcaaggcaacuuuauauauuaaagaauaaauucccuguuuaaaauccacaccaaaaaaaaaaaaaaggagaaggaggaaggagggggaggggagggggaggaggagaagaagaagaagaagaggaggaggaggaggaggaggagaaggagaagccaucguccauaggacugccuguaacagcucaccagcucuguaggugaaagaugaggcucaguccagaaggaacccaagcugggcauuggugaugcacaccuuuacuccacaacuucagagguggaggcaggaggaucucugugaguugagaaucugccuggucuauggagaagguuccaagacacccaaucucaagucaggccugucuucuguugcuucccaccaugguuagccucuguccuaaccacacuguucccagaacuacccaugacagagcucccagacaacagacuaucgcuugcaaacuggaguuuuccaaugcuuuagaucuaccuuuugccaggggucaggcaaagaaacuagcauuauuggaggaauggaauuggauuagcuauuccuuguauggucuuccuggccuagaacccuggucacugcuuaucucucuucuaccgauuuguauggcuauuccauagcucucagcccuuagccaggcauccaucccauggucagccacuccugcauaucccuuuucccuucgugcaaaguaaggagccccuccuuagcacccauucagccccacagcucuaagauggggaggacauacggaagagagucaagugcuaagcugaugcccccaauugaggccucacagcuuggacaacugacuguagggccaccugccugcaaugagcucuuacaaaucagcaguguggccaggcuagccacgugcaggguccccuccugucugauccuggccugguugcacugagaagacugacuggggguaggucucucaccuccuguguggauggaggucauuugaagcccauaucuggcagccaggccaaacaggcuaccuugaguuagggagaauagaaaugguccuauagguaagggagcuagggguacggcacggcuaacagguuuagguuauuaacugaggagccccauggugcugguaggucagggacccuugauccuugagguucugguacuugucucagcugauucucaauaggagccccuaccuaagugcucccucagcagaaaagcacugcacaagcucugcagcucaaggagaaaggugagcaggacuucugccuaaggaaguugugagcuaucuacagagcaggucagggguugggaaagcuacaagguguucuucacugagggaugcuuuguagcucagaguaacagaagagaagaggcuuuuagaguuaccaagggaaagauucccuucccugacaaagggauacugcagguaguagacaggcaaguggacuuaaccugggcaacaaagacuuuucuuucacuuagagcuggcauaaggccccacgcagcuaacucaccuguccugggacccagucugucugucuucuucccuuucacaccaggggcccuuguacuuuggaaaaggggaacccauagaugggacagugguaaaggaagaccggguaggggucuuguuaccuguuuuagccacacgugggggaagggaggccccagcucuagcacaaaaggcccuugugugaacagcaggugccuggaacuggaggggauugucagccauuagagagaacuaccugccuggggaagguuuacauaccagcaaggcucaggccuauggggcacccagagugaggacugugccugaguguggcccucuacuaggagccugagugaagcgagcaagcuguuaaccccucucaucccaggacaagagcgggcgccccagcuuuggugggguuugauaggacaugcagccguagagggcaugggccucccaggggcagacccuaucacacuggcuaugcucaaguccugggcuccagcucaaaugcacuguaccuuuaaaagccccuucucuguuacucuggagugacaaaugaucucaauuggcugcugaggggacugagacagcagcggcugagcaagcacuggcauguggagaggaugggccacugucacuucugggggacaaugcuguuuauuguucuaagggcuagcccagagcagaaccuccaaaaauuaucugaagaguuagccugauauucuuguccacuguuacaggccacuguucacggugaggacaaugucuuuccccucaccugaaccagagaguuccucaucuuuaguucgugcuuugaugauaggggaagaaaaggaguuucaauucauccagccaccccuuuccccagacggggacccgacaggcgaggacagccagccagccuuuacccuuccucuaagaaccucaucacuagccacauccugguagcccacagcccccauccugggcaggucugacagcacaaguggaaaaacacagaucccauaguuuccaugugaaguuuuccugcugcggucucuccucccucagaggagggagggaaacaagaguguguugcaggggccagcggccucaacagucagcuucucugcuuacgcgcccgggccaacugcccauccugucucuccagcuucuacagggaggggcuucaggacccacaguucuucccggugcaugcagccagcuagagggacugagcuuggcuggggcagagaggucuggguucaagacagagaaccuuguguugucauugagcuauugcgguggcugacgguccuuaggcuaagcuagccuccacaugaucagccugcuguguguucauucaugacaacaccaccgucgugguaugaucacauagagaagagaugacagagauggcccagaaaccggccaagggcacuagggaccugacucacacguucugggcucuagugcaucugaggguggggaaucgagaauucuucucuggcuuccugaugugucugcccucagcccugacucauaagcucuuugcucuuagggacagaagaugcacuccaggagcugccugccaccucuccuguuguugcuucuggugcuccuggggucuggaguacaggguugcccaucaggcugccagugcaaccagccacagacagucuucugcacugcccgucagggaaccacagugccccgagacgugccaccugacacagugggccuguacaucuuugagaacggcaucacgacacuugaugugggcuguuuugcuggccuuccgggccugcagcuucuggacuugucacagaaccagaucacuagccugcccgggggcaucuuucagccacuuguuaaccucaguaaccuggaccugacugccaacaaacugcacgagaucuccaacgagaccuuccguggccugcggcgccuggagcgccucuaccugggcaagaaccgaauucgccacauccaaccgggugccuucgacgcgcuugaucgccuccuggagcucaagcugccagacaaugagcuucggguguugcccccauugcacuugccccgccugcugcugcuugaccucagccacaacagcaucccagcccuggaagccggaauacuggauaccgccaauguagaggcauugagguuggcuggccuagggcugcggcagcuggaugaggggcuuuuuggccgccuucucaaccuccaugacuuggauguuucugacaaccaguuggagcauaugccaucugugauucaaggccugcguggccugacacgccugcggcuggcuggcaacacccguauugcccagauacggcccgaggaccucgcuggucugacugcccuacaggaauuggaugugagcaaccuaagccugcaggcccugcccagugaccucucgagucucuuuccccgccugcgccucuuagcagcugccaggaaccccuucaacugcuugugccccuugagcugguuugguccuugggugcgugagaaccauguuguguuggccagcccugaggagacgcguugucacuuuccacccaagaaugcuggccgacugcuccuggaucuggauuaugcagauuuuggcugcccagucaccacuaccacggccacaguaccuacuauaaggucuacuaucagggaacccacacuuucaacuucuagccaagcucccaccuggcccagccucacagagccaacuacccaggccuccaccguacuaucgacugccccaccaaccaugaggccagcuccucagccccaggacuguccagcauccaucugccugaauggugguagcugccguuugggagcaagacaccacugggagugccuaugcccugagggcuucauuggccuguacugugagaguccaguggagcaagggaugaagcccagcuccauaccagacacuccaaggcccccuccacugcugccucucagcauugagccggugagccccaccuccuugcgugugaagcugcagcgcuacuugcaggguaacacugugcagcuacggagccuccggcucaccuaucgcaaccugucuggcccugacaaacgacuggugacauuacggcugccugcuucacuugcagaguauacagucacccagcugcgacccaaugccaccuauucuaucugugucacacccuugggagcuggacggacaccugaaggugaggaggccuguggggaggccaacacuucccaggcaguccgcucuaaccaugccccaguuacccaggcccgugagggcaaccugccacuccucauugcgccugcccuggcugcuguacuucuggcuguguuagccgcugcaggggcagccuacugugugcggcgggcacgggcaacuucuacagcucaggacaaagggcagguggggccagggacuggaccccuggaacuagagggggugaaagccccuuuggagccaggcuccaaggcaacagagggagguggggaggcuuugucaggugguccugaaugugaggugccucuuaugggcuacccagggcccagccuucaggggguccucccugcuaagcacuacauuuagacuggugagaaagagcagccagggggucaggcuuucagucaccacccuccugcugccacagaaggaaguucucaguauacaccacagugcacgugcaugauggagcugugggacccucucugggcugggucucaucuguaagcugcuacagcccagaugaacucugccagccgccagugcauccaguacagcgccugccaucuugugcaaugugcaacccugggaugugagcccugccaugugcugguaacauggcuaggcauguugggcuucccaaaccauggagucugguaaccagugaaggaagcccccagaaauaaugaguggggaagguacuagggcacuggccuuggccucaaaagugcaggcacacuugaaacuggaaaggaaggugcucugggcacauguggauuugcuucuauuguuuuguuuuguuuuuucuaauguauuuauaaaagaucuuuucccauuuaugcugggaaaguguuuuucaaacucagugacaaggacuuugguuuuuguaagacuguugaugauaugaaggccuuuuguaagaaaauaaaaaauaaaguaaauugccugucucucugguugggcuugagauuuaaggucuguggacaugcacaggauuggagggcugcugcccugccauuagaaugcucuagccauggguccugacccaugguaaggcuugcacuuggguggggccggaaaauggacuuguuagguagcuuacccuaggcuaggccuccucuucugccagcaggaaccacagugcuuaauguauaaggcagaaaggggcucauagaaaacacagaacacaaagggaggucacaucccuccuuggguguucugaaagugcaguccacuaucuucaacuagagaagacagccuggagcuuccucauucuagagccuaacagcugauccugggaccagguggcuuccagacuggaccacagagucuuaggcuggcuagguauguguguccuggcuccuuccugcuguccacacuguucuggcacaagccuagcuguaaugaagggcaguggugggggaaauguggauuaccaaggcaagaaacccaguggguggaaaggagggccagacagaacauuagcaguaaggacagggcuaaaggacugccuggcuugcagacggugccaaguuuggugguauuccuuaacuuccugcucugggaugugaccaagaauucuagaaccccaaaggauuguuuccuaggaagacuacaggcugugggggcagcaagacuagguucaaggacagcuguagccuggacugggugugggcagcuccaaaaacugauggcucaucuuugucuguuacccuuagggcugagagaggaguugggcccuggcagaguagaagggcccagcaaaagcagaagccagucucucacaggcugcgaugccaaucagugucuucuugugggucauggccccgguaccaggucucgccccugaagggaaggaguaggcccagccaggccuggggaacaggcccugugguuugggguguugaugucagcaucaagucaggcugagccacaugaggcucuggauucaauuaguggcugcugaggcucugggagagggaggagguggauggugggucauguuuggcaguaggugguagcacuggccaggguggggcuccuuucuacugaggcugcaguguggcggcagcagcccagguggauuuccuguaggccuggguucuauuagggcaguaggcguggcgaggcugccccucucggcagccccaucaaaggggccuuugugggccuguggggcacugcugaagagcagugacugccgaguaaauguuuuugcugcaaagcaaaccuggcuuagagggauggcaggguaggguggcaagaccuagagaagggggaggagcccuccaagaaagauauccagaucaugucaucccuggugggguccaggccaagaugccagccuccacugaagguaauucucccagcgugaggccaggcggauguggggaggaaauuugggcucuucucaccaggagcaugguuccuuagagcuuuggaaacucaaguuccaagccacaaucuccuuuagggaagaggagaacaucccaugggagacaacaguaacagcucguaguggcaagauggaugggguccuaacaccugcuuccuggucuccagcaaggugaggugagcagcugcagggagagcuuucacccucuugcuauaaaaagcaggacuugcaguucacucacacuuccauacaaucuccacagacacagcaccucaguacacccaggagcaaggaacaugaagcaggcauuucucuucaccucuuggaccaaagcugcucuuuaguaggggcuuugcagaacuuccugcucucaugcaccuucccccauguugaaccugggaucugguacaugggaaaugcugggacauccucugcaugucagcgugagcccuccacaaggcaugacgaagccuggcaauguucugccacucugcacagagcaaggauccucacagacacucuagaaaugaccaggaaagugcagagacaggaaccaugcaaaggccuuggcagagauugguggugaaaggcacgugccugacccuugagcccuguagcucuugugaguacauacuguucugccuaaacuaagauggaaacucuguaacagagagaucaagaguggcaaggagacacagcugccaaacuccccuauggcuguguccagaguuggcacucuguaaacuuuccaucuucacaaaugggggaggggggucugcuuuaugauaugccuaggaggacccagggaccuaccaccucucugaacagucuggauacuggcgugugccaaugucuaccagguuuguggaggcuggagaguccuagcucccuugccaagggugucagcuugccagggcauaagccagaacugggggacugagggaaggaaugcuggccugacagcccaucugggaguaauuugacaaauuccaguccuuguugguccuucgaggcuauucuuaacugcaguaauuacagggucagccuggccaguggcaccauggggucugggcaugguuaacucuuccaagggccauccuaaggcuaggcaggagaugcccugugggggagggaauagucuaaucacuacagacugauuggcuggaaguagcaggugaagaauacuggacugaaggugccagggaccccacagcaccucugcuggaggccuguagaaaacaggucaucuggcuugagugucuggaagaaacgaugcuaggaaggacagugccaggccugggguggauggacaagacaaacucugguugugcagccccaaggcuagcaccucugucuccuccaaggcaugaccaucuugaugauagcuuuuucuugagaccuagccccaacccugaauaugucucagcuuugccuucuucacucuaaauagauaucaccaagucaggcagugguggcacacgccuuuaaucccagcacucgggaggcagaggcaggcggauuucugaguucaaggccagccuggucuacagagugaguuccaggacagccagggcuacacagagaaacccugucucgaaaaaccaaacaaacauccuggcuucuccucauccauuagaggguaggaucucccugaccacaccucauucucugagggcauaaacaauauuucuuucccaagcauucccugaccccacauaugauacucuuguuucugggccuuugagaaguccuugucccucaugauucagguucuucaguucugagacauccuagaaaggaugugcuggacaagauagcuaagggcaggacgccuuucuuggaucuaguauucccuggaucuagaagggucucuggacagcccuuccauuagucacagcuauggcuucagagcuggaauugagucccucccuccuuccccugcagccaugccuggccugucaaagucucugauccucuuggaaccuucauuuccuuagcuauucuuacagacugaauaagugcuuauccuaagugccagcuugcuagugccugguuuauaagccauuacagaccaaggccauuucuccacaaagcugcucagccuggccagggaucccaccaggaagagucguaaacuuucuuccacacuguucugggaggcacugggagggaagaaugagaguaugaagcacacguuaccauccugugcugucugggaacaaaugugaggcaggucucaagcaagcuucuuacacaaauggcaguagacuccaagcccaccuguagcugccacacacacacgggcaaacagccguccgccccagcaucucagaucucauauccacuagugucucucuuccuaccacaaccucaaguauccuugggcccucagcuccaugaaaacauccacagcaaaaaccacgcucauuccugccaucugucccccugguaacacauuuucaaggucauaaccccuacccuaaauuuaaaaacacacuuaaaugaaccucuagagagugaagugugcccacgaccaggagacuacaugccugacagaguucauguacuggcccauuuaggacugccucagcaccaccugccggagaagcuggggauccugcaggguugggcccagguccagcccaggcucggcaucugucacgcucuagggagcagccagccucaaugucggggggccaccacuaguggucacuugggacaccuucuaaacacuaggcucccagcucccagucugucaaaaguccuacccaggagagguguccagggugacggaggccagggcacugcugaagagccggguaucccagagcuucgcuucucgcucacgcaucuguggggaagccagagcaaggcucagaggagucucccuacuucuggaacccagugcccgagggugcagccuggcaucgccacugccccagagcauaagggagucauggcagggaagaagaguuuggguuucauuuccugcccugccccuuuaagaacuuuuaggugacuagggacaagggguguuucucuucauggacucuggucccuauggggcccgccauggcuccagaggucaagcuuagcuacugcaaauggaaucugccaguuuucuaaagcccucaguucccuggggcccugagacccagcugcagucaggccguauauggacaggccuauaacuggcugucugcaccucaccucccaauggccucacccaacguucuugaagcaagggccuaaaggacuagacaagacccuggcuggcaguaccaugagugcuugaggaaccacuaccugguugaauccaguggacacaaggugcucuugaaugccuguccaugccaaccggaugucucuguuguucucaugggccugugugcucugcaaaagacaagagacagcacugagccaccagggcccccugcuggggacaaggaucucuugaguggcugggagcugggauguucugugccuacuugucugagcacccacagagaacaggggagguccugaaggccacaggaaucacaagaagagccuugagggucccugcaugcaggggacagcaggcucagcuucauucucccuccuucugagagggcuggugugguggggccaccucuguagguaccccgaggaagcugauggcugaggguccucauucuggagcuguaugaaccuggggaaugcacacccucuacagagcucaucuucucacuuguaaaugaggcuuacagugcccgugccacccacuccuuggggcugccuagaggaucaacugaaagcgcacacagaaggacugggccuugagaaaagccccgugcaaaucauaggauuagagggauuauuucugccuccugucgcugccaguaggccagagggagggccuggggccaagcucuggguagcauccugggaaggguaaagcggugccccugguggcccuucaggguguuggagcaucugacagacaggaaggcuagaggccucaagaaaggaagaaguucacauaacaggcagagcaaaugguccugucccccuugggcccuggcaggagggaguccaggggccagaggaaaugcaaacagcuucucucccagucacccuggccccuagagccugagacaaggacccuguuaccaaaaauagcucacccaaauguggccagccuccuccaaacuucccacgaucuuguccuugggaaugaacgagggagggaagcaucguggagaagcugucccugggcccccuccccagcacacagaggcugaccccagcgugggagaccacuggaaaugcuccgccuguccuucaagggacuuuucccacuguucccgcccacccagccacagugacacaggaaguuggaguuagagccugagaacuaaggcccaacacuucucucuccauguaagaggggcuuaagggucaggacaaaggugaagccauuggccugccccaccucugacacacucacuauuacgggucagaagugcugugugagcucuuguuccucaugagugugcagaaucccuugugaggcggaaacuggaugguuuguaacugguuugcaucucacacacucacucacauuuaacaagcacgugaggcuugccauggcaagagcugugcuaggagcucacagugggguaggacagguuucaaagacaagcaaugugaauaugccgugcuaggagcaggagacacaggagacaaagcagguccgguuccuaaguccaugggacauuuauacaccaggaggccaagaagacuaaacgggguaacucaacugcugcggcuauuaagugccacagaggagaaaacgaaggcugugagaagcacaaagacaccuucccuggacaucuacuucaaggacuaaguauuaaaaucuccuaaaugcucagcacugaaccuguauugugcuguuugaauuggggggaggggggcacacguuuuuugagacagggucuugccaagucuaguccaggcugaucuugaacacuugauuuucugcuacagccuccuaagugcuggauuuacguguuuucagaugugcaccacaacauucagcuacagauaugcauuuuacaagguaacacggcacagaauguaucugaaaacauuacaaaugauguuuuguuugcacuagaaugaagacucuauacagagcuagcacugcagagacuggaagggaacuucucccagggugggggugauuucuucagcaacuacaacuagcagcagauaccuacguguuucuuggcugccucuccucccucuccccagcucuaguuuugaaacagggaaucacuauauaagccacgaugauacuaccaccaccuuccucuuuagccagcaucuugacauuaggagguaguuagaaagcaucguccaaaagacaaguaagagggcuuguccugaccucuccugucgcuaauucaggucuugaguccucaccacugacagccaucauuguucaaacucaagagcauuauguugcucagagguuaaggguacuacugcuucuccagaagaaacaagccugggucucagaacccacauggcagcucacagccauccguaauccagucccacuuacauacaugcagaacauucauacauauacaaauaaauacuuuaaaaauaagagcugcugcuucucuggauuggcaauggcuucagggcucuacccuaaacucugucuuaagggacagcagagagucuaaggagagacugcuggguccuaggccagugacaguggggacuucuucaucucaaaaauaaaauuaagccaaagacaggcaagccaagccaaggcaggaagaccagaaguucaagaccagacucagcuguguaguaaguucaagacaagccuaggcuacaugaggcccugucucaaacacaaaaccagcuuagcgguggugcuugccuuucuuuaauccuacuacucaggaggcagaggcagguggaucuaugagccgaaggccagccuggagagagagagccaguuccaggacagagcuaaacagagaaacccuaucuugaaaaaaauuaaaacuaaguagggguauaaaauacaguagggagcugggcggugguggcacacgccuuuaaucccagcacuugggaggcagagacaggcggauuucugaguucgaggccagccuggucuacaaagugaguuccaggacagccagggcuauacagagaaacccugucucaaaaaaaaaaaaaacaaaaacaaaaaaaaaaaaaaacaaaaaacaaaacaaaacaaaaacaaaaaccaguagggagccacccaagggucauuugcuccaagaccaagugccuagaggaacagggcaaaguugaguacaacucuagugguauguacagccuccaaccucuggggacaaugggguucagaugaggagaggcccagaaaaggcacagguaggaggaugcagggcaguacacuguacccacccccaccuugacuccuguuagacaggaagggggaacucagagaaagcacuuucagaaggagucucgcugagcuggccccucagcucacaccacccuggccaacagccgugguuuuccuaauagaagccaggugugggccagaugcccugggcggaaguugggggugugugugugcagggacgguuggagggcagcauuccaggccugcugcugcccccgcaucgcauagagccaagcacaggcaccauccuggcggccaguggagcugcccacgcucuucccagaucuccuggcuaaagccccuccagggggcuccugcagacuccccccccccccccaaguccucaacgccugccuguuuucuucaacaacuuggagcccgccccuuggcuagcagccacagcagcuccaccucagccucacucacagaccaccucugugggguguuagggaggcguaggaggggagggaaaggggagggggaugggggagaaggcaggcuggaaagaggccacuggaaaggagaauggagaaggaaaaaaacuaaaggauuuggccggguaggcgugaguacaagguguugugccccccaaacccugggcaagucacccuuaaaggggcuucuaucuuaccuuaaaacaaaucuggggacaucuaaagcuuagagaucagagaaagccuuccaggcaaggccuacaucacccugagauucaaauaacccugugggaugggaucagcagggacauggggcuaagguguggccaacuuuggcucucugcaguucuauccaguggggccucguuuggcacaauagauuuuugaggaugaagggaugccccaggcuguccuuaacuccccacggggaacagaacaagagggcuuaggucuuuacuaggaaacaagaguuuguacuacaccucccugggggugggggugggccaagccucaucacauucugguucuuuuuuuuuuuuuuuuuuuuuaagauuuauuuauuauuauauguaaguacacuguagcugucuucagacacaccagaaggagucagaucuuguuacggaugguugugagccaccaugugguugcugggauuugaacuccugaccuucagaagagcagucgggugcucuuacccacugagccaucucaccagcccacauucagaacaaauucuuagggcugaagagacggcucagcugucuagagcacuggcuacuuaucuagaggacccccaggaaucugauucccagcaccuacauggugcuccuaacucucuguguucaaaucccagaggaucugauacucucuuuuggccuaugagggaacuaggcaugcauguggugccacagacauauguggacaguacucauacccauaaaauaaaagugcgcugggcggugguggcgcacgccuuuaaucccagcacuugggaggcagaggcaggcggauuucugaguuugaggccagccuggucuacaaagugaguuccaggacagccagggcuacacagagaaacccugucucgagaaaaacaaaaacaaaaaauaaaauaaaauaaaaguuuuuuuuuuuuuuuucuuaaacuauccuuuuucaaaaacgaaauagaaauccuagaguuagagacaguucgggguuaaaugugcaugauucucuugcagaggaucccaguuugacuugcaguacucauguuagacagcucacauauauguguguuuuauauauauauacauauauauaacuguuuuaguuauauauacauauauaugacaauuuuuuuuaaaaagaaaagaaauauaaaucuuccaaguauggugguguacaccuuuaauuucagcacucaggaggcagaagcagguggauugccuaaguucaugguguacauagagugccagcuggggcaacaugagagagagaaaaagagagagaccagaaaagauggcucagccccggagggucugggcagaguucccagcacccacaucagguggcucacaaccaccuacaucuccagcucuaggcagccaaucuccugucugucuucagugggcacccauguauauaugugcacacacagucugccccacucuuccccucccucccuuucccucucucucuuuucccccacuucccaacacacauaaauaaauaaaucuugagagagaggggcuggagagauagcucagugguuaagagcacuggcugcucuuuuagagguccugaguucaauucccagcaaccacaugguggcucacaaccaucuguaaugggaucugaugcccucuucuagugugucugaagacuuauacauaagauaaauaaauaaauccuugaaaaaaaaaacucuugaaagagagagaaaauacaaauaggaauucacuggucucacucccugccuacaagcccaggggaccuguguaaacagccugccucuccucuggaccuuucagaugauuucuagaacaagcucucaccuucccucuauaccccucuaaugacuucuagaacagucuucccaccucagucccucugcuuagggccucagggaaaacugaguccuaaucuguaagccaguuccucaggacaaacaccaagcccucccgaacagagaaccuucagcaaucaucaggggcaaggccagauguguggcuagcugauugcugucuacaggggucucagucugagaaauaaaugacucuccaguggcccucauuuggaaaucaugacaauguggcuuccaggcaccaaguaaacagagaauaacaaaauaccuacaguccccaggucuaguaggaaggggauaugaguccaucccauggcucacuaaaagaccuagauacagaaagugaugaauugaagauucuuucugacuccuaaguagcuggucugugcugaccaugcugagaaaggaaggauggguaucaaaggaggggaggaaacugaaaucucaaauuacauucuugcagucagggaaugacugucugugggcagccuggcugggucccacccugugaucaaagcuaggcccuuacaaggacccagacaucaggccucugcacccugaacuccagcagcagcuguugccaccgccaagucccucacaugcuggacugugugguccucauccugugcacauaacucaccugagaagccuggguucuugcucuggggucaaagauccgaagcugcuuguccuaaaugaagaagagagaaagaaccaaaugauacaguuaacuggaagguugcuggaggggggcagccugccuucacacuacaggcucucagugaguccuacauuacacagacggucuccaaagaacagagcuuacuuccuucuuacuuggaagguccccuccugcccagacucccagaagauuauauucaacaacauuccaccuuuuaaaaaaauuaauuaauuaauuaauuaauuuauuuauuauuuuuguuuuuuucgagacaggguuucucuguguagcucuggcugucuuggaacucacucuguagaccaggcuggccuugaacucagaaauccaccugccucugccucccaagugcugggaauuaaggcaugagccaccacugcccggcuuacccuccacuuuuuuaauuauuauuaucuaucagacaugucacguguaugcccucuccacagccuuucuguucucuuucuuucguuugcuuuuucuuucuuucuuucuucuuuugagacagguccuaugcaaugauguuacuucugcacuugaagaacuucauccugagacuagagagaugguucaguugauacugcgugccaugcaagcauguggaccugaguuuagucccagugcuuauauaaaacaaggugugcaucaguaagccuagccauggagcacgaacagaagggcacucagcucucacugcuagccagccuacccaaaacaaagagacccagguuugguaagagacacuaucucacaaaauaaaguaggggagggcuggagacauggcucagugguuaaaaguaauggcuccuuuaccagaggaccuggguuuaauuuccaacaccuacauaguggcuaacaaccauuuauaaccauauauauccaacuggccugugaaggcacugcacucauaggaucgcugucuucagacgcaccagaagaggacgucagauuccauuacagauggcugugagccaccaugugguugcugggaauugaacucaggaccucuggaagagcagucagugcucuuaacugcuaaaccaucucuccagcccagauuaaaugauuauuaaacauaaaaagaacuaaucuuuccuaaccauccuuucagugcaccaacugaucaagauuaccugagggcucagaugaaaaaagacaaaugcucaugcccuauauacagguccuauuucugcaagaugaucugggugucuacaugcugucaacaugcccaagcacaaaugcauaaaagcuggaauguaugccuggccgugaagcucaguaauaaagcccagaccuagcaugcaaacauacaaaagauccugggaucaacaacucaaagaaaaaacaauucaguagaguuucuacucacuauuuauagauuuggccauagugaauuguuaggcacaaagagggaguugaagauaacaugccauggugugagucugcuaugguuacaauaaauacaaaucuccauuugagugaccaugcucuuagacacuuuggagucaagcagagagaaaagacugaacucagaccagugaguuaaugcugggugugagggaugugaggggaaguggaggccagccgcauuuccuuucuauaguuuaguacaguucaacuuugucuccaucaacacagaugccugcuuucauauuuugaaaaaugauacucagacuuacaaauuuaaacaucaccacuugcaucagcaccaaggaaauuaaaugcuuauuuauaaaucuuacaaaguaaguauccacaaaacaugaggcaagcuacaaacaccgaugaaagaaaccaaagauagaaacuaacgauugcauaguccauuuuuauggauauaaaaucaguuugggugaguaaagcuauugcuguccaagcuugaggacccgaguuugggucacuaguacgccauaggaaaccaggcacagcaaggcacaucuguaauccaagcaccagaagauggaggcagaaagauccagguuagccaauugguaagcuuuagguucacugagacagacagugauggaugggcuggguacagugguucuacacagugagccccagaccagcugugaugguuugcauaugcuuggcucagggaguggcacuauuuggagguguggccuuauuggaguaggugugucacugugggacugggcuuuaacacccuuguccuagcugccuaguagucagucuguugcuagcagccuuuagaugaagauguagaacucucagcuccucuugcaccaugccugccuagaugccaccauguucccaccuugaugauaauggacuaaaucucugagccuguaagccagccccaauuaaauguaguccuuuauaagacuugccuuggucauagugucuguucacaucaguaaaacccuaacuaagacaccagccaaugcuacacagugagaccccacuuaaauaaaugaaauaggguagaggggcuggugagauggcucagcagauaaagguacuugcuauggauccugguuggguuuuuagucaacucaacacaagcaagaguuacauaggaagaacuaccucauuugagaaaagucucccaucagauuuccuguagguaauucucuugacuagugauucuuaugggaggacccaacucaacuggggguggugccuccucuggguacaucauccuggaugguguaagaaagcagucugaacaagccaugaagagcaagccaggaagcaagcagcacccuccauggcuucugugauagucccugcccugagucacuccugacuccccuuagugaugcaugugaccuacaagugagauguaaugaguguccucccaggucguuuuugaaggcaguauuuuaucacagcaauagcaacccuaacuaagauacuguguaagucugaagaucugaguuugaauccuggaaccauaguacaggugggaggaggaaacugacugacuccauaaagucauccucugaccuacccaacuuguguacuauggcacaagcacaaaauaacuucuuucuuuucaguuuuuaaagacaaggucucucuauauuagcccugauuguccuggaauucacuauguagaccaggcuggcuuugaacuuggagagaccucccuaccucugccucaggacugcugggaauaaaagcaugcaucaugccugguuugggggcgugaaaugcugacucaguaguuaagugcucuuaucgcugucaaagaggaccagguucaaucaauccccagcucucauucacaaccauuguugacuccaacugcagggguccauagcccucuucugaccuccaugagcaacaagcaugcacuggugagcauacaaauaugcaggcaaaacucuugcacagaaaagaaaaugaauauauacugggggaaagguagacagugauuagagaaagccaccaauguccggucuacauguacugcacaccccucuccaacauggagacacaucagcaaacaaccucaugaaaacuggacuucaguuucuaauaauuuaucaauauuuauauaauuguaacaauguaucuaacuaaugcaaaagguaauaaggagaagcaggcaugagauauguugguaaucccagcacuugcaaggcugaggcaguagaagguuuccaaauucaaggucggccuggguuauauaaaauacaguaacaggucugagcauggaggcacaugccuuuaaucccagcacuaaggaggcagaggcagguggcucuccaugaggucagucugaucuauggagccaguuccaggucagucagggauacgugguaagaacccgacucaaaacaauucaucuuauauacaacaagguaacaaaggaaauggauguggaggggaaauauaugaacuuucuguauuaccugcuauauuuccucuacaaaacagucugcuaaauaaaacuaaaacugccaagaagugacucgcaccuacaaugccgguggucagaaaguggaagcagaucacuuugaaucugaugccaacuuggauuauguaagugaaguuacaggucagcuugagcuacaggcuaaggcuuaaacuauaaccugagauccugccucaaaauauguuuugggggugcuagagagauggcucagcaguuuagagcacuggauauuauuccagaggacucaaguuuaauucccagcacacacauaucuguuuacaaccaucuguaacuccaguuccagggauccaugggcaccaggcaccuauaagguacacagacacacauacagacaaaacacauauacacauaaaaaaacaaaacaugcaaacaaaaacagaucuuuucuguuuguuuguuuguuugguugguugguuuuuugagacaggguuucucuguauagcccuggcuguccuggaacucacauuguagaccagacuggccucgaacucauaaaucugccugccucugccuccugagugcugggauuaaaggugugcaccaccacgcccagccuaacaaaaacagaucuuaaaaccuaucaauaaaugaauaaaagaucaaauaucagggaagccggguuaaugcuugcucugugcauagcuggagucugugcuugaggaggaacaacgaacagccaguuccaggaaggacaaguucacagcaaaaggcugcggucuccagccggagacucacaaaaaagccuggaagaaaccugaguugaagcucaaaagucaaguacgagacaagguggaaaaucccaucaagaugcugagacaggcuugcuggugcauggugugaggggaaagacacacaacgaagcagauagggaagauggaggagcagugggcaaaacugagcugcaggaggcacauaguggcuagacagggcuggguaccuaggccugcuaggacagucagggaagcccaaggucuucuggaaaagauuucccaacugcacuuugcucugcaccaagcacagucuggguuuuggguccugagcagcauugcccccaacagucaggguucuuggggccaugugacaugcgaucagccacgaagaggaggaggaggagaggcagaguaagagugagcacagcagugacagcagagggcagagaagaacguuagagauucagaacggggaaacagccacaagggaugaacagccacauggagauggaaaguuccuaaacaggagagcuagagagaacacuucucacucagcagggcuagaacugcugaggagagcuggaugcauacauucaaaugcuaaccccaccacugaccagcuuugugaccugugcaaacagcguccacugagcaaugaccagguuccagcagcuucccuuauagggaggcaacaaacuccacagagaaccaacuaagucuaacaguuuaaggcuggaugcaaaccagguucagagcaggcuggcuuugagcucaaagcaggccaagccugccaucugugaugguugugcgcccucuaguggcucuguuuucuucucucagucauuaggauuagccugagugcucagagaggaggcugagcagcccugcuuuagcagugguaagacaggacucagguaccccugauggaaaaugucaugccauuuuggcagcacaagcagcaauggcaauaagcuguuaggccaaagccuagucuacaacugcuggcaaagaggggcucugacucugucucauggagugagcuuaccuaccacucugggcauccuauguaagcccaugggcaucuccaccuagccuguggucauaaggggcagccuccugcuaucaguacuauauuaguaaagcuaggacuuccucccaggaucucaagacaccuuuccagcgaaggaaagcagaaguggcauaugaucaagguaccuucuaguccuagcaugugcuaggggccagccuggaagagaugguacauccccaccgguagcacaccuaggucuggaaaagaggggaaggagcaggggccacuuuauaagcucauaacuuuacugugccuucugccugggaaacagagauugcuuguccugaaagcuuugagcucuggguauagagaggaaaugucuucgugugcggaacuagcgugagucuccugggcuuggcuuucuccaucuaaguuugccuugcaagauacagcaggccacccaccccucagacccuaaccuuccuaccuguucacugccaccacaagaccaccagcucuuacuccugaaggcucggcagugucuccaaaccacagacacaugcucacucugccauuccugcccccggaaugaacucugccucuggcugaggccaaauccggaucuaugaccaaucugaucaguucaaagcacuaugucccuuucagagguuaaguuacaggucauaucugccuaguuaucuguacuguccuugaagcaaguuggauguuauggaaggcuauuuggagaaacuauucaggcagcugguauggcuuugcuuauaggcaaaaucaaaccaaacagcacaggccagcaagaggcagcgugaacuuuccucaagccccucuaguggggccucagauggagcagggagcucaaaaaugccaaucccuagcaccuaggugguggcgcacgccuuuaauccuagcccuuaggaggaagaggcaggcagauuucugaguuuaaggccagucuggucuacaaagugaguucuaggacagccaggacuacacagagaaacccugucucaaaaaaacaaagcaaaacaaaaaaaugccaauugacugacuuggcucuucagcucauauuguuaagcauacaaggcugaucauaccagccccacaugauguuuuaagacugcuugcugccugcuuaccuuacaugcugugcccacaauggcuccaucccggcuccaaacagcacucugcaccagguccuugugggccuccaacucugcagggaaacagccaagguuaagcaccaggugcugagggaagcaggggaguagaugaggggaggccugccuugggguaaccccaguugcaaagucagcagcaaugauggucuuucagccugcagggaguggggacagcagcuuuaucaagacaugcuacagaugcaucuacaggcuuccuucaagucugcccucaccaggauaugccucuauuugauaacccucugaggcugcugcaugcuuuuaaucccaguacucagugggcaaaggccagccuggucucccacccccucaggaaaaagcuuccgagauucccugcuccgcagcguggcucucauuucccaggcacauuugcuggcucuaacacaucccgaaccccggcacugccaccaccacugcuuuccagcucccuccuccuucuguaguuuggggguuuggaguacaauagaugccugcuggaagcggacagugauauacuacucauuauaaggcuuuagaauguauacccuaugccugucaucuuuuguagguuguuggggauggaacccaggaccucagaaaugcaaggcaagcaagcacucaccaucgaguuguaccccauccuugauauuuuauuuauuuauuuauuuauuuauuuugguuuuucaagacaggguuucucuguguagcgcuggcuguccuagaacucacucuguagaccaggcuggccucgaacucagaaauccgccugccucugccucccaagugcugggauuacaauuuuuuuuuuuuaaucauauuuaaguacauuguagcugucuucagacacaccagaagagggcgucagaucucguuacaggugguugugagccaccaugugguugcugggauuugaacuccggaccucuggaagagcaguuggguacucuuacccacugagccaucucaccaacccuacuuuuuuuaaaaaaaacacuaccaaaaacaccaauagagaagggaggguuguccagacaggggcugccagagaaggggagcccuuccagagugaccguaccugucaggggcugcugcuuggcuacaucccagaccuucacagucuugccagcugugcucaccagaacaccgucuacagugggguggaacugcaguaccuccacuggcagcuccucaggacccagcaccacuccaggcacagagggaagcgcuucuccagugccagacagacgccaaagcuuuaucugaaagaaagauggaguuuacgauccaggugcugagagacacuacgauagccagaccugcccaaagcuauccugguccuaucaagaaaggucccaugcugaaacaaggccuauccacaagaggacaagguaucucaccugccuuagcuguuggaguuagguaaccacauaucuugccauggagagggagagagcccaacucaggaaacauaggacgugaucagagaacagcaaggaugggcugugagucagggcauggguucugaacuccucuuuggccucacacaccacccuagccugcuccccccagggcaaacaucuauuguaagggcagaucacaacagcagcucugagaaggcacuuggggcgagcaagggcauaaacagaagccagggcugcuuggagaccccaggguguagggggugggucauaggcagcucuuggaaucagccccacucaccguccugucagcugaaccggaggccaggaggaagucaucaaagggggagaaguccaggucagugaccaggucugugugggaggagcaagcggaugugcugaauagcccuuccuuacagaguuucaguccugucacuuucuuuuuugcuuuuuugguucuuuuucgagacagaguuucuuuguauagcccuggcuguccuggaacucacuuuguagaucaggcuggccucgaacucagaaauccaccugucucugccucccaagugcugggauuaaaggcgugugccgccaccaccgccgcccggcaucacuuucacccacauuaagaagccacauucuuucuagacacaucuaggucucuuccuacaacacauauccuggugaguccuuuggcugcucuuucuguaauuauauuagaguagagcucuaccauguguguggucuguguugcuucuagcaacaaacugcacaguuacguaccuuuggagguuuuguuguuuguuuuuugaggggguuucacuguguaucccuggcuguccuggaacuuguucagcagauccaucugcuucugccuccuggguacugagauaaaagugugcaccaccacuacccagcuucuuuucuuuuuuuuuaaguguugaggaucaaacccagggcacugugugugcuaagcacacccucuacuacuuccaugcaacugcuacccacaguugaguacuuggggcagaagucuuggcauacuaacauacaaacucccuugaacuuuauagaaaauguuugauggcccuacucugugccuuaaugcaguaucacacaguauaguacagagucuuucugaccaguuuguuucucucucucucuuucuuuuuaaaaaauauuuauuuauuuauucuauguaaguacacuguagcugucuucagacacaucagaagagggcgucagaucucauuacagaugguugugagccaccaugugguuccugaaauccuucggaagagcagucagugccucuagcccucuuucucuuucucucucucucucucucucucucucucucucucucucucucucucuccuuccuuccuuccuuccuuccuucaauuuuuauuagauauuuucuucauuuacauuucaaaugcuaucccgaaaguccccuauacccccgccccugccgccgcccugcuccccuacccacccacccccacuccccuaccuacccacucccacuucuuggccuuggcgcuccccugcacuggggcauauaaaguuugcaagaucaaggggccucucuucccaaugauggccuguuucuuucuuucuuaauuaauuuugucuggcauguggguguuuugccuacacguauguuuguacaccacuugcaugugugauggccacagaggacagaagauguuagguucccuggaacuagaguuccagaugcucgugagcagacauaugggaacugauccuggaucugcaagagcagucauugcucuuaacucucuccagacuuucuuucuuauuuuuugagauccauugugaugugacauguaaaaaagaaguuucucucucucccucucucuuuuucuauuauuacugucauuauuauuauuauuacuacuacuauuuugucgggagugacuuugaacucccgagucuuuuucucaagugcgaggauuaaaaguaugugccaccaaucuggcuuguuuucucaucugacuuuaaacacgguugugguuaaguauacauauugguguuuuaauuauuuuauuguaguuaguguauguguauguaugugcaggcauacacaugucacggcagccugugaaggucagaggucaacuccauugaguaaauucacuacuguuccuugaugagacccaaggacuaaacucauaccaucaagcauccauacaagugccucuaccuggucagccaucuccccagaucagcaguaguuuuaaaauaacccacauugggccugugagaugccuuugcagguaaaagcauuugccaugcaaagccugaugacuuaacuuugaucccuagaacuccuaauggaggagauccaacuccugagcugucaucuguucucacauacaugcuguguucuccauacaugcugugacauauguguaccucaacacugacucuuguaucucuccuucacacacauacacacacauaccaacaccaacaacacaacaacaacaacaauaauaacccauaccagcauuugggaggcaaaggcagauggaucucugaguuugagaccagccuggucuacagagagagaauuccaggacagucagggcuacaaacacaaagaaacccuguccccaaaaccccaaauaguagcuagcuagauacauagaucauagaugauagauagauggauagauagauagacagacagacagauagaaaaauaacccacauuuuggguuaaaaaaacccugagguucagaacuagaaucaagaucuagaugugccugaucucauguuugcuucuugaugcuuuuuacuuaugagggaacuacuccaaguuguuaaugucuggagaguaguaagcccccuaucaauagagcacucuacacagaaggcagaacagugugcggguaaguugguagcucuggugcagugacuuuagaguuuuucuuugcagggucccugcugucaggcugcccuuucauguaacuaagcucuggcuccccagagcccucccuaagcugagguugguagcauagaucuuuuaagucuguaauucuagcuacuugggagauuggaacagaaagaauaaaaaaguucaaagucugcgugggcaacccagugagaggcugucucaaaaauaaacagugaugaaaauauaaaaaagguuaaggauauaacucugagauacagagggcaaugucugcccuagagauaguaaguguuaucuggcccacauaggcaccaauaaagggagacccugggcacacaagaccuggcuacugcccugacuuuggaagcuaccugcccuugagccucuuucaucuuggggcacaccugcuuggaccacccagcagccagaggaauggaauaauaggggcgucuacaguuccaaccauacaaaagacagcauguuaccacgcuggcaagcauggguucugaagcaagacuggcugcaacuaacugucagccacuccuucucagcugugugcuucugggucuguuucguacccuuuggguuugguacccucauuuuccuaguugggaugaugcuguagcacuaacugcuggguugucauggggaucagggaggccugugugugcaaggacuugguaaagguacacucccgugacucagguuaacuccuuuuuagaugccagcugccugcucuacggccuuaucacgcuggcuagaaauccagaugagucacuggaagggucccucuccacauccaucucacuuuccuugcuuccucugacacgagggacagcaguggcaucucuugcuguggugaugcugguuuguugccccggccacagccccaucuuuaacccgcuacccuccauguuuccucuccacugcauuccuccagcccugauauccccuuagcauugguucauccugcaccaccauauucuccccaguuaaauaagagagagaaagagagagagagagaucagcuguuaagccacaaugagauuuguggggugaaucccagcagccuuccacaauuggagguacggccggauguguuaccuuaagaggaacuggguugggugguugugguccaaccguuuccugccugcuuuccugccaaccucagaugguuaugcccgugaaaaucaugugcagaucuuuguuuuagaagcaaagaguaaaaugacugcugccuaggacucugugaugauauuuccuacuagacauaagggauccugauaaacagaaaugcucugaaacaggaugcuggaacccacaacucuauaacuuuaaaaaaacaggcagcuaacagccaucuguaccuccaguuccagaagacccaacaccauuuucuggccucugagggcauugcacgaaugugggacaaacaugcagguaaaacaaccauacacauaaacaaacuaacaaaaacaaccuaaaaagucaacgauccacuuauaacaaagucucuauaugguauccaaaugacaucucaaaacucuuuuucaaaauuuggauuagcgggcuagagagaugguucaguaguuaagaguacugguugcucucucagaggacccagauucagucccaguccacauggcacucacagccaucuguaacaccaaccccagccuucuccuggccuccuuggcaccggcaugcauguuauacacagacauacaugcagguaaaacacucauacauaaagaaauuuauacaaaauuuagauugggcuaggcauauuggugcacaccuuuaguuccagcacuugagagcucuggagaggcagggggauuucugaguucaaagccagccuggucuacaaagcaaguuccaagacagccagggcuacccagaaaaaccguaucuuguaaaacaagaaacaagcacauuuagauuagaagacguucggcauacucuacauaaaucuuggcuuuuguuguuaacaaccuaaugaucaucaucagaacucugacaaugagcagaacccuacuuucagaucucccucaaaccacccuaccuaaggaguaagaauuuauccucuuccuuuaccccaggucuuuaauaagagaucuagcucauagaaaccacagcuauggagacuaagccgacuaggccaaugccuagaguauaauaaauguuccccaaagugggcauucugccacacaggcugcugaggacccccagaaucagcugcagcagacaaaaguccuuuguaaggguucaucuccacccugcagcucagcauagccacucccuggaguggcuuuuagcagcauggcugggcuuagaaaugagaggugcccugcuagacuccagagaauauguagggcugagagccauaagggugugugucugguccucaggaaggaaauccaggggcccaggacuuccuucugccaccccgauggacuggaacaucuaccuuccuuucugcaggccagaguuccaaaccagaugcagccuucugaccccccaaggacuuugcagaacauacagugagaacaagaagccauaggcgacaggaccaagaaugaaucccuggucacagguuuccugacucaggcaucacucaccugaaugacagccaagguaggucacaugccucuuguuuuccucauggccuuccagagauaugacacccaauacaccuguuaaacaaacacagagguucucacuuugagcuuaaugguggccacuuaucucccuucaaaggacuccagaccccaagccaugugaccuccugaaagccucucccaguugucccuuuuuuuccugacacugaagggaucuagggucuuccccagcuugaaccaucugcacugaauguauagaacacuagaaaaggaggugcucuuuuucucacacagaccauggacgaggucagcuuugggcuaucagcuggcacucccaccauccucaccagagaaggaagucagcaccucaaggcagcaggguugagggaccaagagaaaacugggaacaggugaggugguuuacaccuauagucacagccccugggagacagggcuagaggaauccugcaaguuggaggccaucuugggcuauaaagugagaugcuaucggaaagcaauaggaugggggugggguuagagagugcaaguggagagaacuugagcagcuuuggcuccaacucugccuagagucccuggugaggaaagaggcauuuaucugugcuagcuuggucuaucgauguugucacaagcagccaagggaauucaaccacacaaaaacucauuuugguuuuuuuguuuuguuuuguuuuuuuaaguuuuugguuuuugggguuuuuuucuuuuuuuuuuuuuucuguuuuuuguuuucuuugagauggggucugaguagcucaggcuggcuugcaucucaaacucuuccagauucagccuccuggagugcagagauagcaacacaacacuguacaaggacuuuucaaaucuucauugugaucaaucccagcccaagguccaauacaaggagggggauugucuguggggauggcugaaaacagaaauaccauuuucuuuccucccuggcuagaaccaccaccauaguuuacauauaagcaagaucugacugcuauauguugaccaguguauaggggucuaaggccugccccuccccacagcccacuccauuccaacuccccacuaugaauggaguuugcccuuuuccugacccuaucuaugaugauaaugucugaaccuuuucuucuaugucuaccucccuaccugggcggucagaguugaaagcgaucaagcugcagcuugauuugaugugguucccgcaugugggggugguuacagcacgaauaucacugauccaggccugcaaaugaagaauaacaugguuagugucaggucucuccucagggccauagacagggccauaaugcaggaaacuguguguguguguguguguguguguguguguguguaugugugugugugucuggugucauccacgcaaaucacccacuuuguuuuuugagacagggucuuucccugaaucuagaacucacaaauucugcuaggcuggcugguuagugagcuccagccguccucuugucugugugggugugugaugauuguaagcauacaucaucacuuagguucuggacaucaaacuuaugucuucaugcauuauagcaaauauguuacuaauaaaguuguuucuucagcccuuaaagcugcaccauuagagcaguauuuuuugggauagauauuuggauuuuuuuuuuuuuuuuuggucugcccccacucagucccuuaaaaaauagcaaauguucuugaaauaaucuaacuagcucagagggugauucuauuuagcaaaucaguucccuaauaaggaugaggaggcggcugucagaggaaaugcaugugucucuggggggaauauuucaguucaaagagugggaaggagcugggcagugguggcgcaggccuuuaaucccagcacucgggaggcagaggcagguggauuucugaguuugaggccagccuagucuacagagugaguuccaggacagccagggcuacacagagaaacccugccucaaaaagaaaaaaaaaaaaaaaaaaaaacaagaguaugaaaguggcaaggaagugaccaucuaacagaagaugggugugcuccuguggcuacucugcugaagccagggcccacggccccuugugaacaucacacucaguagggagaagauaaagaucuggcuuccucagagcaugcuccgcccuggaugagugaaggcaguaauggugacaccccgcauaugggaaagaagagcgcucgcccugcaacugagaucaaggaccccauucccucuguuggugucaaagcacagaucugcaauccuucuugccucaguaacaagcacuccugaggcccccgguucugugggccugucugauuaacuuacuagaaggagguccauacagagagaagccacagagcccugaaggucucuccagauccguccacuaaucauuacugcacucuuaguaauagucugcauccaaaucuaagcacuguguacuuccucucaagcuuucaauggcgccauacuauacucauaacaaaacucaacuucuuccucugaagggcugcccuguaacucaucugucaccagcuuugccuggcuaauggccucuguccacccuggguucacuuucuuuuuuucuuuuuucuuuuuuugguuuuucgagucagggauucucuguguagcccuggcugcccuggaacucacucuguagaccaggcuggccucgaacucagaaaucugccugccaagugcuaggauuaaaggccugcaccaccaccgcccggccacuuucuuuuucuuuacuggcuuuuuuucuucucacccuucuggccucuguugaaauccacccaccugggcacuguccuccacaauacuauuacguucaacucuacuucacuucuuuacaucacagcccaccacauacccccggguguucugauucuucaguggauuuauauugugcuugcugaccagaggcuguuaaguuccacagagaaggggaaaugucacaauguucacuguuuuagagagcugagcagcacacaauagguacagaaaggcuaacuguccagagaaugaaaauggagcacgguuguccuaacuugcuuugggacacuagagguccaaauaacacagggggagaaaggccagugccucaccgaguggaguguccuucuugacacuccaucugggauccaccugcucuaggcuucuccaggccccaacaaccgcuaguaucaucaccccaguaaaggaagagcuugcaccaguagacaaggaagaguggcagaaacucgagggaggaagccugccuggccccaggggcucccucuccagaugauaccuucccucucacugagaccacaagaaagagaugcaucucucccacagcccggccggcccggagcaggggugauccuagacugcuggaagggggagaccggcgucgacaguuucccagccagguucccagcaaggccgaccggaaacagaggccuguucgcgucugggagugcugcgaggccuccugggguaacagggggaggcgaaccggccaggccgaccuccgggaucacccaacuacuagggcgcgucaucagaccuccggacucuguccucugagcagugaaggggcggccugaacucuaggguucaucuaaagggagaaguuccggguggacagauggggcgagguggggugagggucuucacaacccagagugugcacugcacaggcaggcacugggaauggcaguccuccgggaccagaagccagggagugggguccacuggccgggcucaccucucggcgggacggccgggccuccauaugccgaaacuuggacaccuugaagcgacucauggcagcugggacagagcaagcucaggcuggagaacgagggucgucagguacuaggugaaugaagagaagccgcccuggacucuugcagccugccgccucagcagccugcagccuggugccacgcccuuauugaugacaaccaaucggaagcuccugcggccugccuaggcacgcccccacgucacccuucuucagcgcgacggccuucagccccgccuucuucagaggccaggacgaccugagaagucacgcccugaugccugggggacuacugcacuggucggaggucaugugagccgcagcuguccuaccgaaggaaccacacuucaauugcugcaggauuagacuugcaauacuggucccugagguuuuacaaugaccugagaaauagcaggacagaauuaacuagacuaaaacugggaauaauccccgcgacccauaaaagauaagaaccacugagacucaaucuuucucucucucaaucucucucucucucccucccucccucccaccucuugucuccccuucccucccuuucuaccccuuuguuuugaguuuuauuuuuauuuuauuuuauuuuuguuuauuuauuuauuuauuuauuuugagacaggguuucucuguguaguccuggcuguccuagaauucacucuguagaccaggcuggccucaaacucagaaaucccccugccucuuccucccaaguccugggacuaaagaugugcaccaucacugcccagccaaaaauacacauuuuauaaugcaauuuuuuucauacuagaguguaugaugauaaugaccaagugauauauagcuuuauucucaauaucugugagcaucaauuuucccuuaaaaaugauuuuagcuguggauuguagcucaguugguagaguguuugccaggcauguaugaagcccugggugccauccccagcacagugacauaguccuauagucccagcauucaggaggaagaucagaaguucaaggucagcuugguuuacauaguucgggacuauauagugagaaccugcccaaaaagaaaaaaaagaaaaagaaaaaagaaagaaaagaaaagaaaagggagaaagaaggcaggguugggaaaauggcucaguggguaauuaugcuugcucuugguuagacuuguuggauccccuggccuugugaagugucuuaaacugccacaugggugcugggaaucagacuugggucuucuucgaaaauaaggagaaacaaguacucuugacugcugggacauuuacuuuuguucaccugucuaucccugccuacucaucugugugcacacaauguugggguccaggaauugccucacaaaucacacagacauugaucucggucagaccaggaugguuuauugaucauaugcuccaggauuggucgaccagggccauggucaggauuucagaacugagccacuacccugaacuaagauccuacagggcuuuuaagcccaagaucuacaaacauuugugccaaguuauuucaucaaucgggauuuaaagacaggaagauuuccuuaggaacaugucuuuguuguacacuuauccugcucccauugguugggguagucaacuguggcaggcaggggacuugccuugucuaauaauauucauguccuaacuugucaaccaggaugggcuuugucuaacauucaugucuuuacuugcuaaccaggaugucuuuuucugccaaguaggaugucaguuccuaaggaggucuugggaacuuaaacuuuacuagacuccuacucuaaauggaagucuuacuccaaauaguuucuuauauuggugcaggugcucucuuauguuggaguccaucucaggggcagcuuauaccauaaaagcucauacgcaggugcaggaagugcugcugggugguugguucagguccaagcuuauuguggguaacuauacaaaacaguucuaccgacuucuauagugauugauuuccagggacacagaacauaagagaauauguaaucagucuuggcauuagaaaguuuccuaguaacagcagaaacuuaugacaaaguuuccuuaugguagacuaucaaagguagguucucuggaagcacagcaagagcucuuaccugcugauccuucucucuagcuccaauaaaaaugauucuugcagggcucaguggugccuaucuguauucuuagaaauuuucaagagugagugggaggcuggcuugagcccacaaguuugagacuagccugggcacuauaagauuaaugacauugcuauagcguguacaacagagccugagauuugagcaguaggagcuccaacuuuuuguuguugcuguuguuuuuuguuuuuuuguuuuuguuuuucaguucauagucuuagucauugugcuggagauauuugaaugcauuugcugcuggaugcauuacagaacuguccccucucauucccugcgccuugccuuccuccuuguuucacugaaaugcucuuuguucccaucacugacacccaugcacaagcucuccagcugcccuugcacuuuacacuagcuucauaacuacuuucugcuugauugguaguuuuugaccuuaagagucucagaauccacugagaauuugguuggugaagguuauggauaucuauccaggguaacaugcacacacauuuuguguacaaaacugggggguagaaagugccagugugcucucucuugugcacguguauguguguguguguguggugucaauguagacugaucauccuaaacccauucauaagcccucagauucucuuccuuuuauuugggaggguggugaaaaauguaacuuuccuaacuaaccagccccagucuagcuuucuggcuucauuuucaguuauguauacuaaauuuaagguuuaagcauauacuucuacacauuuagacaccagcuuuuauagcuuuuuuaaaaaauuuuuguaauaaacugaugacaugacuguuccauaguaugcuagaccugguaauuugaggagagagagagggagagggagagggagaaagagaaagagaaagaaagagaaucgaaggguuauaagcuuggggaagugggacccaugagcugcagaguuugaaguuggggaagaagugagaagagcuaggaugcuagcaugaacuuugaaauuugaaacagguacuuuugguacaagggagccugaaggccugaugugcuuugguaugcuaauagucaccacagauagccacgugucccuucagccagggauaaagaaaaugacuccuuuugauaauaggaaccagcuucacaauuuuuuuuuucaaaaacaggauuucuccagguagccccaacuauccuggaacuugcucuguaguccaggcuggccucaaucuuagagaucugccuaucucuaccucccauguguugggauuaaaguugugagaaaccauugccugacuugcugguuuuuaucuaaccacuagaaauccuguacuccagguugagucuuauuucuggauauuuguacugccuuuuggaguuuggggaguuggauuuuccuucgggccuaacucgaagaugggggucucauguagcccagacuaucucgaauuugcucuauagcugaaaaugaucuugaacuccugaucauccuaccucaaucuagucuggcagcuuuugguguuuucgucacuuggaauacuacaucuguacucgauucacuuuucaucaaaguucaguuauggacauuaugacucagaaaguuuaacagcccacccccaccccccacugccaagccuuaugcguguaagaaacuuaucauaagaaacagaucgaguacacugguaugcuuguaacugugcaccuuugauagcacuuaccguuguuacuuaauaagaagucugucccuguaaggcgaguuugcuccccuggagcggguuuccucuaacauucuuucuagaacauggauaacaaacagcaggcgcacaauacauaauaggcauuuacaaugcucauugaauuuucgcuacagguuuggagaaggcuaacguguuuaagacggaccugaguguuucaaguucugcugggaaggaaucagacgcggaaaaacugcagccaacaaccgggguggagccuuucugagagaacauguaauaagauguaauuuucagggucaagggagggcauccacacgggguauaccggaaucugauacugacgccgcguugucugcugggguuuguaguuccugccagggcaaggcucgcuagauuaugguugcugcacucagcgacaacauucacaaguaaagugcagcauucguuccuaccucacaaaauuccaauacagggaaaaguuacaaacugacauccucauagucuagcacuuguacacguuggccuagguucuaccguucggagaccgaggcgcgugcgcaaugcuuacgcucugcgugcuacggaugccucgccuccggaagacgcgaccggcgaggcgggccagugacggucugcgcaggcgcaguguccccgggccaaaauggcugcgugguguuccccacgcugguugaggguggcaguggggacuccccggcugccggcugcagcggggagagggguccagcagccccaggggggcguaguggcaacaucccugugucgcaagcugugcgucucugccuucgggcuuuccaugggcgcucacggcccccgggcgcugcugacauugagacccgguguccgccucacaggugagggaggcuuccagcucuggaguagaggcuccugggauuagaaagggcgauucggcuccaucugaugaccaggguagcgggauggagaugucuuccggcccaagagaggaauuucuggggacacaggcaagcaggaggcagagaggccaaggugcuggcuacccagaagccgucgaggggaaagagcugcguggagccggagguguugaaacgcuccgaacgccaugaaccuucaccucugucaacaguucaccucucuguccaggcugcugcccccuugucauagcccuucucuuuuucuucacgcucuagcuuguaguggaagauguaacugccauuuagugagugcuaggcacccauaaaucaagggagaugcaggugcuugcccucauuaagguuagagagugugaugaauugucauuucauagcguucauccuaaauaucacgugguguaauagaagggcauuuaucagucuuuuagaauccuuaagucagugaauguaauaauggagucuaacauuuauuaaacauuguguaggaaguaugauuucacuccuuggagaauguuucaaugugacaggcauuguuaaccauuccauuuuauggagaaacagguuuagauguuaaaaaacuugaaaaagucacaaagcuaaaaacugguagacuugguaugguaccuaccuuccuuauagcuggaggggaugccaaauuagugugcauuaagccuugaaguguuuuagccacgaucuugucugucucuuuaaaaaauauuuuuguaaguuauuuugaguucugugugucuguguguggguaugugcucuuaaguacaggugcccaaaggggccagaggcaucugauccccuguaauuaugagcugcuagacuuagggacuaggaacugaacuuguguccucuacaagagcaguaugugcuuuuaauugcugagccaucuuucugucaucauaguuccuuauacuguguuaucacuuaauuuucagugagaaugaaggaagcaagcacugaacuuuauuuuggguaguucuagggaucaagcauaaggcuucaugcaugccuuagaguggcuuuuaaauuauguauccuugugugagagagauauggaggcgcauguacacaggcacuaaguauuacuucuguaugaaagcauaacugaagaacugcaguuggcuuuccucaagucagcccauaggcuacagugggcauauuuuaucucaagugacaauauguguggacauggcauccuguagugguguauccugacaccacaucuaaggucaucaguuuggccccaaacuuuagucugugaucauuccucaagucccaaacaggggcuggagagauggcucagcuguucagaacgcugacggcuuuucuagaggacccagguucaauuucaauucccagcacucauaugguagcucucagcugacuguggcuguaguuccaggggaucugacaccucuucacagacauacauucagucaaaauaccgaaacauaugaacuaaaaagaaaucauaaaaaagaaaucuccuaaccagaaagaaaucagcaauuagcuacuggauuaggcauucuuagaacaacaugaagacuaauccuauucuggguucaaaaagcaagacaugugcugggcauacuuuguagagaaaaaaaauagauauuuccuaguaguugcuaaucauuggccuuuagaauagaaaaaagcauccgcuguguaauaguuaccugugguuauucacaguuuccuugagcugucugcugaugucguagaagcugguacagcugacaaacuuuugccacuaauagacucaugcuccugauaauggaaggagugaggaguacaggaauacagccaggcagguagcaaguaaagagauccaauauaggaucaccaaguaucgaggucuaaugucuucuccgggagugacugaagagucaaucacaaucucauucugauuauuccugcucauucuuuuuuuuuuuuaauuccuuucuauauacuuuuuauuuuauuuuauuuuaauuagguauuuuccucauuuacauuucuaaugcuaucccaaaagucccccauacccaccccccccacuccccuacccauccacucccccuuuuuggcccuggcguuccccuguacuggggcauauaaaguuugcauguccagugggccucucuuuccagugaugaccgacuaggccaucuuuugauacauaugcagcuagagucaagagcucugggguacugguuaguucauauuguuguuccaccuauagagucuauauacuuucaacuucucuggcugauuguuuguuuguuuuuguuuuuguuuuuuguuuuuuuguuuuuucgagacaggguuuuucucuguauagcccuggcuguccuggaacucacucuguagaccaggcuggccucgaacucagaaauccgccugccucugccucccgagugcugggauuaaaggugugcaccaccacgcccggcuguuuuuguuuuuacuuuggaaacaggguguucuauguuccagacuggccuagaacuuccuguguagcuaugaauggagcuugaacuuuugauccucugcauccuuuuccucauguuaggauuaugcuggguuuguucaguucagggaaucaaauucagggccuugugcauaccugguaagcaguguaccuacugaacuaugucccugagcuuugcccacauuugaagaacauugaguuuggccucuaguguacucagugggaauaggcccuauagcuggggcuuguuugcuuuuuuacagauauuucguagcuggucacuuauuuauaauuucuucuuguuggauaaacucccagacuaacuuacuuucuuguuucauuuccaggaacaaaaaguuucccuuuuguuuguaccaccucuuuccacacaagugcuucuuuggccaaagaugauuauuaccagauccugggagugccccgaaaugccagccagaaagauaucaagaaagccuauuaucaggucuguauuggucuuagguuuacugacaagacuguagaaagauugcuggucuggucacuguguguguauguguguguauguuuugcuuuaauuuuuguugguuuuuuuuuuuuuuuuguuuuugcuuuucgagacaggguuucucuguguagccuuggcuguccuggaauucauucuguagaccaggcuggccuggaacucagaaaucugccugccucugccucccgagugcugggauuaaaggcaugugccaccaugccuggcuuuuguuuuaguuuuuaaauuugugcaucuguggaauaugcacaugacugcagauguucacagaggacagggguaagggauccccuugggacuauaguuacaggcagcugugaaccaucuaacauggcugagaauugaguucaggucuuuugggaaagggguaugugcucuuagccacugagccaucucuucaacccagcuuggugcugauguugucugguccuuacugccuugauguauagccugcuaaggcaggucacaagcagccgagccuauggaaugaucugggaaagauggaguuuggggugccuuuggugggcaaugaaugugauaucaaucuguuaacguuuuaagaaagaagagaagaggcagguaagauggcccaguggguaaaggcauuugacaucaagccuagugaccugaguucaauuccuccaaaaccauuuaaagucaggagagaacugauuucacacguacaccaugcuguccacacaauuaugacauauauaaauaaauagaaauuauauagguaaacaucauuacucuuuuuuuuaaagcaguuuuaucauuauguauuuuauauauagggguacacuguagcugacuucagacacaccagaagagggcaucagaucccauuauggauguuuuugagccaccacguagcugcugggaauugaacucaggagcucuggaagagcagucagugcucuuacugcugagccaucucuccagcuccucauaauucuuucuuaauucuuaauuucuuuauuuuuuauagcaguaacugucauacguuuauuacguaauucuucaaaaccuugcacagcaggcaagccaggugugguugugcugccuuuuuaucccaguacugggagacagaggcaagcgaagcucugugaguuuaaggccaguuugucucaaaaccaaaccaaaccaaaacaaaaaaccauacuagucuacagagcucauucuaggacagccagggcuacauaaacccugacuuguaaaaccaaaccaaccaaccaaccaaaauugugcagguuauuugcuucccuguugcauagguucagagcaccaggaugcuaaagggcuagucaaguauuuacuuauuacuuuuuuaaaaaaagauuuauuuauuuauuuuuauuuauuuauuuuuuuaaagauuuauuuauuuauuauauguaaguacacuguagcugucuucagacacaccagaagagggagucagaucucauuacggaugguugugagccaccaugugguugcugggauuugaacucaggaccuuuggaagagcagucgggugcucuuaccugcugagccaucucaccagcccuuuauuuauuuuuauauaugugaguacacuguagcuguacagaugguugugagccuucaugugguuguugggaauuaaauuuuaggaccucugcuugcuccggcucaaagauuuauuuauuacuauacauaaguacacuguagacacaccagaagagggugucagaucucauuacagguaaccaccaugugguugcugggauuugaacucaggaccuucggaagagcagucaguggucuuaccugcugagccaucucaccagacccuacuuauuacuuuuaacauauauuuauuuuugguuugugugcaugcauguuugucucauguacauauacugcaugcauucuuggugccuucagagaucagaaaaggacaucaaauccccaggaacuggaguuuuagaguugugaucuaacacaucagagcugggaacugaauccagguccucugcaagaguaguaaaugcuuuguuuccuaaagauuguuuuauuuauuauguauggaguguucugccugcauguguacaugcuugccagaagauggcaccagaucucauuacagaugguugugagucacccugugguugcugggaauugaacucaggaccucugggagaguagccagugcucuuaacugcugagucaucucucuggccccuaagacaucugugaaggaaugauuuauuuucaaauuuuaaaucuugcuuuaagaauuuguugcugucuuggccgggcgugguggcgcacgccuuuaaucccagcacuugggaggcagaggcagguggauuucugaguucgaggccagccuggucuauagagugaguuccaggacagccagagcuauacagagaaacccugucucgaaaaaccaaaaaaaaaaaaaaaaaauuuuuguugcuaucuuaagagagacagcuguuauaaagagacauaauuguagcaaguauuuggguucuguuuuagugacuauccauaucuauaguaauuuacuuuuuuuccccuuagcuugccaagaaauaucauccagacacaaauaaggaugaucccaaagccaaggagaaguuuucccagcuggcagaagcuuaugagguaaugugacuuguggguucauucacuggccauucagcucugugcacacaucagagucugcacugcacaagauagcuuggcauaucauacaguccaggguggugcugugucccugcuaguucugcuaacuuagacucuaaaugaagaaaacaggcuggugcgaucuaucugcugccaagccugaugacaaguucaauccucagcaacuuccauaaaucguccucugaccccugcugaguuccauagcauuugaacacucacauauguacacaaaaggaauagguguaauuuuuaaaaaagaaaagagacccgaagugguggcauauauguaauuuagcacuggugaggcugagggcaagagaauuucuguaaguuuaaggcuaagcagggcuauauagucugccuucauacaaaacaaaacaagagcaagguucaucugaucaauaaauauacucagguaauucauauugauagcugaucucgggaaaucccaguuagacugaucaaaucaguccuuauuugaugacuuaaguuagcaauuguaaaaauagaccguaaagcacauaggaagaaaccaaauaucugugagagaaccauugaccaguuacagaauuauuggagaaugacccugugucuuagcuaggguuuuguuguuguuguucuuguuucuguuuuauuuauuuauuuauuuauuuaauguuauguuuauggguucacugucgcucuccucagacacuccagaagagggcaucagaucccauuacagaugguugugagccaccauguaguugcugagaauugaccuuacgaccucuggaagagcagucagugcuuuuaaccaguaagccaucucugcagccccguaguuaggguuuuaguucugugaagagagaccauggccacagcaaguuuuuuuucauggugcuagaaggguagcuuugcguucugcaucuggaucagcagacagcaggaagagaaagcaacacuggggcuggcuucugaaaucccaaaacucacucuuagugacacacuuccuccaauaaacccacaccuucuaauagugucacucccugugagucugugggggccauuuucauucaaauuaccauagcauuccucuuggaguugacuauccccaauggguucugcauguguuuauguguucaagggccuagauagcaacauguagagucauaguucaguaaguacgaagguuuuauuaccugucagccauagcuaaucugugcuagagcuuucucgagaaguagaaccuauaggauauaggcaaucagagauuuauuaauuggaucauaagaucagcugcugagggacuggagagaugacucauuacaauguuacaagcauucuagaggacccagguucaauucccagcacccaauugguaacuuauaaccaucuauaccuccaguuucaagggauccagugccgucuucuggcuuuuuuuucucuuucugagacaggguuucucugguguccuggaacuugcucugcagaccaggcuggccuugaacucacagagauucaccagcccuuuccucucagugcugggauuaguaacaugcacuacaccugacgauuuucuggcuuccgagagcaccagguacacaagugguagacagacaucaaugcaagcaaaauacccauacacauaaaauuauuacuguuuuuuuuaaaacagggugucuuuguaccccggauggcuggaacuaagagauuugcuugccuuugccucccaagugcuaggauuaaaaauaugaaccaccaugccaggcuuauaaaaauuauuugugcugggcaugguggcgcacgccuuuaaucccagcacucgggaggcagaggcaggcggauuucugaguuugaggccagccuggucuacaaagugaguuccaggacagccagggcuacacagagaaacccugucuugaaaaaccaaaccaaaaaaaaaaaaaauauauauauauauauauaauuuguaaaagaaaggugcugcucaagagcccaugguggcaccuacaggcuguagcaucagagcaacuggcagcugcucagucuaaagcuagaagcaguggcaguggcccagucuggagcugcaggccugugggccccugagagggccugaugcaaguguacauuugaaagcugaagaaaggagcgagagagaugguucagugcuuaagagcacugucugcucuuccagaggaccuggauucaauucccagcaaccacauggaagcuuauaaccaucucuaaguccaguuuuagaggauccaacaccuucacacagauacacauacaggcaaaacaccaaauaaaauaaauauuucuuuuccacauuuuuuucuaggacagccugagcuacacagagaaagaaauccuguaucaaaacaccaaaaaguauagugcuguaccaguccuguccuguccuguccuguccucuccuguccucuccuguccucuccucucuucuccucucuuuucuuuuuuuucuuuucuuuucuuagagacauggaggguuucucuguguagcccuggcuguccuggaacucacucuguagaccaggcuggucuugaacucagaaccgcccaccucugccuccuuagugcugacaucuaaagugugcgccaccaggccuggcuauuuuacauuuaaaaauaauuucugcccagugugguggcgcacaccuuugaucccaguacuugggaggcagaggcaggcggauuugugaguucgaggccagccucgaacagaguaaguuacaggacaggcagggcuauacagagaaacccugucuuggaaaaaaaaaaaacaaaaaaaccccucaaaaacaaaagaaaagaacugaacccaaggaugugcagaggcuuaacgaaugccccagcacugaucucuaacgugauugugguguuuguugaaacagggugucacugugcagcgccagcucucuucauacucauccucuugccuuagccuucucacuggugggauuucaccaccaugcccgacuucuguagaguguuuugcacuuaguaaaucgacagacuuguuugacauaagcuguguugccugugucccugagccuuagaagacucagagcucucugacugcuguguuaucuuucaucacagguguugagcgaugaagugaagaggaagcaguaugacgcuuacggcucugcuggcuuugacccuggcaccagcagcucugggcagggcuacuggagaggaggucccucuguugaccccgaggaguuguucaggaagaucuuuggggaguucucaucuucuccuuuuggugauuuccagaauguguuugaucagccucaggaaguacguuucuuauucuuuauuuuuguauuuuuugagagagggucuuacauucuagccuuggcugucuuagaacucacucugcagaccagguuggccuuaaacucacagagaucugccuaccucugccucccaagugccaggauuaaagacacgugccaucauacccaauguucuuuauuuuaaaggaucaacuuuuagguuuaagugcagcacaagggucuuuuuuaguuuuuguuucucagaaaggcaguggaaugauuuaacgucauccauuugacaggaaggaauacuuggaaaauccuuuagguagugaugaacauguacauugugaugucauuaucaauagcugcuuacucaguagauugauucaucuagagcagggguucugaaacuggauugugacuucuucggguggggcuugaauaugagauauccuaugaaccagcuauuuuuauuaugauuuauagcaguagcgaaauuagagcuaugaaauaauguuaugguugggggucaccacaccuguguuaaaggagcucagcguuaggaaggcugagagccacugauucuaaaaauaaaauaagaggacacauccccagugucauaaaaccucucaccagacuccaccucuucaagguccucuaccucccauuaguacuaaauugaaaaccaaguguugggccuuugggagauaaucuagauuuaggccaaaacaaguguuaaaugcagacauuauucaugucuucaguugaagagaaaauuuuuaccuaaaacauuuuagaaucuguauuuuacaucuauugaucaacuaaauaaauauugccauucuuccccugaaaaguguacauguacacauguuugguacuucagaaguaacuccagcuacugaccucaaacagagcaucacuguagucacuguaaagcuaagcgacaggccaugccucacucuuucaguacaucauggaauugacauucaaucaagcugccaagggugucaacaaagaguucacugugaacauuauggauaccugugagcgcugugacggcaaggggaacgagccuggaaccaaagugcagcauugccauuacuguggcggcucgggcaugguaaggauggaugcuuuggggcccugcccuacuucuccugguacugauuugcuguuacccaccugccugugcugcucuccaacccuuucuuuccuguuccaagagauccuuuauuuagauaguccuggggcuugggcuggguccccuagcacuggaccaggcugcucuccaacuaccuauaugugugaggaugaucuuccuuuaucuuccaagugcuacugucccacccuggcucuucuagggaguggggguuagaggaaggacagggucucacucuauuucaggcagaccuugaauuuauaucaacucucuagccucaggcucuuggaugccggaauuauaagcaugugucaugccugguuauaauucuuaaaagucuuuuuuuauuauuauuacuuuauuuauuuauuguaugcucaugugugcuaugugugcccacauguggcauucaaaggacaauuugugagacucuuuucuuuuuuuuuaaacacaucuuuuuuuuuuuuuuuuuuuuuuuuuaagauuuauuuauuauauguguguacacuguagcugucuucagacacuccagaagagggcaucagauuuuuguuacggaugguugugagccaccaugagguugcugggauuugaacucaggacuuuuggaagagcagucggugcucuuaaccgcugagccaucucuccagccccaugggacucuuuucucuuucaucguaugagacccugggaaugaacucaagacauuuugcuugguggcuuuaagugccuuuaccugcuggccaucuugccauccauuuuauauauuuauguuuuauuuuauucauugagaccgagucucaauguauaguucuggcugcucaggaguuugcuguuuagaccagauuagcuucaaauucagaauuguucuucuauaucaugugcaggcauuccauauuuagaguucuuguauagggcugugucuaauuggugaacauguucuuagcaugcucagagcucugaauucauauuuuguuuuguuugagauaggcuuuaacucuaaucuaggcuggcuuggaacucaauauauaccucaggcggccuuugagcaugaguuagucuucauuugucagucucauuagugcuauccaaacaagugugagccaucgugcccaaccuugaagucaguccucagcacguacauaugcacacacacacauauacauauauucauuuaaaauauuugaguguuggcacacaccuuugauuccagcauuugcagaggcagguggaucucuauggucuaugaagcaggauccaggacagccaggggcggggucaggguggggaguugacuucugugcuaggugugguuguagguauuuguacucccagcacuugguagguggagucagaaacaucagaagguggaguuuauucuucacuacauagcaaguuugaauucagcuuuggcuacaugagauaucaucuuucuuccuccaccagaaaaagaaguucagauuaucagugugaggcccugucccuguuuucuaaaaaaaguguguucuagagcagcauauaaggagaaaaaaaauccguccauccaugcucccucccucccuucauacccuugucucucccacuuaagauuuaagauuucuauucuuugaaguuuuuauguguguauauaauguauuuaaauuguuauucacacccgcccucccaauggggguagggugugggcagagucucauguaaccuaggcuagccuugauugaacuccugaucugucucuacccuccauauuuuaagauaauagaccugugcuauauaaagucuuaucuuuuugauaaaacaauguaucuacguucuuagcauuuuucucuucaucaggaaacuaucaauacagggccuuuugugaugcguuccacaugucggagaugugguggccggggcuccaucaucacaaaucccuguguggucugcaggggagcaggacaagccaagcagaagaagcgcgugacaauuccugugccugcaggugggccacugccuggcagacgggcuagcaugugugccuguuguaugcaugauuguacaguuagagauaaagccccaacgcccugguugaaggaagagcuagacuccuuucuuuuuaagauuuauuuauuuauuuauuuauuuuauguauaugaguacacuguagcugaacagaugguugugagccuucaugugcuuguugggaauugaauuuuuaggaccucuacucacugugauuagcccugcuagcucuggggcaggguguaagaucucauuacaggugguugugaaccacccugugguugcugggauuugaacucaggaccuucagaagagcagucagugcucuuacccgcugagccaucuuggcagcccccaagagcuagacucaaguucuccuuuguuccagucaucguuacaaugugcccgcucuguucuugucuugggaugcugcagcuccuguccaguuuucugaccucgcucucuucugucuucacucagugaggaccaacaugagcaggaaacaagcuauuaccuagugauacuguuaaccucaguacucaggcagggggagcacagguuuguggucagccugagguccauagugaggcccucauagccaaaacaagaagaaaccuggacaaguggguuuuccuggguagaaauugcugugggagaccccuaccauaacugcuauuuggaacuuuuguucuaggaguugaagauggucagacuguaaggaugccagugggaaaacgagaaauuuuugucacauucaggguaggugccugccugucagcuuauguugggucuuguugucuuggagugggugcagcugagauuguucauuguaguaagguagacaguucacgggcacagguguugcuguuccaguuaaggaaaggcugccuggcaugauuauuaauugcuuucaugcuuauguguagagaaugaagcuuucucacaacacugacaaguuagaaacacagccaggcagugguacgcaugccuguaaucccagcacuaccgagacagaggcuggugggucuuugaguuugaggccagccuggucuacacugagaguuccagaacagccaaggcuacaccaagaaacuccaucuugggggggaaaaaaaacagaaaaaaagagaaagaaacauagaacacaaaucccagaacaucugaugugugguggugguguuguuucuguauaaauuguugguuagagagcaaaagcaaaacccuuuuuuuuuuuuuugguuuuucgagacaggguuucucuguguagcccuggcuguccugcuggaacucacuuuguagaccaggcuggccuucaccucagaaaucugccugccucugccuccugagugcuaggauuaaaggcaugcgccaccaugccuggcuuuauaacuuuucuuuccccguuuuugaaccaggaucuuccuguguugcacagguuggccuggaacucauaauugucauggcuuagccuccagaauuuuuguauuaugggugggcuucccccccccccccccgucuaguaucuuuguaaugcuuaauuccauuagcuugauguguagcuugaugugggugucuuauugcuguguuuacuuugccuuuuucuguuugugagauaucucauuggaaucgaguacuagagauaguaaguagcacgugccuacaauccuagcacgugggguauggaggcaggaggacccugaguucagagccagccugggcuauacaguaaaacccugucuuuaaaaacaagacugaaaacaaaaacaagaaauaguacucagccgggcauggugacgcucgccuuuaaucccagcacucgggaagcagaggcaggcggauuugugaguucgaggccagccuggucuacagagugaauuccaggacagccagggcuacacacagagaaacccugucucgaaaaaccaaaaaaaaaaaaaaaaaaagaaaagaaaaagaaauagggacucaggauguagauaaaguuucucgagugacuggccauggugguggcgcaucccuguaaucucagugcuugggagguagaggcugggcccacagaggauuugaagcaaguccccaguaauaguaggaaagcuggcuguaguggcacuaccuguacaggaaaagcugaagcaguggguuuacauaagucugaaguuggagucuaccuggacaacauagugacaucuucucugaagccaaagauagcacaguaaauaaaaauagugggagggguagaucuuguagcuggagaauucacagaugcagggaugugcugaacuguagcuuagugguggugugucugauaugugcaaagcccuguguuuuuucccuagcacugcaaaauaaauaaaaauuuaaaacuacauaaaggcagaaaccuggagggcauuuuauaagaauuugguugaggauccaacugcacuuuccauuuuauaauaaaugaaagaaagaagaagucaaaggcagaggauauuuuugagauaugaaaaacaguauuugaaagccaaauaaauuccuguccugacuguuguccugaaggcagcuuguguuaggugagcaucggaaagccguguguaaaccugugucugugcgugcagaggacagagguugguguggcuccuuucucauuccuuguucuugcugaaccuggagcucagugauucaucuaagguuucugggcaguaagcucagagacucacaugcacgcacacgagcacacacacacacauacacacacacacacacacacacacacacuucccagcaguguacuaccaugcccaguuuuuacaugaguguuguggauccuugucuuguguggcaggcaccuccacgucuccugcagaucacguuuaccuuuguagauguauuggucugugguuuaguaagauuuggggaaaacauuuaaaagcccgauugcauucuuucuucuguaacuaaaaguagugauggaggcugaagcagugcagacauugcucugcagugcaguguguguggaggcugugucccuccagagccuugcggugcugucuccuauugaugggagguguaggucucgaggcgcuaguuaagugcaaagagguuaaagugugucagguuccaaggucaggucugacaagacacauggcuggugucuagccucaggcagcacuuccaccgcccuuacaccugucuucucucuggcauuaggugcagaaaagcccuguguuccggagggacggugcagacauccacucggaccucuuuauuucaauagcucaagcuauucuugggggcacagccaaagcccagggccuguaugagacaaucaaugugacgguaagagggcaugaggacagcugucucugcagcuuguugauccuuuuucuucccuuccccucccucccucccuucuguuuuacuuauuuauuuuuugagauggcuauuauguauccucaguugaucuuggacuuguaauccaguugccuucccuguguuagguuugcauccaugugcaugcauguuauuuauuuuuuuuaagugggaaauagcugagguggucuaaaccugaguguccagccugucaggaacucugaauagaagaggcauuggagccugugacaccaggggcugcaggcuguuccaugaggaguaauuacaacgccacgccuuucugcucccuggucugugccuccucuuccgaugucaguguccuggggacuaacagcauaacuaaugcucuggaaaaggugcuguuuguucacguucccgcccagggaugucuggagagcaggggcucuaggacuacuaugugcuacucugguaaccaccucuaguuugggaguuuguauuugucguuuuuuuugggaggggggguugacacaggguuuuuuguguguugaccagacuggccuggaacucgauuggucuaccucugccucccaagugcugggauuaaagaugugagcuaccaccuucuggcaaccaucucuaguuuuuaauugcagcuguaaauggaugcuuccuguacccacacuuacaccacuauauuugucucggggccaucuccagccucuggguauagagacuuuggccauaccauaggcuguggcaacagucacuggggagucuucuuccaccuccuccuagagaccaccuggaaccucugcuucucuagggucccuugcuauccagcucuugagaguaacagagcaaucuuagucucacaccugcucucaguguuuugcuucuagagccuuugcuucacuucucacaucuguuucuagggucggcucucagcuguccuacagcuguguggguaguuaguucugcacaccugguggaaguccuuuuuugaagacaucucaggauuaucucuguauagugagauguuuuauuuuugaauagugggaaccaggaagcaucagcauauuucuuuuuuuuuuuuuuuuuuuuuuugguuuuguuuucgagacaggguuucucuguguagcgcuggcuguccuggaacucacucuguagaccaggcuggccucgaacucagaaguccgacugccucugccucccgagugcugggauuaaaggcgugugccaccacgcccggcucaucagcauauuucuuacucaacagaucccugcagggauucagacagaccagaagauucguuugacuggaaaaggcaucccccggauuaauagcuauggcuauggugaccacuacauucacaucaagaucagaguuccaaaguaaguauucaguaagacuauggccaaaacuguuccggcaaacaggcauccuuugagucuuuuagcugccaggcccagcacccagcaguucaguugcccuuugagcucuuggcuugggcaaguuuuuucuuccuuggaaccaguuucgucugaccugauucccaucugagcauuggcuauaguaaguuggccucauugaguuguggaaugaaugacacaggagcugcugaacuccugauguguucugggcuuaaugcuguggcacccaacaugugcugugccuguuccucucaggaagccagugucagcucuugucccuuuugugagauugguuucucaccuguugccugacaaacacacauaacaugugcaccccaaccugugagcaucugcuuagcagugaugacaguuuaaacaacucaggguuucagagagaagcucaaaggaccagcauuagcacaagguaccccaagaaagggaagggaauaagggugaggggcauggauagaggcagacaugucauaggcaaaugacugucuauaaagguaaaggggaccccccccccguguuaggaugagguguuuaauuuugauugcuguacuccaauucuuugauaguugaaccuugguggucagcgucaggaggaggaaguggccaaauaagggaauaggccuugauggcuagcuuuaggaaugugaucuaacaguuuugcaaggaagagagaauagugaaggguaaggccugccagagccacacuugccauguguaggcuggcuagagcccuuuucugaaacguugacuuggccaucaguuccucaccacuggcucagugcgugccucugcgcgagucagacauguaugugcuuaugugcuuucaagggcugccuggaggaagugcucggccacuaacuguuguugguucacaggaggcugagcaguaggcagcagaaccugauccugagcuaugccgaggaugagacugacguggaggggacgguuaauggagucacccacacaagcacugguaagguaccugggacugacauggcggugugagggaccucugagucucuauugacagacauuucagaacuugaguuuucauaggcccccaaaagucauuggaagaggggacucguggguauacagccaucucucaugggugcgucuccuauucacugcauccauauauuuaagaaagcccaggagcacuugcugcccggcagcugugccuaaaaguuguuuccugaguucuagccuugguucugccacuugcccugugacuuugggcaauuaccuccaagaauucuuuguaauaguuuaagggggagaugaauugaacagagcuauagacacuuuacuaggaguccaaaguaaacagugcugacaacaguauaaagauacuaccucccacuugaugaacagauuuguugccuaggcucagaugucaugaacucagacacaagugguugaugugugggcuggagcuuuccugugccccugaggcuguuucucaggugaagcuucuguugauugauauaggucaggacaggucaggacaggacaggacaggucaggacaggucaggacaggcugugcccagcugcacguguuucuaccucauugcaucauuuuguuuuugugggaaccugaacagaguccucagaucuggaguggccuuauauuaguguguggugguuuauagccaguauucagagcuagggcagcuuuuccagcagauuagagggaggauuuggaguucucagagggaagagacaguaguggaaguggaaaucccagcagccuucccuggaaguuuuguugagcuccuguuaagaacaagagcccuguuuauagcuugaccaaacaccaaaugauauuuauuuuaguguuuagaugcauaaugcauaaacuuuucucuuuguuuuucacucauguuugcuuguuugagauggucuugguggcauguaacaugagauccuacugcuuaggcuucugagagcugggauucaggcuugguccaccauaccaguucuuguguucucuuuuaagcuaaauaggaagugggacaaguuauuccauagaacucugauugugugccuauaacuucaugacaaguccccaagguuucauaauacacgagauuugcucuguacacaggagcuccuguucugcagggcagggcgcagauggggacaggaacaguccauccuuuuuagaauguccuuacuauuuucuuccauuaaccucuguugucauuguuuucaaaaucgcaucucuuugggaguuugacucccagauuugauuuuguaaagcagcucaguugauaaagugcuaaccuaaaaucccugaggucucaaaaccaaaaaccaaugggcuuuuugauaaucuugcagagauggguuggggagagggucaugaggcucccuccuucccucccuccagcaccuccugcuggcuguaucuaauucuacuccauagcauguguucucuggaaugcuaacugacaggggacuccacgaugcagucuguuaggucauugaccauguguaggacuuuucugcauugagaacauuugggcaucaccaauguuccuguaagcaaccccucauccaugucugcaaguaaacccaaaaaacacauugguucccucaagcuggacauaguuggaacugcuuuccugugucugugcccaucuggggugaguagacauuguucacauccaucucccugggguaguugaugcagcaucuagaugcaggacagacagcaggagcacagcucacucugagugggcacacggaaaggagugcuguaagcaacgcgcucagugaggccggugcuauugggagcugcagaggugacucagagacaucgcugcucuuacagaggaccuggauuugguuucugacacccacuuggaggcuuagaaccauuucuaacucaaauuccagggaauucaaugacuuauuauggucuucuccaugggcaccaggcaagcacguggugcacauauguacaugcagacaaaauagcuauacacauaaaaaguaauuauaaucuuuaaggaaaaagaaaaauguagaugggcagugaugguacacaccuuuaucccagcacucaggaggcagaggcaggcggaugugugaguucuaggccagccuggucuacagagcugguuccaggauagccaaggcuauacacacacacacauuucucuuuuucaaaaaaaaaaugcuuuaaaacagucugggugguggacaaagcugccaggacacagcugagcuccacgcuucacacagagccagagccagagccugcacagcucucugcucaguucugagcauuuccuuuuguaauauguaaaggguuaaguaacauaaaggacucuuaacacaucaacacaucuauaaaccaugggcucccuauaccuccugagucuucuaagauaaaauacauuucauuuccuugguaaaugaugacagacauaauguguugacacuguaagucaccacugguggcacuucuuucuuuuuuucuuuccuuccuuccuuccuuccuuccuuccuuccuucuuucuuucuuucuuucuaaguacacuguagcugucuucagacacuccagaagagggcgucagauuucguuacagaugguugugagccaccaugugguugcugggauuugaacucaggaccuuuggaagagcagucggcgcucuuaaccacugagccaucucaccagcccccugguggcacuucuaauccaugccagguaccaugccacuggcuguacuuuaucacuuggucucaccaaauugcauagaggcccuauauauuuugcuuuuugagacaggggaacucacuauguaguggaggauaaccuugaagucuugauucuccugcuucucucucaagacgcccguguacaacacaugucgcugguguugugagaagagacaagaugggguguacagcagaggauccugggugagagcagcucacucguggguuaucuuaaacauguuaauguauacaacauaggcagugugaaauguggcaguggguuaggaauuggaucuuuucuugagguccauugcuuacguugcagccaacagucugguggugaagagucugggcugggguugaguuagguucugccucuuucuaguggcuuugggacucuagguggaccugacagcauggcuucuguguacauggagcugagaugagcuacugcauagccuuugugucuuggccccgaggccucuggcacuuaguguugcuguuguugucauuguucagauuauagacagucccuuccccucccuuuuuucuuguuugccuacuguggguuugugacuccuaaggcucugagugucccauuugcuucagucuaauaccugagguaccccuugccagccugagaguggcccuuauguuccuggaguggcccuuggcuacuccucagcuuuugggcaguuagguggguagguggggcuggcauuugcugcauggaggugucugcucuugaccucgguucuuucuguuguuugugcccagguggcagaaccauggauagcuccgcaggaagcaaggauaggcgagaggcuggggaggacaaugagggauuccuuuccaaacuuaagaaaauauuuacuuccugauaccccugcugagguaggaaaaccugugagcuugcuuuccuguaaaccucugaacuaaucucucuucuuuaaccaacaugagaucccaccucacccuacccuaucccaggaggugggagaguauaguaaaugugguuccccuucaauccuuggggcagagcaugugguaccuagccagcacagcguugagcaggcuucaguggccagccucuucauuuuaauucaauuuagauuccuuccuaaagagguuagauuuagagguaccuuacaguccucauugucauuucccaaggacucugucccucuguggugggaccagcuugcccgaaguccagagggcaaauuguggcagagccacgccuagaacucagaucuccuccaccucccaccugcuuuucagcacacuguucugcccaggcaacauggcacuguucauguuugggccacugaggagugacggacauuuugucugccuggagacacacuguuguuucauguucaccccagguccuggggcucuugacccucaaagcucagcuauucuccagggauuaacagagccucuuccacagggauguguucugagauguggaauauaacuguuugucuucuuggcucaggaaagcggucaacuggaaacuaaauggagcagcagcuccucucuguggccagggcaucagacacaggaggaucccagaacggcagcacugagccccugcucccagaucccucugaaccgccgagcaacagcaaaacuaugugacaacacuucuccgcauaaagguuauggugcccuaggcagugacauauggccucaggcuggacaccgagacagguggaaauacccuguccauugguagaugucuugcuucuucugguucaggcagggaaaacacuuggacucuucuugcagcacuaaaacuaaccuggaaucgcauguaguagagcugaaagaauuaaagacccggcuuacagcuucagaugaagcuuuaagcugcaguguugugaagugauuaauucccuuucuaccaaccccgugggaguucuacaguacggcuguccugacacggcucuugucuaggaccagggcggcacaucccaccagcgccaucuuccuggacagagugagcugucagucacuccccagguuuuuuuuguuuuugggguuuuuuuuuuuuuguaccaaguagcuagaaagugggaccuagggcccugggaggacaccuagcaacagcagguuccauuucaccucagauggcagcuugccuggcaguggacuuagaguguucuagucugauguaugugggguuuccugcccuguuggaccaaaguuuccaugguccuaugggauagccuucagccucuggagacccagagcuugccugccagggcuugguucuccauuuccacugcugacauuugauuuccaguguauuuaaauuacuccgugguaaauuucauugucuuuuccuguguaaauguuaaaugacaauaccaucggugaaggcccuccacaguggacagagcaacuuccuuuccagccucugcugguagcaugcugcagcuucuguguuaaagguccucuggagcucguguaagacaggaagaacacuuucucuguaguuucuuucuuuucauuuauaauuuacaaaaguaaagcauuuauuagugucugauuuaagaauguaaagugauucuguaucaauguaaauaagaugaucuacuacaaaagauauuuaaaaucaaaau

SEQ ID NO: 8070 - RNA, 1041 nt, Mus musculus
uggagccuuucugagagaacauguaauaagauguaauuuucagggucaagggagggcauccacacgggguauaccggaaucugauacugacgccgcguugucugcugggguuuguaguuccugccagggcaaggcucgcuagauuaugguugcugcacucagcgacaacauucacaaguaaagugcagcauucguuccuaccucacaaaauuccaauacagggaaaaguuacaaacugacauccucauagucuagcacuuguacacguuggccuagguucuaccguucggagaccgaggcgcgugcgcaaugcuuacgcucugcgugcuacggaugccucgccuccggaagacgcgaccggcgaggcgggccagugacggucugcgcaggcgcaguguccccgggccaaaauggcugcgugguguuccccacgcugguugaggguggcaguggggacuccccggcugccggcugcagcggggagagggguccagcagccccaggggggcguaguggcaacaucccugugucgcaagcugugcgucucugccuucgggcuuuccaugggcgcucacggcccccgggcgcugcugacauugagacccgguguccgccucacaggugagggaggcuuccagcucuggaguagaggcuccugggauuagaaagggcgauucggcuccaucugaugaccaggguagcgggauggagaugucuuccggcccaagagaggaauuucuggggacacaggcaagcaggaggcagagaggccaaggugcuggcuacccagaagccgucgaggggaaagagcugcguggagccggagguguugaaacgcuccgaacgccaugaaccuucaccucugucaacaguucaccucucuguccaggcugcugcccccuugucauagcccuucucuuuuucuucacgcucuagcuuguaguggaagauguaacugccauuuagugagugcuaggcacccauaaaucaagggagaugcaggugcuugcccucauuaagguuagagagugugaugaauug

SEQ ID NO: 8071 - RNA, 1041 nt, Mus musculus
caauucaucacacucucuaaccuuaaugagggcaagcaccugcaucucccuugauuuaugggugccuagcacucacuaaauggcaguuacaucuuccacuacaagcuagagcgugaagaaaaagagaagggcuaugacaagggggcagcagccuggacagagaggugaacuguugacagaggugaagguucauggcguucggagcguuucaacaccuccggcuccacgcagcucuuuccccucgacggcuucuggguagccagcaccuuggccucucugccuccugcuugccuguguccccagaaauuccucucuugggccggaagacaucuccaucccgcuacccuggucaucagauggagccgaaucgcccuuucuaaucccaggagccucuacuccagagcuggaagccucccucaccugugaggcggacaccgggucucaaugucagcagcgcccgggggccgugagcgcccauggaaagcccgaaggcagagacgcacagcuugcgacacagggauguugccacuacgccccccuggggcugcuggaccccucuccccgcugcagccggcagccggggaguccccacugccacccucaaccagcguggggaacaccacgcagccauuuuggcccggggacacugcgccugcgcagaccgucacuggcccgccucgccggucgcgucuuccggaggcgaggcauccguagcacgcagagcguaagcauugcgcacgcgccucggucuccgaacgguagaaccuaggccaacguguacaagugcuagacuaugaggaugucaguuuguaacuuuucccuguauuggaauuuugugagguaggaacgaaugcugcacuuuacuugugaauguugucgcugagugcagcaaccauaaucuagcgagccuugcccuggcaggaacuacaaaccccagcagacaacgcggcgucaguaucagauuccgguauaccccguguggaugcccucccuugacccugaaaauuacaucuuauuacauguucucucagaaaggcucca

SEQ ID NO: 8072 - RNA, 1898 nt, Mus musculus
uuuugaauuaauuaaccauuuaauuguuuuuaugucuuaacuaauccacaagacuaguauagcacccuugguguagucuaggacugcaggugcccugcaagguggaguauuccaagacugcuccaagcccagcagguucacagcccauucaagaacagcacgccccaguucccaggucucuguggugagacaagaugagacaugaugugaaauggaggugcagguacaacccaggcgcucaagcugggcuaguccuccuacuggcuguccuugcuccucuuaaguuuacucacucccucacaguucuccuuugccuccucuccucccccuucucugaugaugacaguucuaccccacuucucucucucucucuuucucucucucucucucucucucucucucacacacacacacacacacacacacacaccuccugaacacagguuccagcccaccucagacaguucuggcugagugaggagcugagguggugguggugguggaaggauggugcuuccuaagagcugggagaggggaucuugguguggagggaagaaacccuuggcuugggaggccaucaguauguaggggugcugggugcuucuguuuccaacgcucccuauggucucuaggcaauaccagcuugaugccugaggccacccccagccaacucaccuuuucuuuuugcaaugguguccaaauggggcugggccagucccaacacaggcgacucauuuaucuuugccuggagaccccacccccauaccacagauaaaaauuuuuagcauuuucuggccagaauaaaaucuuauuccuuuggacuuuagaugagggcuuguccuggagcugucugcaggcaguggccuucucuucuuuccacaagaguggccuugauggucccuccucuggccacuaacagugaggcucagccucccagugccccuaucuagaacauaagaugucugcagagaccagaaagcuguucaccaccagagcagccacauucccugaacugcuucagcucuguagacagaucaugggggcuccaugggcucaaagucacacagcucugacucaugcagaaggauugacuguuggguacuguacuacccuguccuccacugcagaagguuugcugaggaagcggggucugggcuaugccugugcacaugucccugguccucaaagagggccugcucucccuaacaaagucauaucuaagccccuagcuggucauuucaaaggggccuucuaaggguccucugcagaucaaagaaccuuaguaaccuucuuaguaaccuucuguaagagcugguucuuacagcccagggagugaaggcccguccucaguccugcagcuugguguccauccuucuacuguggaacacgcuguugggagcucaacuucaaagacaggucugguccaaaagugaaaggccugcaggcuggaggcugggagaagguagcagucaggauuugucaguugguauauggcaucucaguaugucagccuuugcguuuuaagauuaaggugguggccagggacgguugaacacaccuguaauguucauacucaggaaacagagaguaggguauuagaagguaaagguauuuauaacugagaacacucucaaggccagccugggcuacaaagacccugucucaaacaaucaacgagggacuggagcgguaccucaguggcuaacagcaccaucuuuccaagauccagguuugauucccagcacacacagagugguucacagccauccgugacuucagucccagggaaacugaaacccucuucuggccuccagguggccuuguggcacacaucuauacacgcaggcaaaacauucaaccacaguaaacaaaaaaaaaaaaaaaaaaaaaaaaaaaac

SEQ ID NO: 8073 - RNA, 1898 nt, Mus musculus
guuuuuuuuuuuuuuuuuuuuuuuuuuuuguuuacugugguugaauguuuugccugcguguauagaugugugccacaaggccaccuggaggccagaagaggguuucaguuucccugggacugaagucacggauggcugugaaccacucugugugugcugggaaucaaaccuggaucuuggaaagauggugcuguuagccacugagguaccgcuccagucccucguugauuguuugagacagggucuuuguagcccaggcuggccuugagaguguucucaguuauaaauaccuuuaccuucuaauacccuacucucuguuuccugaguaugaacauuacagguguguucaaccgucccuggccaccaccuuaaucuuaaaacgcaaaggcugacauacugagaugccauauaccaacugacaaauccugacugcuaccuucucccagccuccagccugcaggccuuucacuuuuggaccagaccugucuuugaaguugagcucccaacagcguguuccacaguagaaggauggacaccaagcugcaggacugaggacgggccuucacucccugggcuguaagaaccagcucuuacagaagguuacuaagaagguuacuaagguucuuugaucugcagaggacccuuagaaggccccuuugaaaugaccagcuaggggcuuagauaugacuuuguuagggagagcaggcccucuuugaggaccagggacaugugcacaggcauagcccagaccccgcuuccucagcaaaccuucugcaguggaggacaggguaguacaguacccaacagucaauccuucugcaugagucagagcugugugacuuugagcccauggagcccccaugaucugucuacagagcugaagcaguucagggaauguggcugcucugguggugaacagcuuucuggucucugcagacaucuuauguucuagauaggggcacugggaggcugagccucacuguuaguggccagaggagggaccaucaaggccacucuuguggaaagaagagaaggccacugccugcagacagcuccaggacaagcccucaucuaaaguccaaaggaauaagauuuuauucuggccagaaaaugcuaaaaauuuuuaucugugguauggggguggggucuccaggcaaagauaaaugagucgccuguguugggacuggcccagccccauuuggacaccauugcaaaaagaaaaggugaguuggcuggggguggccucaggcaucaagcugguauugccuagagaccauagggagcguuggaaacagaagcacccagcaccccuacauacugauggccucccaagccaaggguuucuucccuccacaccaagauccccucucccagcucuuaggaagcaccauccuuccaccaccaccaccaccucagcuccucacucagccagaacugucugaggugggcuggaaccuguguucaggaggugugugugugugugugugugugugugugagagagagagagagagagagagagagaaagagagagagagagaagugggguagaacugucaucaucagagaagggggaggagaggaggcaaaggagaacugugagggagugaguaaacuuaagaggagcaaggacagccaguaggaggacuagcccagcuugagcgccuggguuguaccugcaccuccauuucacaucaugucucaucuugucucaccacagagaccugggaacuggggcgugcuguucuugaaugggcugugaaccugcugggcuuggagcagucuuggaauacuccaccuugcagggcaccugcaguccuagacuacaccaagggugcuauacuagucuuguggauuaguuaagacauaaaaacaauuaaaugguuaauuaauucaaaa

SEQ ID NO: 8074 - RNA, 3036 nt, Mus musculus
uccacaaagacaguuuuuaaggcucauuugagguacauauuuuccuaaauacaugugguaggcacacacugacaccuuugcaaacauaggagcuggaaauggcauuccaucaaaagaucuucauuuuagucaacucaggaggccucuccaaaccaggagaccccagucaaaggauucaucugucuucugcuggacagggacugcugugaaaagccccuuagagacauuuaggaccacaaccagcauuggggacagugugguucucuggguugggucaugaauguaugcucagagaacucuggcugggccacuugacagaccuggggaggccaaacaguauuagguguggccucacaucuaagauucucgaaagaacaagucuuucucugagacuguuugaaggaguccuggcagcuacagaagggagcuuagacuuggguucguuggccggugcccuccacccaucuguggcaggcuuauacucugaaguugcugagugaaaagcaaggucccugacugaggcuagcuagucucaggacagcagucggaaauguauuuagccagugauauggaggggaccaacccggcagaagugggccaggccaugucccuagugugcuggccagcuccugccacuuguggguuuuccaagguaagucacaugugagacuucuuacaccaaaccucuugacuuuaaaaaugcugacacaguuagcaaaccaggcaacaguaugagcaugugacaaguucuuaagcccuugagauaacugcccuccuccagucauagggaggguacagccaccaacugucaaagccauguuuucccuuauuucuguaugucacuauguccuuugggaaucagucacaaagcuugaaacauucuuuaaaacaacuucauagaugcaaauagcauuuuaagaguggaauuguggggcuggagagauggcucagugguuaagagcacugucugcucuuccagaggaccugaguucaauucccagcaaccacaugguggcucacaaccaucuguuaugggaucugaagcccucuucuagugugucagaagacagcaacaauguauucaaauaaaauaaaucuuaaaaaaaaaagaguggaauugugaaaaaucacuuaagacaccagucauuugggcauguaggacaugaucaacucuaaccggcuguuuuugguugguauucugagacagggucuccuguaucucaggcuugcuuucaacuaaauauguaucugaggaugaccuugaauuuuugacgcuccugccuccacauucuagaguuuagaaguuacaguuguaugcucucaugccuggccugcuuacgcagcggcagaaaucacaagcaggaccuccuguaugcuaggcaagcacucucccaacucagcccguccuaacccacaagcuggcgugcguuugcugcccaggcugcugagagcuguuugagaugaagcgcugcuaaggauggcuuacaagauuuguccuuugcucugcagccaaccuucucugaacacaaaucguugcuuaucuuuuugcuucucagcuuccugguggggguuaagcucuaagagggcccaggguuuguguuacugucacuagucauaucugauucucccaaguuaguccugauucucugaguuguucagacuagugcuccagcacccuaccagcaggguuccagcauccuacaaacucaaguaucuaagaccugcaucccaggagagucuuaaaaggcuggaagcuaggauguuuggcaagcacuuaaaaaugguuaaaaugacucacagacauccgugaucacagccuuuaggagaggaguucaaagcucgccugaaccauauauuaagacccugcuucaaaacaagaccaccugcagcacucaaaauaccauugucuucuagaaguuuggagaucaggagacugguggcugugugcuuaucugcugcaucagaaccaccugauauugggaccuguauauuuuuaauaacagcuuuaaaguggaauugacacaccagaaagcucaccuuuuccaagugugaacgaauggcuguuacuuuaggcagaggggucacugcuguugaccugcuauuccucccagcacugauauagagaccugggaucuguuuaggcucggcagcuaggcaugugaaccaugugugugacuagcauggccaucuagagaggaugucggcagugucuacagugggcuuugaucaccacuaccugauggugcuaccugaccuguugggcaggcuucuagaacacugggcaucacacuguauauaggacggcucuuacuguaaggacauuacaugcccagauguuaacagugcuaaggauaaaaggucccuucugccuucauguguguaaccacuugagaccaccaggcccaacucucaggagccuccucaaauagguaggcucaauggcggccucaguuccagcauguuagauaucucaaggguacuucuuaaaacuucaaugucagccaggugguggcgcacaccuuuaaucuuagcacuugggaggcagaggcaggugaaucucuggguuugaggucagccuggucuagagugagucccaggacagccagggcuacacagagaccuuguugggggugggagagcaguggcaaaaaguucacuguguauuuaguagcucgauuuugacugggggggggggggcggggaagcuucacacugagauuuuauguacaaaacaaggucuagggugauguuuucuacuuugccaugagacaacauuuuaagcagggcuggcauaauccaccccaggccaccuaggagcugcugggcauuucaaaacugacauuaggccaugugcuacaucaaacauaguccacagggccacccugcaugacagguggcccugggaucagaucccugaggaacaguuuccuaccaucccuguggggaagcuguagaguaagacuugagccaaacacaccuuccuccuucccgccucauucucuaccuccagauagguaggaauccagguugguauag

SEQ ID NO: 8075 - RNA, 1024 nt, Mus musculus
cagguggugcggauccuggauccggaagcaggaagcagugugaguuccuaggaccuaccuggccugggggggaaggggugccacuagaggcaggugggggcacuggaaucagcuuugcuggggagagaggagguaagggggugguugguugggugggucggggcugcccaggucagggucagugugggggccaaaggucuaggggagggaggggagacaagcagauggggacgggguguguguguguggggaggagauaguggagaaaggaacagggaagggagagauugcugggucuggagcaggaggaauagggacagaggaggaggcuggagggcuuacagagcagaaggcugaggaaaacaggggggucaagggucaucucaggguaggcuuagacuguguacggccagaaagaggccuggacugagguggcccuuugggggguguggggcagguggcugagauggggcuuucugaugaggagcugaggcaggagcugcaggccacugcagaggaaguacuggggaggcugaggagccggcagcucuuccagucggaaugggacgucgcugccuuuguggucuuucucacauuugugggugagugcggcuccugauccaaggcccuaccccguugaagcagggggccacaucacaucuggaugccucucucuggucuccaggcacugugcuguuguugcuguugcuggucuuuguccauugcugcuguuguugcugcugcaacaccucccccaggccccggaaggugagccccgggaaggugagagccugggaagaugaaccuaggaaggggugggcgcugcgcagagaggagcuccccucgaagccccccucacaccuacgcugggcgagaagggcagggcagagccuucuggugaggguuuuuucucuugcaggaaaagcgcaaugguguggauaacuuggcccuggaaccuuaaugcuaacuugcccuuggcauggguccugcuggaugacaguaacagagccaauguuugccaaag

SEQ ID NO: 8076 - RNA, 1024 nt, Mus musculus
cuuuggcaaacauuggcucuguuacugucauccagcaggacccaugccaagggcaaguuagcauuaagguuccagggccaaguuauccacaccauugcgcuuuuccugcaagagaaaaaacccucaccagaaggcucugcccugcccuucucgcccagcguaggugugaggggggcuucgaggggagcuccucucugcgcagcgcccaccccuuccuagguucaucuucccaggcucucaccuucccggggcucaccuuccggggccugggggagguguugcagcagcaacaacagcagcaauggacaaagaccagcaacagcaacaacagcacagugccuggagaccagagagaggcauccagaugugauguggcccccugcuucaacgggguagggccuuggaucaggagccgcacucacccacaaaugugagaaagaccacaaaggcagcgacgucccauuccgacuggaagagcugccggcuccucagccuccccaguacuuccucugcaguggccugcagcuccugccucagcuccucaucagaaagccccaucucagccaccugccccacaccccccaaagggccaccucaguccaggccucuuucuggccguacacagucuaagccuacccugagaugacccuugaccccccuguuuuccucagccuucugcucuguaagcccuccagccuccuccucugucccuauuccuccugcuccagacccagcaaucucucccuucccuguuccuuucuccacuaucuccuccccacacacacacaccccguccccaucugcuugucuccccucccuccccuagaccuuuggcccccacacugacccugaccugggcagccccgacccacccaaccaaccacccccuuaccuccucucuccccagcaaagcugauuccagugcccccaccugccucuaguggcaccccuucccccccaggccagguagguccuaggaacucacacugcuuccugcuuccggauccaggauccgcaccaccug

SEQ ID NO: 8077 - RNA, 36044 nt, Mus musculus
cagcaaacacccgucacguggucaggccaacuccaaugggcggugccgcggcgaccugaaguucccggcugcccgugcggcggcggugguugggugguaagauggcggcugugagucugcggcucggcgacuugguguggugaguccuggcgaccagcgcugaacgaaagacggcgcgaagcugcuuuuccuggucgcaggguugccagcuggcccaggaguaguuuuauuaugcacuccggacggcggagaguggggaagaggaggugccgccgcggugugaacgacgcuugagcggaagaggcuguccgguccccgggggaccgaggccgagaggggccgcggcggucccugcucugaacccugaggccaucccaggggaggguuacggcucuagaacucuggcuccagcugccacugcagagaacucuggcguggcguggagucccagggucucuccggaccuccucucaaagcaggagaggauaccuugcuagagacagagccguccauacccgcguucgguugggacagacgugggcucgaggcuugguuccagguggcgaaauccgacugcccggcgcugccccaugaagaaaccgaggggagggugacuucuccuuugcaaaugauggcuaggcggugauccagugccucucguucuguuccuuguguccccugcaacagccaaaaccaagagugaccauugucuccuuggaacugcguaguuucccuaccuagaggaagguuuccaugaucauuugucaaaggaaagccgaucauggggugaauuaaaucagucuuagggaagucuguguuuacagagagaaguuuccaacacucucccagggagguaccagaccagugacguccugaugguuuuguuuuucuauguuccuucucgggaagagugcacagaucucaggcacacacacacacacacacacacacacacacauauauauauauauacaguuuuguauguaauaugugagggcccugagcccagcugugaaagacccaucugguuugccugcuuuuguucuggcccuuuuguucagccuagaguuagaagcauagauugcuuguugagugggcugaaggagauggacuggcuuuuccagggcaaguucugacuguuuguauuauuuucucuagggggaaacugggccgguauccucccuggccaggaaaggugagugcauuguugguuuuaaaagaagguaguugaagcuaagggagaggguuaacauguugaauuuccuccauucucuaacacugacuuaaaaugggcucauuuugauaaaauguaguguuuugccuccaguuaucagucgguuuugaaaguuauagcauaaaccagaguguuuaaauaugagguaaucacuucagucagagggcuugugaaauugguugguuuuuuaucuuggaaaucaauuguaaucaaaauguagcaugcuaaaaucuaaggaugaagaaacagauucuccaggaagagggaagucuaaauguagguuagugaaaagcuaaaguauuuuugucccaacuaaguuuaaaucuucuuccccuguuaccauaugugcugcuccagugcaucucugcagaagauggcauuccagauuuuucaagaggugguccaucauagcuuuccaaauguucuggcuuuuuagucuugcuaggaauccaggaaaugucugaagacucuuugcaauaugguauuuccugugccuuggugguccccuauuuucacugcuuccugucuuaacucuugcuacccacaacaaaaguauuuuaaagaauauuuucuguuucuucauuaaucacaucacauggagggaggggugauguugcuguuaguuuuaacuguuucuaugccacgagucauugcaauaagacuaucuguuggacaauauacuaccuguuggcuauggagaauuuaaagaauauuuacauauuucuucauaucacaauagcaaagucccaucuaugggacaaguauagagcccugguuugcuuuuggacauuguccuuucucagaucuugggcuuuccagccucacuggagccauggggaguuacuuucccaguagccuucugguucgccucauaccuuuucucuuucucuccuucagauuguuaauccacccaaggacuuaaagaaaccacguggaaagaaaugcuucuuugugaaguuuuuuggaacagaagaucagugaguaguccucccugagagcuucauguugcuuuuggguguuccccugagucugaacugcucuaugaguaucuaaggcuugcugcagugugaaaaaugguuccucacucuggcuuuacgcuuaaauaaaaggugguguucuuaucuagcaaaaaauuauucugaggcuaaugaugauuuccuucagguaagaaccagcguucauaacucuacaugugguaggcaugcuguuuauaucacgugcgcucauguguucucucucucucucucucagcaauuuuuacaaauguucuguggccuuggggauagaacacggagccuugcccauuuuagaaaagccauugaccacugagcuacaugcccagcugauuuuguuuuaaugaccauguaguguagucugagguacagugaaagcuaagguguuauuugguaaaaauacuuguuuaauccuguucucauuuauaaaacaaacuaacuuaccugugucauugcaauacaaagcuuuauuuccuagugugugcugaacuggaagaaccuaggaccauugcuuugagaguuugacuuuacagaaagcaaacuuuaaaaaguuauacugaaggaagaauguguaaccaauugaauauacaguaacuuguauagcuuucuccucaauacaggauaggccuggcuagguaacuugguuucuuuaagcaguuguuucuguacuuacuauuguuuaaagaaaaauguuacuuuaaguucaaaaaaagagugauuuuuuuuucuucuucugaaaagucccuuacaaauugcuucacacauucaggaguuuauguggcagagugcucuuccggguuucaguuuacauaguauguugaccuucacaaugcagauauacccuacccccuuuuuuuucuuaagccagcuuacgagcuuugugguggcaguauuucaaggaagacuacccuaaguugugagagcagagcuugugaagagggaauguuguucagugucaugauugagacuggacuacagcucaguuacagaagagcacucgucuagcuuguguaaagccuuggguucauucccauuaccaccacuauccccacucacugacggaaggaaggaacauguuauugucauagacuacuugaagaagacuguccugaugagaaaaacagguguugguuauacugcauaggagucuacauuucucagugcuagauggugacccuucauuucuaggacagugacuauugucuucaccuuuggggaucucaguaagcgagcaagauuuaauaguucagcugggauggugugcagaagagggcgaggucaauggaaaacaacgggucuaggaaagcugauggaagacaagauggaaauccaguuccgaagcaugaauagaguuugaaugauugggaacaaaaguggcaauguggauccuuggcuuggugccaugggggaaaaaaagaggcuccuugccuggcauaguaggaaguaacaggcaguauuauugaccauacccuaagcguggcugaaugaagaaccaagacaugugugaaauaacuauggaaacucauuuauuugaggucugaaagccauuauuugauuuuuuuuuuuaauucuaaaauucuagaaggauaaaguggcuucccucuauacacaaaauacuagaaauaagacccaggaaauuggaauuauauaaacugagcacuuagugauaaagggcaugugcuaaacacauaaauaauuaccugcugcugguagugaugaugugauuucuugaaaauaagcucuccugaguacacgacaaguggcuacagggcagcuaggagcuauaaaugacuuuaagugucuuagccccuuugauggaguuccacauuuaaaaaaaaaaaaagcauuuuaaaagggcucauggugaagcuuagugguacaguaaauguuuagcauucacugcccaguacguccgaguuugcuuggugucuggcuggcugguuugggguggucagcgagcacaggaucaggacuugcagcagugcuguuacagaggcugccucuggguacucagugcuaagugcuguuacagaggcugccucuggguacucagugcuaagugcuguuacagaggcugccucuggguacucagcgcuaaggcugguucauucagggucagggugcaaucuuuacaggugagaucuccagauuagcuggugguagcggaauacuuggggaaguagcuuuggauguguuguauggccugacacuuaucagauaacugguucuacccacucucugaucuaagcaagccaaagccaaagaagggacacaucagacagaagaguagggcucauuacugugggaaagcaaagccugagaaaagcaucgucaggaguuaggaauuggcuaguagccuucaagaguucugcaagggacgccucaauuagaauguuguguaacuguucaagagcagcacaaugacucccaugugaaguagucacuuuggaggugguauagacaaaugauagcugaauuuuuuuagagauaagaacuaguuucuaaaagacaaauauaucuguggcugugauggguccuuuaagacugacgcuuuggggcuagcccuugggacaaagaggcaggcaaaccagccugcucuauauagcuaguuccaggacaaccaauacuacacauagaaacccucagaguggggguagggauugacacauuaauuaaugggaaaaaauguauguaaguguuuuuuauauuagcaaggaccuuuauuacagaauacaaugcauagcuucuugaguaagauauuaguauaugaugguucuggagagaugggucagcaauuaggaacauuuacuacuuguucuugcagagaaccuggauuugguucccagcacucaaucagguaacccuuuggcuuccaaggaugccugugugcacaugcuacucuuuaucucacauggcacacauauaugcacauaauuuaaaaagaaaauauuuaauaguauguauauguauauacauguguguguguguguguauauauauauacauauauauauguauauaugacccugaaguuuuagacaucuagcuuuuccuuuccucucuuaccaaaacaucuaacaaauuauguuggcaugccacaauuaggaauagagggucaaaccugccucaucaggccacugucuugaggacaggacuuaauaugauggagucaacucuccaauacacaacuuuccacacuuacuuuaaaauccaggggaaaaauaucuucagcauggcuuuguuaacucuaccacaguuaaacaugaagaaacauugugugggaguccaccuuggacaagucuguccuugguugcugcucauuaaagagaugaggcucaggguuuaaaauuuugaugagacauuagaaggaugucuccaugguuuauaggaauuacugcucuccuggaagacuauaguugguucccagcauccaugauaaguagcucauaauuaacuuaaauugaaguuccaaaggaucuuauacugacaugcacacauauacacaugccuggcuugcaaacacaaauuaguaucuauuuaaagagauuuuaaaaacuugaucaacagaggcuggcaaaaugcagacacaggugcuugcuugccauuucucauaauccaagcucaguccucagaacccacguuaugagagaagagaacugccuuccucaaguuguucccuaaccucuacacuagcaccaugguguuugugucugcccacacauacacucacacaguugaaaauuuuugauuagauuguuaguuggaaauagcaaagugagaaaguguucauuuaguuugcagguacucagagccaccaguucagaaauacuauaucaaaagcuggagucaugcccagugcuuaggaguaguuaggccuggcugguacaaggugucuugagucuguccuaaaggugacucuccuagaaaagucuugugauuggugaugaagagcauacuggguugaaacuguaagcaugccuuuaucuuuucaccagguauugacuaaucuacuuucucugcaucugauaccauuuaauaauaguuagaggcuuaaguuaagugagugguaugguccaguauucuggauauuugacugguacaaccugucccugugccagggcugcauggucgucauguagagcauggauuagauuuuccuucccaauaacagaaacagcucauguccgcauagugacuccuccauggcugaagacagugccauagugagcggugucauggaauuacagaggaggugacuacugcuugggacaggcagcgcagcuagaaagccucaucuaggcuugagaaugucaccaaguaucucaguuccuuuucuguugcuuucaucaacaccacaaccaaaagcaguuuugagguaaggguucuuucaaucuuauaccuucaggucuuugaggaaagucaggcaggaaccauggaggagugcugcuuacuggcuugugcuuacguucagcuauuuuucuuuuuuuuuuuuuuuuuuuuuuuuuuugauuuauuuauugguuauauguaaguacacuguagcuaucuucagacacuccagaagagggagucagaucucguuacggaugguugugagccaccaugugguugcugggauuugaacuccagaccuucggaagagcagucgggugcucuuacccauugagccaucucaccagcccucagcuauuuuucuuauacaaucuaagaccaacuucccagugguggcacugcccacagugggcugugcccucccauaugaacaaucaagacauuucuccaugggcauggcuguaagccaaucuggucuggguucucccucuucuuaggaaaaggaucuaauacguguuugguuguaucaaguuaacaauaagaacuaaccagagccgggcgugguggcacacaccuuuaaucccagcacuugggaggcagaggcaggcggauuucugaguuccaggacagccagggcuacacagaaaaacccugucuugaaaacaaaacaaaacaaaacaaaacagaacuaaacuaaccaggacaccaaguucuagaaacaaaguuuucuaaaucuaucuuaauugcaagucuuuugcuguuuccucuugguggugauggugguauuuuguuuuguuguucuuguuuugguuuuaaacuggaucucacacuagaguagaacuccuguuccuuccucauccacuucuccagugcuggugugacaggagugcacagccacacuuggcuuaguuugacaugaacuagacauuuccauguugccugugugugugugugugugucugugugucuguguguguguguuucccauugccuucauuuuugauuaguuagguuaaaauuaaaccuuuaucuucagccacuuucagugauuuuguuuuguuuuaagacaacuauaaaaaugguuuucuaaguacuacucacgcauccagauggagaaaggacccauguaaucugaccugggcuuuaugccccugucuuuuuauaggccaugccaucuagcucuauugugugcuuccauuucuaagcuccaccccagguccuuauaccuaagcaguggaggagacacauguaugagauugucagaugguuuucacuuaaggagaaaaaguauagaauuuuuuauuuaaguggaguaauuugagaaaggcuuagugacaguguuccaucugaagaguuuguaggaaauaugacaagacaucaaggaacaugcugugggucuuaucaaauguauucacagcaacaggcagacugaguuucucacuacauaccucuaagccagaaagucuagggcagccccugcugagcagcuggcaugguaaguuuacguaaagaccuuuaauauugguuuuuggacucaugguggagcuagagauguuaauuuuuuuuaaugacucugaaaagaauaaagcaauuccauuuuuuguucuucuucaaccauucagguaagcuaauuucuuuugggggaaaggaggcauuggcuuacugaguugguuucucuguguagcuuuggcuguccuggaacucagagauccaccugccucugccuccugagcgcugagauuaaaggcgugcgcugccaccaccaccugccuaacuaguuucuuuuuuguuuguuuuuguuuuucuuuguggauuuuaauuuuugauuugaguaggguuuuuuuuuuguuuguuuuugucuuugagacagggucucacuauguagccuuaacugaccuggaacccacaaucugccugccauugccucucaggugcugggaguaaagguguguuccuauacacucagcucaaguagacuaguuucuuggguuguaccaccccagaaauacgaugcagaaucaaaaaguuguauguuccuuuguguaaacaguagcauauuacacauagugcuuuuucugcuuuuuaacauuuaaccaaauacuugaaugggcagccucacagauugccaguuaguuugguuuucaucauuuacuaucaucacaaacaauguguagcuaacuacuguccauaaaagcaaagcuucacacuuuaggcacagacuugauaaguuugacuuuuugacuucccaaucaguggcaaagugcuaaauggguagagcuucuucuggguccuggggaaaggcugugaagccaauccuagguuacagcucauuacaaguaaacacagcagcugugugaggcugaguccucagagcacgugacgagcauauacaaacccugcguucaucuuagcacacacacccugaacccccucuccaaaaaaaggucuuuaaaaugccauugacagaguugguagaguuuacuuaacaugcacaauacucuaguuuugguucccaucauuauauuaaucaggugugauauacacaauagaauccuaauccuagcacuugaaggugaaaauaaaaggaucaaagguuuauggucauccaugguuacauaggaguuugaagucuaccugagcuacaugagacccaugcuuccaaaaauuaaaauuaguguggcaauacacaccuuuaaucccagcacuugggauguggaggcaggcagaccuuuugaguucaaggacauccugcucuauggaccaaguucuagaaaagcaggggcuacauagagaauuuuuuuuuuuuuuuuuuuuuuuuggccagcuaugauagaguacacagcuuuaauugcagcauuugagagacagagguaggcaguucacuaugcauuugaagccuggucuacuuagugaauuccagaccaagcuagaccuuccugccccaccauuaauuuauuuauuaauuacaauuuuuuuaaaaugugccagguggugguggugcacgccuuuacuccagcacucgggaggcagaggcaggcggauuucugaguucgaggccagccuggucuacagagugaguuccaggacagccagggcuauacagagaaacccugucucggaaaaaaaaaauguuagaguuaccccgacccaggacuggagagauggucagugauugagucagcuggcugcucuuccagaggaccucacaaccuuguguaaauccaguucuaaggaaucugacaccaccuucuggccuccaagaguaucaggcacacaagugguaccgacauacauguagacaagacauccauacauaugaacuaaaagaagguaaaauaguuagccaguugagcauuuuaucaccuuuucacccacugucaagcaguccuuguaccccuaaggacggcuguaaggugacucccucacugccagccugcacugcuguccuucaggaugagagguaccacugcagccccagcuaaaggcaccaggucacuaagcaggcagggcuugucgcuguggccacaacagagcacguucuguucugauggcugaagugguuccagugcgcuuugcuuucuagagguucugcaacuugugugcuccagugccagagcucgcaucuuauugacuguauuucugcugaggcaggucaccuggucgguuuuuuuaguagauuaacauuucuugcuuuuaucuucucaaaguuguauuuguauugucaguuaguucauuugaacauuucaaagaucauugugucaagaaagauuucaguuuaguuucucaaaguccuaucuggaaagugaguagaauuuuguguguguucuuccuucuugcagaaaucagaaaucuguuuaaagcacauugccaaaaaaaaaggggggggcugacuuaauuggcauuucuuccauagacauccucaccuuugcuuuuucugucagucagagguugguaggaggcaggcaugacagugacaaaaagggugaaugggacuccugccugcagagcaucuaaccuaguuuuggaggauggacagaguguaccuugagaaccaucuuugaacuuuauccugacacugguguggucucagagcugagucagugcugcagcuccacuaccuucacuucuguccuuaggauucuguaaauggagaaaggagcugugucuggggccccagggacagacugaccaacauuuaggggggucaguacuuuauuucaugguuuuuccuuauagauuggagucauggcucucaugucagguugcaaacuagcugagcuagccaccagaauaccucucuccacugauagguaugguuggcucugugugccagagacuguugucugucccuguguguuguuugccuucacuauagguaucaugucugccccgguguucuguauugagcugugucccagggcugccacauuuguucuugaccugucuucacaacugcucccacaauacucagagugaaaagcuggagguggauaagaaacacuuuggucgggguacaucuuuaaucccagcacucgggaggcagagacaggugaauuucugaguucgaggccauccuggucuacagagugaguuccaggacagccaggaccacacagagaaacccugucucaaaaacucaaaaaaaaaagaaagaaagaaagaaagaaagaaagaaagaaagagagagagagagagagagagaaagaaagagagagagaaagaaagaaagaaagaaagaaagagagagaaagaaagagagagagagaaagaaagacagaagcacuuuggccguugugagugaguauucuccaaccaucuauaaggacagaagcuuuacaguuacugcuguaacccaguuucuauauccuuagccgggcccaugcuuuuuugaagguuaugcugugagacccaaugaguauuacaggaaaauacauuuauaaauuaauugauacuuugccaagccuguauuauguucucauuugcacuuggauccuagagcaucauuuaggaaagccacagaaagccuacuguagcagacuugcucgggauccacaacaggccagauccuucagaacuagcagcugacugcuuuuuuuuaacuuuaagguguuacacauuggcaguugaaauuaacaauaagagaaguucauuuugccuuucaaaaagaaugucauuuaaagccucuuuugugacugcugcacucaucccaaaacauacguguguguaugguuuaguagccauggauaccaucauuuacgaacagauauagacucaguggcugcaaauguuuauaagaacagcaaacuuuuagauacuguguuugggguagagugcuccguugacagguaguuuagucuccagcaccauguauaccaggaguuguaaugcauagcugugaucccagcauuugggagguggaggcaaaagacucaggaguucagggucauccucagcuacauagagucuagacauuuuacuguacacugaguccuugccagguauugugacacaccuuuaauuacauuauucaggaaguggaagcaggcaaaucuccacauaguuggaggccagccugauuguugugauagggagacccuaucacaauaaaaagaaaagauacaugaguccuggcuuuuuuuuuuuuuuuuaaauaaggcuggucuaugaugguuaaucucagcaggggcaaguggaauucugugaguuugaggccagccuggucuacagaguaaguuccaggucagccagggcuacauaaagagaaacauugucuugaaaaacaaaauuuuauuucauuaaucuggcucacauaguugacuaagucaaaugugaugguucacacucuuguaauuccagcacucaagagacaaagauaggaagagugccuggucuacauggugagugccaggccagagagagcaaugcauugaaagccuggagcgguggaggggaggaaagguggaagauguuuccauccuuggccuucgugcagucuacaggcuuugucugcacugggcaaguugcaggugugugugguuggguauggaaagcugauaaaugagaaugaaaguacagcagugugugauccagugacuucacaggaggaaaguucuggccuguugugguucuguucauuucaagaaaauguacuugaggcucaagaguuagaaauggaugguugguaagguuuaugccucuuuuaauuuucaacuaaaacaaguguuaaaaacccuccccuagugagaucucaggaauguguuggcauaugcaguauggaugaaacucuuucuguguuuguuuucuacuagugccuggaucaaaguggaacagcuaaagccuuaccaugcucacaaggaggagaugauaaagauuaacaaggguaaacgguuccagcaagcuguggaugcuguugaagaguuccucaggagagccaaagggaaagaccaggugagagaggcugcagucguuccccuccaacaucggcucaaugauuuugcaugguuacuagcagauggugugugucauagacacgcuccuuucccaugagauuugccuagcaagaaaacagcuguguccagaacucuaugucuguggcucacuuuucugagucaugcauguuguuuucggaagaguagcccagcuucacaauacaggaagagaucuuaggaauucagccaccuuuggggcuguagacaagugaggugauuuuuuuuuuuuuuaagcugucuuuccagcacaaacagaggugagcaaggaugcuauuucucaggguggcuaugaagacaguucacagaacugcugagagagagagagaacuguguggcccauguugauggcaguggugguaguggcuguuguagugguuaucauuauuauuguugaacuuucagacaucaucccacacuucugcugaugacaagaaucggcguaauuccagugaggagagaaguaggccaaacucaggugaugagaaacgcaagcuuagccugucugaagggaaggugaagaagaacaugggagaaggaaagaagagggugacuucaggcucugcagacagaggcuccaaaugccuuaaaagagcccaagagcaaaguccccggaagcggggucggcccccaaaggaugagaagguuugucuuacugccguagcuucugggacuagugucuuuuuugugucaaguagagccaugcucuaaguauaaucuugcucgucuaguggguguggaguacuucccauggucuauagaugaaugagagcaagaugcacagacauaggaaagagaugcagauggugaaggccggaaagcugucuccugaguugcucaggccaggggcaaggcuaacaagaaugaagggaaaaugcuguagaggugagcaugcacuccacgugaggcaggauucuggcaugaguaucccugugcagguagagagauggggcaaacagagguauagacagauugacacugggauacagaggaccauucgguaaauucaagauagcaaaaguacuuaggaaacuguuuaggcugguuguugagauggcagugugccgaacugggccuuagugauugcaaggucagagaaaggggccugaagccaaauagaaagccaaagucacagacagacccaugagagguagcauuuccugaaaagagucagggagaggcagucagaggcagccuuccugugauuuggcagcuggcuauguggaaagguaaagaugaaaggauaaggaagcugcaagcuagaagagagaagugcuucuguggcuuggagagguuaucugggguuugcuguagacuuuguuuauggaacuaaagguagaaccuagaacuucaugcgugguaggcaagcacucuaccauuaaacuagccaucagaucuuuuuuagugugauauguuugaagcaugacccagaaaguacuagaauuauagacuugggaagccaucuuggagggcaaaaagcagucuagugcaugagacuagaugaccuugucuuggaaauauguggaaaggugcucaagagcagaaacuguacugcaaagaaaguauguggucagggucagggcuaaugagguuguaaguguggccagaugaaaccaggaagaaauggcgccaucuguucuggagaacaggucuuggauuucaggaaguggauggccugugaauagugagagcauacugggagauaugcaaccacgauaaaagaaagagaagccagguggcugauggaacagggggagauaaagccuugaugaaauacuagagggcagagcaagacuggcggggucaaacaccugugggacgggccacgaaacgacucacacugucuugaauuugcagaaagagcagaagagcucacugcaucuuggggcuggcccaguuacacuccauccauggggugccuggccaacuauugccagauagucugguuuucuugagagagaccggaaaugcagaauuguaugugaagcucccuaaguuuaaauguuccaaugugauucacauuuuuaaaacacuuuaagguuccacaugaauaucauuugcuaagcgcagccuggucugccucuguggucucuuuacacuguccuaaggcuaaggaaaaggaagagagcaagagucuuccuaugaccaugcucgguaaguagggaacuucagagaacugccagccucauugaguaggggacuuugcaagggaugugaccugauggccaaaauauaguuuucccuagagaagaaauuggagccaccagguaucacauugccuuccaaauuaguacugucuucaggcagguucucacagacuccuggacagaaacaacuuccucucuagcccucucaaagcuuuccucaaguugauaaugagaagcaaucuaccccacaacauggcaguucauuuggggcauaguaacuuuuaaccagguuucagucuagguaaacaacauucuuauagcaaccccuaacaggguccuuucuggggcauuuuuggacugggccuguguuugaugcuucaguagaguguccuggcacuggaaugacagucaguguaucugaccucgucuauccuguagcucacagaguacaggccauggcaauugucauuuggccaaaagucagcaggaaagcagaggcuccuagcugcagagugccauucuguuguaguauaaucuucugcccccuaaggauaacugaaaaggccgaccuagagcucagaggugucaagugcuugccuacagacaaagcuaaauguauaucuagaauucuuuuugagagcuugccuggagcccugcaccuaugucuuggcugggcucuccuuuccuuacuucaaagcugagaacuacagcuucagcuucggaucaucccugcagaaaugugucagaccuguggcacucauaaaauguuacacuuacaccaaaaagaguaaaucaggguuggaccaagagcuauaaacucuauucugucaucccuggagcuccacuguuccaacuucauugacugcaacuuaaaauucaccagccuggugucagagguguaucuaauugcagaacagucuuuguagccgcacucuacuagacuauuagacaggugcucccuuggcagcaggacacaucuagagauaaagccuaagagacagaugugaccccucucagaaagagagauacccacuucucuaauacauacucagcuucaucugcauacuagcaugauucccaauguggauuagaauaggcaaaacacaggcaaggcaaggagaacacacuuguaguagcaagugugggucuaaguuguuggaauuugaguuguuucauguaauuuuuuuucuuuugguugguuggauuuugguuugguuugguuugguuugguuugguguauauuuugagacagagucucacuuuguauccuuggcuggcuuggaacuaugaagaccaagcugaccucaaacucaaagaucuaugccuaugucugccucccuggagacuaagauaaaaaauaugugccaccauuucugggaguuugaauuguuuguuuuauuuuauuuuuuaagauaggguuucucuguauaacccugcuguccuggaacucgcucuguagaccaggcuagcuucaaacagaggucugccugccucugccuccugaguguaaagauuaaaggcgugaaccaacaccuaauuuuuagucugucucacaauuggccaaugcuacuugagcucucugcaccucaguuuucuuuucuguaaaaggaaggcaauauuuguucuucauuguaauagggguuauaggagaccaucuauguaaauuaguacuaagguaacuauugaaaccuuugcgucacuguaaucaacaucaccuucaaaugagaaaagguacagagaagucaaauaaagcugcuuugaugaggagaccuuuccauagugcccugaagugaaccugagucaaguggacaugauggaagaccaucccgaguaauaacagagguccugagacagguucauguuugggguguuugagauaggggaauggaguacugaugaugggaagggaacagaauuaggacucgggcaaagaugaaaguggaguaaaaugucugacagagcucucucugaaggcuccauagcagaguucagcuucacugugagaaguggggagcuggcuuugggaagauaugacaaggucugacuugggcuaguuugcagagacuagacugccuaggcccagagagggagcuaaagauucagugugcaucugccugcugacagugaugaugguauagaggcaaguuugguacaagugacaagggaaagaugguuuugugguggcaaagccguagaggaggcagccuggcaccagggaaguggaacuucaucacaggaaugguggaaugucuauggacacaugagcauucacccugguaucccacuuagguggauggaauauaagguauuaucacaguuguaggaggggccggcauugugcaaaggaauggggcacaagacaugcagauagaguugcucacuugagaacacgccaaguguacucuggcaugcauccuagcuuuaaucuggacaggucuccucagcagugccaucuuuuugcuuuguuuuuuaagacgagauagauucccuccaacccacuguuagugauuauuauucccauaaaguauuuuccugugucuugcuggcagcguucuuauuaaccucuuugugacaugcgugcaguagcagguuuuguuaguacaaaacagcaagaacgaguugcccuuuuucucccacguaguuggguuggcuuauauuuacacuuagaccauggcacuugccaggagcuuaguucaggguugaguguggccaaaaggggaagcaaagugugcugaugcucucucugccuuucuccuguaggaccucaccaucccugagucuagcacuguaaaggggaugauggcuggaccgauggcugcauuuaaauggcagccaacagcgaccgagguaaagaacuuuccugcucguaggacuguccacaaugucagaacaagagcauagcagauuuucuggcuaugcugugugagccucuuucccuuuucucccuuuucugguuuuugguuuuguuuuauuggaacaaacuacggaagucuggagguuaaaaaaaacuccauguuuaggucugagguuccagguagucugccuguuuagcaucauaugugggauuauagacccgcuaucauucucacuguuuaggguaggauugcuuuuguguugacuguaaacaccuugucuuccauaaaugcucuguuguuccccccaccccaccccaagggggaggugauuuuuuuuuuuuuccccccuggggaggguuuaaaaaagagguuauuuugucuugugacaggguaauccaugcuggccucaaacugaagauccuucugccucagauacccaagugcugggauugcagacauguagcuaccagugcagauguugaguagcuuggggauuggaggagacaucauacuagcuucacugugccugcaccuggugcuaggcagaguuaugaacagcuguggagaucuauagucauagugacuauaaucagaauuggccccagaaagccaagaccuacaaggguuuggccucacacccaaggagaucaguacucugaagguagaagaguccuagaauugcugugguuuauauugccaggccaacuauaugccuggugaaugcuuaguacuaaaaugcaggagagcuuugugauauuaguccacacaguuacuagagugauugaucucaaccugcagaaacaucugucuuuuuguacuugagccuauuuuucccuuagcuaguauggcagugguuuaugaaagaccagaacuaagcuggugacauaggcguguaguccuagcaaaggagcaccuccuucuaguaggagggucacaggguaauagccugccuggugaccaaguaaguugaaggccagcuguguaacuuagauauuaucucagaauaaaauguaaaaaaagacaaaguucaaaaagcaaaggugggggcuggagagauggcucagugguuuagagcaccaacugcucuuccagagguccugaguucaauucccagcaaccaugugguggcucacaaccaucuguaaugggauccaaugcacuuuucuggugucugaaagaagcaaaggugggcggcucucuuugugcucaaggccaaccagaccuauaaagugaaagcgucucuuuuuaaaaaacuggaaagaaggcuuggaggaggagcucagugguagaacacuuaccuaccaugggcaaggcccuaaauucugucccuaguuccagaaauugaaaaaauaagaaaaaaagacgaaggaagaggcaggcagagaucugaguuugaggccagccuguucuacagagugaaguuuuaggacugccagaacuacacaaaaacccuguuucaggaaaaagaaaaaaaaaagaaaaaaaaaaaagacuuaguucagaaauagaaguuuccagacagcugugaaggagacuuaguuggagaagucaugcagcaagagggagucccucuucuaggcaagaggaagggacuaauaguggacagcucauuugaugucuuugucuuucaauuucagccagucaaagaugcagauccucauuuucaucauuuucuguugagccaaacagagaaggugagugcucacuugaggcaaacguguuuauguugccauggcaaccagcugagugacagugugggcccaugaggaaaucaggugccagugagauuaagaauaaacaaaaccuuuagaacucagcccuugugcugcuaagcuaucaucacugcccuucagagucuagggugggaggagcuaggcauacagccuguccaugcccgggagcuugcccaugugccuggugccacauccuguggcccuguggucagcauggccucucaacccuguauugcagcaggaagcuuuacucauguuugugaggccagagguugggccaaacuuugcaaagaucccauugcaguggguggcuuugaaagugggcagauuucauuuccagcccggcucuucugaccaacucccaaaacgaggcauauaaguugacaccucugaugcucagaaucagagaccuucgaagaacuauguggaguguugagguaaugaguguuuacucugaauuugauaaaauuauacgacaaagaaauauucuguguuaccaucucacuuuaggccuaaccauuuugggaaauuacuauguagaacucuuacacuuaauaaauggucuuuuuuuucccccuucccucuuuauuagccagcugucuguuaccaggcaaucacaaagaaguugaaaauaugugaagagguauguaggcugccugccuuguuguaguuuuuauuuccccuguggucucaucaugggcaaauugcugaacaguuauuuguguuuccuaucccuaggaaacugguuccaccuccauccaggcagcagacagcacagcugugaauggcagcauuacacccacagacaaaaaguaagaccuuggaucagcggccuccuggaggcucuggauucuaugagcacuagggagguggcaccaagaaagcccugagggcucugucuaagccacugauaacuaauuugggaacaguuucacuucucaaagguggaaguugccaucuccccccagggucuaucccuugggacuaggcuaaggacuuggcuccauaauugucaguaagucugagcaacuguuucagaaguucucugagccccauaaaaaugaugucuuuuuaagcacuaccucaagccugagauaguccuucucaguugauagaaggugugggcuuagaauucauguccuuguaaguagcacaacugccuuugcugacacugcuagucugggaccauucuuggaaauguagcucaguagacccugugaugggaacuucaagauuagaaaguuuuuggaguaaaacccuuuguuuugcuuuaccugucucugucugucuguauguaugucucucucucucucucucaucaccuccuagccuuucccauguaccugccgucaaccucccaccuugccuagacuaugguccccaaaccuuccacacacuuccuugccuuugcugcuucauugcgagccuguugagucugcagucacuucgugaaaagggugucuauaagagacuaucuugugaacaauauaacaaguauaaauucuaguuuguaccuuccauacaguugucucacagacuaaacucagugugucuuuugacaguucaaacuguugaaaucccuaguuacacaaguucuucuugaacuacccucugcaguaugcagaagauaggagcuaaucaaaggggagcuagaacccagagaugguagcguacaccugugaucccagcgcuugaggcaccaggauagagaagguuuaggaguuuuaggcuaacaugggcugcuuagcacaaccacgucucaaacaaagggugaaggccagacauagaagguagauaucccuuaguaagcauuguauuuguuuuacaaacaagaccagcacagggcuaaggacuugaguccucauauucuuacccaagaucuugacugccucucaaagcaacugacucuuaacaugaguuugaaguagccaugaagcaacugauccacauuaauccacgcugacacagagacuauugaacugucacuugucaugauggaaauccagauacuucauucauagaucuauuggguucuccaaaacacaaaaggaaagaauauuucccugucuugguagacauuccuagaggaaacuguacuacacaaaagagcuauaaauggcagaagucuaggcauggaaccuaguggucaaagaacccuguuuuguugaggaaggugguggcuuugguucagauguuguaugugcucaaacagagaguguugaguccuggguaucccuguaaguguaagccuccaaauaaaggaguaguuucucaagggugccugcagguuggauucccaaaaaccaaagggaagaaccaaagagacugcacagagucuucaugggaauucugcagagagcugagagacaacccaaauagaaaacaaaaaaagguggaauuucugauagaaaaaagagauaaagauauguaagaaccaauuggguggaaugcuucacucugguccucacacucagaagccugacacaggaacauugcuguuaaguugaggucacugauuacauagcuggccagacugagcuacaaggugaggcuguaucucaguucuuaaaacaaggcccagaaagauugaguuugaagucaaucuucaguaaagcacauaagugaggaucuaaauucaguucccaguucccacaugaaacagcuaggcauggugcugcagaucugauaucagugcagggacagacagguagaucucugggacucacuggccaaccagcuucaccugcuuugcaaguuucaggccagugagaaccuugucuccaaaaaaagggugguaauaucugaagaauaacauucaaaguuaucuuuugaccuauacauauucauaauguacaagaacuagaaaagagacuuuuagacaagauguagaucucuguacgagugcauaaagauaacaggaguagcaagcagccccacaaaguucuccaguuugaggaaggaguagguagagaaaguuugagguaggcaaaauuugcuauaugcaugucagcugcagagaaaggaaggcguugggaacggugcuuucggggauguagauagguagguugagugugagaaccugggagaacagaugucaggaaaggguggaacauacgaguccuagcauucauauuguggagguugccuggcucucagcucuuuggcucugugacuuaugcauuuuggcaugaguugggguggucugaaagccuggugcacaggguugcugaucaagaagccauucaagagcuguagcucagaugcuuuuaucagagcagcaaggggaggccucacaauuggaagacuugccaugagccaugaagucaugcuuugaugguuaauggccauaugcauuuagggacccuuacugaccgucuaggaaaggaagagguacaguccugggccaaggaguaugacuccgugguugaccauugaccuaacaugaaacaccccuggguuugaugccaacaccauuaaaaaaauugucauuggugcugcaggaugccuuuaccuggaccaaucaaccucucucuuucaggauaggauuuuugggccuuggcuuaaugggaaguggcaucgucuccaacuugcuaaaaaugggucacacagugacugucuggaaccggacugcagagaaaguaaguaucaagggugagguuuaucaggccuuggaaaguggaguaacugaagguauuagacaucugugucucuacucgacauucugcacccaguaaaacaagagcugagcuuuguccaggcagaaagauauguaggauguuguuauaaaguuguaacuauuuaaaacuacucaaggucuagccagacaugaugacacauaccuauaauuccagcacuuaggagguugaggcaugaggagugcugugcauucuaggccagccuagguuauauaggaagucuaggccauagugagaccauuucucaggaguacaaacaaaccugccuugguggcacauguacaucuuuaaucccaauacuuagaagacagaggcagguguaccucaacgaguuuaaggccagccuggucugcaaaacaaguuauaggacagccaggacuauguagagagacuguguuuuauuaagaaacaaaacaaaacaaaaagcaugguucagcaauugaagaguggacugcuuuuccagaggucuacaguucaguuuccagcauauacaucagguggcucauaacuaccuguaacuccaacagauccaguuuccucuucuggcuucuggguaccugugcucuuguguccauacacacauauacacauacauuuuaaaaaaaaaaaaaaaaaaaaaaaaaacuuuuuuuuuuuuuaaaaaaauacaaauacaaauaauaguaccaaacagaaauaaccauuuuuauaaaaugaaggaaaucccauuacauggaacauguaaugcagacccagcuucguccuuguaaccaccauacuuuuaucugugauguaguccauaaugagcaagaugaacagcaaggcauucugcaguuagaaacugcuacagggccagggcuauacagagaaacccugucucaaaaauaaaaaaagagagagagagagaaacugcuacaggcaaugagaguauuguucuuacauggagugaaggagcagagacuagcaaaguucucccucuuaagauauaugcuaugcuugugaaugauaacugcggggcuuaaguuagagcugaucacuaacggagacacuggcgguaaaugacgacaauauuaacaaaaauaucuuaggugcuggguguggugguguaugccguugaucccagcagaggccaaaagagaaaaaaaaucucuagaguuuauggcaggccugccuauauacagugcaaaucccaggcuaguuaggguuacauagcaagacccugucccaaaacaacacagaacaaaauauuuuagggucuggaguauagcucagugcuagagcaaggcuugguucucuuucucagaaaacuccacucccaaauuugauuucugcugaaucaggugcuuuucaagaucacaaaaaugauuggggaucccaucggcaguaggcucaaaggccgugcacuccuguuaggaaccgagguuaagcacuguagaugcacugcagucuggauggccccaucauucuccucaggacugcagucuggauggagcaggugagggcagacagggcaucugggcaugugagaaaauuuuccuuugauggacgcgccucuaccugccuuuuuucuugaugagaaaacauagacaagauagcaaagcauccaagaauugagucaggcaggcccaacuucaagucacaggugugcuguucaccuucuuccuugguaagacauucugcagggugacugcaccuacuucauagaggccagaaaccaauaguacucagcucuaaaguacccagcaccaggcaagagacuucugugaaaaagccauuuaauccucugguaaucgccuuagaauuucuuuuaaggcggugauaaaaaugaucuuuuggcuggacauaauaaugcuugcuuucggucccagcacuugggaggcagaggcaaggagaugucugaguucauuggaggccagguuggucuacauagcaaguuauaagccaaccagggcuaaugagguucguucucucucucucucucucucucucucucucucucucucucucaugaggugcgcucuugcgcucacacacacacacacacacacacauuaaaaauaaauaaguaagaaggacuggggagauaguacgguagguaaagguacuugccaccaagucuaaccauccggguuugaucaccaggacccauauuguggaaauggggacagaacuuccccucugcaauuuguccucuaaccucugacccacauauucacauacacacaucacucacucaguaaauaauugcaaaagcaagaaaauguuuucgaauaguccucugaccugauacaguguagacucagcugcucaggaggcugagguaagagggucucuugaggccagacugacuuguaugguagauacagugacacucugucaaaaugacaacaaaguaaaaugcucuacuggugcuucugaaacaauaaagaacauggauugaguucucaggaaagagagaguaaaauggaauuuugauggcucauggcaugagacaaagccagccugggcuaccuugcaaguuaaaggcuaacugagcuacagaauuagacauugucaaaaaaaagaaaauguuuuugagggugccugguaggcuagagaaacaacuccguaguuaaauagugucaacgaccaggguucaguucucagcacucugauggagacucagccauuauaccucuaguucaagggaccugacgugcucuucuguccuuugaggguaccagguacagauacgguggacauauguauauucaggcaaacauucauauccauaaaauauauaaauguuuaaagggcaggaggcaagugguucuucuguugcugcucuuuguagcaaauguacuaaguggagcucuguucucucuaacauagaauugagguugggaauauggcucgucugacuaacuagcuugcugugcacugagguucuaaguucaaauccccugauagccacuugaaagcuggacauuuacaauuuuuuuuuuuuuaauuaaaguugaggccaguuuaggaagacagucgauguuugucucuggcauccucauacauguacucaagaggccacacauguguguauaaacaugaauauacacaaauaauuuuuaaaucuuuuuaaaaaaaaaauaaaaagauuagucacacagugagaacucucuuauuuagccuagacacaaaaccuaaaacuucauuccaagauggcugccauagaacucuaagcuccagaaguugacuagacaacuccaauaaagauggcaauaaagggggaauagcaaagacugaucagagaaauaucagagaaggaaauuugucaggaccaucuguaagcagucaaacuucacuaaagaaaaagguaaauauagggcuggagagauggcucaguaguuaagagcacuagguacucuucccgaguuugauucccagugcccaugugguggcucacaaccuucuguaaugggaucuaacuccuucuucuggugugcacaaagacaaacuacucauacguaaaauacaugaauaaauaacuuuuuuaaaacauuucuuauuuuguuaaauuuuguuuuuaagacagggucucacuauauagcccuggcuuugccuauagcucacacuauaggcuguccuugaacucacaaggauucaccuucgaccucccaagugcuagguaggauuaaagguaugcaguacuacaacuggccuuaagguuuuauuuuuauuucauauuuuauacauaugaauguuuugcccaaauguguaucuguauucugugugugugccugaugcccauggaggucagaagaggguguuggauccucccauaugagugcugggaauaaaaccccaagucuuuuggaaaaacaacaaguguucuuaaccaaugagccgucuccccagcucuagauccauaguuauuggauaauaacacucccaaaacaagaaauggacaguauugaauguccgccaaucucagaacccacauagaagggucugcaguauuauuccuguuucaugugugcacacucaugcacaugcacacaguaaaguuaauacaauuuggaaagaagcaaaccuuuuuagggguccuggagagauggcucaguuguuagggcacuguuuggucuugcagagggucugguuuuaguucuggaacccacacuguagcuuaccagugccaggaacuccaacacauucugggcaccaagggcaccagacacguaugcauugaaaauacucauaaaaaguuaaaaaaaaaaaaaaaaaacccuggcugucuuggaaaccacucuguagaccaggguagucacaaauucacagagcucuaccugccuuugccucccaaguucuaggauuaaagugauccaacaccaccaccaaaggguuguuuuguuuuguuuuguuuuuuuaaagccuacucacaaaaauaguaugcucaaauuauucuaauaaucucuuauaauaugggagggagggaguacacuaacaccagugagcuguuuuauaggguauucuggauaauuaauuucagaaaaaacaaaaacaaaaaaacauaaguuaggacuuugagaccugcguaagucuuaaccuggcuauaggauuuggaaccagucaagagaaagggaccacacagccccacccugcucccucugcaugugcuccaccuugcucugugccaguagcucaggucacuagacugguuugccacaguuuuacuaguacagaggagcuggacauagccacuguucauauccuaauuuucaaaugccagccuucagcagacacuggccuugugugaaguaucauaucauucuagcuagucaccauguucaucuucagaaacaggacagucuauauaaacuucucuguccucuuaagcucaaaggguugguucuccagcucuagugucccagggcuucagccucagccuccugccuugggaaaucagacaggggcauacacaucucuggccuguccggcauguuuguugugcauugcaugcagcucacauuaggaucugugacuuuugcagugugauuuguucauccaggagggggcccgccuaggaagaacccccgcugaagucguuucaacuugugacaucacuuuugccugugugucggauccaaaggcagccaaggacguaaggaucccccuucccucugcaucucaggucguagccaagagagcuggcuggccuccuccccuucuccccugcacacugagugagugucugcauguggggggauaucccaucugugggccaacuccuuuugggaaacaugucaaaguugaauacagacuuuaauucaaagaaagaacuucuggguucuugaagucugcuuaaacauuuuuaugaacuggcuccaggaauucuacugagcuggacuguuucguagcugagugugccuuucuuuuguccaaaggccaacuccuauuuuagcuguugcuggauuugcauguguuagaaauuuuaguagugauccuauuaaacugugagugaucuacuccaaagaagucuccaaaauaaguagugaaguucugucuuuugaaccuugggaagagaauacaaggauuaaagggaacauucuggaaugacuuuuugguugguuugguuugcuuuuuguuuuuugguugguugguuugggguuugguuuguuuuuuugggauuuuuuguuuuguuuuguuuuggguugguugguugguuaguugguuaguugauugguuuuugacuacaggguuucucuguguagcccuggcugcccgggaacuuagucuguagaccaggcuggccagagauccgccugacucuugagugccgugcuuaaaggcaugcgccaccacagccuauuaugaaaucucauauguagcccucauuggccuggaacgugcuauguaaguagaccagacuagccuggaacucacagagaucccucugccugaaauuacuuuucucucucauacauauuuaguagcucuuucauuaucauuuuuaauaguuaacuucugaucaggaagugaacuccaaaaaaccagcagauuguguucugcagggaauccugagcacuuaacugcaagucuggacuauugcuucuucauuguguccccacagcuggugcugggccccagcggugugcugcaaggaauccgccccgggaagugcuauguggacaugucaacgguggaugcggauacagucaccgagcuggcccagguagcagccuuauguaggcuggcucuggaucaucuuuucagugggagcccaagacccaggcugaccacacccaaguacgggcaguuugguuacacuagagcggacgucgggagccuugggacuagucucuugacugucccccuucagaaccucagcugguuggaacggccauggaaggucacugcaggcuaguagacaggaggucccaugcugucagcccuccuacagugagaagccuccagacugccaguguggccuuuuuggcuuaaacagcugucuacaguugagucuagcauaguguccucuucacagucuuaugggcccacuuguauucugaggguggcaggguccagagggcaggaguuuagcccaggcaucuguauggcuguuugccccuuggucuuugaaaaucagaacacuggaaaacaagauauacacaaaccaccucccuuacuuucugugacucaacgucuguauaaggauagccuguccaauccacuacacuaguaggcuuugguacauguguuggcuuugggacuuuuuuuugguuuuucaagacaggguuucucuauguagcccuggcuguccuggaacucacuuuguagaccaggcuggccucgaacucagaaagaggauaccugccuccgccucccaagugcuagggauuaaaggcgugcgccaccaugcccagcucagcuuuggacuuuugauagcaacaugcuaacauauucuaugaugagacaccaugacccccaaaaauguuccuuccuccauccuuggagaagcaagaccaaucagaagcugucuuuccuuacaggugauuguauccagagggggacgcuuucuggaagcaccagucucagggaaucagcaacuguccaaugaugggauguuggugaucuuagcagccggagacaggggcuuguaugaggacugcagcagcugcuuccaggcaaugggaaagaccuccuucuuuuuagguaauauaccuaccuauaccuaucuggccauguugggacuaaaggcuugcagguggggccgcuacauuggugacagugucagucccacauggccucaccaggcuuccuaaaagaaggcuucuuuugccagacacaauuaguaccuggaaggaaaaagagccaguccugucuaggacagaugaaagagguuuuccaggugcauggguaaaggcagguagagaugaccugucuguagaauccuugggacaugaccuuugcccugagcaggugaaguuggcaaugcagccaagaugaugcugauugugaacaugguccaagggagcuucauggccaccauugcugaggggcucacgcuggcccaagugacaggccaaucacagcagacacucuuggacauccuuaaucagggacaauuggccagcaucuuucuggaccagaagugccaaaguaagucaccuuugacuauucuugcaauuuuauuuucauuagagcugagcagcugggucagaccauccaggaaagaguccuuucaugauucauuguuuaaagagcccccuuuccagucauuccuugccccguuccaaagaggcccagagacacggugaaaaugguauuugaggccccagaguaggcccugagucuuuuggacaugggggaggacagggccgugcccuuaggaaaugguggaggugagccugauacucggcgggcaauuuucauguagaucuuuuaaacuucuaaugaauggcuuucccuucucagauauccuacaaggaaacuuuaaaccugacuucuaccugaaauacauucagaaggaucuccgccuggccauugcauugggugaugcagucaaccaccccacucccauggcagcugcagccaaugagguaacuucacagcaagugguccaggcccucgauccuugaauuucauuguuauuucugucuugcuuucuuagcuuucuuuucuucccacuuuauugagaacagggucuugccgacccuucugaucaguccugggcacugugguuacagaugugauucuuaccuuuucauacuuaaucuuacuacauugagccaaggaaggaaggagugucauguauagaauugcacugguucugucuuuagguuaggaucugaauucuuuuucucuaucuagucucugguagaggaguccuacacgcaacaguucuagaccuacuuauaaccggagcaugagagcucauuuucuucucaaccacaguaaauuuuuauuauuauuuucuuugugauuucuucugugaucuuuggauuacuugaaagucuuucuagccaaguauugucuuauauaacuguagcccuagcuaacuaaggcugaaguagaagguucaaggccagccuacacaacuuagugagagucugucucaaagauuaaaaaggagggagauaacauuucuugguagaguacuuaccuggcauguacaagacccugggguucaauuccuaauugccucccccccccccccaaauugaaaacaggauguuugugcaauggauaauugguguuguuuaguuaaugaacaaaugauucgcaucauaugauuccagcuguggcuggaaucucuguuagucuccucuaauuccgccugcccuucauuuccuuagcucaccugucucggaucucauuagguagcccagacuguccucaaguccacaacccuccugccuuaaucuccauagugcugcuaguauuccagcauuaccugccuguugugucauguuuacacagccuauggauggggcuugcauuuuuauccaucuucaguaucuacuuaccaauuacagugcuugcuccagucacaucauuucacauaccauaauauguuauaccacaugggcacauuagaaaaguuucuuuuggaaaaggagucuuucuuguccuggcaccuucuucaugccugcacucacauaugucucucccaucagucuccuaaguagcuggaacuuuuuuuuuuaagauuuauuuuuacuauuuuauauauauaugaguacacuguagcugucuucagacagacuagaagagagcauuggaucccauuacagaugguuaugagccaccaugugguugcugggaguugaacucaggaccucuggaagaguugucagugcucuuaaccacugagccaucucuccagcccaguagcuagaauuuuaauuuccacuuaauuucuucucuuuuaaaaucacuuuuuaggacuggagagaugggucaucgguuccugccugugaugguguucuugguguucagucuagaaagcugcucagccuuccuugagcauuaacagauaugacagaaaugugcguguucuccuuuacaguggcccugcuuagacugcucagcugcgcaucaccucagcaaaacugggugcccuguugccuuucacacgauggcuuugauucuuuucaagcuuucaugcaguccccagagucuuggauggcuucuauugcuagacccugcucuggguucuggaacaugcugggauacaagcagcgccuccgaucuucauucacaucacuuacauuuuaauggaaacacaaaauaagcuugacgcuuuuaaacaaguaaagacuguaaagaguauaauaaauacaguuuggggaggcugagcuggcagaaaaucucagcaguuaaaagugugcacagacacuggcagaacacccgcacacauaacaaucaauggcaccauuaaucccaaaccucaggaggcaggugcagucugaccggugaguuagaggcaagccuagucuacauaaugagccagccagcgcuacagagugagacccugucuuuaaaacaauaguaauaaauaagccaaauguaauauagugaauuccaggagagcuggggcuacauagugggaagauaaaaggaagaacaaacaaacaugagauccuuguaggcuguaaggaaagcccugucucaacaauaaaacccaaacccuggggcugauggaucaggacuuaagagaaccagcugcuuuuccagagggccgggguucaaauuccagcacccauauggcagaucauauacaucuguaacucuaguuccaggagauccaaaccccucugagagcaccaggcacccacauagugcacagacauacaugcaggcaaacagacacaugaaauaauaaaauaaauuuuauaacugaauaaaacaaaaguaauaaaauaauguauguaggcucuaagguaauaaaacagagauagcugguauaucaaugggcacagcugcuguguugaugagcacaaaggagccuuuggaaagguugguugggaggugucagccauuuuuuaagaaagggcacagugauccugaguauaauacaacauccucggaagacugcauugagggcugucaccuugacuccuaacagcacugagcacuucacaugucugcguauaaauagagccaugaggguugugacuguuccuucuucagguggggcuguggcagaagcccacaggcuaggccaucugcuccacaucaagccaguauucauacccacauaucucaagcucuagguccugccugcuaagcaacaggcuagaaccaucuggaaauggcuccaggaaucagggcucuaccacauaguagcucuguagcuagagaccaaccucuaccucuuuuauuuuuuuuuuucagguauacaaaagagccaaggcacuggaccagucugacaaugauaugucugccguguaccgagccuacauacacuaagccuugccugcccaucuacccucccaucuucccucugaccuccccucccaguguggggucaggguucugggacuagcucuggaccagucaccugucuccauuuccuuuuauacagacuuugaaacuugcaucagcacaguacacagcagcacccugucucccugaggcccuggccagggauaagaggaucuaucucuccugguggcugugaagaagcucuugagcugggccuugauugacccuggagcaggagguuguggauucucucuguuccucuguguucucugucucugucacacacacacccaggauagaagcuacccagaaacugcugccuggcuguucuugcaagcuuagcccccuucuggucaagagacuggagggacuagaauugacagggagcacuggaagcuuucaacuuccccaggacagagacuggcccccacugggccccugaaaggagaggccccucagccaucaugaaccaacagauucccugaggaggcucuguggaucaccagcugaggaggauuuuccuguagacacuaccauuacaccgcagcucccagagugucucugugaacugaagagagaccagcauagccacauagaccccucuucagggggagcagagucuacagucuucuguccugagccuguuccucccaggagguuucauuuggauuugcauuccagcccaagggaaggggccguaagggccuugggagcagugaaguguaugggcggcuccuuccuguuuccauuacgccaggcucuugagcugggcuaccuguucagccugcucuacacagguccccugcaugucccucuuccccuuuuccuuccauggagauauuucugucccauccucuuuugacccagccccagccugaucaacaccaauaauaagcauuuccuagaugagcauuuccuaggcugggcuuuugaugaggaaccuuacuucugccagugguuccaaguucuggguuuuuugggacuugaagcauuucuccuugaagaggggaccagagaggcuuagaaugucacacgagaggaaucacccgaggaagccuuccuccucaugaguuuggauuuucaaagccacgauuuaacuuuuccaucugggauaaggaucucaggacaugggcacggggcaggggaugcuuguggaguucagugcaauuguccauucacugggaugcugaacaguuucugucuggacacagccugucuugguccugggggcuggggguggggaagaugcuguaagaaaaccgguuagucaauguugucuuaauauuguugacaauucuguaaaguuccuuuuuaugacuauuucuguuuaagcuauuucaccuuucauuuugaaacccuuuccuuuuauggagaaaaugugacacuguggaaaugcuuguaagaaagccccuacucccgcuuuuccuugaaaugacagaucuaggugauuacgguugugaauuuuuauuuucacuuuguuuuuaaugaacauuugucuuucagaauaggauugugugauaauguuuaaauggcaaaaaaacaaaacaugauuuugugcaauuaacaaagcuacugcaagaaaaaaaaauaaaacauuucuugguaccauaac

SEQ ID NO: 8078 - RNA, 36276 nt, Mus musculus
cuugagcgccgcgcucucagcgcgucgaagcccagagacuccaagcucccgccuccccccuccccuccggcucgugacaacgaagcauccgcgguccaaagcagcggcggcggaggcggcgcggccggacuagcgcgaaagggagccgacugugcugcccgcucgcuuccgggacucuagacucauuuccagucuuucccgcugcuuccguuacggcuguuaggcaggcgcgggccccgggccguugccgagccugaggucccgggcggauagguguuggaguccgguugcugcccugacugacccuggcgcggccuggaagccagucucggucccagcccggggcagaagaggccccgguugcccgcgagcccgcgcucggggcgggagcuccagacugcugaggagcgcccagcucgacagucggcuuccggagcggcguccccgccaagcguccucggcgucgcccgacuuguuuucuuggacguggacuuggcauaucucggcuccccccgcuggcugacaagagaaagcggcaguuugucgagaggcuuccuucccgcgggcuggggagccggccaugggccgcggcgcgggcccuccgcgcgcccgccugcagcgcucgggagcgggccgcugagccgcgccgcaacccgagggucccgggccggcaugaggaccaccacggggggacgucuacggcccgcgucggcucuggggacaacggugagcgccgcggucugguccagccucccgcguuagccuucguaaguagugugacacuuugcaagaaguuuugacagcuggaagacaggugacaguaaugggaacugguaccugccgaggggcagggcggcugcccuaaguuccguagaccgaguugaagcucgacuuugagcaagaaaagucucacacccaagaaaaggcggcaggagucugugucaggguggacuuaacuuacagcuguacuuucugaagucaacgccugcucggaaggugacggguucacgccccuuuccccaaagcaguguccuuguagaggcuuugguugucaauugcucugagagauggugugguggagaagcugggugguugaccccagcuuguuuuuucuuuggaagaaguaccacauuuuucaaggacugucauuuacauuguguguuaauuaaacacgaacugaccauuuaaaguguauuuaagauuucauaaaauuugacaaauguucuuaauuuagaaauuagaguuuuccaggaauuuaagaauauuguaaugacuugucuuuaaauguaaaucuuuacaacuaaauuuagaaacaaucccaucaaagucaggaauagaacaaaggauacauugucuaauguccuguaauucuaguuaaugaaauaagacaggagccgaguagugguggcacaugcacucaggaggcagaggaagguggauuucugaguucgaggccagccuggucuacagagugagguuccaggacagccagggcuacacagaggaacccugucucaagcaaacaaacaaacaaaagaaugaaagaagacaggaaacaaaaauaaauauaaaauaaccugucauuuuuguaggacuuugccuuucaaaauaaaaagggaaagccauuaaauagggaaagaaauuaaugaaaaaauuagcauacaaguuuuucuguuuuuuuuuugguagucaguucaaaaguaaauuaguuaaaaagaauguauuuaugauaacaaaaacauaaaacagucccuaggaauaccuggaaauaggcuuuugcauaauauguuuuuuguuuuguuuuguuuuguuuuguuuuucaagacuuucuguguguagcccuggcugucuuggagcuccuuguggaucaggcuggguuccaucuuagugcugggacuaaagaucuguccaccaccacaaacccauaaucccauaauuugcuuuuuaaagagaagaauuuuuuccuguguggcauacuaauauucaagucauucggaguauuuaaacccuacuuugugguuuguuuuuuuuuuccuuuuuguauuuuaguuggagauaagcucucaugcaauccaagccuccuucuccuuguccaagagugacuuuaaacuuaggauccuccugccucuuccuucacagugcuucuauuacagcuauauauuaccauucucauuuuaauuuaaucccagugugugauuuaauugaaucagggccuccagugugcaaggaaagcacuuugcugagugacauccccagcucaaucuuaguguuuuuguuuuuguuuuuuaagauuuuauuuauuuuacguauaugaguacacuguagcugucuucagacacaccagaagagggcauuggaucccauuacagaugguugugagcuaccaugugauugcugggaauugaacucaggacuucaggaagaagagucagugcucuuaaccacugagccaucucuccaguccccauucuuugcuauuuuuaaaacuuguaaguuuucauuaguguuuuauuuacaaauuuaagaauuuaugggacaaaaaauuaugugagggucuguaagauggcucaacagguaagggugucugccuccaagccugaagaccuauguucaaucucuggaacccacaugaugaaaugaaagaauuaacuccuauaaguuuucacacacacacauacacacacacucacccacacucacaugaaugcuugugaaaauaaaaauuacuuaaacuugaauaaaacuuagagacagcaccagguuaaacagguuaaauuuucuuaaacaaucaacucuuuuaaaucaaguuauuuaaauucucuaacauguuuuaaacuguaguuuuuuucuuaauucucagguacuucuuucuugacuuguuucauauuucuuuuguuugcuuguuuguuucuucuuccaagacaggguuguuugucuguguaucccuggcugcucuggaacucuguguagaccacgcuguccucgagcucauggagcgccacugccucugccucccgagugcugcaugcuguaccaucucccaacuacuucauguuucuaaagagguaaacuugcaaaccuuggaggaagcucuucccaaggucauaaacaacucauaaauuaguuguauaaguacaacuuacguucuuuuguggacuuuacaacuuauauuuucuuaagcauuuggaauuaaauaaguuuaacauggacuuuaacauauauuauuaucuuaaauguuucaaaugcccuaguccuuaaauaugaucauaaaacuucaccaaaaccugacuucuaagaguuaauaggugggacuagagagauagcucaguggguaagagcacugacugcucuucugaagguccugaguucaaaucccagcaaccacaugguggcucacaaccaucuuuagagcuacaguguacuaauauacauaaaauaaauagaucuuuuugaaaaaauuauuauuuaaaaaaugaguuaauaggugaacuuacuuuguccucuaguccuaucuccuuguuggcuaaggcuugcacagacuuuuguagcugacaagaauauuguuacugguuaugugguuuggaguuguguuuucuaaaaacaugggcugaaaugaagcuaccuuuaaaaaauuuugucuagacaaaacaacacuggaucugguugccaauuccuucguccaauugagugacuuacugauccauuucuuacagaaagacuguguuccucucuaagugggagccuguaugccuuuaauccucaguugagguguguuucacaaccagguggaucccagcacugcucccaggcccugaagcuuccuuuagguacuguguagagcauccaaguguguuuugauaaacucugcacugggagucuauuuuacuaguuaugucuuugcuguccaauuagaauggcuuuuuuuuuccuucaagacaggguuucucuauguaguccuagcuacaggaugccugccucugcccuccgagugcuggaaauaaaagugugugccaucacuguuucucuggaaugacuuuuuuuaaaacucauuuguauauuuuuaacucccuuauauggucuugcaucacuuuuuuaugauaauaacaaaaugaauggauauuaaauauaugcuaguauaucuacauauauguggaaauagucaaaucauucugaauucauauuugugaauuauuuuugcaaaguacagucauauuuuggaggggacuuggaaaaaugauucuaaaauugaucugaaaugggcuaaaauccaauuacuacuuuuaaaaagguaauaaagacaaacuuuuaauucaggauacuaaaaauaagaguuuugaagacaguucauuacugaauaaacaaucucucaaguacuugauuaauguaauacagcuuuuauacauggaccauacauaugaggucugcuuuguaauugguacugggaaaacucaaguuauagccuguucuugcagcauagagcccaguaaguucacuauggauuagauuuaaaagugaaaacucuuuaauagacugacugggggauuucuuccauaugaucuguuuaaaaagagcuuucuagacacaaaagaaauaagucacauacaacaaaccccaaguuuggacugcauuaauacauaggcuuuugacuugaauuaugugguaugagaugauuucuaaaauaggagaaauuuguauugaaaacuacuugcuuuuagcugggcgugguggcgcacgccuguaaucccagcacucgggaggcagaggcagguggauuucugaguucgaggccagccuggucuacaaagugaguuccaggacagccagggcuacacagagaaacccugucucgaaaaaccaaaagaaaaagaaaaaaaaaaaaaaaacccaaaaaacuacuugcuuaaaugguuuaaagcaauuauaauuuaucaguggauucuuuuugacaaugaaauuuuuaaaaaacugaauaacugacaaggaaaugccugcuauuguuauuuagaaaaugccuaccuuuguuauuuugguuugaccuggcccuucuuuucacuguuaacagaaaccaugaagugacaccuacuaagacuuguugguagccaugucggagccccacaggguccaguucaccucugucccagguucuuugaauccugcauuuuugaagaaguccaggaaagaggaaguuggaggaacagaacagcaucaagacugugagccagcugcagcagcuguucggauuacacucacucucuuugaaccagaucacaaacgguguccagaguucuucuacccagaguugguaaagaauauccgcgggaagguaaaaggccuucauccuggagacaagguacauucuuguugcuuugcagaucugacaugaagcuaccaguguucacauggaccuuuauaucagagaagugagugaggcuagagaggccugagcugccucaaguuuaucucacucacccagagcaagcacugggugagaaugauccuuguggcuuaugcuagaggaaaauauauagcauauucaagcuacuuugaauuauagcuaacuauauaaauuuaaaaagcaguaccuuuuuuugugcuaauauuuuuauaugacucacuagagaucauuguuuugaugguugcaguguugcaugcuuuccuauguccacucugaaggacaaacaggaagauacccauacucucaucguugcugucuugcauaguuucuuguuuuggauggguagaaaucugcuucugccugcuuguuugcuuucuuccuaugccaaaauuggcuuugugagcuucaagcuguuugaaaucaguuugguuucuuuaaaugauuuuuaacuuugaauuuuaauguuuucuuuuucuuuucuuuccuuuuuaaaauuuuaaaccuuuauuuauuauggagagagagagagagaacgagcgugcucaaguguguagcuugugggaguuagagcuuuucuuccaucguguaggagcuggggaauggcacuagggugucaggaugauagcaaacgccaagaaucucaugcugcccgagcuuaccucucaccaaccuugauguauuuuuuuuucuuggcauauuuguuuugcuuuucuaguauggaacuuucaaacaugcauauuuucaaaucuuugcauauagauuaccaaguaugggcaauaucuauuacccaucuucaauuguuacagcauuggccagucauuaacuuuuuaaagaagugugugugugugccaggugugguggcacacaccuuuaaucccagcacucgggaggcagaggcaggcagauuucgaggccagccuggaguucaaggccagccuggucuacaaagugaguuccaggacagccagggcuauacagagaagcccugucgcgcccgcucucgaccagcaagaacgacgcgaccaccaguccuucuaacagcaguuuauucaguccugauucuucuuguuuauaucccccgaacccugggccucucacuccuuuuauacucucucucauccacgcaccgcaggccacgcccccucgccagucacgaggcuucagcuaaucagggcagcaggggcaaaucuccaccaaauuggguucaccuguauccugguacaccugcgcagcacucaagacguuugugucuuauaugaggaagucaggugcaagucauaugacuuagcugcagucccuggcgccuuugggacugccgccacacccgcuccccacaaagcccugucucgaaaaaccaaaccaaaaaaaaaaaaaaguguguguguguguuuuuguauauuuuugagauaaugucuuucccauuuuguuuucuauugcugugauaaauguagaaaucuaaagcaaguugggaaggaggaaaggauuauuucagcuuacagccuacuacagucuaucaugaagggggaaguuaaggcaggaacagaugcaggagcuaugaaagaguguugcuuauuggcuugguucuuuucacuugcuuagcuaccuucuuguacaacccacgaccacuuguccaggggucucucuacccagagugggccauucccacaucaaucauaccaagaaaauauucccacagacuugccuaugggccagucugaagguugcauuuuuucuguugaggucccucuucuaaaaugacucuagcuugugucaaacugggaaacaagacaaaaccaaccaaccaaacaaaaaaaccaaguaacacacagucuuacuauguagcccaggcugaccuugaauuuaggaguccuguggcaggcuccuaaauacuggguuuacauauuuacaccacuauauccaacuaaaaaaaucuaaacaaauuuuucaguuguaucauacauacaauuuuaaaaaguacauaaugauaaaauuuguggauuuuucauaaacuuagcagagccaugcaaccugcacauggcucauaaaacaccacauuucuacuugccucaaauacuauccgccuaccucacagggaacugcugucaaucaagaccaguuuuguauuucuuugugcuuguauguacauagcaucauauauuaugaguaggagcuagaugaagaacauuugaagcagucacugucuauuaguauauugguaggcuugaaagagaagguaaguaggcccacacuuguggcauuuuggucucuaguggcuuuuaguagaaaaggaugagccagcaccuggguagaaugagguaguauugguaagucucuagcauagugucucagugccaaguaacucacccagccugauugauuuggggaauguauggaggaagcauggcuagcuagaaggacuucucaccuuucuugaauaaaaauguguaggguuauguuuuguuauauuugaggcagggucucauguaccauagacuggccucuuaauuaccauauagcaauaugcucuuaaauucuuaauccuccugccuccacccccucccgccucccagugcugagauuaagguauauaucaccaccugacuaaaauguguuuuguuuaucuuuuaaauuuuauuuuaugaguguuuuuucuacauguaugucuauucacuguauauguaccugguaccuguagaaacuaggugucagauccccuggaacuggacuuacagaugauggugagccaucgugugggugcuaggaauugagcucagguuuccugcaagaguaggcaacauucucaaguaccugagccaucacuccugcuccauccauuauuugcuuuuauguguacuagugguuugucuauaugugucugugccacauguguuaccuguagaagccagaagagggaguuggauccucuggaguuacagaggauuugagcugcuauaugggugcuaggaagggaacuccugguuuucuccaaaugcuuguaacugcugagcugucugucucuccagcccaaacuguguuuguugucuugauugacaaucuuaaaggcagaaugaaaucagugcaucuauagcaagggucaucauguguauaagugcaaguaaacaggaugaaaacaauaaaaucuggucacaauuccuacuauagauaguguccucauucugaagagaaagagauaguaggagucgguuaauguauugacuuaugggcucauacuaaauggauaaaacaauugaaauuagaacuccagugcucugacuuaccuuguuuuauuuuuggcagcuggggaaaagaaguuccuuauuacuuuuaauauuacagaaaaauguaugacauguacaagggagaaguuuggaucaaguuucaagggaaucacuccuuuucaguuuuacaaauucugaguggaucugucuuguguuaagaguacagucaugugugagguccuaggcaccuacucccaguauaaucugauauauuuggcuauuaauccauugaacacauauucuuuacaaugugaagugcugcugcacagggaggaccauauaaaagucagaaagacugucccugccucauaggaauuuacagucuuacagguauuuuuaaaaaauuucaggagcacagguagcagaaguuacaauauguugagguuuaagcaccagagguucuuggcugagcucaguaauggccagcacgcuguguuuggacagaacugagucuuugguucuggguaguaauugaaaagauguguuggcuuggcuuugaggaguuaaauuggguagugcucaaaaauggcuuguuuguguguuuguuugaguugggguuuucuguauaacaguaguggaccagacuggcuuugaacucacagagaucuccuugccucugccucccaagugcuaggacuaaaaguguaaccacugcccaucuagaaauggaauuucuaaagguuauuuuagccauuuaaguuguauguggugaucauuguagaaauagaagauacaaauaaacagcacauuuuuuuuuaaacccauguaggcuuggagagauggcuuaguaguuaagagcagagcucuuuuauaggacucagguuccauuucuggcacccauacuguggcuccauccauuuguaauucuaguuccaggggaucugauguacucuucugaccucucugggcacuaugcauauacauacugcacauauaaacauguaggcaaaacauauaaaaccacucauuuauuaucauaaauguuuguacuuuguaugcaccauaguauuccaguauguauacauacuauaaaucauguacaucucuuugaguggauggguuuauuagaguggaaaguagaauaaagaauuuuuuuucuuuuuuuguuugagguuggaaaucaagcaauacuauauaguauggacuggcuuucgacuuucuugugugugugcauugguguuuugauuccuuauauauuuggguaagagugucagaucuuggaguuacagacaguugugaacugccaugugggugccaggaauugaaccccuauuuucuggaagaacaaacguucagugcuguuaacuucugggccaucuccccagcccuagaggauuauucuuuugcuucuguuuuccaagugcugaaauaacaggaauguaccuucauacuuggcuuagagacauuuauuuugaagcaagcaucuauuuuucaguauuuuaugugcacucugaagucuuagcauauagauuauaaucacuauuaauauuaaaauuccuugcccaagaacauggaaaauuuacuugauuaaaaaaauguaggaguugggggcugaagagaugacucagugguuaagagacugacugcucuuccagagguccugaguucaaaucccagcaaccacaugguggcucacaaccaucuguacugggaucugauacccucuucuggugugucugaagacagcugcaguguacucuuauaaauaaaauaaauuaaaaaaaacacaugaguaaacuuauagaauaaaagcaaacuuuagaagauuacaugaaaguauuuagaaugauuauugagguuggcaaacaaaagagucaugacaguagacccuugaagguauguuuccaaggguaaggauucugugaaucaguguuugacuugagaagcacuaauaaauaaauaaauaaauaaauaaauaauauauuuuauguauuuugguuccucuuuccuuuucaugaaugcuugugcuugcuaagcaagcauucuaccaguaggcuaaguucuuaaacuccucaaaccauuuuucuaaagccagaaugguugucaaaaacuuguacuacauuuugugggauuuuaaacuuuuuucuuuaaauauguauuguuucaugaauucgaaugucaucuuugcaacaggagccuugcuggucuucucuguaucauuccaguuuuaauagguaugcugccaaaaagagcacagcuuuuaauuuaaaaaacuuuguuuauuuauuuaauguguguguuuauuuggcuugcguaugugucuauguaccacaugcauacaguauuaucaggccagaagaaggucuuagauuuccugcgacuggaguugggcauggcuaugagcuaccauguggaugcugggaauugaauccaaguccuuuaaagagaaguugguauucuuaugcucugagcuaucauuuuuaaccuuuuugaaccuugacuauucuagaagcaucuuggagccuauugaccuuucuuaaaauguuuuuuuuuuuuuuuuuuuuuuuagauuuauuuauucauuuguaugaguaacuauagcugucuucagacacaccagaagagggcauuggauuccauuucagaugguugugaaccaccaugugguugcugggaauugaacucagaccuccggaagagcagucagugcucuuaaccacugagccaucucaccagcccuugucagugcucuuaaccacugagccaucucucuagcgcccccuccccuccuuuuuuucuuucuuucuuuguuuuguuuuucgagacaggguuucuguauagccuuggcuguccuggaacuuacuuuguagaccaggcuggccucaaacucagaaauccgccuaccucugccucccgagugcugggauuaaaggcgugcaccaccacgcucagcuuccuuuuaucuuuuuuuuuuuuuuuuaagauuuauuuauuauuauacauaaguacacuguaugucagacaucccagaagaggccaucagaucucauuacgggugguugugagccaccauguggcugcucuguaacaaaauagguccucuaaggccuuauuuacgccuuuaacucacacacugccuuggccucucuaguagcuaggauuacaauaaauugauacacuuagugaaaaucuguuuuuuccacaguaaaaaaugguauuuuaucuugcuauuucugaauaauaguuuuuauuacauaguuuagaaguguuggguaaucauggaagguuauuuaaccaagacuauggcuuuuuguauguauguguuuuauuuuuugugaaaugaucucuuuccagaaaaaagaugucuuggauccuuucaaugaugaagaaaaagaaaggcauaagguggaggcccuugcacggaaauuugaagaaaaauauguaagauuucucuguugggcaagacaacagccucaucagugagaauagucuccaagcauuucaugaucauuuaguggauagucaaaagugaccuggaaauagauguaguauucagaggaaacagaaugcagcuauuaaaccaauguauuaagguacagaacucuuauguggcagggcagugugugaguuaaaggcguaaauaaggccuuagaggaccuauuuuguuacagagcagaagaaucuguuuuguucuucuuucuuaggccauuuaugcagauuaaaucugcucuauuucaaguuuuaggggcgggauuggacuauguaugugugugagagaaagaagagagacagagacagguugggggguaguauguguuuucauuacuuuacaacuuaaucacuagcccaaagcaacauuuaauuguacuuaccaaaaagcaugugacuccuuccuuuuaaauuucaggguggaaagaaacguaggaaagaccgaauacaggacuugauugauaugggguauggcuaugaugaaucggauucuuucaucgauaacucugaggcggugaguacuuaguggaaugauauuguaugauacugacaguggggaagugggguugugguaucucaguguguccucuuugcacaagcagcauugagcuuaagaggaagagaccuccuaaacccagaauuuuuuuuuuuauuugaaaaccucuuuccaaaacaucuaguagcuugcacauuagugauugaagagaggaggucuuagcaucgugucugaagagugacaggcaaucccaguugcaucucuuaaauugugcaccuuggaccauagaagcagaagugggagcugaugauauguuucccccuuuaguaugaugaacuuguuccugcuucuuugacuacaaaguauggaggauuuuacaucaacucaggaaccuugcaguuuagacaagcuucagaaucugaagaugacuucauuaaagaaaagaagaaaaaaucuccgaagguuaggauauucuuucuuuuggacuuuagaaauauauuuugaugugacucugugaaauuaguagguuacucuagaauauguagucucuuaggaugccucaggagauugguggacagguacaggaugugaacauggggaugcuggucaggccuuagucauuucauccaugucuaaagaugguccagcagggucauguuuccagauaagucuuagggagugcuaugaacccacuccuccugacuuuuccacuguggacuuggagaggacuuuaauucuggggcugucacccacugcauacuggucagccuuaguuugaguauauuucagggccugccuaccacuggccauuacuuaaaaugagcgaguucaccuacaaccaauucuagaacagccaccauggucuucacuuggauucuugcaggaaacacuguuguuggaauguuguggguucuugacccagggacugcuuugagagacagcuuuuuguucaugaaggaaaugagaugggucugaagauauacacuacacagagcaagucuaguguacuugcucucugacucagggaauuguguaacugccuuuuuuuuuuaauucucagaagcggaaguugaaggaagguggugaaaagauaaaaaagaagaaaaaagaugacacuuacgacaaggagaagaaaucgaaaaaguccaaguuuuccaaagccggguaagagggagcagcuuuucaugaggaaaaguucuggucuaugagggcacaugagggcccugggauaccugggccugauuuuccuucccucuccucuccagcuucaaaggaggcuauagggccugacccuccucuccagucucuucugacagggcuguucugggcaagucagccauucucaucucucuguguuggagagccugugggccugcauuccucugucagcccagucgccuucaaguugcugcuguucucugcuuuccauguguucuuccuugaaaugguuuuccugccccucccauuuuuugcaacuuuuauuuuagccugguagugguucuuaaaaaacccauuggauauuuagcauuauaugacacuguauugcuaaucuguauucaugcuuaaguuuugguccagcaagaacaaguucucuuugccaaaaggauggaggcaugauaacagaguggacugauagaacaaagacuaucauggagauccuucccugggagcagggaugaaggcugcugaguuucucauggagaaccugaguaaccagucucccucuugcuugcagcuucacagcccucaaugccaguaaggagaaaaagaagaagaaguacucugggucauuaagcguuagagagaugcucaagaaauuucagaaggagaaagaggcucagaaaaaaagggaggaggagcauaaaccuguagcugugucaucaauagaagcucagggccuuagggaacuggagggcacuucugacccacugcucucacucuuuggcucuacuucugacaaugacuugcuccaagcugccacugccauggacucucugacggauuuggacuuggagcaguugcucagugagucuccagaaggaagcccuuuccgagauauggaugauggaagugauucccuuggggugggauuggaucaggaauucaggcagcccucuuccuuccccgaaggccugccgauaccccuggagaagcguguuaaggagcuggcucagguauggugacaucauauggcugggcuuuucuggaagccauuucaguagauuggcauuagcucugcacccuguggagcuugaugcccaagaaauccuuugugaaaguguaagccuuucccaaguucucauuucaucccaaggaggaaacaguuuaaguuuugcccaccaggauucaguuuuucaccuuuuuugguucccuuuacuucuggaaauuuuauuuuggggacauuuuucucuuguucuguuuucugccaguuucuuucuuacaacucccauuugcuuuuguugaucagccccaauguugacaagcaggcaacugagguaaaaucucaucuuugaauucuuccaaagauuuugaaaguucacugguuuguaaacacauuaagagcaagcacaugcuuagcuguuacuggguuuucuugcucugaugucaucauuagugcugaggugcaccugguuggugaugaggggaagcuuaguuugaacaccuccuccuaucccagaaaacagcaagcagucuuuagcauggaauagccaugcugcuguuuuccuccuguaucuggagaugaugaucucuugaguccuaagaacugucaguuaagcgauuuacuacuagcuauaaucuaacuggaucaugaguuuuaauaccauugccuugguuaaaauagcauuucccuguagacacugauuuggaugguagcucuaagaguguuugugcccaacagcaguacguuuugaacuagugguacuuacagcauuuucagaaucacuauugugacuauuucaaguuucaggacagugcagaacaucagcuucaguauaaauguuuuguuuucucaccuagagaaggcauuugaacacaguguacaaagcaaacaaaacaccuuauucauagcuauaguuucuccuuguuauccuaugugugguauauccaaguguucuugaauguaacgcuuuaaugaacugugacaugucagggacucaguuaucugacuaugacauugaaggaagaggaauugaaucuuuacuuggcauauuugagcauauugucuuguugcucagaauuuauguuuaaaaaauuacuucuuguucuuuucaaugcuuugauuuguaagcacauuguuuuguagucucucaaagacuuguuaacuaaguugaaugauaccaggugauaguagacuauuguuuauuuuuaacagaaaaguccagauaaacuccugcuuaugugcucacccccaugguagauugugaucagaguaguaaccuauuauuucaccuuuuuugggaaaagauauaguggaaaugaagugccacaccugaaacaguguugaacugugguacaagaaagcucuggguagacaugcuaucugguaaguugucucuccugaauaauggccccguuacagcuuacauuacagauuuugcugcaccuggagcccuucauaugugugcaugggugucugggugccugguccuuugugauaauuagcuaggaaagguugucuuuccagagaagaauguauuuagacauagaagaacauuacauagaguuccaaaagccacacaugguuauuuguauccuuaauaaagaauucugugcaggaucuugaaaugaacacagcauuuuaaaaauuaaauuugagggggcuggagagaugguucaucgguuaagagcacuaacuguugguccaaagguccugaguucaauucccagcaaccacaugguggcucacaaccaucuauaaugggaucugaugcccucuucuagugugucugaggaagugaugguauauucauauacauaaaauuuaaaaaucaauuaaauuugauagcuaggcauggugacacucacuuauaaucccaaucguugagagguggugacuucccuaaauuuauuuucuucccuuauucuuuuuuaaaaauaagauuagauagauuuuaaaucuugacuuuagaugagauacauguccauuucuauugcuuaaauuugaaaacgaaugcuaaaacuugggcuuagcuacauauuauuccugacuaugcugguuaagugucucuuuucuggucuugccuaagcuuauacuugugacugcauucagccagcacacuagucauauacuugacuagaucucccuaucaaggguuucugcagaucaugguagucucacuaguuacuccaccuuaccucagaauuggaauccugcuucagucuccaaaguaacugggauuaugggugugugccagcaaucccaacuucaguuggucuuuaauuuggguuuauuugaaauguagcaccuaaguaauucacuauaaagccagauccuccaagaugcaguuuaaaagacuucagaaaaaaaauuuuuuuaaagguuauacagucagaaagcguuugaaguacuggagaaauggcuuaauaucuaaaaauaaaauuuguagccugguaugguaguacaugccccuguaauuguagcucuuagggagcagaggcuagugagacaagaguuaaaggauaggagugagaagggcagaucaguggcuaagaaugcuaguugcacaaccauugaggaccugaauuuuggauccuagcacuuacauaacaaagcuaaguguggucuaguaugugccuauaacaaccuuaaugcucucagggugggguggagcagaaggauccguaggcuuagugacuaaaagccuaacccagaauacugaauuccaggaauaaggcagagagugauugcgaaggacaguugaugugcuccuuuggugucucgugugcacacacaaauaccuacauacacacaaaguacauauaaacagaguucaaguucauccuuggguuaauaaaacccuguuucagaaaaguaauauaaucugcaaacuuaaacuguugcugcccugaugaacaaugugacguuugaauaucuguuuaaggagugagauugaauuaacuaaggauacuuuugggucuuagaacuaguaguauaaauuuaaacaaaacaauaacuugucuggggagauaaugaagugcuugcuacacaagcaugaggacacaaauuuugauuccccagaauccuuggauaguaagccauggugccuaagaaacaacagcugaggcggucugcuagcuaauauuuguacccguacacacacaugcacacuuguauacacaccacacaggauccaguuucauuuucuuccuacauuaacuaaggcuguagcucagugguacagggcuugaauagcauauaugagacccuauauucucucuccagcaaugcaagggugaggggagcaaacuaacccaaacacagaaacaaaccccaaaauaucaaaguaauagaaucaaucccacugcucuagaaaagcaccaagauugaaucugaaugcuuuuuuaaaaguacacgaaauugcacaugcucuuuagccauguauaguagcuuaugccuguaguccuagcacccagaagucaggauugcaaguuucagggcagucugggauauauuauuguaaguucaaagcuggccuuagauauaccgcaagacucuaucuuuuaaaaauuaauaaguaaaauaaguuaauuuaaaaauaaaauccacacuggacagugguggcacaugucuuuaauccuaguacuaggaaggcaaaggcaggcaaaucucugaguucgaggccauccuggucuacagagugaguuccaggacagccagggauacacagagaaacccugucucaauaaaauaaaauaauagacugcauauguccuuucuuccacuguccaguauuuauguuauaccuuucaucuguuuccuaugggcuaucuuuuagacaaggcauccuuagaaguuugaauuuuauauaguuucuccacauucauuucugauuagucaauauuuaauuuuuuccaucuaguuugccuucuuaaaauugucuguuuauauguuuucuuuucuuucacucauucaguggaccuucgauuugauaguuguaaugaauacaauggcauagauucaaguucuuauccuccaugaucuugucauguagagagguagacaacuggcugaaauacagaacaaaugaaauaccuucagucuuguuuggauggcuaaccagagggcuagguagacagccagacugaguggagaucaaaaaguagcucugaggacucagacuagaguccagaguguugauuagacuagucuucagggcaagagguccuugucauaaaguaggacagagcugaaugugagucacuggacagugggauccucagaguguaugguaggagacgagcagaaauggauggcuaguggcagauaguggaaaaccauauguuaugguuggguuugacuaucagcuggaaaagaacccuuauaggguucuaaggaaguuagugagauguuuuaagaaggcuaaggugcagguaugaguaggagccuaggaggucaagcaaguaaguuuuaauaaguugcuugcuuauccaaggccacucaacuacuccuuuacagaaguaauuggaagugauuuaaagguaauuggaaguacuaguccagaguucagaggagaagggucaggacuuagauuugagggaucugcugagauguagaagccugagcaucaggaguuaaaggucaguaucagcuuuugaacucuguuucuggugggcaggguauaaaggaccuaguagaauaagcaaguggaaccaggaggacccagagauugcaauuacaagaaggcagaagaguaaagauuuauauaucuuuaucagagagucaccuuguuguccccauuuuguauaaaguuugauuucagaaacuauauuuugccuuaauuuccaggucagcaucuuuuuguucaggccagugauucccaacccucuuugcucauuagaaucaccauguggcauguugagagagaucugauauuugggcuacuugucaagaacauacauucuucaguuccaacucccaagauuauguuuugauuggccugggguagggaaaccugccuaggaacuuccaugugcagcuaagagugagaacuaccaggauuagucuuugcuguggucacuucagggaucucuagacuuguucuucaaguugucaucuuuaguaucacauaugauuucaggagucugagugugggauacuguacagauuuucaaaggaucuccuuuaagugcugaagcuacacagucauuuuuuuuuuccuaauaggcuucucucuggguacugaguaugacuguagugcacaguauuuuuauuacuuuucauuauuuuuugauacauaaaagucuuuaaauuagcaggucuuacuuaaccuauagguugcaacucuuucauagagucaccuaaaaccauagauauuugcauugugauucauagcaguagcaaaauuacaguuacaaaguagcaauagaaauaguuuuaugguuggggaucaucacaacaugaguaauuguguuaagagguugcagcauuaggaagguugagaacuccugcuuuaaaucugagagguuugcugaagaucuuacuuguuuuucuaccauugacagcauagaaaucgcaauuuacagggugguugguaagggccugcacacagaagcuagacagcuggcugaguuggucucuagccagaugucucaggaucacuucuuuuuccaugauuaauaugguuccaagaaacucagcccacagaugcugcgucagcuuugggaugaccuuaucuggggcugggaaauaggaagauagcagaguguuuuguuggcaggugcucuuugggagcgaugacucugugccugcuggugaaugugagggaugcaugggaaagggcacuaauacauugcugucacugucuccugugaaucaggcugccagagcugcugagggagagagcaaacagaaauucuucacucaagauauuaauggcauccugcuggagugaguaccaucuguuuguuugucucuguucuccuauuuaaaaugaaacagggacauugcaucuaucuccauaaaugauagaacuuacaaaucuucagcaacggacauuauuaaaaugauauaguacauguauugucauaguuggaagaggauuucuugacaaguaugcgaugaaaaaagagaaugcagaagaaugaaugacaaccuggugaccucaggucugcugggaguuaggugccuuucaggguuccuccucguuuucacuugugcugccauuucucuucaucccgucaugcuuuucccagagccccaaaaaccugagguacuugguugucugaacuaauuaauaaggacaacagcaagcauacaaagcuaagccaugucaggccacagcuuugcaaccccuuuccugguuauauuagguagcaggagcagcuugaugcucaauagcagggcuuugcuuauguaaggacaguugucaaggcuuggauguuuccacaaauggccucuacugaguagaauguggaugaaccuuuuggcucagcacagggccucaaagagcaccugugagaguuuugugucaauaaagagccugcuugauugugucauauaaagaaagcucgggcuuuuucuguuuguuuggcuggcgucacuagagagugaggauuuuccugaucucaugaucauggauagaauuaguaacugaaaaucaaaauguggagaaggcuggaaagaugcucuagugccuauaagaacuugacauugcucucauagaggaccagguuuugguuccuaguaccuagaugguggcucacaacugucuuuaacaaccugacuuuuuaacuuuaaguccaggggauccaguguccucuuaagguuuccaugggcaccaggcauucacaugggacagacauacacauauaggcaaaacacuuugcauaaaacaaaaauaaaccuucgaaauacugucaggaaauauuuccugccaacuccaagcauuuuguuacuuucacuuuuaaaacuuucauauuuucuuuguuuaugaaauuuaauacuccuaucuuuuugucuuugguuuuguuuucuugacuaccuuugacuuggucuuauccaugaccuaagagccuugauucuuuuuuccuagccaaguucuuucagcuugagaguuuuucuuguugcugauggagauuuuaucgcuguggccacaugguugguuacauugugugacuaucagccuacuuuuggugccuagcuuucuucuccagucugcaaccuaaggaagagaaaacuugcagugagcugcaggccauugaugacuguguuguguucuucagcauagaggugcaaacucgggagcugacuagccaaauccguucugggguguuugccuaucuggcuucauuccugcccugcagcaaggaugcucuagucaagcgugcucggaaacuucaccucuacgaacagguggguggcagagucugccuaaggaucccaucugcugcacuaccuccuucugauagcccguuaugaguccucaguguaagacugguucaugagccaagccuguacuguguccuuuuuuuguagggugggcgccugaaagagccacuccagaagcucaaggaugccauagguagggcuaugccugagcagguagccaaguaccaggaugaaugccaagcacacacacaggcaaagguugcuaaguaaguaugucccaucucacuugaguaucaucuuucuguauuaucuuccuguaucuccuacuuccucuuaaaauuacuuguauauaugugaguugucuguggaaugugcaugaacuugcagaauccagaagagagucauaugcccugaaguuguuaaaggugauugugagcuagggugcuggaaacugaauuuggauccccugcaagagcaguauaugcuuuuaaacucugagcuaucucuccagguuccugucucuucuuuuuacacuccuccaacacuuuuuacauugcuccuucaugugugcugucauccauguagggagcccaugugcuuuauauagggcaugggugguuaaauaaagaugguguuagguguuggcuugauucauuggugcuuuagacaaaugaaagaaccucaggaauuauuauucuuuccuuauagguuagguuauaugaagauaguuuuuguugauuuucucuaggcaauguagcacuuucugaucuuaaggaaagugcuguagaagggaggagugggaagcuggugggcaggaggaccucagaauuccuucuauucccucuauaggaugcuggaggaagagaaagacaaggagcagagagaacggauuuguucugaugaagaagaggaugaagaaaaggggggccggagaauaauggggccccggaagaaauuccaguggaaugaugaaaucaggugugcacaaacugggaccuugcaucauuggaggguuugugagaccagugucugagccuguucccauauugcuaaagaagguuaggauugauuacuuucauggguugcugaaagcacacaguggugacugugaaacagcauuugggguggugggagguugcugaucucucucucugcuccucagggagcuucugugccagguggugaagaucaagcuggagagccgugaucuggagaggaacagcaaggcccaggccugggaggacugugugaaagcuuuucuggaugcugaggucaagccucucuggcccaaaggcuggaugcaagccaggugaggucuuugugcugaggcagggaaaucuggccugacugggaugaucccugccccauagguugcuaucuuauugauuccauucugaugucacuugaguacuuagggucauacugggaucuauaaaggagacuucuuaaucuauaagagggaucuuauuuguggaguucaguucuuguaaguccucaucccacuuuaguuggaagauuggcugcauucucuuuuccucacaguaugaacuuuguuguuugaugcaguggcuguaccagaggcuaagagauggaagucaucuuagggacugccucaugguuccaaaaaguuucauucacaaggagccacagugcuaauuccaugcuggagcuuaguguugagcuauccagaagcuccuucaugugugcugucauccauguagggagcccaugugcuuucuguagggcaugggugguuagauaaagaugguauaagguguuggcuugauucauuggugcuuuagacaugaaauuuucaucuuuccuuacaguuagggaauuuucauucuuuccuuacaguuagguuauaugaagauaguguuuguugaguuucugagggggggggagaccaugcuacaugugcuacuucauauuuuuuccuuagguggauuuaaauagcaccacugccuuagggaacuuguggcuaugauagguugcaacaaagccauugacuuucuugauggcuguacauaaguuggugaggccauauuaggccuccucagcuggauuaagugccacugaguuccagagccuucaggaacaaucuagaagcagaguuguggcauagcgggguagauaugauaccccagcccuuugucuuucaggacucuauuuaaggagagccgacgaggccauggacaccugacaucacuucuguaaguaccucagaauuuuauuuuuuggggcucugcuauuuuaaucuuuucguguggaucucuucugaauccuuucuguguuccuuucuuugaacagggccaagaagaaaguaauagcucccucaaaaaucaagaugaaggugagucagccuguuugggccaugugccaacuguccugaagcuaugcucaggaaaucuccugagugauuguggcacucuugaaggaggcagccaucugagcugggccacauaauucuagcugcaguuuucccgacauuauucagccagcccaggucuugugguuguggggcucaagaaucugaagcagccccaaaagcgugcagugcaaggccacuguaaaugugaaaggucacuugugugguggucuucuuaagaaguauacucuugcuguggaacugugaaguuuguagcaguagcagggagaaguggcuguuaguuaccugggagaaccacagggaaguacaauggauggagcacaggaaugugauaaccgucucacacaucacagaaaucucucaacagagaccuuugguacuugccagaggaauucgauuagcccugcuuaaagagauugugagaucagauguuuauuccugaguaucugaaaaguuccuaaaaucugugagaacauacuguguuaaguacuggggauacaggagcaaugggauagauccuauucugaucccauuagcauggcuaggagacagguauugugaaaaguuagaggaaaagaaguuaauugaaaggaauucucaucagugguggcacacgccuuucaucccagcacuuggggucaaaggcaugcaggcucugugaguucuaggacagcaagggcuacauagaaaggggaggaaaaaacagagcaaaacccuaccaaaagcaacuuggaaaagaaaagguuuauuuugucuuacagcuuauaguccaucauccagggaaguuagggcagaaacucaagcagggcaggagccuggagccaagaacgauacagaggcccauagagaagugcugcuuguuccuuauggcuuauuuagccuguuuuuucuuuuuucuuuuuuaauuaauuaauuaauuaauuaauuaaauuuuacaucuugacugcaguuuccucucuuucgucuccucccagucucuccgccccccaauccacuuuuccuuuguuuuucuucagaaaaggagaggccucccauggauaucaagcagccccggcauaucaaguugcuggaagacuaggcauauccucucuauugaggcagccaaguaggaggaaagggucucaaaggcaggcaacagagucagagacagcuccugcucccacugugaggagacccaugugaagaccaagcuauacaguuguaagauauaugcaaagggccuaggucaguccuauacaggcuuucugguuggcaguuuaaucuuugugagcuuguguggacucagguuaguugauucuauggguuuucuuaugguguccuucaccccucuggcuccuacuucccuucugcaggauuccucaagcucugccuaauguuuggcuguggaucucuguaucuuuuugcaucaguugcugggcaaagccucugaugaugauuaugcuaggcuccuauuugcaaguauaacaauaucuuuagcuugggcucccuuuuauggcaugggacucaagcucaaccugugguugguuggcuacaccuucaauuucugcucuaucuuaccccagcacaucuuguaggcaggacagauuguaaguugaagguuuuguggcuagauugaugccccagucccuccauuggaagucuuaccugguuacaggagauggccaguuuaucagccugcuuucuuauggcauucaagaccaccaguccaggaguggcacugcucauagugaacugggccuuucuacgucaaccauuaaucaagaaaaugugggcuagagagauggcucagugguuaagagcucuggcugcucuuucaaagguuccgaguucaguucccagcaacuacaugguagcucauaaccaucuguaaugagaucuaaugcucccuucuggugugucugaagacaccuauaguguacucauacauaaaauaaauaaaauaauucaaagaaagaaaaccaaccuccccaccaccccccccaaaaaaaucaagaaaaugcaccacaggccaaucccaguuaagauuauuucuuccaaauugggcuuguauuaggcaguugauauacaacuagcagguacagugaguaaaccuuguaguauuucagaaacugaaagaagaaaaguuuugcugugggcaugugcuagccuaaaaccagucuccaccagcuagauacauaugaccagauaauacuauaagucaaagcacacaugguaccuacacucauccaucacuugucuuguaauuacccaguaagcuugaauucacauguugacauccucauaacaggccacuauuggcaucuuugaguccaucuaacuaugagcauuuccauuuuccuucaggaaucaucuguuaagcuugacaaaaaaguuucuguuccaucaggacagcaugguggucccacuacuuugcucucagaacaucagggcggaggccugaacacuggggcaaacagcagggagcauccaucccaggcaacuuguggccucacugacucuguuucugucacccuggaggacucccuggaugaagaccucgucaggaauccagccuccucuguugaugcugugucuaaggagcuggcuacguugaacagcagagcagccaacaguuccgaauucacacugccuacacccuccaaagcaccaacagaaaaaguuggugguguuuuguguacagaagagaaacggaacuuugcaaagcccagcucuucugcaccaccccccacaaaugcucugcaaucaccucucaauuuucuggcugagcaggcucuagcacuggggcaguccucucaggagaaaaagccagaggguucuggcuucaaagagcuauccugucaggguccccuuagcaagggugugccugaauuacacccguccaaagcaaagcaccacaauuugccacggacgucucauggaccccaggcagcagcuccugugccuggaccccaagucaaagucuuucaugcaggcacucaacagcagaaaagcuucacacccccauccccauuugucaacaagcugcaaggcccaaaggccaccucuccacagugucaucggucccuucugcagcugguaaagacagcagccaaaggccaggcauuccaugccacuaugccagccuccucuggaaguucaccagccuccagcagcagugcccauaagacgacagccucaaacucuaccaccaucagccauccagccaagcugcaccccaccagcucuguggggccgucuuauaagaauaaccccuucgcuggcucagucucuaaacauggggcuucuucuagcagcccaucgcccggaggaggagcccaagugcagagcucuguuucuggggccucgcucccgggggugcagucucccucagcaggacagucugcuagccgagcugccccaaguucugcugugaaaaaaacaccuguuacucagaagcugacccuuguagcuccaccuggagguccaaauggagauucugguggugggacccagggaguggcaaaauuacugacuuccucccugaagccugcugcaguuaguagugugacaucgucuaccuccuugccagugaguauuccaaccuugcaaccuucccuagcuucaagguuuugggaauaaggcugguugucuuucacaggucuguaaaaguggucugaaagagaaagucagaugaugacaguuaagugagauuagauacuggggggaguacuggguuuucuguuuagucucacuuuagcugguggauggaggacugguauagccucaaugucuuagagaaacugggagggagggaaaaagagagggaacaucuuuuccuagaaccugacuuugcacugugacucaaagauggacauaccuucagccauuagguagcaguuagaauguguuuauaccucaguacaaaguggcaguaccuauugguugcaauucuuugauuagcuugaagggacucuguaggauauggugacuugacagagccuagcagggaagguguaggguguguguguauguaaaauuagaaguuuggccaaggguaguguugcacaucuauaaucccauagauagaagcaaaaucaggaguuaaaagcaagacuuggcuacauaucuacaaacugagaccagccaggauacaugaggcccugucuuaaauugaaaagaggucuagaaagauagcucagcagguaaaaggaaaaaaagcacauagaccaggacaccaggcuaugguggcagucacaucuuuacucccagcacuugggagccaggcagaggcagguggaucccugaguuccaggacaaccagagucucacagagaaaccuuguauggggguggggguggggguggggguggggugacauuaccucucuugaagagugccugaguuugguacccaccacccacaucagguagcucacaagugccuguaacuccagucugcaggagcucugaagccucuggucuccuuuggcacacauaaacacacacauaaauguaaauguaaauauaaauauaaauauauauacacacacauauauaugcauaaauguaaauauaaauauaaauauauauacacacacauauauaugcauauauaucccuauacaugcacauaauuaaaaauaauugaaaagugaaaaggaaagcuugaacacagguugggaacuuggaagcuuuuucuuuuccuguauauuuagagaauuguagacagguuguucuagcaaggucuugauucuuucucccuaccacuacauauagugacuaugcacacuaguuuccagggaaaaaaugguauauacacacauguguuuguuugaguagugacacaugaguguuaugguguauguguuguguucagucuuuaccuucugucuuguuugagacagggucucauuguucacugcugcauacaccaggcuaacuggcccuuaagcuuacaggccuucucaucuuauagguguaucuuauagguguacugguuauaggcucaugcuaacauacucaguuuuauauggauuuugaggauucaaacucaggccucagggcucaggcucuaucagugguagagcaccuaucuagcauacacaaggcacuacacuacugcuagaacaaaaaaggaaaauggggccgggcggugguggugcacgucuuuaaucccagcacucgggaggcagaggcaggcggauuucugaguucgaggccagccuggucuacagugaguuccaggacagccacagcuauacagagaaacccugucucgaauaaaccaaaaaaaaggaaaaugggaaaucauugauugacaguaucauugauugauagccuugacaguauaucaucaugacuggugauacagaucaguuauuacaaugugugacuagcuuguaugaagccaugauuugauccccagcaccauacaaauugggcgauggugcauacuuguaacuccagcacugggagauaaagugagccaguuccgauguucagggucauccucagcuacauaauaggucagugugggccuauuaugacaccugucucaaaaauagaaaaaacacuuugagcccuucaauugaaguuugcagccauggugaggaucucugucagguaggguucucacacuucuugugacaauccguggccuuccugagauguguacacccugucaaagugaaacaagggccuauaguagauaaccugcaauucagcccaguguccuggguacaaccaugccccgcugaacaggacuuccugggcucaugaauacuuaacuagcuggucuuauugaaaguaugaucuugugcagucagauuucacuagccacauuccacuguagugcuacaaugaagcuuucuaauuaacuuuaaaaauccaaugaugggcagaaguguucacuuccgugugaaugugaauauguggggaauuaguuuugaauauuacuuagggacaccucauucugguuggacuauaaaagucuuuuuauucaguguacaaauuaaguuuugaaauuuggaagguaaaucuaaccucaucaccuuuauauauaaucuuauauuuauuauauauuauacuuguauauauauaaauauaauacauuuauauaaucagguagaucuuuuaagaugagaauauauauuauuauauuuauauauuuauuguauaucauccauuuaaacauacacaguuacauaaauauaaucuauauaugcauaagguuauaugacucuaggcacuuaguucauugccugugggaggaugucacugucugaugagagaggcuugccuauugccaucaucucaucaucuuauaucauuuucaguuguuucuuuuucuuuuuucuuuuuuuuuguuguuguuguuuguuuguuucuugggauuuuuuuuuuuuuuuuuuuuuuuuuuuuuuggagacagcauuucuucuguguagcccugguacucucuucauagacuggacuuugaacucacagaaauccaccugccucugccuccugagugcugggauuaaaggcaugugccaccacugcugggcuuuaguuggaucuuuuuaaaugagaaacuugccacacuguuuauauuuauggaagcuuugguuuuaucuagaauuaaaauuuaucacggagauaacuuuuuuauuuauuuuauguguauaaguguuuugucugcauguguauuguauaugaaccaugugcauaccugguacccacagaggccagaaaaggguguuggaacccuugggaauguagcuaaaauuaccucuguacccuggaauccccuagaugcuggcucauagagacuuccuaauuccuccuuugggugcuaaguaguagguucuuucacaggguagguucugacuguguguguuuccuccccagaaaggaacuggcggggcagugcugcuguccaacaccucuuccuuaagccugcugucuucauccuauaaguccaacaaccccaagcuuccaggggcuaugaacucaaacucacugggaaucauaacccaauuuccacuucauguacucuccuucaaugcagacuccucugccaaagcaggagucucuaaggaugccauugucacagguccagccccugggaccuuccaccauggccucagccacaguaaguucuugucuccugccucuguuccuauguugugugccauguuggguccuguauguguuugguguaaccaugggaacaucccccaccucuggaagcugcauaguacccgggauagcuguuuuguuccagacuggucugcagguugccuggggcucuagaucucccaaacugcuuuucuguucugucuucaauguguguguuuuguucucuccccuccuguuucucucaggucuucuggcugguuugcacuccagcccaccccacacagcgccucucccacaugcugcugugucuacccaugucccacagagccugccagguaaaugccaggugggcagcgugcugugcacucugugcgccacacuccuccacccguaggugcuuugcugcuggcgcuauuagccaucucugccuuaucaucucuguuuuguauuuugcuuuguauuuugaggcuauggcuuuuuggguuccagaauaauacaggccuauacuaccagagacuuucccugguuucuuauuggacuggucauugggucagacuuagccugugugacgcuauaugauggagcaugagcaugaaacagguguuccaacccuaaugcauuuaaagagaagaaagguaaugguguuacuuguccagagguuaaccaagcacuuuagagccuuuauggugcaaugcuacauaaccuccaggcauugucagaugguagagacucuuugaaagaguguaaguauccauaggacagugagaggccauaguacaugauugugaaggaaaggccucgaucucugaagcuggcacagcucugaaacagaagcagcuuuuaggccucccugguguaagcucccuugaaacagauugggaagcacaccugcaaugaggccagggccuccugacagaauggggcuuuuggaaguaggcaguucuaagagcccugaguacauugugagcucaagagcaugagaauaguuauagauacuucaugaaauuuuggcuuaaagaacccuaugagagccaggcaugguggcacacgccuuuaaucccagcacuugggaggcagaagcagguggauuucugaguucgaggccagccuggucuacaaagugaguuuguagccaggacuacacagagagaaaccuugucuugaaaaaccaaaaaaaaaaaaaaaaaaaaaaaaaaaaaagaacucugugagaaccugauuuugaccuaguauuguuaguacuuuagaccuguuucaaccaggucccugggcuaucaggagagaaaggcugaauuuagggcaggagucagaugcagacucuagggaugaauccgugaccugcucauggacaguguggguccauagcucauugucugcuuuaggaucugucugugagcuccuugcauucauguccuaaagcugggaacucuguagugaguggaugucagaggccuuguuaggaugagggugaguuugcauuucucagagggaaaccuuuggaccuuugaagagcaaagcaaguagcaguagucaauucuuugaagaagcagucacaccugaggacuuccucugcauggguggguggcuaccauuugagugaagugcaaugugggugucucccagcuauggagagccugugugcugugaaaaaugagauggugccaccucuaccugcuuugaaaaugaccuuuuuugagagaaacaaaguaauugaagagagacuggaaacaguuucugcaucuguagaauuuucagcaacaaagggcagagggacacugauagaaaggaaaagaaaaaaacauuucuuggaccauuuuuauguuucccuccccuggucuuccaaagcuaucagaagaguuacggaugucgcucagugguugagcacuugccuagcauauauaaagcccugucucauuaccaguaccucaaggagaaagagaaaaacuauggggcagucagaagagcauccaugcaaaaugggcuagcagacugaacuucauuuugagcugugcuacaguguggggcucuguagggcugucagggaguacucuaucuagcagugagcugaggcuugcuuccguucugcuuucccuuccauguggauuugaugcuuaccuuugucuuuguaccucugauaccugaguacauuuugauggcaagagaaugaacauugucuggauucuguguggucgucauguugcagagugccuguucuguaaacgggcucaauggccuccugccugagaagugcuggugcucaugcaugacacaggaugcugcaaguagcaaugcacacagcugcugucgggggacauugcugcuucuguuuccugugaaguuuguuuaugcugucuaaaaggaauuggagcacuuaaagaaugaucugauuucacuuauucuuuuccagaugcuucacagcuucaugguaaagggccuguuguaccgaggaaauugugaccacuuuggaggauggaacugaaugacauaggucuaggaggaagcccaacauguaugucucugauaacagacauuugcugugcucuucaugcccacugcuuuucuucuggagcaggcgugaguuugaaauggagcacuucuuagcacuucagaugggccuccaaccaaggcagcuucugcugcucacaaagcgcuuacugaccuggugcucuaggccucauggcuuugucgcuggacgacaucaaggggcagcucugugcugggaaguguaccuagacuguguugggaaguauaguguacauguguaccuguggcagaucuguuggccacuggguucuagaucugccuaacuccuggcauuuggugugucucggaguucccuacuggucagggucuccuggccacaguagaaucccuggaugguugugauuccgucccauccucaggcuguguacucaagaggacaauacccaggccagagccgcaugugggggaccuugcaaaauacuaagaacacauaaugugugcuccuuguaggggccaguuucuccucagaacaugacaaugaagcucuuauagagaaaaagaucuuuauagauucaacaaucgugguaggauuuuuaaagacaccuaucuugggcuguuuucgucauuaccauugaaugcguuggauagaaugggacugcucuucacacaucacauuauaggaagacuuaauuccagugccuuuugguggagcagacuuugacaacucacaccuauccauucagcccacugaauggaucugagaugaagaucuuuuuuuaaagcuagucuguauuuaagacaguuuuauuuaauuggguuuuuuaaugacugcacaccauaaccugugccgucuugacuugaaagucaucugagcccccaagcccccccaaaucccagguucccagcucugauuuguuuuuguagaguugaugcagguggacuacaguggagccccucagcccucugugucugagagcccagggguucuaagcuacagguagacauuccacuuugucuuacucuuagaaaucucucucuggcagagcuguaggacaguucucucugaagcaucugccacagagaacaggucuggggugcugguguccucugcacagcgagcuucuguguagacuuaggagggauguccagagggucuggagaguagacagaggacagagauaguugacuacagagcuuccaucaucaggcugucacacuuacccaguggcuauuucauauggacucggagggcuguuuccuauccuauaaaucugccucgcaguggguuuggcugacugccuagccagaccacauuuggggaggugaucagcacucucgguaugcacccuagggugggucaagugugcuuuugguuccugccucaaggguauggagcucaguagcccucuauuccuguggagguggccaccuuuccaccuuacugggagcaggaccuuugucagcucuuuggucuggccuuugcucugacuccuuuuguauggaagaaccaauuguuuucacauuggccauguggacuccuuauccuuuuauuacauauauuuuuuugcaacuuggauuuccaguuuguuuacagaauagucuuagguaguagcaaaaagagccaaagaagagauuuguauagcugagcucuaagccaagcugaggccgccagcaaagcugagcagugggaacucuccaggcuccucugcccgucagacagcgggcccuagcaccccaccccuuuggugcucccuccuccccaugugccacugcuugugcagcuagagcaggaugcccucaucuuuaggaaucuagugaugccucuugccucagggaaauguuucuuugauggggaguuuaugagauuucuuuuccuuguuuaugcuuuauuugugguaaugaacgagugaaugacuuuaacagccauggccagggagaccuauggcccggcuucagcagaggguggagguagagcaagcucagugggaugcaaggguuucuuuggugggugcaagguucugagacuuaaccaggcguggccguuucuuaggugugagaggggcuuuugugccgcaacuauguugguguuagggggugguguggaaauuguuaaucuuguauaaagcaacucaauaaauuguuuugagguuuccaagau

SEQ ID NO: 8079 - RNA, 11291 nt, Mus musculus
cggucacgugcucggcgccggccggccaagauggcagcguccugcguggcgcugcugguucuggcgcugcuguugcuggugcugcugcugggcuuguggaagcgugggcggcaaacgggcagggcccggcacauggucgucguggugcugggcgacgugggccgcagcccccgcaugcaguaccacgcgcugucauuggcccagagcggcuuuucggugacgcugcugggguucuacagugaguggcggggaccugagagggaggcucaaucaggagccuugacucucccuguuuugggacagaggcgggagcagcugugcuccucuccugccuguucuggucuggaccgcuguuuucuggugucugggagcagcgggcgucagucgccguuuaccauacgugaggacuacaaauagaucgguugcaaaagugucugucacuugcuuuguuuagguagugcacagacaggcugcaacccuggugugugagaccuuagugcuggucaccacuuccucaugcugccuuugucacugaguuggcaggcugaauguuucuucacaucccuuguccagccgcagagcuuuucuugcuguggaugguucucuuguccccuaagguguaggcagagguguccacucccucaucauguccacguggaugauuuuucagggguucacucuuacuaugcagccucuagcugguuuggaucucacuauguaggccagaguguccuugaacucacagagauccacuugcuacugccuuuagaguguugggauuaaaggcaugcacuuuaguagccccucagguauccaaccuuuugacacagucauaugaaaucugcuagcauguuggggacauucauaacuauccucgaacacgugcugggcaccucaaauuggaucugcgaacuuggggguggcccagcucuaucuaagggaaaguggaaauagcccuuauugguccccguguggagugcuauccuagggcagacugccauccaggaguucuacucuuuaucaguuaaauugggucccuauugcaugccagucaucagguuaaauuaaguagguaugaugaaugcccuucgaggguauucuauagaagaacacaaagugaccucauuuucuauucuggguacuggggaccugugagguuuugauagguguuauuuuccuuccaccuuguuuacuugagaugggcaugcuuuguagcacaugcuggcuuugaacacuuuauccugccuuauccuuccaaguacuggaauuacagaugugaaggaacacacccagcugacuguaacuggcuauuucugauaccugaaagggcucauuugcauuugcagacuccaaaccucgagaugaacucuugcagaaugauaggauucggauugugaaguugacagaucugcggggccugggagguaggaccagucaacuccagguucuugacuagggguagggaugguugcguauugggaagaugaagggacucucagugccaagagcucuuuuguagagacagauguuuucugacuugcagcugggccccgaauucuccaguauggagucaagguuguauuucaggcaguguacuugcuguggaagaugaugcgcauggacccugcagccuacaucuuccuccagguaugugccagcugcucuuuccuucugugagaaucaccauuaucauagcaggucucuugcuggucuuuuaaacaugcacacaucggguuguggguguggcucagugaggucuuggauuugauuuccagcccacauacaaaaugaacaaauuauuaaauguauuuaauacuucugugugcauagccuauaaaaacauggggagggcugcugcacucgugaacuugcagcuauacaagaccggggcaaggcugccaacacuguagcaugggcggggggagggggguggauucacaggggagccgucccuagcuaaggagcuguuggcaguuaaugguuguuggggguggagguuauuuuucuucuccaguguauccacuaauaaauggcccauucuucaauaaacaaccucucacuuagguuauuauaagcaacuguaguuaaacucagucacuaaagaaaaaaaaaagaugagaccaggagggagcacuuggaggggaaaccgguacagagggaugacugacaggugaggagggagcuaaggaagagaguggggagugaucagaaugcaucacacauacacagucaugaaacugucagguaauaaauacaguaauaggaaaaacaaacgagugugcaggcugccggagcaguggcucagugcucgguugcuguucuugcagaggacccagguuucacucccaccaucuacaauaggaguuuacagcuaucuguaacccagguuccagggauccagcacccuugucugguccucaugcuuggguggcaaauucuuuaccuacugagccaucgucuuaacucaagagcucuugaucgaugaugauuuugggguuuucagauugggcaguuugguuucuuuauaacuucuuacucccuuuguuguuguuaauguuuuuaugguggaggggaucuucuuucugcccccgggcugaugagagccuuuuaggucauaguuucuuugcuguguggucacuccucuaggcuauaugggccauagucuaugcuuccuccacugccugagucuccuuuuccuagaacccuccaggucugccugcuauugccgucugcugguuugugggcugcauuugugggagcaaauuggucaucgacuggcacaacuauggcuacuccaucaugggcuugguccauggcccccgccaccccauugugcugcuggccaaauggugagaggaugugagugguucccccugaguccucauuagagugggugggagagaagggccugggugagcagguuggaucuagagcaggguccucaguuccacucugauucuggcugcccaucucauugugugcuucuugcucugggguccagcuagcucuguccuuucucugucccugcugggauugauuguuguuugugggaccagcagaccaggcagcuccuuccugucacagcaccagcuucgugccaggcuccaggccaggucccguuuuuccccacucugucuccaucacccccaauuauggugcauuguaaaaguuaggugagugggcugagagugaugcugccucuugcugcacaggaagucaucaggaaucagccccuggaggcugcacuccagagccaacuuguagcuggagggaagaaaaggcugccguacucuggugguagcuaaugagcuuucucacuccggugcccagacuagcuucgaauuuauguugguccucgugccucagcuuuguacacucugggauuacaggcacgauaaaccacacccaguuuaguaguguuaacuuuuuuuuucuugagacaagaguuucucuguguagcucuggcuauccuggaacucacucuguagaucaggcuggucucaaacucagagaucugcuugccucugcugggauuaaauguguuggccgccaccaguuagcaauccuacuuuuaugcauuuuuuuguaauuaauuuuucuaguucauuuuauucuuaaaaauuacuuuaauuucaaaaacaaaacaaaaacaacaacaaaagacagcuguguggugguggcacauguguuuaaucccaguacuugggaggcagaggcagguaaaucucugaguuuaaagccagccuggcuacacagagaaacacugucucaacaaacaagcaaacaaaauuacuuuauuuuauauaugaauauuauuuuuauauggcuguuuugcuugcacguuugucuguguaccauguguuugucuugugacugcagaggacaggagaggagaucaaauccccugggauuggauuuauagaugguugugagcugcugugugggucuagggaauuaaacccuggcucugugggagagcaaccagugcugaagcagcucucuggucccuaaacuuguuuuuguuuuuaaagauuuauuuauuaaacuaguuacacuguagcugucugcagacacaccagaagagggcaucagaucucauucuggguguuugugagccaccaugugguugcugggauuugaacucaggaccuucggaagagcagucagugcucuuacccgcugagccaucucaccagccccuuaaacuuguuuuuuugagucucauuuauuguaggcugguuuugaucuaccuuucuagugcugggauuacaugugugcacugucaauauuuauuuuaugaugugcuggggauggaacccaggacuuugauguauuaugggcaagcucucuaccaauggagcuacaucccuacucauauguauauguguauauauacauauauguccauaauacacacauauuuugagacuguuuauugugacuggcuucauaucauaucauaggaugaccgugaauucugauccuccugccuuuuucuccucccuuuuucaguguuuggauagacaugcaccaccaugucccauguuuuaagcacuagagguagaaccagggccuugagcuugccaggcaagcugucuaccagcugagccacauuccagccugaagcuuaguccuugauuugcucucucucucccuccuucucuugggaugaagccucgacaucacuaaacucccuucauaccacaaugagagacagcugcagccccgauugugccgggaggcugagacuugguuaagcagcccuuauuggguuucuccucuuuauugcaugagucuggauuuguggggauugauuccuuuuaaaguaauuguguaggcugaacagugagaggagaggaagguuugagagaguaacuuacucagagcucauggugcauucugacagguucaagggcccucgcucugcagccuuuccacugucuaggaguaucaagucauauggaggcugggguggcaucuaggcucauccuaggguuccaugcugauccccaagauauuuuguagguaugagaaguucuucgggcgccugucccaccugaaccugugugugaccaaugcuaugcgggaggaccuggcagagaacuggugugucagguaugcagggcuugggaugcccauuaauccaugugcuuugagagcuucagcacaguccugcagcccuguacugaaguacucaggcccugggagaugguuacugguuuugagaagccaagggggaggcaguagacuuuuuuccucucccagcuauguggccuauaggacauuuucuugcuaaaauaucugcaccauucuaaggaauuuucauuucuugucucuuggauuuuucccaaacucucuugcuuuuugggauccugcugugcccucuugcuuagauuuuuuuuuuuuuuuuuuuugcccacucccaucucaugucagggcugugacgcucuacgacaagccagcaucuuucuuuaaggagacaccccuggaccugcagcaugaacucuuuaugaagcugagccacacguacucuccuuuccagagcugguaugucucucuccccucuuucugccguccuggucuccugcagacuuguggauucacucaucuagaggcagcaaacuaaagcuauagccugucaccuauugcuguaaaaagguuuuauuggaacacagcccacccauucaccucuguguuguuguugguuguuggaacccugguauagcggugaaugucuguaaucccaggacuugggagccugaggcaggaggauuguaaguuugcggccagccugggcuacauagcaagcccuucccuucccuugaaagcagugguugcucucaaauugcagcaguggaacugcauaucacagcaguugauggcccaaaaccggaaggaucguacucucuggccuuuaaggaacagccugcugagcccugggcuaucuuguccugcugucaguggguucuuguugggcaagggaccugaguguccccugggcaucucacugggcagagaagguaccugcccaugucuacugugugcuccuaggaaccgagcauggcugggggagguggccgaguauauccuuacugggaugcugagcaggcaggguggagagccuauggacguggcacugaguaguggaguggcuguuacucaugucaucucagugcuagcaaccaggagcugugaagucaguggggugcaacuucuguggccugccucuggcucuguuuuuguggcacaaugucuaauaucuuaucucuuuugucugauucuucagcucagaucccucacauccugacacagagaggucggccuucacugagagggauugucagagcgggguugugaggcgucugcaugggcggccagcacugcucgugagcagcacaagcuggacaggucugcuuccccuggcaccugggcugugugcccagcuugcuuugggauccagggauggguaucugagaagggugggaaguugggaggcaacuaugacuccuuuucucucccuguagaggacgaggacuucuccauccugcuucgagcauuagaaaguagguguguggcugcaucagcagcucagaacuuguuaggggcuacuucuaggucccuaccuggccuuuuguggaacccugucauguggucugccccggugucauggguaggccuguuugagauguuggggagggcauggaaagcuuacugcucuuauguggucacugaguggcuagacccucagucugauguaucuugagacuagcagccccugggaagcagcccuucacuucuuaccuguuuuccccugguucuugugucuauuuuaaaaauagaguuugagcaacaagcacucacuggagacagccucccuucccucgucugugugauaacagguacuaacaagaacaccauggcaugguuguagaagggcggagggugaagaaugggcacagggccuuuacaggacaucucuguagacacugucuuguuggucaucaccagaguucuccaggguaguucucucuuccucuuuaagaucuugcccuugucaggcaagugcucuaccacccagcuauaccuccauacaaguuguccaggcuggucuugaaccuacccuguauaucaaggcaagccuugauauacuaacccacuucagccucccaaguagcugggacgggccucugucaguaagcccuuggggugguguuucuacuuucuacuuguuauauagagaaccugaugcucagaaaggacucaagaguaaagauuucgcucuggggugguacuacuuagcccaaacgcuucccuuucccagaggauuucuaacuucuguagguuggaggcaguaugucuucuguucauucacaggguuaggcagcuacauccuccuguucccuuccagcugaguucccaugggacccuguggggagucaggcaugcuaaggaugggcugugucacuggugcggguggagaugcugugucccugugccagcuggcugggguaugcuuagcauccagccaugggaugucagggucugagguggccacuggugggggugguccugggaaagggucaucgaguaucagcuggagcagcaggaucugcccaccggcagagguggacaguggccagggcagugacuuugcuucucugugaagggaagggaccgcucagagagcacuaccgccaccucaucagccagaagcaccuucagcacguccgguucugcaccccauggcuggaagccgaggacuacccacugcuucuaggugagagggcgggcugcaggcgaaggcagaagccacggugcuccacggugcacacagugcacacagugcacacagugcacacagggacauguuaccagucugucugcugcaauuuuugagacaggaucuauguagcugaguuuagccuugagcuuguagcaaagccuucugccucaguccugagugcugagauuacaggugugcagcaccgcguuuggacuuuucguucauuuguuuguuuguucuuuccgaguaagauuucaguguauaguugagguuggucuugaacuuguacagugaucuugucuucgucucucuacugcuggguuuacaugagugcuccacucgccaguugauaccugauuuuugcuggauuuguuguagauccaguuucuuugauuuuauuauuuuucaguuuuuguuaagguuuuacuucugggacaguaaaaacuucccuugaucucagagagauccaguugccuuggccucccaaguguugggauuaaaggccugcgccacaggcccagcucugcccuauaguuuuaaucuugaguuguuagagguuugccacucucuagugauuauuuguuguguuuguguggguguguagguaacacacuugugucauggcaggucacagcccucagaggacagguuagaggagcuggcgcucugcguuccuugagauccagagacggggccaggccgucagccagcaccuucugcuaaggcugucauuuuuaaguggucacugggugguggucuugagcaagccaagugaagcaaaaucauagcucugcuaucacaguuucuccuugaacagacauuucucuuugaaauggaauuauggcuaaguaugaacaauaaaucaauacaaguaaaaacgaacaaaaccaaagcaacuauuaggcagagucaaccauguuuuagccucugguuaggcugccuggcuucuuggucaguuuaugccauuuguguuuggggacagucucagggacagcuucugauuuccacucauuguuggagauggggguggggugucacugcauaggccugggagagcguguccuaguguuuugacugucuuugcagggucagcggaucugggugucugucuacacauguccuccaguggucuggaccugcccaugaaggugguggacauguuugggugccacuugccugugugugccgugaacuucaagugguaggugcagauaccaagccuuacuuggggcauauucuagagcagcaguuggcccugugguucugcugcacuccagugaaggucagucagcuuggugcgaccacuccaugucaugccagccacugaggugcaaaaugguuuuaggauguuggaaauaugaggcuguagucuggaggcaaaggcaggauuccggagcuugaaacuaacuugugcuacucaguaaguuccugucucaggaaaaaaacuguaguaaggagcaugcugagugugucucuaccaacauguggcuuucuucuuaucccugcuccacugccaggguauuagaugccauuuagaggggaugcucaugcggaccauaugcaaacacagcagcuuaugggacauaaggaacuugagcaucuguggaugcacaggggcuccaggaaggaggccugcacagagugggacgggcacggcugggguuugcucauggcuagcaugcuacucaggcuuacccugggagggggaggugggacgggcacagcugggguuugcucauggcuagcaugcuacucaggcuuacccugggagggggagagggagggggagguggccagaugcgcuugcaggugccuuacuuuaccucccugcucuguagccgagcucuuaggacugcauuggauuaucacaccagugcaguucugggacuccacuuccccggccagggcggaugugagcacagaggcugcagcuuggcagcuaggaagcagccucuggaugggaaagccuugagugagccaaguucagggacugucaggaucaaaucucccagugacucugaaaagcuaccuuaauguguggagccacguucagacaugcugggacccuagcucucagguuggaguggagaaaaaacacagaaaccaucucaggccaccuucccuucuccaaaucagccuggugguuugacaugugcccuuguaggcuuuucuguccaaauacuugcgcucagaacagaggccuauuucaccugagggguagaaauggcuccgcucgguucccuuucuucuccagcuggcucucaacucccuugcucucucugcagucugcacgagcuaguaagacauggagagaauggucuggucuucaaggaugcugaggagcuggcagcucagcugcagguacugggucuacuccguccguguggggcugggugguuugaagccuggcauugccagcugcacgaucccugcuucccacacagggacagcugugguagaacucugggguguagaggaagggagcagagggcucaaagguagcuucucagccugggcugucagccagucauucaccuugccaggggaaaacauacauaccccugccugccacguguccaaagauggaagcugugcugcccuuuaaggagggugggggccaagggagcacccgcugaggggucuauccuuauaaaacuaacguccucucauuucuguccuuaagucuggguaagaacugcaguagcaucuggcauggaugggaacacuagcugugcacaugcgcacauaaucugaguuccaauaaaacuuuauuuacaaaggcaggugggcaggacccaacccgucccugauagacacacuaaaggcuuccaucuuaacugcaucugcagggguguguugaggaugggaggggaaacugagagaauagcagguggaggcuagccauucucuagggcagggcugugggugaguagaugaauccaucaagugucgagugagcggaggggcaccacuggacacgagcaaggaggccggggccuggugcagggagcugaguuccaguuuuccuguuucccuagaugcuuuucucaaaguucccagacccugcuggaaagcuaagccaguuccggaagaaacugcaggagucggggcagcaacgcugggaugagagcuggcagcacacugugcucccucugcucgcucacucacagaugacccccaggccccauccacccuguggccacccuuccugccggggcuuuugagugcccccuaguggucauaagccugaggacagcagugggcgacagcuaggaucuggcuacugaucuggcagcucucuucuguucugagcacuucuguuacuuccagugucccugccaacuucucagucccuggguuuuuguuucuggacuugucacaucccuugcguucugguucugcugugagcucugggauagccuguguucacuggguuuggcugagcaaggcugaacugucugacaggacagucauacuuaauaaauguauauauuuauuuguacaaugg

SEQ ID NO: 8080 - RNA, 11834 nt, Mus musculus
aucugaguuccaauaaaacuuuauuuacaaaggcaggugggcaggacccaacccgucccugauagacacacuaaaggcuuccaucuuaacugcaucugcagggguguguugaggaugggaggggaaacugagagaauagcagguggaggcuagccauucucuagggcagggcugugggugaguagaugaauccaucaagugucgagugagcggaggggcaccacuggacacgagcaaggaggccggggccuggugcagggagcugaguuccaguuuuccuguuucccuagaugcuuuucucaaaguucccagacccugcuggaaagcuaagccaguuccggaagaaacugcaggagucggggcagcaacgcugggaugagagcuggcagcacacugugcucccucugcucgcucacucacagaugacccccaggccccauccacccuguggccacccuuccugccggggcuuuugagugcccccuaguggucauaagccugaggacagcagugggcgacagcuaggaucuggcuacugaucuggcagcucucuucuguucugagcacuucuguuacuuccagugucccugccaacuucucagucccuggguuuuuguuucuggacuugucacaucccuugcguucugguucugcugugagcucugggauagccuguguucacuggguuuggcugagcaaggcugaacugucugacaggacagucauacuuaauaaauguauauauuuauuuguacaauggaaguguuugcucugagccuguguccacucgagaugagcugcugaggacaggcaccagcacucagccugugcuuacuguacacuugugcuguuauuuaacauuccugcucaacagaagccuuuccgcuuuccgcuuucccaugacagucauuuuucuuuucucuucuuuccuuuucuuuccuuuuuuuuuuugguuuuuugagacagguuuucucuguguagcccuggcuguccuggaacucacuuuguagaccaggcuggccuugaacucagaaauccaccugccucugcgcgagugcugggacuaaaggcgugcgccaccauacccggcuagucaucucauuuuucaaaucaccuucaaacaccauggcgacuggucagcaccagcuucaggauuacgauggcugaaugcucuucguaagggaacaguuugccagugugagggggcaccucuucccaguagauuccagcacggucuagauaagaguacagagaucucaggagggcaguugacacaggugugcuguguguucaagcugauuugcuuggccacagguuuccaggcccggguagaugcucuaugggaguguguaucugugggcacgcuuggucuaaagguagaggcagagguucugcucccauguuccccuuuauucccuaagccccagcaauccugucucugccccugacgacacuagaauuacagguacuuacagccacaacccagcguuuuaaauggugguucaaacuugggucuucuuguucguaugguaaguaagcacuuuugcuuacugaucucucuguggccaccucuccuguuggguuccuugccucucugcaccugccuacccugucaguuggcacaagcagagaucagcuaugaucuaacucagcugccuggcuuuaugggguuugcaauuacugugagccaagaugguuuaacuaguauuguguuauaaauaaagcuaguaguuuagagaguagcacaggcaaaaacccaccugaguauaaguuugcacacauucuacaaauuccucaguuccuccuagcuguaauuuuuaaaaaguauuauggauggaauccagcugugcacauaguagauaaguauucuaccacucagguaagugcucugguccccauaaagaguuacugaagucagacacaggcuggcugcucugugguccccucugccuuucauagggaagauguguugcaggcucucucucucucucuguguguguguguguguguaaucaucugaaggacaggaagggcucuuagugcuccaucaguggauucagguaguguucaccugcuugucugugcugacugggggugucuguguguccgucuguucacagaugcuguggcaggugaguggauaguugcugacuggggugucuguguguccgucugcccacagaugcuguggcaggugaguggauaguugcugacuggggugucugagugucugucuguccacagauacuguggcugugaguggauaguugcugacugggguucuguguguccgucugcccacagaugcuguggcaggugaguggauaguugcugacuggggugucugugugucuguccacagaugcugcggcaggugaguggauaguugcugacuggggugucuguguguccgucuguccacagaugcugcggcaggugaguggauaguugcugacuggggugucuguguguccgucuguccacagaugcugcggcaggugaguggauaguugcugacuggggugucuguguguccgucuguccacagaugcugcggcaggugaguggauaguugcugacuggggugucuguguguccgucuguccacagaugcugcggcaggugaguggauaguugcugacugggguaucuguguguccgucuguccacagaugcugcggcaggugaguggauaguugcugacuggggugucugugugucugucuguccacagaugcugcggcaggugaguggauaguugcugacuggggugucuguguguccgucuguccacagaugcuguggcugugaguggauaguugcugcagaggcuuugguaagggagcugggccaggauaacgucgcacuguacuggguguguguguggagugccuugguuggcaugcagggacuguggggauaguuuugagugggugggguauaguguggacucagcccaggugacuuggccacucaaccugagugcuucagugucugcacagcugagaugggaugguuggauacaucucaggugcuggagaggggaugacagaaaagugucauuugggguucuacagauggugggguccuuaucccuuuucuaaaaucacccuuagcuucucuucuaguugcagagugcccaaaacaauggcagccaacugcccauugccucugcaggccaggcugugccucagguaaaugucaccacagaaagagaaggaugcugaggagcaacggcaaugucagcccgguuuuuaagcccuccucaugacagaaugguggcccacaggucgggaacugacccagcucuucgaugaacagcuugccuguguccuggcugcggauaguauaggcuacauagacaucaggagcgcucuuccucuggcaguccucgagcaucuucaggacccugaccagugacagugucaucucccagcaguacaguacaucuaggaaggaaaggcuguuacugaaagggccucccaccaggugugaggggguggcuggucucacucugggggcagggcuugggagcugcaguauuaagauguguguguuguuccuuaggaagugucccaggugaaaggcaggccccaggaggaaaggccucuaaagacuggaaccuccuguggcccuugcucacuuagaagcuucaugaugaagcagauccuagccuggcuuugggcuuuuagaggguacugaguguggggugugcuguuugcagugaucucuguugugauaggggaggaagacucuaguggcccaggcaaauccuuucuuucaaagacuccauucuguuuccuaagaggcuggggcucucuugccaucucuaaaggacacaggacagggacuuaggacccaaaugguuggcagccaaggccacauggcacagugauggcacaucugcauagagccagcaugggcagugugguugggccugccaccucauuuaaacaugacccaggaugguacuaacaacagguggagaaguuggaugcggcccugagaggaccacaggcuacauggccagucuaccccaccuaaagauccuggguggcuguuugucaccagcaguggagggcaguccuugugguggguggaacugcucuaguguucauauaggagcagggagggaacucaguggccucagggggcuguggcaagguacuccaggccaccuagugugcugcccugacaccuguccugcucaucucaagcccucuggggacagcuggcuguucauggacagagccccagcagugagagcagcuaucuccacagggaccugaagcucuggaguaugggcugucacgucacugaaagcccagggugucucuuuggaguccugcuggucccugccugcuccacccacagcuucuuccugcuggaaugaggguugcugcuggggcauuaccugcugcaaugacaacaucugccuggaaggcagagagcugagaggcugucaccucgucccaguccagcugagccacugucaccuucgagcugccugcgucaaugggggugugcggcucuaaggagaagccguugaggagaacguuuccacggagcugcucaagcacuugggcaugacagucgcugaagauguaugcucuggggcagcaugccuugcaaauugccaggccuguaaggccagcuccacugccuagcuccaggauaguccugagugagagauggggaccuguguucacaacugcgccagcaccaaucaccuuagugcccugcucuaugccccagggucaccugucagugaaggcugcuggguucucaauggcccauucugccagguagagagcagcgucccauguaaccaagccuguggugccaugggacacgauggcagugcucucagagaguguaacugaguuuccugaaggcugcagacaagaaggagaaugaacaaaaccaucagaguaugucuggugggaccuaaaccauagcaagugcugagcagaaugugauaugggguagaaggcuguagaaggcacucaacaauggaaaguaacgaccuccccacacccggcaauguggggaccucaaggaugugauaagugcaaggagccaaucucagguuccgugcugugugauccccuucaucuaacaccuuuagacccagucacagagaagagugugugugguggacagggguaagcacaacacaacacucauguuucauaccagcaaauagcuccgguggcacuggguggacucuugggucaucagaaccucugccaacgccucauacagugcauccaaaggcuccguggguacagccucaugcugggaacagacagccuuaauucagagaucacacugacucuuguaaacaaccauuccgucccuugcuucugucugcuuugugaauaggauuggguagcuuucacagcauucguagugcuggugauggaagucaagaccguguguacaugcugggcuggcauuggacugcggagccaggcuccagccucaucuuauuggauuuagaggggaaguuugggagugggugguaugccagcauuugaacaacuuagaauuaaaauuaacagaauuaaaagugcagugguagggugccucaaggacagguguggagagagggcagguggaucuaggagagccacauugccccagaggggugcugcuguucuugugagccccaggcucauaaugcagagacuuucaagaugccucuuggugccguuaagccauggcuucaccaggccucacagccccguuucuccuggugcuaccagggucuacagagguaccagggugcugaggcccaggacuagaauggugcagaagcaaggaugacagcugugcugagccuggugggcagcugcuugcuucagugcugacugaagcuggccugcugcuguucuccauggcugucuagaguggcauggagcaggucuggauaugcccuccaaaggugccuugcagagguuggggggauucuggcuagcagccuaguugggagaauaacaagauacuagcugggaagggacuguaagaacaaacuuccaacaggggcgcaugacugguaggaugggggaggaggaggcauccuucauucacuggcagggaugucugguugaaaggagaaccuuaguuuaggaggagaagcugcugcugagagcccuggcugcucuccucuguacucuccgaccauguucaccagcccccugcaaggaagcucugacucagagcuuacacaacaaccacagggcagggaggggcugcuggcaccuggggaacucuguaccccacuauguggccuguccccagcagccacugcccaucacugaccuuuuugaugagcuuugagagaaagcagcgggcauacuucacagaagguccgugcugcacacacacagggugcuucacagucuagacgacaaaggacaaggugguugcuugcucucuguguccuagaagcuucacaugauugguggggauugacguuccagcaaagauaugcauggacaauguggguaugugcccugggcaucuccaggaagucuuuccuuaagaaggucuugcuagacagcauggacuggucucaaauuugcaauccuccugucuuagguuuauagguucaugcugccauucccaacuuaagaacaaguuuuacgaucuuucuuuaaaacauuuggacguaguagcauagcucuguguaggaaccugagcucacagggccuuuccugcccacccagccuggcaggugggaaugauacuaguuuguugugagggucaaagugggcuaucugacuucacagaugaggugagggcccaguggcaggaaccagaagucucagaugccugucguccugacuaugaggccuagguggugaggaggguuggagauggaacggaacaggcaaauauggaagagcaaaagcuuugccuagagaggaacucaugacucagcagaaagcuuccaaaagugaggugcaggcucuucagccagggagagcagugugggguagcucccagguggcucugaccuggcaguuuugaaaggaggucagaggaccagcagaaaguaggacauggaaauggguuauggaaggagguauaguuugaugccuuggaacgaccacagaauccccuuaaugccccuuaauauagcucuucauguugugaccaccaaccauaaaauaauuugccacuucauaacuaauuuugcuacuguaugaacugugauguaaauaucuguauuuucugauggucuuggaugucacagaggggucacaauccacagguuucgagaaccaucguucuagucccugucugggcucuaaucauugcucccuuaaggccuucaagggcuucccacugagggcucauugguggauaacuccacuagaucuuaaaggagcgugcugaguuugguuggucacccaugggaggcugugagacaaagccugccugccucccccuucaucuuucugauacaagauagcuuagacugaaucugcauuggcccuggcucagcauagaauuccuggucuaggcuccuagggugggcucagcugcuagguugucacaggauuuucccucuccuauugcauuagggcagugggaggccugugacaggacagggaaaagggaggugagcuaauaguugcagagacagggagcaucuuggggggggggggggggaggaagauggcaguagacgugaaucaucauagcuaugaccagccacggguucuuauaucauaaagguuagaauauugggauaauuuguccaaucuaggugggcagcuuuugucauuaucaauugguucugaaaugauuguauuagaaucuuguguacugagaauuuauugguacauaaaucugacugguuaacuaauaagcacugagccuuguuuuuaccagauuacuggguauuaaaccaugaggauggcgggucuauuugguuacuggaaugugggacagaguuggugggacccagccaagaacauaguguuguggcccaccagugcugguacuagagcaggaacgacguggcccggcggggcuggagaguuagcggguugagagaagcaggagcacggagaguugguggagucauuuuguuuuuuucaaauauuccccgcaacagcuagggacaaaugucuucccugaauuuguauucaaacaugcuccuucuggggaggaagauuacaguuuucccugcugaaagucacgacccucaagguuaaggcacaggacauggugguguggcuuguccaagaguaggcaagaugggcucuauuauuaugcaaagaacaacauuucaaagcaguuaacuaaugcuggaaacagucauaugucaccugucaucucugguucaagacuucccagagggugugggguggagagauggcucagugguugagagcacuggcugcucuuccaggggacccagguuugauucccagcacccaugugcuagcucacaacugccuauauuccagccccagggaaucugacacucuuuucuggauuccaaggacagugaauacauauauuucucugucucucucucugucucacucucucugugugucucugucucucucucucucacacaccaaccuaaaaguuaaagccaucuagaaaaaaauggcauaguaucguuccauagagauaaagccuuaaaaaaaaaucuccuagcuucccucaucucgugcaguuuaaauuagaauuugaauuucuuauucauccacuaaaaccaaacaucugucuguagugcuaugccuauggguaaugccaacacaagugcuguuuuuguucucuggacacugguguuuggaaaggauacuggcaaggcuugggucugcugucuggggauguuggggcucuuacccucugcagaauagccagcaacagcucagaacccgagggguccuuuaguuuuucuucuaggcucugugagagagagaggagagagagagagaucaucucagggacauuuucucagcaacaguacacuccuguggaauauuccgguaaacaguauaauccuaggggcuaauccuaaguagaagccaccagaggugaacuugcucuaaugucacgggccacauauggcugaguaugagaagaccgugucccgauucacaucagauguggcugcccagccagaagucauggggucauggcaacuuuggggcugagcugguaagcugggaacaaguuacagcguaaaggccugagaucugcucucuaagcuaaaauggagacucagauguguggugccaagccugaggacggcaucuuugacacagggacuauagcuacaacuccagucaggcagguaugugacacacagcaagccacuuuaugucaaucagguucucuacaaucugccuugacccuuuucugagcacagcuauacaguguuauuucugcucccugcacuguggccacagcagcuggcuugcugcucuuaagcacggcaaccauguuucuaccacaagaccuuugcucccucuucucugagaccaucccuggggcuuggguagcaguucaaguaccucuuuggggaggccuuugaugacucuacuuuguuugucauuuccuuguuuauuuuuucauccgucugagacagggucucaucuuguagcuggggcuggccucuaauccacagacucuccugcuuuaggaccccaagcugugguuauaggcaugagcugccacacaugguuuugccuggugucuucugguuccuuacuguuuuagggcuggcuucucauguguuaugaugugcccuggugugcagcucauggacggcauucaguaaauacuuacugacccaguaacugcuaggaggcacucagugcacuuccacagucagguggaagucaggguuuguacccacguacucccacaaagugagauacaggaggggcugccaacaguauacaggagcaacaguaaucaggcgguuaaguccacaauucguguucaugauagucuuuagguucuugguagaagcgcucuuauguucauucuccuauacauaagcuacaguuugggggauggggcaguaugacucccuaauuuggagcugugggacucucccuuucuaccuugguugccuucagcaaaaggauugucagucugacagcuuauaccagccuuggcugccugaacacuccauaaacacccuuagacaaccagaccugauugucaugacugcugaagcugcgggcucagccggggcuguuugaaacuuuuugcuguuacaaaccuggguguacaguguauugcucugcacucauuuccugugggacagaggggagcacgcccccuaguggcguagcggaaggauggcugggauggaacaagaggcaaagccgugauugguucagacaccuacacagccugcugcuguggucaaagagggaguagacuguaaggaacccucccgcgcuaccuccugggaagagucucuugccuacuuuaguagugcgggcugcggggguaacaaggagaaagcagacccagucaaggcucaacaguggacggcagaauuguaaaagcagacaggcuggccauggucaagagcuaaugaauccgcacuuccaagaccugcacaagagcuguauguuucuaagggcugcugccaagggcugaagaaauccaauaccuuggccugcugggaagcucgcagccaaaaauguccuaagaacucccggagggccaagggcccuacacucaagaaaccugcaauuacuggucuugucugccuacagccggcacagaaaaacacagucagcagagaucagcacucccagaacuuuuugucuaucuaugauuucuagcugggcaaaggaaaagaaguccagcuguuuaguagcaagaggcugcuaucauuguauccuuuacuguauuaauuagaaaugauggcacagagauguagccucuuguaaagucccacagcacacaggggguugaauuagaacuauaagcaggaagcuggccuccccggccagagcucugauucuuuccuucuuaaacuccuggucaaauggagugaccacagacgccagugcugugcacugugggugacccugagcaaguacuuagcacagcacaugaacuauuauuacaguugacauugaauaaggacuuauauguuauucggguuucguuuugcguuaagaccagagauauuuuaugucgaugaaauaauacaacuacccaaaccacccaacgaaaccggguagacucuggaggaauacaaaucuauaguaacucaugccggugagcucaccgcacaagaguuaacagcgaggcacgcucuaaaggauccucgcguccgagcugcagguccccaggccacagggaagcaccauuuucaguccgaacucccucugagacgguucugccugaagccugcccuucggauggggaccuggccuccuuuucaggagagcgcggcucuugccauuugaagacguuuaguuuuucaaaguuguuuugcagucgccaagaugaccgauuacuggcuuaaaaguugcuaaaauaauccagcccgguucgugacccuguaaacccugccggggaagggcccgccugccucccccaguccagcggugagcaaaggcggcccgagacucccggccccgccgcccguggugcucgacccugauacccgccgcacgcccgccgcccaccugccagggaaaggagggcagcgcgcgagccgccaggaagcggcgcucgaaacucugcagcagagacguggcccccucgugguccucaggcgccaucgcggggcagggccaggguugccuggaaacgggcggaagcgaggccug

SEQ ID NO: 8081 - RNA, 11834 nt, Mus musculus
caggccucgcuuccgcccguuuccaggcaacccuggcccugccccgcgauggcgccugaggaccacgagggggccacgucucugcugcagaguuucgagcgccgcuuccuggcggcucgcgcgcugcccuccuuucccuggcaggugggcggcgggcgugcggcggguaucagggucgagcaccacgggcggcggggccgggagucucgggccgccuuugcucaccgcuggacugggggaggcaggcgggcccuuccccggcaggguuuacagggucacgaaccgggcuggauuauuuuagcaacuuuuaagccaguaaucggucaucuuggcgacugcaaaacaacuuugaaaaacuaaacgucuucaaauggcaagagccgcgcucuccugaaaaggaggccagguccccauccgaagggcaggcuucaggcagaaccgucucagagggaguucggacugaaaauggugcuucccuguggccuggggaccugcagcucggacgcgaggauccuuuagagcgugccucgcuguuaacucuugugcggugagcucaccggcaugaguuacuauagauuuguauuccuccagagucuacccgguuucguugggugguuuggguaguuguauuauuucaucgacauaaaauaucucuggucuuaacgcaaaacgaaacccgaauaacauauaaguccuuauucaaugucaacuguaauaauaguucaugugcugugcuaaguacuugcucagggucacccacagugcacagcacuggcgucuguggucacuccauuugaccaggaguuuaagaaggaaagaaucagagcucuggccggggaggccagcuuccugcuuauaguucuaauucaacccccugugugcugugggacuuuacaagaggcuacaucucugugccaucauuucuaauuaauacaguaaaggauacaaugauagcagccucuugcuacuaaacagcuggacuucuuuuccuuugcccagcuagaaaucauagauagacaaaaaguucugggagugcugaucucugcugacuguguuuuucugugccggcuguaggcagacaagaccaguaauugcagguuucuugaguguagggcccuuggcccuccgggaguucuuaggacauuuuuggcugcgagcuucccagcaggccaagguauuggauuucuucagcccuuggcagcagcccuuagaaacauacagcucuugugcaggucuuggaagugcggauucauuagcucuugaccauggccagccugucugcuuuuacaauucugccguccacuguugagccuugacugggucugcuuucuccuuguuacccccgcagcccgcacuacuaaaguaggcaagagacucuucccaggagguagcgcgggaggguuccuuacagucuacucccucuuugaccacagcagcaggcuguguaggugucugaaccaaucacggcuuugccucuuguuccaucccagccauccuuccgcuacgccacuagggggcgugcuccccucugucccacaggaaaugagugcagagcaauacacuguacacccagguuuguaacagcaaaaaguuucaaacagccccggcugagcccgcagcuucagcagucaugacaaucaggucugguugucuaaggguguuuauggaguguucaggcagccaaggcugguauaagcugucagacugacaauccuuuugcugaaggcaaccaagguagaaagggagagucccacagcuccaaauuagggagucauacugccccaucccccaaacuguagcuuauguauaggagaaugaacauaagagcgcuucuaccaagaaccuaaagacuaucaugaacacgaauuguggacuuaaccgccugauuacuguugcuccuguauacuguuggcagccccuccuguaucucacuuugugggaguacguggguacaaacccugacuuccaccugacuguggaagugcacugagugccuccuagcaguuacugggucaguaaguauuuacugaaugccguccaugagcugcacaccagggcacaucauaacacaugagaagccagcccuaaaacaguaaggaaccagaagacaccaggcaaaaccauguguggcagcucaugccuauaaccacagcuugggguccuaaagcaggagagucuguggauuagaggccagccccagcuacaagaugagacccugucucagacggaugaaaaaauaaacaaggaaaugacaaacaaaguagagucaucaaaggccuccccaaagagguacuugaacugcuacccaagccccagggauggucucagagaagagggagcaaaggucuugugguagaaacaugguugccgugcuuaagagcagcaagccagcugcuguggccacagugcagggagcagaaauaacacuguauagcugugcucagaaaagggucaaggcagauuguagagaaccugauugacauaaaguggcuugcugugugucacauaccugccugacuggaguuguagcuauagucccugugucaaagaugccguccucaggcuuggcaccacacaucugagucuccauuuuagcuuagagagcagaucucaggccuuuacgcuguaacuuguucccagcuuaccagcucagccccaaaguugccaugaccccaugacuucuggcugggcagccacaucugaugugaaucgggacacggucuucucauacucagccauauguggcccgugacauuagagcaaguucaccucugguggcuucuacuuaggauuagccccuaggauuauacuguuuaccggaauauuccacaggaguguacuguugcugagaaaaugucccugagaugaucucucucucucuccucucucucucacagagccuagaagaaaaacuaaaggaccccucggguucugagcuguugcuggcuauucugcagaggguaagagccccaacauccccagacagcagacccaagccuugccaguauccuuuccaaacaccaguguccagagaacaaaaacagcacuuguguuggcauuacccauaggcauagcacuacagacagauguuugguuuuaguggaugaauaagaaauucaaauucuaauuuaaacugcacgagaugagggaagcuaggagauuuuuuuuuaaggcuuuaucucuauggaacgauacuaugccauuuuuuucuagauggcuuuaacuuuuagguuggugugugagagagagagagacagagacacacagagagagugagacagagagagagacagagaaauauauguauucacuguccuuggaauccagaaaagagugucagauucccuggggcuggaauauaggcaguugugagcuagcacaugggugcugggaaucaaaccuggguccccuggaagagcagccagugcucucaaccacugagccaucucuccaccccacacccucugggaagucuugaaccagagaugacaggugacauaugacuguuuccagcauuaguuaacugcuuugaaauguuguucuuugcauaauaauagagcccaucuugccuacucuuggacaagccacaccaccauguccugugccuuaaccuugagggucgugacuuucagcagggaaaacuguaaucuuccuccccagaaggagcauguuugaauacaaauucagggaagacauuugucccuagcuguugcggggaauauuugaaaaaaacaaaaugacuccaccaacucuccgugcuccugcuucucucaacccgcuaacucuccagccccgccgggccacgucguuccugcucuaguaccagcacuggugggccacaacacuauguucuuggcugggucccaccaacucugucccacauuccaguaaccaaauagacccgccauccucaugguuuaauacccaguaaucugguaaaaacaaggcucagugcuuauuaguuaaccagucagauuuauguaccaauaaauucucaguacacaagauucuaauacaaucauuucagaaccaauugauaaugacaaaagcugcccaccuagauuggacaaauuaucccaauauucuaaccuuuaugauauaagaacccguggcuggucauagcuaugaugauucacgucuacugccaucuuccuccccccccccccccccaagaugcucccugucucugcaacuauuagcucaccucccuuuucccuguccugucacaggccucccacugcccuaaugcaauaggagagggaaaauccugugacaaccuagcagcugagcccacccuaggagccuagaccaggaauucuaugcugagccagggccaaugcagauucagucuaagcuaucuuguaucagaaagaugaagggggaggcaggcaggcuuugucucacagccucccaugggugaccaaccaaacucagcacgcuccuuuaagaucuaguggaguuauccaccaaugagcccucagugggaagcccuugaaggccuuaagggagcaaugauuagagcccagacagggacuagaacgaugguucucgaaaccuguggauugugaccccucugugacauccaagaccaucagaaaauacagauauuuacaucacaguucauacaguagcaaaauuaguuaugaaguggcaaauuauuuuaugguugguggucacaacaugaagagcuauauuaaggggcauuaaggggauucuguggucguuccaaggcaucaaacuauaccuccuuccauaacccauuuccauguccuacuuucugcugguccucugaccuccuuucaaaacugccaggucagagccaccugggagcuaccccacacugcucucccuggcugaagagccugcaccucacuuuuggaagcuuucugcugagucaugaguuccucucuaggcaaagcuuuugcucuuccauauuugccuguuccguuccaucuccaacccuccucaccaccuaggccucauagucaggacgacaggcaucugagacuucugguuccugccacugggcccucaccucaucugugaagucagauagcccacuuugacccucacaacaaacuaguaucauucccaccugccaggcugggugggcaggaaaggcccugugagcucagguuccuacacagagcuaugcuacuacguccaaauguuuuaaagaaagaucguaaaacuuguucuuaaguugggaauggcagcaugaaccuauaaaccuaagacaggaggauugcaaauuugagaccaguccaugcugucuagcaagaccuucuuaaggaaagacuuccuggagaugcccagggcacauacccacauuguccaugcauaucuuugcuggaacgucaauccccaccaaucaugugaagcuucuaggacacagagagcaagcaaccaccuuguccuuugucgucuagacugugaagcacccugugugugugcagcacggaccuucugugaaguaugcccgcugcuuucucucaaagcucaucaaaaaggucagugaugggcaguggcugcuggggacaggccacauagugggguacagaguuccccaggugccagcagccccucccugcccugugguuguuguguaagcucugagucagagcuuccuugcagggggcuggugaacauggucggagaguacagaggagagcagccagggcucucagcagcagcuucuccuccuaaacuaagguucuccuuucaaccagacaucccugccagugaaugaaggaugccuccuccucccccauccuaccagucaugcgccccuguuggaaguuuguucuuacagucccuucccagcuaguaucuuguuauucucccaacuaggcugcuagccagaauccccccaaccucugcaaggcaccuuuggagggcauauccagaccugcuccaugccacucuagacagccauggagaacagcagcaggccagcuucagucagcacugaagcaagcagcugcccaccaggcucagcacagcugucauccuugcuucugcaccauucuaguccugggccucagcacccugguaccucuguagacccugguagcaccaggagaaacggggcugugaggccuggugaagccauggcuuaacggcaccaagaggcaucuugaaagucucugcauuaugagccuggggcucacaagaacagcagcaccccucuggggcaauguggcucuccuagauccaccugcccucucuccacaccuguccuugaggcacccuaccacugcacuuuuaauucuguuaauuuuaauucuaaguuguucaaaugcuggcauaccacccacucccaaacuuccccucuaaauccaauaagaugaggcuggagccuggcuccgcaguccaaugccagcccagcauguacacacggucuugacuuccaucaccagcacuacgaaugcugugaaagcuacccaauccuauucacaaagcagacagaagcaagggacggaaugguuguuuacaagagucagugugaucucugaauuaaggcugucuguucccagcaugaggcuguacccacggagccuuuggaugcacuguaugaggcguuggcagagguucugaugacccaagaguccacccagugccaccggagcuauuugcugguaugaaacaugaguguuguguugugcuuaccccuguccaccacacacacucuucucugugacugggucuaaagguguuagaugaaggggaucacacagcacggaaccugagauuggcuccuugcacuuaucacauccuugagguccccacauugccggguguggggaggucguuacuuuccauuguugagugccuucuacagccuucuaccccauaucacauucugcucagcacuugcuaugguuuaggucccaccagacauacucugaugguuuuguucauucuccuucuugucugcagccuucaggaaacucaguuacacucucugagagcacugccaucgugucccauggcaccacaggcuugguuacaugggacgcugcucucuaccuggcagaaugggccauugagaacccagcagccuucacugacaggugacccuggggcauagagcagggcacuaaggugauuggugcuggcgcaguugugaacacagguccccaucucucacucaggacuauccuggagcuaggcaguggagcuggccuuacaggccuggcaauuugcaaggcaugcugccccagagcauacaucuucagcgacugucaugcccaagugcuugagcagcuccguggaaacguucuccucaacggcuucuccuuagagccgcacacccccauugacgcaggcagcucgaaggugacaguggcucagcuggacugggacgaggugacagccucucagcucucugccuuccaggcagauguugucauugcagcagguaaugccccagcagcaacccucauuccagcaggaagaagcuguggguggagcaggcagggaccagcaggacuccaaagagacacccugggcuuucagugacgugacagcccauacuccagagcuucaggucccuguggagauagcugcucucacugcuggggcucuguccaugaacagccagcuguccccagagggcuugagaugagcaggacaggugucagggcagcacacuagguggccuggaguaccuugccacagcccccugaggccacugaguucccucccugcuccuauaugaacacuagagcaguuccacccaccacaaggacugcccuccacugcuggugacaaacagccacccaggaucuuuaggugggguagacuggccauguagccugugguccucucagggccgcauccaacuucuccaccuguuguuaguaccauccugggucauguuuaaaugagguggcaggcccaaccacacugcccaugcuggcucuaugcagaugugccaucacugugccauguggccuuggcugccaaccauuuggguccuaagucccuguccuguguccuuuagagauggcaagagagccccagccucuuaggaaacagaauggagucuuugaaagaaaggauuugccugggccacuagagucuuccuccccuaucacaacagagaucacugcaaacagcacaccccacacucaguacccucuaaaagcccaaagccaggcuaggaucugcuucaucaugaagcuucuaagugagcaagggccacaggagguuccagucuuuagaggccuuuccuccuggggccugccuuucaccugggacacuuccuaaggaacaacacacacaucuuaauacugcagcucccaagcccugcccccagagugagaccagccacccccucacaccuggugggaggcccuuucaguaacagccuuuccuuccuagauguacuguacugcugggagaugacacugucacuggucaggguccugaagaugcucgaggacugccagaggaagagcgcuccugaugucuauguagccuauacuauccgcagccaggacacaggcaagcuguucaucgaagagcugggucaguucccgaccugugggccaccauucugucaugaggagggcuuaaaaaccgggcugacauugccguugcuccucagcauccuucucuuucuguggugacauuuaccugaggcacagccuggccugcagaggcaaugggcaguuggcugccauuguuuugggcacucugcaacuagaagagaagcuaagggugauuuuagaaaagggauaaggaccccaccaucuguagaaccccaaaugacacuuuucugucauccccucuccagcaccugagauguauccaaccaucccaucucagcugugcagacacugaagcacucagguugaguggccaagucaccugggcugaguccacacuauaccccacccacucaaaacuauccccacagucccugcaugccaaccaaggcacuccacacacacacccaguacagugcgacguuauccuggcccagcucccuuaccaaagccucugcagcaacuauccacucacagccacagcaucuguggacagacggacacacagacaccccagucagcaacuauccacucaccugccgcagcaucuguggacagacagacacacagacaccccagucagcaacuauccacucaccugccgcagcaucuguggacagacggacacacagauaccccagucagcaacuauccacucaccugccgcagcaucuguggacagacggacacacagacaccccagucagcaacuauccacucaccugccgcagcaucuguggacagacggacacacagacaccccagucagcaacuauccacucaccugccgcagcaucuguggacagacggacacacagacaccccagucagcaacuauccacucaccugccgcagcaucuguggacagacggacacacagacaccccagucagcaacuauccacucaccugccgcagcaucuguggacagacacacagacaccccagucagcaacuauccacucaccugccacagcaucugugggcagacggacacacagaaccccagucagcaacuauccacucacagccacaguaucuguggacagacagacacucagacaccccagucagcaacuauccacucaccugccacagcaucugugggcagacggacacacagacaccccagucagcaacuauccacucaccugccacagcaucugugaacagacggacacacagacacccccagucagcacagacaagcaggugaacacuaccugaauccacugauggagcacuaagagcccuuccuguccuucagaugauuacacacacacacacacacagagagagagagagagccugcaacacaucuucccuaugaaaggcagaggggaccacagagcagccagccugugucugacuucaguaacucuuuauggggaccagagcacuuaccugagugguagaauacuuaucuacuaugugcacagcuggauuccauccauaauacuuuuuaaaaauuacagcuaggaggaacugaggaauuuguagaaugugugcaaacuuauacucagguggguuuuugccugugcuacucucuaaacuacuagcuuuauuuauaacacaauacuaguuaaaccaucuuggcucacaguaauugcaaaccccauaaagccaggcagcugaguuagaucauagcugaucucugcuugugccaacugacaggguaggcaggugcagagaggcaaggaacccaacaggagagguggccacagagagaucaguaagcaaaagugcuuacuuaccauacgaacaagaagacccaaguuugaaccaccauuuaaaacgcuggguuguggcuguaaguaccuguaauucuagugucgucaggggcagagacaggauugcuggggcuuagggaauaaaggggaacaugggagcagaaccucugccucuaccuuuagaccaagcgugcccacagauacacacucccauagagcaucuacccgggccuggaaaccuguggccaagcaaaucagcuugaacacacagcacaccugugucaacugcccuccugagaucucuguacucuuaucuagaccgugcuggaaucuacugggaagaggugcccccucacacuggcaaacuguucccuuacgaagagcauucagccaucguaauccugaagcuggugcugaccagucgccaugguguuugaaggugauuugaaaaaugagaugacuagccggguaugguggcgcacgccuuuagucccagcacucgcgcagaggcagguggauuucugaguucaaggccagccuggucuacaaagugaguuccaggacagccagggcuacacagagaaaaccugucucaaaaaaccaaaaaaaaaaaggaaagaaaaggaaagaagagaaaagaaaaaugacugucaugggaaagcggaaagcggaaaggcuucuguugagcaggaauguuaaauaacagcacaaguguacaguaagcacaggcugagugcuggugccuguccucagcagcucaucucgaguggacacaggcucagagcaaacacuuccauuguacaaauaaauauauacauuuauuaaguaugacuguccugucagacaguucagccuugcucagccaaacccagugaacacaggcuaucccagagcucacagcagaaccagaacgcaagggaugugacaaguccagaaacaaaaacccagggacugagaaguuggcagggacacuggaaguaacagaagugcucagaacagaagagagcugccagaucaguagccagauccuagcugucgcccacugcuguccucaggcuuaugaccacuagggggcacucaaaagccccggcaggaaggguggccacaggguggauggggccugggggucaucugugagugagcgagcagagggagcacagugugcugccagcucucaucccagcguugcugccccgacuccugcaguuucuuccggaacuggcuuagcuuuccagcagggucugggaacuuugagaaaagcaucuagggaaacaggaaaacuggaacucagcucccugcaccaggccccggccuccuugcucguguccaguggugccccuccgcucacucgacacuugauggauucaucuacucacccacagcccugcccuagagaauggcuagccuccaccugcuauucucucaguuuccccucccauccucaacacaccccugcagaugcaguuaagauggaagccuuuagugugucuaucagggacggguuggguccugcccaccugccuuuguaaauaaaguuuuauuggaacucagau

SEQ ID NO: 8082 - RNA, 1638 nt, Mus musculus
acacacacacacacacacacauauauauauauauauauauauauaugcauauauguauccacacacauguauacacacccacacacauguauacacacacacacacacacacacacacacacacacauacugaugagaaauaaucuuauuugggcaguuaaaguaugacauguauguuuuaaagaauguuuuaguauucauuuuuauuauacuucuauuaauuuugcuuugugucuucuuauauugagaggaggaggauacagugccugcgagguaauaagaggacaccuugugggaguuuucuucuacuguguggguccuaggauugacucaaguccuuaagguggcagcaggcauuguuacccacggaggcagcucaaaugaucaucuguauuguguauauaacaugcuaaaauuccuguauugcuuccugccuuguuuuuaaaauguggguuagugacacagguuugaagagagaagggggucugggguggcuugcacugugacaguuuauaaaccguccagggagaaaucaccacaugggugagggacuauccucaguuuucagaccgagagaguucggcuccucuuuucuuucuuucucucucuccuugucuuucuccccccugauucaaguaaaguaaaccagcucaaagccuauuuuguacuugaaaaagaucaaggcaguggggccgucucucaaggaccuaaaauuacauugguuacagagugaaucacaucugggcuuuaaauaccaucucaacccugcacucuuccuuuguuuuaaaguugccuaaugcuucuuccuggaaaccugggcuccccuucauucucuuaccaaaauccuucacauaagaguugggaaagggaagcugguagaggccuggucauggccuucagaagacaacuuguaucagcggccugggcaggugcucuauguguuaggaaaagguccuugcccaucuaaagaaaccucucuugaguugggacacggugcaucuacuaccccagacacuacuguguaauucuugaaauauacccuuguuuuauuucuuuuuuacaugcaucuuauacagacacagaagacauguacgccuuccucugacacaccauacaucuccuuuuuagguccugcuguguuuauagagaucaggacgaugguuuaugcacagugauguucaaguguuuauggaacauuugagccucagauguggggagagagaccuguggagguaaagcccuauuaacagccaggcuuaucucauggacgggaauagucauuuuaauaugcucaagaaaaagccagccugcugccguuuuucuacccuugcccggucuggguccacaccuugggaaggcaagcacagccacaaagaccucuuacagaacugauuaccacaaauugagucuuuucucugcuugacagugauccaagcauuggcccccacuuaauccucucuagcaauuugccuaccuccgcugcuaacaagaggugauuggagaggaauuuugagucuccacuuaacaucagcuucagggcacagugugcaccucaccagcuccuuuagccugucccaucuaaccaguaacaggccaccuuaccagcuccuuuagcuaaugggaguuuucaaacccuag

SEQ ID NO: 8083 - RNA, 814 nt, Mus musculus
ugagccaucucuccagcuccuucaccuuauuuuuaagaccuaaaccuggaacuugcccauucagcuacacugacuagccagggaacuccccaggaguggguucacaggcacaacagcaugccugucucuuuauguuggugccagugguggaacucgggucuuuguguaaacacuucaccacugagcaucuccccagccccugucaucaucucauagacacucgccgucucugcucauucgagcuauuccuugagccuucccuuccauuuucaaaagucaccuauucagcaucauauccccagaguucaucugcuccacccaacugagcaaaggcuuguacagcacagccaucagcacuggaaagugugucaccggccacauuaccagcacaaaacagagccgggcgugguggugcaugccuuuaaucccagcacuugggaggcagaggcugguggaucucugaguucgaggccagcuuggucuucagagugaguuccaggacagccagggcugcagagaaacccagucucgaaaaaccaaaaacaaaaaaacaaaaccagcacaaaacagccaucccuucucccuucaucuccccaaggagacccagccuccaauaagcugucagccacucuuuuccuuccccuuguccccucuauaaccacaagccugcuuauuagcuccacagaguucugacucuucuguucugugcacucccugcaaaugguacuuuacacugugugaccuauuggaccuggccucuuuugcucagaauauuauuuucaagguuauggugaugcgaaucgagguuccauuc

SEQ ID NO: 8084 - RNA, 814 nt, Mus musculus
gaauggaaccucgauucgcaucaccauaaccuugaaaauaauauucugagcaaaagaggccagguccaauaggucacacaguguaaaguaccauuugcagggagugcacagaacagaagagucagaacucuguggagcuaauaagcaggcuugugguuauagaggggacaaggggaaggaaaagaguggcugacagcuuauuggaggcugggucuccuuggggagaugaagggagaagggauggcuguuuugugcugguuuuguuuuuuuguuuuugguuuuucgagacuggguuucucugcagcccuggcuguccuggaacucacucugaagaccaagcuggccucgaacucagagauccaccagccucugccucccaagugcugggauuaaaggcaugcaccaccacgcccggcucuguuuugugcugguaauguggccggugacacacuuuccagugcugauggcugugcuguacaagccuuugcucaguuggguggagcagaugaacucuggggauaugaugcugaauaggugacuuuugaaaauggaagggaaggcucaaggaauagcucgaaugagcagagacggcgagugucuaugagaugaugacaggggcuggggagaugcucaguggugaaguguuuacacaaagacccgaguuccaccacuggcaccaacauaaagagacaggcaugcuguugugccugugaacccacuccuggggaguucccuggcuagucaguguagcugaaugggcaaguuccagguuuaggucuuaaaaauaaggugaaggagcuggagagauggcuca

SEQ ID NO: 8085 - RNA, 19921 nt, Mus musculus
cggcgcuuggaccgcgccugcgcaagcuguccgucauggcggcuuccugagccccauggcuaggguuccgcgugggacuucagaccagugucauggcggguaagagcccgggagagggggcgggaccgggaagaacccagggagcaucuuggcuuugagagccaagcuuacacgaccuugaagucugaacccucagccucaguuucccuuucuguaugggacgucucgguuuccgugcugggugaggcagucccacucugucucggauuaggaagggaaggagaggccggguuagcgacuggcuucuucagagugacuggccgcuaauggaggaggucccuggagccgcugacgccgcccugcgcgcguggccagcccuuuccugcaccucugagcccugcgcccuccagcuuccuggcguucccucucccagcuccuaaguuuugauuguccagugggugugcauccaccugccugggaggaggggaguucuguccaccccgguagacugguuuggggaauaacaguggcuguaacccuugaagaauucuugggaauccaacucugccgucucggaauugccuagacgaccugccagcuccccuaccggaaugaauuugcaacaugaaaccugggacugcuuuuccagcaguaccuaggagaaacuggacaccucucuauaccaugcauuuucuaaguagagaaacugucucaaggucucuagccaucuccccgggacacuuuucuauaaacaugauccuguagcuacuuacaaguuacugaugaucccugaaagggacgguugucacguuuaauccucacacaggccucagugccucccuauuuccagaaugcugauucccaggcgaaacccuuaaaggaggcucaugaccugggacuucucucucaggccacauuuccugggaaaccugcuucauucauacuuuuaaguagacgaagucgaccagagguuaguagagaauuuguuuuccaccuauauguuagacgauuugguccucauauaauucccacuuacagaaugaacaaugaacaugcauccucugagguguaaauuuguguaccauaacaacacauucuauccucuuauucauggucaguguucccaaagauggcagagaggauuuuuuggaccaaaaccaaaagccaaaucuugucuuccauucagaacuaggggagccagucuaccucgaaccaguaggugguuagggcuaggcuguguuuccucugccugaaucaugucugauuuuuguugccagugguuuugcugaaggcugaguacuucuuugauuucauucacaugaaaucccacauugguuucauucccagccccaguucacaccugcuuacccgcuuacguuuucgcuggcuuaucaugcuguggagggaaacaaagcaaacucggagaagaacuuucuggguuggcgccauugccguucccuggcacucauccauauacaaagcuccagcugugggcaguuagagcaugaagacaucugaauuaugauaauaaaauuaaaccguuuccaucuuccaguuugaaaacaaauggaggcuccuaagaguuugacucaccguaagcacaccaaccacguaggaauugucccuguaggcacuggagaagggcagguuugggccaaacacaugaaaccaaccucguggcaaagaagucgccgcuauuucacaccuguuguaauucaaagacucugcucagagcuuuucccacaccucaccccacucccacacuccugcaagguggcaauauggcugauagagcagguccagagaggaaagugauuccccccgaggucuguagcugggaggugggggaccagaguuuauaccuaguugcccagcuucgaggcccgucagacuuccgcuggugcucuguggugagguagaacaguuaguuggaaggaaagccuuccuguuugcaaccacuguggcuuggauaugguuucuaauuguaguauauaguuauauaggaaaguauuccucagagacagguaaugaaagaauucaguaguaaaaugucauguugucuucaguucacuuuuaagagaauucaaaggagaaaucauagauggauagauagauagauagauagauaguagauaguagguaauaugcuuuacuggauaagauagauaauauguauuaauagaugauugcuagauaauacauuauuaaauauauggucucuuauuagauagauggucucuuagauagauggguauauauuauuugauagucuccauuauuagguagguggucucuauuaggaauauagucuguuauuaggcaaaugaucuauuauauauagggacucuauuuuggggagcguuguuuguuuguuuguuuugauuucgagacaggguuucucuguguagccauggcuguccuggaacucacucuguaggccaugcugacuucagagccacagagcucugccucagccugagugcuggaauuaaaagcaucuacaccaccaccgcccagcugcgugucuauuauuaaacagacaaucucuacuauuagauagauggucucaguaguaaguagauggucucuacuauugaguagauagucuuuuauuagguagauguuauauuauucauagauagauguucccuauuauuagguagauguuauauauucuuagauagauuguguaacuacacauaacaaagugcuaguuuuccaucaauccaagcgguggauauaccauguuuaccgugcgguuuccccagcuuucuuggcugcuugaaaagugcaaguaguacagaccuguuaucccacuaagaucacaaacucaagcuugucugaaauacagaauaagucaaggccagucugucucaaaauaaaaacauggcugagauauagcuuagugauggagagcuugccaagccggugcaaggccuuggacggauccucagccacagaagagacaugggggggggggggggggcagggcaguauaaagggugucauccaggaagauguuccaggcuucccuuggccaccuggacuuguucuucugucucaggugcaucccaggaauagcaugggcccagccauggacgaggucaccuucaaaagugacacugugcugucagauguccaccuguacacccccaaccagaggcaccucauggugcggcugaauggcauggggcagccagguaagauccgggucugaguggagcaacuggcugccugcuggggcccuuuaucaucuucuucuucuuuuuuuuuuuuuuacauacuucuuuugggggaaaccucuucuuuuuuaaaucaaaacuucauugcaaaaacugacaaagaaaacaaaauucaccuauaagauuuaaugagacccagccaacuucuauaugucucagccaacuucuguacaguuagccauuuuguauacuucuauacagaauagccauucugacacuggggagccucacauuggauuuuaugauuucgcuauuaacuguucucucucucucucucucucuuuaaccacuuaccauccacccaaaaaaccaaaaccaaccaaacaaaaauccaugauacaguuagaacuagaagccacaaacguuacguguucuuuagugacucggguguacuucauucuucgugucacuuaagucuuccuucacugugcacugcugugcuuuccugcuguaccacauccugaccuaccaccgacaugcagaagugagcgagcccacauugucaugcaggaaugauguuggagcucugugugacuguaggccccaggcgggucaucuuauccacuugauuauugaacuccuccucggcugaagucaccuuuuggugagcauuuacaugggacacaaauaucuucacauccuuugcccauuuggagagaucuauccacauacuucuuccccagaugucuuucucaccaauuuuccaauugugaucuuuccaagugccugaccauccagccaauccauuggcuacagcccaugagucagugaauaaucguacaucuggccauuucuucuugcaaacaaacuguaauaccauguguacugcccgaaguucugcccacugugaagauuucccuucaccugugucuuucagacuuguuccagaaagggguuguaaugcugcagcuguccacuucuggguggugccugcauaacgugcagagccaucaguaaaccaggccguagucuucuccucuucggucagucgaucauagggaacaccccaugaggcuauaggcgcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcgcgucccacuuuaugacuugcagggucugauaguacccagcucaugauggguaguucaggucgcauaguaacuugguguccuauugucaaacguucaguuuccaccaaggcccaauagcaggccaagagcuguuuuucaaagggagaauaguugucugcagaugaugguagagcuuugcuccaaaaucccaaaggucuuuucugugauucaccuacaggggccugccagaggcuccaaacagcaucucuaucagccacagacaccucaaguaccaucgggucugcugggucauaugguccaagugguagagcagccugcacagcagccuggaccuguugaagggccuucuccuguuccaggccccacacaaagcuagcagcuuuccgagucacuugguaaauaggccuaaguaacacagccaagugagaugaacagguacauagauggugguacugccuugacccugugccuggcuggcucuguuccuucuuccucggcuuccugucuuuccuucugcacagacucccugauuccucuuccugcaucuugcagccaaacauagcuuuugaagaugcaaacccaaccaaagcacugcccugacauggauuccccaccagucccccaugguucuagggaacauguggccuucuagccagugugcccagccugucgcccuccccuucgugaucucugugccccuucaguaacugucccaguuggaugacacauuauaccacgcauugacaaacuacagucuguguggccaaaccugguccugcuuuguuuuuaaaaauaauguauugaaagacgagcagagcugcuuguuacuguguuuuuauggcugcagacagcugggucguugcagcagagauccugugucucaaagggcuuaugauacucguuucuuaaccugcuaaaggaaagauuugcuggccuuauaugguugccacuaugugucacacaaaauacaguuuuauuaugucggggcagagagcucacagucuguaaucaccuuguuuacuuugauguuuugccacuacaaucccuagauauaaguucccuaagaugcugcauucugguuggugucuccagcacagccgaugaucaaugcauguuuuguugaguggauggauagaugaauggacuggugggugguggauaggucagaugagugaauagaugguggguugguggauggauaaauggacaggugaguggaagaaauaaaugauggucaggguggguagaugaacagguacauagauggugguaaauagcuggauggacagugguagaugaaugaguaagauggaugaauggguggauacacagaguaauagaugauggauaguugggaaagugaauagaugauagauaauagacuggauaaauggauggauggguggaugacugaguagguagauaaguaagaugcauggguggaugaguagguaggugguugguggaugcucaaaacuugaugugggaugugguacuauaggaaccugaagcagagcuaacugacugaguacuaaaagcuagaaaggcaucccaagaagaagaaauggcugcacaaggcaguaagggcucuccucgggucuucccauguccccugcucuucgaugaugucugcagugugagaaggugguagcagugagcuggaccuaauaucaagucaguuagagaggacuggggacucugagccacugcgguucacuggccuuggccuuggcuggcugcagguggauuauuccuuauuccugggaugcaaguauggaaacaggcccagaguagacagaugccugacccagccuaggguuaaccauucugaacuccuagcucuuuuuguuucugacauaccuccccuggaacgugcacucauaccgauaucugucucagugacuuucgggcuaccugguggugagggauaggccaagagugugagugugugugacugugugugugugugugagugugugugugugugugugagugugugugagugagugugugugugaguguauaugugugagugugugugagugugugugugugugagugugugugugugagugugugugugugugaguguguguguauggugaguguguaagugugugugugugugugugugugugugugugugugugauuguuuugaccuaccauccuuaagaagcaccugaagcaccaggcagacuggauuuguauccugccuuggccauuuagcaagcucacucacccucugagccucaguguccacgucugugagauggcugcugugcucucuucacaguuacacugcagcuaaucgacucgggccaggugccugcacaggugcucacucagcagaggcugcuccaucggaagcugguggcugguggcuucugcugcccagauggucacugcuaagugcagcaagucucugcugcuuagcccguucaccccuaccuggccuuuaaaaguaucucuaguugagcugggcaugugacucugacucaguuaguaggguuuuugcuuagcacacacagcccugagucuuaacaccagcaacacauaaaagugggugucauggugcuuguguacaacccaaacacuggguuguaaaauuaagaucaggauuggaaggucacugucaucuacauagugaguuuggggcuagcuuaggcuacucggacccugccuccaaagaaaaacuaacuaucuccuguuggcagucagacuugucgaggcagaggaaaggaacgacgacguugguguugcucacucugugucucucacuuacagucuuccugucccaguucaagcucuuguggagucgggacucuuggacagacucgggggcugaggacaguggucccacagacgucuccacagaggagaugcccccugcugggucaggaaguggccacagucaugaggauuugucccuccaggcuggggaugacaacaccauccaggaaggguugaguguuccccuggacgaggauggggaccuggaugugguacgaaggccacgggcugcuucugaucccaacccggcagagcccgcaagagacaagguacaccccacgauucuagcacaggaggaagaugaccucgugggagaccaggaguacgagagcugcccccacagcaucaucaaaauagguaaauaaaggccgcgcucucuggccccugaggcagccacaguggcuguuggggcacaguagagcugugggcaucaguucugaguucagauugguucuagugagcugagaccaggcagugccacggccagcagagucuauucaaauccuauagaucaacucuugcugaagacucugcagaggcucccauugcccucuggauggaauacagaugacucagcuuaaggaggguggcggggggggggggggggggcgggcacgggacacacacacacacaggucucacucuccucucaucagcacugaccaggaccccagacccuucuuugcucuccucacucugguucucuguugggcugcacagucaccucuggugccugcuaccaaccucuacuuucuagcacgcucccaacugcccagcuccugacucagguacuacuuccugcagaaagcccugcuccugccuccagcucccugguucucuaaccugguauguggcucaggacagaguuugugagguucuuagcuggguucuaggagaaaggaagccaugggaaauugaauagccagagugugaauggagggagguaucaguucacagcaaccugaagugggccaaucaaaugggucggaagcuggggcaaugaaaggagaggugagaaggcccaaaaagggguuuugacagacacucggagacaacacugugaggccugcugucuggguucaacaggcagagcaagggucuugugaccucaaguguugugugacacucauuucugagaagacauaaacaagccccucaucccagaauagggagcagaugacagacccacguaaggacaccaccaaagccuaacuuagugagccaaugggcuuuauuuggggaagaaggguuuuaucuggcuuaugucugaucacaguccaccacugaggcaaacgaggguaggaacccuggaggaacgcugcuuccuggccugcuccagccaccaugagccacacgacccaugggcuggcggucguggacuguaugagaaaggaaugagccaguaagcaucacuccccucggucucugccuuaggcccugccuccagcuuccuguccuacauaccuccuugucuuccccuugauggacugugauguacaagcauaaaccaaauaaguuccguuuagccaguguuuuaucacagcaauggcaaagaaacuagggugcucccuccccuccagggccagaguguagaguaaguguuccagagugacuggccuccagccggugugcgccaggaacacugucuuagaagcuaacagcaaauucccaugggaaagcugccccuucuccugcuuuccuguggccuugggucuucaaacaugacuguucuucccucucagccaggggcucaccugccccaggauagcauuaaguuucugaagugguggcucuuggcugugucaccaucaccacagcacagucuucuguaacaguugccaugaguugggcucacugcucuucugccaggacaucuagccucagagugcacacagccuugagcaagcucccagucacucgcccuagagcaccgcaccucuacacagagucaaggauacagcucucucugggugcuaaugauagguuagcagacucaaaaagguugauuuaaaauuccucuucuguuucaacccgacauuaggaaagcauuuugacacauuuugacuuaauauguuuucucuugagcuagucauuuucauggcccagcuccacugacuacaaaugugugaguguuggggacauugaugagauuagcaguuucuagccauccgcugagccugaucccugucagcauggucugacuguaccagagcacaaggacagaguuaucugugugaaugcaaaggaacuggggcucagagcugcuaagggucaagucacccagggacagugaaaacucugauacucgugaguggcagucugaccgcagagccauguucugucccucaaggggagcagacuucccauacucuccagauucucucugcaucugugaaauggggugacccaauccaacucagucucagggugugcgccccaggccggcucaugugaacaugcacacauguucagugaggcagugugucucugagagguuggugggcgaacuuaguucugauucccagcugguggcgcauacugagccccagcaugccucuucugaguccauauuuugguguguuaccccuugucuuuagggcucaugccaaccuggcucccagaggcagagaaggaaggcauccaauuugcugaccuggaaacucgcucccuuuuugcugggcccugggaaucacucagacaccaggacuggccaucauccccauagcagaggccuguauaggucagguccgccucuucuucugaaaggcacaggagugguuuaguccuucagaccaacagccaaggcggagacggcuacuguuugggcuuuaaucuuguuucauuugguuuaguuugugcauguguguguauuaguguguguacacaugcacacauggggaggucaggggucaacuuugugaagcuaauucucuccuuccaccuuuguguggauuccagggacuggacucauguugucgcccuugccugaggagccgucucuccagcccuugcuuuguuugucuuuuagaaggcucuugcucuccaggccacgcuggccucacuccugcagguuuauagcugugaagcagcuugcuccucggauuuuguuauaagacuguuuuaguuugugugaguuuggcaggccuuggaaacgucucugcuguguuuguuuguuuguuuguuugaaccucacacagcuguuugcaaacauuuaguacauagucccuuggccaauuugggcuaugguaugagaccccaucucaaaaaaaaaaaaaggaaaggaaaagacugcucuugaguuguaacgucaccgcagagauaguauuuugcagcguuucuuuuucuccuucaucuuguguuuccacuccuucccaccaucagaaucuuguucugagauaguuuggacuugagaguguauaccaaucaccuaucucaugaaccuuuuauuuaaagagauguaaauuaaacuuguuagcuucuagugugguuguuagcacaagaacauacucuggaaggagcucuauuuauuauuaguauguacauauguuucaguuuuagaauagagguuuaggucgugugauacagguguguacuuuagcuggguucagaccugaugugccuuggucugugggacacauagcagucauccagugaccuaaaggccucuuaccugcuccgacuugcucccaccugcucccacugcucccaccugcuccaccugcuuccaccuuuucccaccugcuccaccugcucccaccuguucccacugcucccaccuguucccaccuguucccacugcucccaccugcucuaccugcucccaccugcucccacugcuccaccugcucccaccugcuccuaccugcucccaccugcuccaccugcucccaccugcucccaccuauucccaccugcuccaccugcucccaccugcuccaccugcucccaccugcuccuaccuacuuccaccuaccccaccugcucccaccugucagugcagcccaugcuucugcuucucuuuugguuguuuaacucugccaccugucuagccagaagggcagacacccccacauacacauauuacccccaucucuguuuucuguccacuuccauuucacaauggacacuucuuucuugguuucuauccuuuccagagcacaccauggccacgccccuggaggauguaggcaagcagguggguaggcccuguccacuucguguggccccuggagggucucuccugagccuugacucaaccuuugcuucuuuguccucucgugcagguguggcggggugcccuacuccuggcagacuauauccuguuccgaagagaccucuuccagggaugcaccgugcuggagcuuggggcaggcacagggcuugccagcaucguggcagccacgauggcacacaccguuuauuguacagguaacaacucuuuaccuguacaacagggaguagugggcccaugauuuguaccaucuguaaaaaugaacaaggucaccaccagguucucucugccccccccccauuuuuugucuaaauggcugucaacacccagucaccacagugucacccugcggucaggagaucaugggcaugcagugucugguguccuuuuucugcucacccuccagggaagagcaaaugacucaggggguccuagguugugcucuucguaggccucacacacugacuuaacauuugugucuaaugacagaaacaagcuuguucuuaggggaaagugagaagcagaagaugaaauuuacucauaauuuccagagugauucaacaguaugcaaugucguaggcacccacugugggcuagauacaguuccagagaguaagcaaguaagucccugccccagggacucaaaagaaaugugcuuguaaccauucauguaugagugugugcguaugucugcgugugugcuauaguuuccagucuuuguaauuaucgucuuuuuccucuuauauguucuccuuuuucccccaaaauuuuauuuuguuuuguuuuguuuuguuuuguuuuguuuuguuuuucaagaccggguuucucuguguagcccuggcugucaggaacucagcccuggaacucacccuguagaccaggcuggccucgaacucagaaauucacuugccucugccucccaaguaugggauuaaaggcgugcgccaccacuacccagccucccccaagauuuauuuauuuauuauauauacaguguucucccugcauguaugccugaacgccagaaagagggcaccagaucucauuauagaugguuaugaggguugcugggaauugaauucaggaccucuggaaaagcagccagugcucuuaaccacugagccaucucucuagccccuauauucuacuguuuuaaaaaagagauuuuuuuuuuugaaauuuugagacagucucaccauguuucucagcuaaccuggaauuuacuguguaaaccaggauagucuugaacucagagauaacauugccucuaccucccaaaguguggaauuagagggguguuccaccaugaccugcuuauuuuuauuuuauauuguauaguguguguguguguuaggaguauguacauaugaguacagauguccuagagggcauaagauccccuggagcugaaauuacaauugguugagagccaucugaugcggguacuuggguguucugcaaaaacagugugacaucuuaaccuugaagccaucuucccaucaugcuuuaaugcauacucuuaaggaauaacugaaaucucuauaaauaguuguauaaauauaaauagugcauacacacaugcacauacauguauacacaugcacacaaacacacucaaccaaaaucuugaaaaguauuuuuuaagaacaugguccuguggccuuaaaaauuauucuaagugacucuuaguaaggagaucgucguugccgucugucuagcccuuugccaagcacccuguccauccugugcuuuccccguuugucaucugcagcagugaacaccugcgugccucaucugacaauccuuagggugaugagugguccugggcagaaacugagcacugucuuaauauuuacauuugaaauuauaucagacucacagagaaguuccuaagauaauucagaaugugucacaugcccgucaucuggcuuccagagaugccaccaccuuaaaugagcggagcaaagcagucuggccauuggugguagcucgacgugaaacaugcuggagacaggugucuuaaccccuaugucacagugcacccuucugucauucuagaugucggcacagaccuccuggccaugugccaacgaaacguugcccucaacagccaccugacugccacuggaggugagggccagcugcagagggguggggucaggugggagucacccagcgggcccaguguuggugguggcuucucuuugcaucagaugaaggagagaugccagguguucccuugcuguagcaguuucugagcauagaugaccugcccugacaccgugacgccuuccugacaucccugggcugacggacaaguucuuucccucaugcauuuggcucauccucuuagcacuaccauaagcaugcagucuuaagucauccaccaagcugccauccccugcuaggguuaucaguccuguguguuauuucuagaaucacugucauugggcacugugaacauguaggaagagaaggggguaugggagagagugcugacagaggaacugaggagauagauaggugccugcuuagaucaugagggugggucgaggagucaggguguuucuaugcccauuugugugcagucugggaguucugucucugcuuuugcagguggcgugguuaaggucaaggagcuggacuggcugaaggacaaccucugcacagguguguguuucguguguccccuugcuuuagugacuccucuguggcaccuagaguucucagcucuuugaccucauugagccagaguccuggcuaccuccacagccccacaucuuguagaaggucucuacaggcugcugggcccuggcuauucucugaacagcugcuaugcugggcccaugaucacaugcugcgcacaccuccagggccaccguggcggaaucaguuccaagugggaguggagagaccagcacucagagaggccagggugugaucccaggucugugaccagggccuaaaccguugcccagaaagcaucgugaaugucugcaagaguuucuuccacagacgaugucagacccgauacuugcuauacagcagcuucuuuccuuucaccugucacuaagggaacucgaagugccugucaccugacaagcacacugugcugugacccuuucacccuuggccuucccagacaucuucugagagagguuuuaguaaccuuucuguaaacacaaaaacugaaauccagagugauguaaccaguuuccuggugucacauagugaauugauugggaugauugacagauaauguucucacgaggccuagggcaagugaggauggaaccaaccugccccucacugguggcaaaggccccccuuaacuguguggcugucccuagguacaagucgaccuguuucgagccccauaucuaucuaucucucccucucugucucucucucccucucccucccuuccucauuuuucuuucuuuugugcaacaaagccucauuagguagccacaacuggcccagcacucacaaagaucugccugcugagugcuagaauuaccagaguguaccagcacacccagcucagcacacccagcucaaccuugucucuuguuccgaagcuucccucagaacguuugcaauaagagcugguggccagcacaggaaggaaugggccacucagucuucucuucuuugguagaucccaaagcccccuucagcuggucagaagaagaaaucgcugaccuguaugaccacaccacugugcugcuugcagccgaaggugagacgauccugucauccuguguccuugucaucaccugugugugucacaguauccccugggguagagggcacaggggaaagcgggaauguuaaaugcuccagguugccuccucggcaguggagauggauaccuguuugccacccagaaggcuggauguacuuaacagcccacugaucugugcuaucugcaggucaggccaccccgaguauugugucuagcccacacugucccucccuagacuuuaucuucaauuuuguuucuuagucaauagggagaugucauauauacuagguagccuugugaccucuggaaugaccuagaccacaucauacccucccuuaagcccuuaagguauagaacccauuuuuauggaaaaggucacauguacuuuacagaggaguuuugaugcagucacacccuaagcuuuauugagauaauugucaccaggaaaccuuuuuccaaaguuuuacugugcuuaauuaugucuaaaauaggggcuggagagauggcucagcaguuaagagcacuuacugcucuuccaaaacuccugaguucaauucccagcagccacaugguggcucacaaccaucuguaaucaaaucugaugcccucuucuggugugucagaagagcauacaaguguacucacaaacauaaaauaaauacauaaaucuuuuuuaaaaacaaaaaaggcuaaaauaaccugcccggugacaaccuauccaucugaaccaacagcagaucaggacucugccagcccugguguuugcagggagcccccagccccuggccugcucugagucaccucuucagggagauaccggauuagcaccugcccugcagugggagguaccagcagcccagagaacgacuccuucaacuuuaucucacuaaggaggaugaguuuggugggaguuacuuacagacagacaguggcuaucuguguguccccaaugucacuaugcccaauuuaccaagcuccuauuuuguaugccuauuaguccacagcagaauugaugaagacccauguccaagcaguggaggugacuacaggcucagauacacacacacacacacacacacacacauucuaggaaggucagaaucuucaugcuugcuccauccucgcccuucugaaugucucgguaaacuguccaaccgugaagaggcuggcuuugauuuucugugguuugcuguguagaacagcuaacaguaacuuucugcgugagaccugagccaggacaagccucacuucacucuuagacacaucccggaagcaccguccagagcauuccuccucaguggcuacuguucaugaugauagggagccacuccguagugauuccgugggucccuuugaauagaucucugccaaaggugcacuuucucccuaacccccuucuuucccuaguguucuacgaugaugacuuaaccaacgcucuguuuaacacacuuucccgacugguccacagacugaaaaaugccugcaccgccaucuucucaguggaaaaaaggugagcugugcugcccugcagcugcaucccucccucgauacagucgucacugugccugucauacaccuacugugugcuggugucauacaccuacugugugcuggugucauauaucuacugugugcugggcugggcucuccacucaucucccucccugcagcugcauuccucccucgaugcagucgucacugugccugucauacaccuacugugugcuggugucauacaccuacugugugcugggcugggcucuccacucaucucccucccugcagcuacaucccccaauggaugcaggagucacugugccugucauacaccuacugugugcuagugucauacaucuacugugugcugggcggggcucuccgcucaucucccucccuguagcuacaucccccgauggaugcaggagucacugugccugucauacaccuacugugugcuggugucacacaucuacugugugcugggcugggcucuccacucaucucccuccccucacuuagucucuuuaggcacuauugucaggcuuccacacuuacacacacacacauacccuaucaacacacuaacacacacaaauacagaaacacacauguauguaacacaugugaagaaaaaaaaaaggauagacaagugaagagguucaauucaagguaaaaaauaauuuuacagauucugguguccaaagguacaaauggcggugccggagaacucugugugugcuccuuccccucuccccucccccuccccauaccccuuuaccccuccccuucuuucuucuguucucucucucucucucucucaucucucaucucucaucucugccuuugcucccagcauguucugugccccccuuugccacaacaucuugguacccaaucccauagauaguacccaguccucagcacccagccagcagaucugcccagaguccguaugcaggcacugguauccagagugccaucuuugcagcugaggucagcuuccuauaaccacaucugaaguggagccaguagccauucugggaacccaggugcccguggagggucaggaaagaauuuacucaaaggcugggugcagaguagccacuuaaaggccagccucgagacgugcacugagcaggaggcaagcugugagaugaagcagaccuuucuggucaugaugcauguguugcugcuggucaauccacagguucaacuucacacugagacacuuggacgucacgugugaagccuacgaucacuuccgugccucccuggacucauuggagaagcuggccgauggcaggcugcgcuucaugguggagccuguggaggccuccuucccgcagcugcucgucuaugaacgcauccggcagcugguagaugcagccccgugaggguggugggaagcaaggcacuggacaugucacacaccuacugugugcuggguuguggcucucugcucaucucccuccccucacuuagucucuuuaggcucuauugucaggcucggccagccuacuguccauccauggucugcccgggagacagagacgcugcaggccuaacacugugaucccugagccggcuuaaccuggucucagcagucacaaggccacagcagcucuguggcuaagucucagguucucuaugggcaguuaagacaccagaggaaacugggacgggaggagaggcgccaguuacucuccuccuuacugaagugacaucacaguuuugaggccauccccucacagcagggaacuccaggagcuagaaucuugcaucugcagucaaagcagauggauggugcugcucagcuugcuuucuccuuuguauuaaaucaguggccagcccucaggacagcgccacccacgugcaagaugagccuucccaccuuaauuuaccagucuagaaacuccgccacagacacgcacaaagguugucucucaaugauuccagauccugucaguuuggcaguuuuaaccauggugcuaaugggcauguuugcucuaaggaggcugacccucuggccaagcacgaaggcucguacuaggcucuuggcaauccagcagcaguugucgccagcauguggcagugcuccacaccucuguccauugucuuagcacacccagccaggaacuggcaaaucugggacacacagcaucuuagagccaaggcaccugcuauuccagcugcuaaacccagcacuuagaguacauuugaaaacccaaaauuaccuugaaaaugaccaggagcuggauucacagaaguccaucuggcaucuuuguucucuuugccucuuggcuauggagaugaggccucguucucaggagaggggaagacagugccaggaaggccagcuuucucacgcuccuuccuguguuccuucuuaggaaguggagcacugcagaccgcauaaggcccccaaauagcaaaacuggccaccugcuaccauuccuuuagucccuugugacaauguaacaaaccaauauccuauggcuaguuccagacuuggucuacccagccacugugccaccauauaauggccagauucucaaagacaggaaggacucgcucuggcccuggcccugcccuggugucauguagcucugcuuugugaaaccucagaaguuuuuaucucuguguguuacaggagcucuggaagauaguuguggaaccagcagcgugagucgccucugugaccucuugacuaauauuuuaacgcauuucgaauaaagacaaacccucagccaucuugcccuugagaugcugucauuuuagauacagugaguggcccuugcauggcccuagcuggucuccuggggcccaucacugccuacaacaguaacucaaauauauaauugaucaagaguguggugcuuagcacuugucacacagcuccugagugcucccgagccacuuggucaaagugagcaaaugccgccucucugcacuguuuauguccacggugugcuucccuggcagggccauggcucugccuucacuuucauacucccucugcucagaggacuggcugcucacccagcaugugugugcuccuggguuccacugagaacuacacagaggugggcugagauccagcgcgguuggcggggugcuugucuagcagauacacggcaugacaauuucccccuagcaccauguaaaauguaugugaccguacauagcugugaugccaguguuacaaggauuccacgagaaaaaacugcuuggccaca

SEQ ID NO: 8086 - RNA, 3065 nt, Mus musculus
ugcuaggccuaaaagggacaugccugggaggugagagcuuucucaccagcguggccuuuccaguguagccugaucacaagcagcaacagaguacacaaggaacgaguguaucacucuuuacacaccagcuacaaucagagcccuugucacugagaacaggaaguggguuaggauccguuagcccccaaaacaaaacaagagccagguuuugugguguagcccuggacugccaggaggcagaggcggauauguugcucugaguuugagaccaauguaggcuaacaaguuccaggccacaggggaaaggcauuuagauuccgauuguagcuacauugaugauuucucccuuucaaaaacaacuccaaaauacuaacccagggcuuuguacacuccaggcaagcacuaugccacucaaccacaugcccaaccccuuugguuuauaacaaaaauaagagccaggcaugguagugcaugccuaaaaucccaacacugggaaaacucaagcaggaggauuguccuaagugugaggccggccuaggcgacaugcagaauguggcccaagccugccucccagccaagcaugguggguuucacaugacuccgaucccaucgccugggaagcugagcgggagcaccgggagcucaagaccauccucggguacaaggcucugggucagccugggcccccugagacccucucucaaaacacuggaccaaagaagagccaccaccccaugcugggcacuguguaacucggacggcauucauaacguucuggauguugggaaggcuaagaagagccuuuuuguugguggugaagggguucugagccuaguguuuccaggcucuugaccucuuauccagagaauugaaaauaaggauugugcauaaauagcagucucacuuuauuuaggaugaaguagagugcagauuauagacagauacacagucaagacugacaacagggcaccaaagugaggcuauagccagaguccuugagguuccaugaaggacgagcagagugguugcuugauuuugauugacagauuuuaaaucauauucacugaagggacucuagccaguccgagcauggcaagcauggcucugccaggcuuugcccuucuccccaauucccucuucugugcuuuaaaaaaaaaaugguuagauuacauccuuaaagcuagcugccaaggucuauuuccuuauuuggccucuuccuccugaggcugacuaccaagguccaguuaucaaagagcugaaguccagcaaccaaaagcucccuuuggcugcccuaauuagcaugcccaauaaaaauuaaacaccucauccuaacaugggguuucccaucuuaucucuauaaacugccauuugccuauaggccaugccugccucuucucuauccagaggcaguccuuugucaccauccauccccagaaaaaauaccccuucuucucucucugugcccuuucucuucucucccuuguuuccuuuuccuucuccuccuuuaucuccuuucuuuguccguaucccugcccuuugucccucuggggcaaguuaaucuuugugcugagaacuugguuuugggauauccugagccuacuccaagguucccuacauucucuuuucuacuacguuugucccuucccauagugcaucugauuuuagucaugcauacccauagugcaucugguuuaaaucauuugcauagucauuugugcauacguaucagguaguaaguuggggauucucccuguaaguucacuugagggauaguguguccuagugcauugcacacucacaacaaguucaugauggauugggucuucuauuccucauaaggaugcauugggaauaugcuugaauagaaaaaugcccaagucagauuauuaccaggggccaagaaauguauauuuuauucugagaugggaguaaagcccaaggcccuuggggguuggguaguuucugagguugcuagaugcauuauuuggagggguguaugcacaguccagggaagggaggaucuguacugccaagugcuuuaugccgaggaugcaugugaguauaauccacaccacaaaguccuaggcuagacuaccuguuugccuugaucacuauuucuaauccaaagguaucuuccacuucacugguaccacgaguuguccucugaccuccacaugcuauguguggcauacacucacacaccgagacucaaaaauauacuuuaaaaaggaaaagauuaaaacuguucuggugaggcugggccugcuggugcacuccuguaaucucagcauuccugagaccgaggcgggaagaucuuguuugaggauagccagggcuacaugagacucugucucaaaauaaaaugauaaaauacagaaacuaguacuuacugcagaaucugauacaggcugauuuuggaggccagaggccguguugcugaggugagguccauagcacuugaguggcugcacaggcuccucuugugucuccccaggauaccaagagccaccugcucuccaagggugucuaccccugucaucuuuucuuguugaugaugguuuugagauacagcuucguauaacccagggggccucaaguuuauuauguagucaagaaugaccugagccuuugauucuccugccucccaagugcugggguuacagggacguggcaccaccuuaaccuugagugggagagaauuguucacuaaguaggcuagcuggccaaucgagacccugggauccuccaguucccacuuccucugucaccccaccuagcuuuuauguagguauuggggauugaacuccaauucucaugcuugcucagcaaguauuuccugaugaacaauuuccacagucgccuucaucugguuuucuaggcagagaaaagcuugccaugggcuggagagauggcucaggguuaagaacacugacugcucuuccagagguccugaguucaauucccagcaaccacauggugacucacaaccaucuacaguagggucugaugcccucugcuugugugucugaagagagcaauggugaauacauuacauacauaaaucu

SEQ ID NO: 8087 - RNA, 4485 nt, Mus musculus
auuguggugcauaccucuuuauuuaaucccaacacucaggaggcaaaggcuagaggauuucugaguuaagagccagucugaucuacauauagcaagcuccaggauagccaggaguaaaauaaggagauacaguucaaaaaaauaaaaacuacuaggcuggaaagauggcucagcagcuaagagugggcugcucuuccccagguccugaguuuaauucccagcauucaugauggcucacaacugucuauaauaugaacugaugcccucuucugaugugcagacucuacaaguagaaaaaaaaaacccauauacauaaaaauacaugcauuuuuuaaguaccuuaggaaaaaaacaaagcuaaaaagaauccuaggugggaccuacugaaguuaggucacugaagcauggcuucggaggauacuaggaccuacaggcucuuaagaagcuuaguuucuuuauguccuucucuauccucagcagggacaaaaacaagcacuuguuuacuguuuacuucaguguuauucacauaucgaggaguggaggagauagcccaucauguccacugaccugcugaguugguaagcauacauauacauucacauucaagugcaccccagagucaagucacaaagaacuaacccacaaacacuuucauugacucaaguguauuaaucucugaacaccaccaaguuagcacugggaagcacaggaggaaacauaucaugauucccuucauggaugucagaauaacaaauucagacagauuaacugaugccuacaaacaggcagagguggagaggacgaaggcagggacagcuauggccuaagugccuacauccuaucugggagagugaagugcuggaacuagccagcggcgaucgacagcuacgaaacgcaaggauaugcuacauguccaggacauugaaaaugguuauaaucugauaugcacauuuuaaggguuuuuugagauuacaauagaauuacauguacuuccuucccccuucccuuuccucccuccaaaccuucccuugcccuuucaaguucguggccuguuucuccuuaauauuguuguguccgugcauaugcuucuaaacacggccggcucacucugugcuugcaugugccaguuuucagggucgcccacuucacacugggugugcccuccccugaggaagacuccugcucucagaguucccauguugccuguagcucuuuguguaggccuguggugggaccccuccacacacacacacuuuggcacgucuagucuacuguuaccuguguucaugcucugcuuacuuuagagaggaccagcaggauggcucagugcgugcaggggcuugcugucaagccugacaaccugaauuuaacccacaagacccaaaugcuaaaaggaacgcaacuuggaaaaguuguccuccaaucuccuuauaugcacagugauaaacacacaaauaauuaaaagaaaaauucuuaaaggaaagaaauuacuaaaaagcuacaaagcaaagcauucugguagacaaauuacaaaaaucacgacugcuuuccuuuuaaugcagguacaauuaccuaauaagcaaguguuugcuguuauuaugaaaagcauaugcacuguccuuuagaugaugaauuuuugcuuggacacagucccucugcugcgaugacacuacaaagcucucaagugugagcacccccggaccuccuagggaucaauguagucucaggggugcugucccuaccucuguugguguacagugacuugcugaugggaaaaaauaaguucacucugggcuuuagccauggccguccagcuggugagcaugaguaagugcugggccccauuggcacccuagaagccuugcucuauguuguaagcucugggcuguguaccuuauacagcacucaguauucacugguuuugccuguucuguggugcuggggauggaacuuaggaccuuauacaugcuaggcaagagcucugucacaaaguccuagccauacccguucccaugagaaggguuuuccaucucacaaugcaauucaagguucagaaacuugucaaggagcuaaggcucagcagaacccaaguccccagaccccacauccugugcuccucugccaacccuccugccucccagcuuuacagcagcggucugccuuagugaccuuggcauagcacuccuccaacaacugccucuucacagaaacuucucgccacuauaugaugggauguccuauguuccacuaagggcuuuuuccuaaagcuuccuuuuugggccaaaacaaccuugaacuuuuucuccaccugccugugucaccaguucugaguacaggcaggcauagccaugccuuguucuaugcagugcuagggucugaacccagggcuucacauccugcacacuaaacaagcauucuacaaagugagcaccagcccagucccugguauuagcuuugucucauccauguccuaggccuucugucuaaaauccaaguguaacgagggcuaugagaggccuacuugcuguucuucaguguggccagaguuccgaacacuugugcgaaccguucccuguccaggauucggccauagcguaaggugagguagaaggucugcuugccacuguacugcuggaugcguacaaacacauccugaacccguuccugggauucugacagggguaucaugucugacacggcacaguacguguccugccgccagccccagaaggucaggugggccacucggagcagggugcccgacucguucacauacaggaugcccaccagucuccggaagaaguggcucauccaacagagcauggccagggcaaagcuggcgaccccacccagaaggcacagugaacugagggucaugaggccuugugaguagcaauagaagcccgggggcagggccaccacagucacagcugucugggccaacuucagccgcgagaggaacccaauugcucggauggcucggaaccgguagauuguauggaauguuucggucucggugccuggugacuucucccgugaguggggagaccugcuccccacccaccuuuuggaaucccccugcccagagcagcaccauagucccuguagaggccuccuccaugcagugggccccugcaaccuuggcacgacucgaaggaggaaagccuggaagagagagguucauuucagaagucacccaugcuaaucacacaaugaacaagacaaagcaucucccagaagggcuucaaccgcuccuggaaagucaccaugacuuccagaggaaagugauaaagccagacacuuaauuuuuuuuuuuuuuugguggaauucuauucuaaauagguaccuucucccauuuuuacaacuaaacaaacaaaacccuagucgcaguuagugagauagcccaucuaguacaggugcuugguaccaaaccggguaacuugaauuugaucccucaggccaacacggugaaggaagagaaauuacucacgcaguacguccuggagccccguaugccaaagcacaagcauaugcacacaaacuaaacacacaagauuaaaacaaaacaacaaaaacauuuuuaagaaccuaagcccucccccaccccaccucacagccccaaguacagggaaacacgggcagucuggagcucggacgggcccuuccuccuaggcaggucuaaaugaacauagaaaaccugucguuucagcuauucacuagagaccgggcaacagcggacuugaaggaccgcccuuccuuaagggguaaaucaaucggugucagaaccccacacaacaaagccgugggguacuuaucacaggaccucugcaguucuccgagugccuugcgcggccagagaaccucuuuguaucauuaaccugucugggaaggaagcagagacgugaggcacggaggcccucaacacacugccugugguucucuggagugagcagauucugggcuuuggagucaagaggacacuagcugugcauccuucuucacccuuccaaagaaaaccucagaauacgcugagggagacacggcucuuaagcucugaaccggguguguacguacgaaguggcagcgacgcagaccguccacgugacccaagggcccgggacaaagcaggaaaacagcccaagcuaauagacucuggccuuccacuggccgguuucccgaauggucagcccaggcguccugccugccaguccuagacccgaccggggacggggagcgcguucccuccugacauuccuaccaugagcccgccgccugcuacaggacgcacgcuguacuugucaccggaaaguugaagggcgcaugcgcgggcgguuaaaaacccgcaugcgcuaauucaaaaaaaaaaaaaaaaauuacuauggcuugggaacuguaguucaaauuuuguaaccgccaccgguguucugugaaccauuagggaaucuucccauggugccuuggaacuccagggcucggagcggaccc

SEQ ID NO: 8088 - RNA, 1144 nt, Mus musculus
ucuuuuuuccaaguccuuugcaaucccuacuugguagguuugcacucuugacagguaggcagagcuugcuuugagccacaguuguuuagcacaaguccuuggaccugggcagccacacugccccaucagcaagaucauacauguaugauucggccacaaucauguacugccuggagagcagaggcccuuuauuaggugggagaguugaaugaagacaguggggcagggggguucugugauagccacuguaggaacuggcaaggccuggaguccaccuggcacagugggagacacuggaccugcagguagaacacagcaucugggcuggcuuggaacugcuacagccaggacagcuaggggcuccagcauuacuggagccaaguggggaaagcagcucucagaagccaaguucucugccaaccugggguagacacccuuuugacacugaggguuaaagugaccagacugagaagugagguauggugcugucccuucagugggcuucacagcacugccauaaaacccaaggaugccacagggugaggaccuggcauucugcuguggguguggacagaguaggggcagccaaggguagggcaguggagacauauggugguugggcacugggaagcugccugggaaguguucuuggaaggcuguccccgagcuucuggaggacacacgugcacucuccaagaagaggcuggagagcaccccugcugcuguggccuuagguacugcgucugcuaccuagguuggucagccuggggguuaaagaggacugcagugaggugcugcuuugcuggguccucuguccuccccuccugcggugacaggaaagcagucuggcuuuaagauauagcaaauagagauggccagccaggccagugcaaguguaaacugugggaucaguugucacuuggucagcuaucugucaggcagcaggccacacugucgucuguggcucacagaggggaagcuggcuugaaaacagaaacauuaacccuuugacagaauagugguguuccuuccugccucagccuccaccacagguugcagacggagcaugucacagaagucuucaguucuaucccagguggguaacucuggguggcugcucucuuucaucaucagaugccccugu

SEQ ID NO: 8089 - RNA, 3567 nt, Mus musculus
ggggagcuuccugugcuguggauucugcuugcucucucaguucuucuucucaauauaucuucucauuucacaggacccauucacugaugagcccucauucucucuaaauggaagguaaucucuccugcaaugagggccuggcucuccgagaggggcuuaauucugaaaacucaugaaagaucguauacaaagacaagggccauuccauucgggaggccuuguuggcccccaggcagauuagaaaaauguccuaaaguaauugcagagcuugagggaccuccagagggaguggaaguugggacagggaagauguuguucaaaucaggcugaggaaaauauuuuauagaaagaaccaagccugggagaggaaagacaaggcuaccagcuucccacaugguuggaaccccaaggaaaggaguuaaaaaugucaaauuuagaugucaugacagagugauuauuguagggcucacugcaguguugggggagagaggggaggaagaggaaggugaguuuauaaauggagagaaagaaacaccaggagagagaacuuuucauucucucauugggcaucuaucuacccuguacacuucacuggccaagaaugaugaccaaggcaaguaacauuguccucacucucaggaccugaacucagcaaaucacagcugcugugaggugugggugagagcagagaggaaggugccaauuccagcuugaaggucagaugcgcuuccuagaggaagugcggaggugggaucugaauuauacagcucaguagcaaaggcauagugagggagggguccuagauaggaccagcagaugagaagaacagagaggacccaguggggaaguugggcagcccagguugaugggaagaugggaaaaugaccaccccacucuuggggacaaaguucccagucugguuagggagaugagcaaaacaaucagacugugcuuuaaccugggcuuuuguuaaaugucucuccuuuuauccuagcagcgcacacauacacauacucaucaaauagccuucuucuuguuucuaucgacacacugacacaaacagaaacugacuauagacugucuagggacugagucacaagcauccuuucucuccagagccgcaguauacacuggugccauuguuuaaauguauaaccuaaauaucuguguuggaaacuuaacacacaaauuuauguaucaaggugagacauuugggagguaagcugaguuugguaaagucaugagguugaaacccccauuauaggaugcagggaagaaaaggaagaggaggaggaggaggaggaggaggaagaggaggaggaggaggaggaagaagaagaggaggagagaucugagcugucaacucuacuucuuuuucucucuuacacuuucuuuuccugccuuccaccauagaaugaggcagcccaagguucccacccugugcugguagauuuuucaaacaucagaaccaugagcuaaguagauauguuccuugucauuuucucaaucuuagguauuucuuuuauagcaagagaaaauggaccaagauaaccuaguucucaaaacucauaaaaauggcagaauuucuuuuccucuguauuacucuccuccuuuccuccuuccuccuuucucagccucuuucuuucagaauguuucuucccgagccuggguguuaugaguaaggaaguugaucuagaaagcacagaaguagagauacagggaugggcacaagugaagggaugugugagagcgaugucuucuuaauuuaauuuauuuuagauuuuauuuaguuuuuguuuaguuauuccuuugugagagggucucauauagcuacagcuugcuuuuaauucauuauguaccagaagcaggccuucaacaccugaucuacuuuccaaaaguugagauuucagguauaugccacaccuggcuaugauuuuuauuuacuuuuuaaggcaucagggcaggauuucuucauggaggccauggagacagguguagugaccaucauauugaggucuugcaauuaaggagcuagauauagacucaacucucaagauacuuucugguuuguuuagggacagggacagacuuucuuuuucuuuccagggaaagucauucugacuuuucuugccacgcacauuuguuauugaaucaaggggaugacauuuuuuagcagaggcccagacucucugugaugcugagguagucacaugcucccugguauucuugacucuggagggaaacugucuuuuucugccuuaaaagaacuguauaaugucccacccagaggaaugugagguaggcucucugguccacugagaaucaucagaggugaggcuucagaugcacacugugcccacuccagcacuccgcccccuuacucccuuuccucucacauagaacacccaaggaaacauuguucaauacagggaggugccaagucuugagauuucagggugcuguaccugacaacaacuucuggaugaguauuuucacucgaggcuauagcuaagcugguaccauauagcuaagcugguaguguaaacugugugcucuaacugaucccacagaggaccugggaucagaaucccgaagccagacuagagguucauuucuaauauuuccuaagagcaaagaagaaaagcaggccagcacugucuggcugccagcagaaguucuuccucagcccuggcuucugauggaaagguaauauaugcgaaguccucugcaggcccuagaagaugagccuguggaguuucaaaucuggcaucagaggcuagugaggaccaaugagaacauuuugcuuuugcucagccagucucuugggcgugagauguugaagcagucuguucugauggguuacuugucuucaaaauguuauuugauguuaauuacuucuuaaaauucacucuaaauagaacagaaaauuuaccuuguuuauuucuuaacaaucucucuuucccuuuccucucuuuccucccucucccuccuguuucccucaccccaugagcacagucaccucugggagguagaagggacugugcagcucuucuggccuggaaauacauuuuacuucugaagcaucauugaugaaacagacuucuauccuucucaacugcagcaugaauggaggucucauaucccaggagacacagccacagcuggcagggcauccucagugcuguguggcuaugaagcacaguguccugcuagcuugccauggcaugcagcaggacugagaagcagggugcugugggguaccgcugagauuggggcugcuugccacaggagugaaaccucguuuacgcuggcugacugaggcauggagaugcauauuggcuguugugcaaugggcuugaaagacuucgaccuuacauggagaugcuuuuaugcugcaacuggaguagcucuaaaaugccuugagaaacuaacaucaguuucaagcagcaaauuguuaaaauugggaaagagggcuacaaacaaaggagcaaagaagaaaugggguggagguggggcagggaacgcucugagggacaugcuguucaaauaaaugucuucuaauaacuu

SEQ ID NO: 8090 - RNA, 3832 nt, Mus musculus
aggaguauggaaagcuuucccaguugggucauuuauaacuuguaaaaauguuuaauacuucaggguguggauacgucaggggaaagaguaggaaaugcacuuuguaaugucccaagugccuauguguggcaaaaagaagugucagguucgcuagugaaaacagaggucaggaauguacagaagagaagggaaaccggugugugucuggaggacagagggauguagaugguguggaagauguucacacacugugugugccagucugugcauaugaacuuguuguagcuucugcuugucacaaguaugcaccaugaucagcaucugaaucuucaaauacccagcuauguaaacucugaauggaguuuagaauuuaaguaugauugcccccauuuugaagauaaggggacugaggcuaaugcuguuauaagccucaccagcaacaaggacaacaaggcugauaaauacucaugucgcauguacccuaggaaugucugcucuucuccagggaggugagacuggaagcagaaagagauuugcuaauuugagguccccaggacuuucccuaaguguccuaugcaggcugccugguuugggguauaucaagagcuccuggggaccccuugucugucgcagucccuucacagacuagagccugcucaugccucuccccgccuggugcuugcacucagcaguagcuuuucauuucuuuuuuuuuccuuuuuuuuuuuuuuucuuuuugcuuaggaaacuuaccuucucuaauuagcaugugccuaaucuuaaauaucucuuucccaaucuccuuucuucuuuaacaguuggcaucagggcuaguaccauuaaacguauguauauaguauacuuucacagauguguggacacagucacacacauacauaugcacacacugccuugugguccucaaucaaagcucucuuaaacaccaugaccccuuucuaaaaaggaugcuauuugcaaauucacugguccuccugcucaucugcauugguuuauuuuugccaggcagacagaaugagguucagagauagggcagggaauggggaguaguuuugcauacaugauugagugcuuuagugucagagugauugagggccagcuauuaaaaugcuguuguuguaguuguuguaguuguuguuguuucauuuguuuaauugccuuagagaugcgcuccuggucauuagcaucaggauaauuguugaugcaccaacauuuguuaacuuuaucccuaggaagaguguugaucugagaugcuuccauagcacuuuauaggagcagagaguggcauggugucuaacaugucacucaggugaugcuccgaagcacacaagugucaucuguguauccccucccacccauguuccaaaccacacuucuuuucuggcauuuauguuuacagugaggugggacacacuaggcccauuuuguagaugcaaagauugagcugggaucacaagggagguuguuuuggaauuacauuuucauagaaaaauccagucauuguucucaaugcuucugaggagucuucaaacagugcccgcagcuugauuucugagaauaauucucuugguauugucaagcugauggucaaaagccucauaacauagagguuacuagagcuagggauacagcucaacuaguagaguguuugcacagcacacguguagucuggguugcauccccagcauggcaagcauaaaccaggugugcuagcacaugccugugauucuggaacucgggaagcagaggcaggaggauuaugaguucaagguuaugcccaggcaauauugugaguuggaggccuacaagagaccuagucuugaaaaacuaaaacaaaccacagaggucauuauuauauaauagcuauucugagacuauguguuucugcaagaggcgaggagacucccagggaugcugaacuaugcagaaaguggagugccucaaucaacagggccaggagcuucaccucuuuggagcuguauuucaaagcacacaaaucuccugugaaccagaaccaaacuauucacaauggacuccuuccucagauuaacuucccaaauaaggcaucagcaggcuucaggaagaagcaagacagaagcaaucaccccucaccagcuccuuuuagauaucauaucagcagaucgaugagucugcauuuuuacaaugcuagaucauuucucaucuccuguagcccugggucauggccucuuccacuuaauucucuuucacaccuuugggaaggauugaaaaugaaccuucaaaaggauauuagcauaacaccuagccaauaccacagaugccuuuuaaauuaauaagguuaauuguucuccagcuaacauaaguuugucuuuggcauuuucaauauuucucauugaucugacauuuuucuguuucaagcuuuuaaagggcuccaaucaaagacuauugauaacagagcaaauagcgaagguucagaaauguacuaauacauugucuguuuuuccaugagaaacaauuacaaacuuugaauucauugacgguuuuucauauuagccauguauaauacauugaauuguuucucuucccagucaggcuaauucuaaugaacaaacaguauugacuuuuaaaaccuguuuuccuuuuuaaaguaucuuaaauguauuaagucuguagacacagcucugaggccgcggccauuagggaagaaccccaugucagaacagaagaaucagacaggguuuuguggcucaucugagcaaucaucuuuggaaauuugauggauuuggaaagcucaaacugacaacucuaacauucacauuacccugauauuuucacuggguaggauguaaaugaauaaaaauuuuuaaagaagauauuaagucaggguuauguaggaaacaugguuguuguaaaacacaaaaagaaauguggcucggaugcuucccaagccugaggguccccaaagauguuuuuaugguugucuucagaguaugaauguuagccuuguucauuccccugauaagacauauuaaucgguagaauucaucauaguuuauaugguccugggacauuuguguaugugugcuuauuauauuuugaacugaauaucagacagaauuaggugaguuaauugguggcuugaauaagaaauaggucacaaaagucauaaauaauguucuucucaaacaguaaaagaagguaaacuauucauuuucuagccaugcuuuaagacucaaauuauguacaagcuacccauugcccacaggagaguuauugaauuagauagcuuauucauaaaggguuuccauaugaguccaucuuuaacccagugugaaugggauugaacucaugcagagggcuuccauccacaacuacauuaaucugcaucuaaaacucacguuaggacugccuugacgccguguacgauggauccaaggauagcugugugcuccaucagugguccucauuugggaguagauauucaccuccaugucacagcaguuuauacugucaugucugauccgcugcaugaggaagugcuaaugacuguauuaacuauuuccaagcauagcuacaaaacuacacguuugcuuaacaccuuucgaugauagaggaaguauauacuaugguugucuucuuguaguaugucuuuuuaauuuuguucaaugugauaucaacuguuuuaaggaaugggauuugacaugugugugcaaacugauauguacauaacucccggggcaacacaagugcccaucauacaguguaaaaaauguaaauagaggaaauuucauuuuucuaauaaagauaauuucugccacuugauaugaaaaugagg

SEQ ID NO: 8091 - RNA, 32225 nt, Mus musculus
acgggcgggcagggaggcgggcuagggagagggcggcagggaggaggcucggcagcccggagggcggaggacgccgcgcagucccagccccaagcuucaaaacagccggcgccucgccccacgcgcagcccgccacuguguccagacgcccgugcccggugaguugggggcgcgacaagggacugcggugacgucgggguuccggaaugacagggagcagugugcccucuuuaggaaucgggacaggccaggggauccgugcuugacggggaaggguuggggugcgguucgugcggcagucccguugcuccuucuccagauuucuguggcgcagaccuucccuuuggugccccccaaggccacccugccaccccuggguggcauucgccaccuuuugcguccaagugggcgggaaaagucugggaaagagucagggcggauccccucuccaccaucgcuggcccaaagcucugaacuccagaguagcccacuuguugccuguuguacucagcgucugauucccaagcaguaccaaucagacaggaccugguccucgggucccugagggccgcgcacuccuccgggucugggcuccguggcgccccacagcggcgagggggcagcuuccuuggguucuuaacggugucccagccugggggguaagcuccaaggauggccccccugccugcucuugacuacuguggcagaucugugggcuuuaaagggaagaagggauggcacccaugauuccacgggaaaaggagguauaacugagugugcaugccaagcuuggagaaggacugaagcaucuagguucaguucaggagggucccacuacuaugaggcaucuagaaccuacaaguucaaaggcaauccagaguggguggugaucauugccaggcgauggagauggcugggauuuuggacuauuuaacagguacagauuuaauugcggaugauggaacguuuugaguauagauaguagugggcgucacucaacauugcugguucauuucaggccaugugcuuguagaauuacaaaugguuuacaucauaaaugcugugcucuuaccacaaugagaggcacaaaagacgccucuagccgccucugcuugagcauuccgaaucagagagaaauuccaaaaccuagacauggaggcugaccaccucucccuggaaugucacuuucaaauaauguaagggguucaguaggauggauccaugcagguuacaggagagacccaagggaagagaauguggaaggccaaugggaguaugcauugggcuucucccgccuccucccagaaagccuuauucugggagacaccuggccuagagaccuggcagaguuagcuacucaaggcugugaagccacaccuucacccugucuuccccgugacuccacucauucccaccaggagauaccucagugggcugcaggaaauggggagagaccuuguaagagguguggguccccugcaagguauugggcagauagauacccggcccacagcccagggaggcacuagggguggccagaaagugcagaaccuguuuuuccuccaagggguuuuggaucuuuaccaccuccacccccacaagaauggagaaucagagagagccggucacacagccuggagccuucucugucccucaaaugcagaagcugagguuggccugcaaucugggcaaggguguuugugugggaagcuggggagggagccaauagggagggggagggcagagcagggcggggaggugccgccccaccaucaagagaggcccccucucaagcucacucugccccaagggagaauuuaauuguaaauacagagcauauuuauuuagcagccacacacacacacacacacacacacacacacacacacacccuccuuacagguaaugacaucuagaucccguucucuccuuugucuuaucuucaccauaggcacuaaccaccaggagggccaguuugccaguguuucuuguuuaugcccagguacauacugccacucuacugccuguggucuccuucccucuucccagagccuuccugcucaucagugaaucuacucugagggauaccacaggaacuauauaaauaccuuuccagggcacauggaauggcuugggaccuugaggcugaccaggagucaggaguccagucaccuccugggggacagauaauuguauauuugcauguugcaacgugugacugaugcccaugucuguuaucaggugggagcucugacacggguuucaaaaccaaagguggggcagcuccuucaaaaaccauggguagcucaacuggagcccaaaggugggcuugggucccugucugggauuggggagcagagucuguuggaggaguaaacuaaagguuggcagaagaucggcuggagcuggaguguguacuccucugugcuacaaggaaccagaguuugagccugaggaaagauagggucccuggggagaggaugagaagagaagguaccccugccucaccccaucacuaguaagguguugucucguucucugcagguguugccccaagaccaugauuuaggugggauguagacagccuuugucagaaucaggaauugagcacaucugacucuuguuagggccaggcccaggagagcucuaaaaauaucagaggcagggcugccacccagccagagugcucgcugguaaccugacaccucaagaaaggcuggugguugggacagauagagaugacaacagaggaccucuggauucuagagacacuugggcuccuccaggcuagccaaccugggcacagaugccugcaagggguagggggagcacucucugcauucacuggggugcgcaaaauagugaagaauuucagaacuugaauuuagaaagcuucacuuuggcagcgagucacaugguaugaguugguggcagaccuaggcuucucucuggacauaggucccagcugaggaguucaaugaccaggaaggggucuguggguucacagccucaugccacgagggacucuuguggcauaagucauuuuucuaguauuucaguggaggaauguuaggggaaacacucaaggacugggucccuuucccuagagcaucuggggauuuuuagucccacaugcugggcucaucuuggagcaggauguagggaggagggaggcuggaaagaaaccaaguagauggucccuuccuuucccggcugggauacugccuucccuuaguaaguucucauccgauuuggaacugagcuccuggccggcaccuuccuugggcagccaggcuucuguuccuuggggaccgaggucuccagaccagacagcugcuccuuucuugccaggauugacugcaccagcuucuagaagcuuccuagaucuuaggguccagagcugagugaugggucgccagugugguguuugguauuaauacuauucucagaaaucuagaugcaaaauagugguuaugaugcaggcuauagauggacagcuuagaccucauuacaaauugcuccuauacuaaggcugguuccucaguaacagaguccucauguaagauuuuccuuccuuuuaaaaaauguuauuaugcuuuucuuguauguauacguauguguugccauguacacaucucacggcacacguguaugaauguugguucucuccuucuacccuaugaguccuaggaauuggacucgggucuucaggcuagacuugguggcaagcgccuuuaccuacugagccaucuugcuggcccucaacauuuccuccuguugugcuaucaccaacccaucuugucacuuuagcuuucuuuaaaaugaaagguauuuuuaaacauuucucugagaaaauguggcaugagaugauuuuccuguagguguuacgcauuucugcuggugcccaggauaauuuuaaaauaaaaggucuauggcuugacauagaaagaagaaagacuaacuauauguucuccuugguuggcaucugaaaaaaacccaaaguggcacaugaguccauagcuucacaggugcugcaugggucagaugaaaggucaugguuuuuaaaauuuuagacacuuaaaaaaaauaaaguuguuaauaagcacaggugaucuucaaguuuggcaaaaaucuuagugcucuguggcugcuuuuucagaaggucauugucuaguggggacuggaaugaacacauuucacucauauuuaguauaacauuguaaauaguuguaugagaauuucauauauucauaugauguauucugauacuuuauuuuuauuuauuuauuuauuuuuuaguuuaaaaaaaaauuuuuuuuuuugagacaggguuucucuguguagcucuggcuguccuggaauucacucuguagaccaggcuggccucgaacucagaaaucugccugccucugccucccaagugcugggauuaaaggcgugugccaccaccgccuggcuagucugauacuuuaaaugaucuacuaguacuacuacuacuacuacgauguguguguguguguuguguauguguguguguugugugaagucacauacaugucaucaugugcauguagcagaggauaacuuuuaggaguugguucuccugcuaccaugugaauguuauuaagcagcugucuucuaugagcaaucuggcagggguaugcccuguguuccaaggcaacuaucaucuagucaggggaugcugagucaagguguaccugccauuccagagaagcuuguaguaugaugugcuaggauuuccuuaagccuguggggcugggcauaguauucuccagguagccaugcuucuggggacaguaacuacauuaugcuucaggcauuuuacagaauauuuuauagcauuaagaagaacaaguuugggcugucaagaugacuuauagggaaaggugcucuaccacagggcugcauuaaugaucuuuguuuuguuuuguuuuguuuucagagacagcaucucucuguauggcuuuggcuguccugaaacucacuuuguagaccaggcugaccuccagcucacagagaucugccugccucugccuccugauugcugggacuaaaggugugcaccacugcugcccagugcauuacugaauuuuuuaaaauaaaauuauugugaugaggagauagcuccaucagaaaacaagagcaaaacagauuugaguuugacucccaagacucacauugaaaaacaacaacaacaacaagaaaaaacaaaacgaacaaacaaaagacugaaugugcuugccuuccuagugcuggccagcagagguaguggaucccuggggcuugcugguuggccaaccuagccuauugcuaaguccagacuagugagagacucugucucaaaagaaaagaaaagaaaagaagagagggaaggaaggagggagaaguaacauguacugagguccccuggccucacacgcacaugagccacuuguaucugcacacacaugaacacauacacagauacacauacacacacauuaugcgagggacaguaaaauggacagcuggguaaacaguucuugcuguggaagcaugacagccugaauuagagucucaggauccaugguggaaaggaagaacccacccuggaaguugaccucugauguccacauauaugcucaugugcgcccaugcucaccacacacacacacacacacacacacacacacacagagagagagagagagagagagagagagaacaacuaccaaaacagcuauauaucaaagcauguacuauuuauauaaaaagaaacagaauucccacugcaugcucugugcccucauaugaauuguguuuauuaaaggaacaaugcccagaaucgagcaucaucuagauuagccacugaggaaagggaggccaaggaacugguauagcugaaugagugaagggcuuccuguuucaucuguagcagagaucugugucugaaucuuagaaagaccaaugaguuggucuuuccuucacugggggggagcaguggguuucacaggugugaaggcaggagccacacagggugcucauggcuggggguggggguggagugguucagcuggauaaaggcagucacggucaucugggaacaagacggugaguugagcugucaucuagcccugugggcaucucugugguauggcacaugguggaugcccaguacauaagauaaguucuguucuggcugcuguggauacuagcagugguuuggagaagaaagacuaacuaguacuuguguggcagucacccaagcaggugacagcaucaggauuagguguucagggguuggcagaaaucucaagcagaugggugaagacuugagucucacacuaagcauuagcuuggcauuauuuaaagcaggagaaaauggccccuacuuagcaguguuaucagcaguaaugacaguaauuaucguugcugccuuuagagcaguuugccggccacgugcagaaccucccugcacucauuuaaggguagaaacuguuauuaucucuguucucaugaaugagccugucaaggaacaugcuccaaucucacagcuugcaaguuaggaucugcugcuggggcucccgggagccaucagacacaccaaucucccuucgauucuuucugucaaaacucgacauaugcuuuuuccucuugaaauaaucuggucuuuuggguccagaauguucuuuuggucugcaaguccugaugggcauccuggaugucaaauauaggugaucucaguccuccagggcuaggauaagaugacaugucaccucuuucuuuugcuucuuagcgcacucuguauguggaaguguguguguguguuggcauguaugugcauaaggccaaaaaugaccucugcuguuguuccucagguguuguccaccuugguuuuugaggcaaggucucucacuaguuuggaaccuucuaaguagacugacuggauggccggugaaccucucaacacuuggauuauaagcaugcaccaguauucaaagccuuuuuaaaaagcaaauucuggggacugaacucaggucuuccuaugcaaggcaaccacuuuuaucaacugagccaucucccagcccgcccuuuacaagcccagccuucgaagacaguuaaugucaugagauaauguguucuuuuuuaaguccaaaggugucagggaaaccuuuugucacuauagaauaugacuuaaaguccagucggaugaccauggacccaaguaccuaaggaggcugagaacgaauuuccuagcccuuagugagcccacuaacagcaucacugacuggcuauggcugccagcaccugucuuucacuuuucccugcaggcccuauuucugaccccuuccccucucgcucaccagggucacuaucuuggccuagacaccaucgucuuucucauugauagacuauccaaacuuuugauuccuuucuauccuuuguuuuaucuucacaguaggcacagauggauuguccccaugucuguccuggcccugagagccaccuuccauacuugcccagaaguaucagaggcaaagcuggcaaguggcucucacccacucuccugagagacuucagugguuucaauugcuucuaaaauaaaggcccccccccccgccccgaaaugaggcuuugcaugaucuggcuccaaagucuuuggcuggcugcccaucagaaaccgcccagagagcagugauaaaaugcaauuuccaguucccacuggcaggagugacaucagccccuugggaggguauggccauucacaggugguuuuucaggucccccaggagugcugggcacaaacugccuccuuucucaaacucaucagcuucuguugauauucagcccuuggccaccuuuguguguggucacuggacuuuaguuccucugacucgcuuuggugguccuguggauugaacccagcgcucaaugcuagacaagagcucggucacugaacuacauccuggcccuccuccuccuccuccuccuccuccuccuucuuccuuuuuuuuuuuuuuuuucuuuuucuuuuuugguuuuucgagauaggguuucucuguacagcccuggcugucuuggaacucacuuuguagaccaggcuggccuugaacucagaaaaucugccugccucugccucccgagugcuaggauuaaaggcgugcaccaccacacccggcucguucuucuuuuuagaaguuugacacuggaucugaauugcccaggcuggcuuugaacugacagccuccagaucugagauuaugggcucuucuuaggauauccuguguccugugguauccuggaauucagcuggaaagcagacugaccucacauucuaaugcagugggaagacuggucaucuuugucuccaacucuggagcagugagauuacaggcauuuaucacccuaccugggcuaugcgaaguagacaggucccugcaggauccaacucuugguuuguuuguuuguuuguuuuuuguaguuguuuuguuuuuuaaaaagauuuauuuauuuauuuauuuauuauauuuaaguacaccguaucugucuucugacacuccagaagagggagucagaucucauuacauaugguugugagccaccauguaguugcugggauuugaacucaggaccuucagaagaagugagugcucuuaaccgcugagccaucucuccagccccuuuuguuuugagacaggguuucacuguguggugcuggcuauccuggaacucacucuguagacuaggcuagccuugagcucaaggauccaucuaucugccuucugagugcugggauuaaaggcgugcaccaccagcaggcuccagcuuguaacccccuuaccauugcuuuuacaguggcuagcuuuccuuccuuuccccugcugugagcagugggugcucccuccuuucagaggagcacauuccuuagggcacacucccuuccuggucacuuucaguggcauuguguugaguggcuagggauggcaggcacagggaccuugcuucugugucugcagaauucaugguugcauccccccugccggcacagguacacaggccuucuugggccccuggggaggagucucagaagggagggcaugggagauagcagagaugacagccaggaucagggcuguugccaccccccaccccauacacacacuucgcucugcuggggucacagcaaaccaugugacaccuguuuauauccuagagacacaaggucacucuuccaagccagggccuaaaggggcuuaaucacaggcacagacggguagaguccaaguaccugaagccacuuagagaugaucucuauaguaaacaagaaauauucaaaaacaaagguggcaugucauauuuacucuuggguguuccuaaaaugccacuagacagcaugacagagggauacaccuguaacuccucacuuggggggugaaagcagaaaucaggggauuucugagguauauagccaguucaagggcagcccgggcuaugugagauucugcuggggagaagaagaagaagaaaggaacacguguaaacuuaaccuguuuuaaagggaaaucugaacaguaagugaugcaaggggacguugacacucauggugucuacccuggagccaucacuggcugaggaccugucuucccagcugcugaaagcauggaaugacaucuauccucuggaaacugugcuguuaccccugucccaggucugcgcuuguggacacaggaguaaggcccaggcacugagucucaggguugggcaacacuagugcugcucaccuucuggaaccuccugcaggcuuggcacaggugggucuucagcaagcccagcuugcuucccuugccuccugucacuuuucaccagaggagucuuaaagacugcucccauggcacccagucuuugcugccacucagggacugacacgugcacuucagcuugccuccagucccucggccugcugaggaguccagguccacuuagcuuagcaggugcuuaccugccccaggauacuuagagacagaguugguugaagauaaaggaggugaaaacgggccagagaaagagcuugccuuccuugacaguguucaugguaggugugcaccaauggggucuugguauuagaaacauaaaacaagccaaucugggugauccagacuugcaauuccagcuguuugggguucgaggccagucugggcuguagagaaaauuccuggucagccugaauaauguagugagacagcaagaauaaagcuguagaugcaugggggcauugggcaaggacccgccuggcaugggagggccuggaauucuauccaccacagugaaaaaacaaaacaaaacucccagaagacagcauucuuuccugagucucaaaagaacacugugucugggaggcucagcuucuuuuuacauauaguauauaaaaguauaaacucuuuauaaaguguauacauauucuaaaugcaaccucaauucguaauauagagcaacugguccuuaaaauauuauuccuugaggaccagggauugcccaaugggucaagacagcugcugagccagccuggcaacccaaguucaauuacugaacuccacauaaaggaggcaggagagcgcagaccccauccaguugaccucugaccucuacauaugugccguguggcgcucgcacacccauacacaguaaucaauguaauaaaaauucuuaagggcggucaguggacaaccuucaggaggcagaguucuccuuuguccugcagaucuuagggauaaacucagucuucagcccacugccgucgcugccugcagauucccucauuuauuggagaucagccuuuugagcuacuugggccuucagcugaucagacaagaccuauccacgucuggaaaggcucucugguugcuccaaagccgauggguucaaauguggaccuuaucgcaauuaccuucucagcaauacccagacaaacuuaacacacuccagaaaaccauagcacacucccacuggaccugauagcucuggucugaaauucuccuauucaggaggcugaagcgggagaaacacuaguuuugcucaagacuagcuucaguagcugaguaagacccuaucucagaauuuauuuuuuacacuguaggucagggaaccuggagguaugguucagugguaggguguuugcccagcaugcaggcaguucaguccucaguaccacaaagaacagcagaaauggaguucccacuggcugcuucuuacuuaugucuguguggauguggccaggcacuggcuugacaaagcacauguguaaaggucagagaacagcuuguaagagucaguuuuccuucuccuguguggguucugaggauugaacuagaauggucaggcguggagcaagugucuuuacccgccuagccauuuuaccgcucccuccccaacacuuuaaugggaccaggcacguagcauuaaguaaagcaaaaucuuucuucaauuccccuucgacccuucaagaggaaaucuuggcuuggcgcuaacacauuugaaaacuucccauccacacuuggcaucuuguuuaagcagagaacuagcuggccuggcacuuggaccuucuucagcagugagggauuugucuggaugcccauagguggccuugcuucuaugugacucccagcgcgcuuuugagggcuuuccuuagugagcagaugcuuccucuuauaaagcugcaggcuucagaagugagcaaaugucugacugcucauugcacaguacuuggacauuagggacaagauguccugugggcagauguccaugugggcccgcuagggugauuccuaaacaucccuguuguccccaugacagcugccuguuccccguccuccuaaagauggcccagaugguuuacucuccuggugacugcccugcaaggguacugggcaaauaaaguuggcagugggggaaagccgggagaugggagaggggauuccaaggaguuuaugcaaaacacagcuauagguccaaagagaaugacagcaguggcccagggaacauaagcucugguugcccugaaugaugcuuuccaguggaauugguuacaugagcucuuuguagucacagaacaacaggaggucaccaaucaaggcauuuuuuccagauacacuggugaggguggcagauagguaccagaggugagcucugcaagaggucucacugucugcugacauccucggauccugugguugguggcugccacucuggcaagcuugaauguuccaagaggauucaccugacagucacaagauguccagucuaacacccaugaauugcugucaggaggacuaaagacagagcaagguaaucuagacucaccacauuccagcucucuacaaucaaggugcucucucagucagccucguggaucuuuaccauggguguggcuuuguuugugguacuucugcucucaagggucuacuuccugacuggugaugaccgcaggcccauagcauagccaggagccagcucugauaagaucacuuuuaucuaacuaucucccaguagucccagagguggguauauccaugucacccgcacuguuuuugaaugaggaaaccaaggcacaacaguuauacaauagacccauucagucuacccggcuccagucuguggcugucuauuauuauuauuauuauuauuauuauuauuauuauuauuaauuauuuacuauacaagucuuugguaaaccucugcuggugucaaucuugcuguauagccaagaauggcaucgaauucuugaucccccugccucaacuuuccaaguaucggguucuugggcauguaccacuauguauguccagucuuaugugguguugaggaucaaacacagaucuuugugcaugcuaggcaagugcuguaccaccuuagccacauccccagcccagccugugucugaaccuccuuuugcaggaguuacuuccugccacuggacugauucauggcuccuuccucuauugacuuacuaguuaaucagauggauagcugguuuccuaaaugagcugccugcaaaacccaucuauagaagugacagcucuugucccuuaugaaagaggaaguggccauuaaaaggaauucauaugggauuacuuccaagucacuaauaguaagugcucuagaaugaaaagaacauugcuaaugggugcauguacugggagcacccugaaucuggggcucacccaccccuaggaaccccuuccaagccagcccccaccacacacacacaaauaccuguaagcacccucugugggaugccugcuggguuuauugaacaguguuaauuacaggaagccccuugggugccaggggugagcacugucauugucuggggcaggaagcagucacugguagaauaacaguaauuauucaacaaguauugugugugaggucaucuggcugugauacuugucauccuggauuguugaggguaguuuucuaugauagaggagggcugaccuccacacucaaggguuuagaguaacugugcucccugcuagaaccuccacaaguauuaagcauuaaguaaacuuaacaaguauuugcgagcagccuugccacugggggagaugugaagugguuucuguccuugaggaacucugacuggaauaaagcaguguugucucugaguauccaucagcucuugcuguauaaaaaucuucccagaggguaacaacuucaacagaaaacucggcuuuuuugguuuaugauuucccaggugggcacucugggcuguguucaguugggcucugggaaggagagaaaaguuaggguuugagccucuguguacagcuaggguagggaugucuuuucuagaauagccugucuuugaaccauguggccuauuauacuucagcuagccagucugaccuuguccaggcccucaggacagaggacaaggaguggggacauaugcaccucuuaaagcugugggucagaagcugggcagcuuucuuucugccacuuuuuguagauaaacaaguagccagaucagcugggguuccguggugggacggauccugcacggcuggcuguuacuuuuacauuccugaccgaaacagcugaaggggagaaaggucuguuugacuuaugaugucagagggauuucaaccuauggcgauggggagggcguggcaauaggaguguguggcccggguuccuuggucuuaguggacugggaggcaggcaguaugaaggaacucaggaaggucaggcucucaucuucaaagacucaccccuccuuaccuccuuccagccaggcccaccucccggaucccacagugugggaccuagugaguaaacgugcuugccaccaaaccugacaaccugagucugagucucagacuuuacacacacucguucccaaaauuguccuuccaccuacacacacacagacacagauacacacacacacacacacacacacacacacacacacacacacacagacacauagacacagauacacacagacacacacagacacacacacagacacacacacacaugcucaugcucuaauuugcugaaacuauuaaccuuuuccuucauguacaugagggacucugggacucuggucucucucucucucucucucucucaauuauaaucaaauuauaauauuuuucuguuuccuuuucucccucuaaacccuuccguaugccucuccuugcucuccuucaaauccauggcuucuuuuuucacuaauuguuauugcaugcaugcauauauauauauauauauauauauauauauuuacuccuaaucagcccaugugauuuuacuguuauauguuuucagggcuggccauucuuauaggguuguccagucaugucggccuuucacaauggccagugguagggacagucauugcccucuguuaggcuuccuggaauugggguuauuccccuuuaaauguuuggcugaguuaaccagugagucaaucugggccuggggcuuuuuccccauggcugccccacagcucuucaggucuguuaagcuucugccagccggagguucagcuccuguugggcacaugcuccccuugcauagguucaucucagcaucucuggugcgaaccuuggagaccaagcuuggguguuauuuauuucacccagggccuaccauaccacuaugugcacuggcaagccacaucuguuuguuuauguacucuuggacuuccuggggcuagaaccuccuagaugcacagaacucacaguauucagguauucacaugucaccgaguaccugguauacagcaggugcccaaucaguguucauuucaugaacaauggcuccuuugggagagucugguauacuugggcaaugcacauuggcuguccuuauugcugaugcuaugguuacucugccacugggaugggagaccuacaggggugcagacaagccauucagucucugaggcuucugcacuggggcucugccaaauuccagugucccgccuguggccauuuccggacagagccaaauacuggccuuuagcuaagagccccagagugaagccugagcgugaagcuagacuguccagggucugugggcuuccacugucccuaaggcaucccagaagccucgacauucccucuggcugguguccagacaccagcccaggaggcugcauugugcucuguuuuccugaaaacagaggccagagccacucucggcuggcaugcuaagggagugcaagaggcccgggcucuaggcgccugggguggaggcacaagcucaggguggguaccagauuuccucaguuguugggcccagcguuucucuggcucacccuucccagugcuaggccaguacccguggggcaagacuauggguggaggggguuggacuugcccagaucucaccagcuaacuuaggucugccuuagaagguuccacaacuccagccugcucuugugucuaucugucuaucuucugguaaugguccuagcccaggccuuggugucaguuauagggaggugugguagaaaggaacaggagggacagaucagccauccaaacaguagauccucccuagacacuugguuucucugcacagauguggccugugccaaagccacuuccucuuggcgaaaguugagguccugggcuccugccuuggggauuauaugaaggaaggacaggaggggacccugggcugccuguagaccaguccugaguccuccccaucaacagcaccuugcuaacaguaccccacaauucuuggcaaggugagagugacgucuggagaauggugucauuggagggccagugagcccuucugugcuuuccuugguaucugaaucuguaaaggagcaggagagagaaggacagagaaacacagaaaaggaccaaggguugggucuugcucugaagccuucagaagccucaguuugucaucugugaaauggggcuaaugagcccuugcucagcuagcuucaugaagcuugauuccaagacaggcuguguaaacacagcuccacccuucaucacagggagucugguuucaugugggauggauccucuggggacccaacuccugaaaucuguucuaguuccugcaggucgugcaguucuagccgcccacagugggauuugcuggucgucccugaaguguguggauggcucagccuggggcagcagccaccgcugaggcugcacaugggaagagucuggggaggacagagccaggagagggacagaguggaaaugcccucugcgaggggugcacuuauaucuaggcuucugcaaccaaggccuggguuuuuuuuuuuuuuuuuuuuuuuaauguaggaagaacauacaaagaaguauggaaaaugaaggaacagagacaaagagagaugggcuggcauucuuggagaaaaaagaaggcaaaaugaugaccagacagggaugacaguuagcugcacagagacacuuaggugguaggagaggggcagggguguugugugaaagaggaggaaccuugagugcagcagaaaugagccaaagcuacuucagcccaguggagggagagaaccccuccugaaaguugccccugaucagcacagugugccccagcacacuaaaucaacaaagaaguuaacaggcugucaagauggcuuagcaaguaaaggugacugacugccucugguccugucuaccugccuugggaguucuggaaagagagagaaccggcucccauaguuagccucugauugccacaagcucgcugugacgggcccgugcccagggucacauguaaaauaaacaaauguaguaggcauuuuaaaaggaaguuaauaaggggccgaggagagagcucaguggugaagugcuugccuugcaagccagaggaccagaguucagauccccagaauucauaugaaaaccagucaggagcuguaaucauggugcuaaacaccucccaccucucccccuuucccaucccuuucccucuccuccccucucugucacucuccuccccucucucccuuucccuccucuacccacuuccuucuuccacccccuccccuccuaucccuucccucucuuguuuccucucucaugucuuucuucuucccuuuuccuuuuuuugggacaggccuuccuguaacccgagcuggccucagacucacuaucgaugccaccaaagcugguuuugaguucccaguccucccacaacuaccucagcacaaagcuuaacauagucauuuucuccaauuaauuguuuuaaaaccugaauggguuuguuugaaaggaugcuguguaucacuacuauaaaugguauuaugagaaagaaagaauauuuaaaaaaaaccgaacaacuaaaagauguuauuaaauucuagauaccagcauugugggguaggguggggaggcggcaauggagacaagguugacagucagcuaugccuuuuuccacgggguauucagaaaggcuagaaugugcucuucuacacuacgugaggaauuaguguuagcuaaugccacgcugguguacauccaaaaucaggcagucaggaugacccacugaguaaaaguacugacugccaagcuugaugacgcacgcugagcccacagcugaagacaagaaccaaaucccaagaguugaccucugacuucuacauugcaugguacaugugcccucccacaaauacacaccaaaauaaugaagaaaucagguuuugucuaaauaccauacucuugaaaaguggcuaaagcuuccauccguuuuuaggaguuuucaguuuuguacgugugcauguuuguuuuguguuauguucucugaagaccaccauuacagucuuggaguucuguccuggugacccggccuuugggcagauggcagauggcagugccguggcauucagccuggcuagggagcuuuuauuggaaggucaggagugcaguuauuuggagucagugugugguggcacugggcguaaugcagccuccacaaaggggaauuugucccuuaguggagaauuggaggaaucucugagccggccacuucaagaauggcugcccggaccucccugaaugucuucuguggcuuuacaucucuuggguugugugaugauuucugggcucagagacuagccggugugagcccacaagccucaaucaguuccagagggaauacuggaggggcaggcagcaugucagugagagagagcuggcagaggggguagugccuguguccagggcauauccaucagagaagccggcaggacaguuggugccacucaagcuuuugaggugagcauuucaugaaggcuggguccucacacuaucugaggacgucuccaugaccgagcuauaauguagggguacaaaucugaguagagaagccaggcccaaaagaucacaaacuaugccauucuguugucaaguguccauguagaccaauccagagacuuaggguugggugggugagaaacgauggcauaguggguacccguuucauguuagagcaguagguugcucuagaauuggggagcgguaauggagauacagcguuugaacauaaagccacaaggggcaaguuuuauuuuauucauauuuuaccacaauaaagaaucuuucccugaaaauauuaugcauguaguaacaagucuuucccuguguguguuacacaugucuguguguggacccccucacugguccuuguguacucguguauggccagagcucaguauuaguugucuucucccaucaaucuccaccuuguuuuccaagacaggauuucccgugaaccuggaguucaccauuuuggcuagacuggcuagccgacccucaggcucugaccaucaccuccccauuucguggggugggggugggaguuaacagguacacuguguccuauccacuuuucauggggaccuagacucaggccauccugcuggugcagcccccugccuacagaugguucugugacuguuuccuuuuauuaucucugguuuucuuucugucucuuucucuaucucuguguguaucuuuuuaucucucaaccucugucucugucuuucugugacacacacacacauacacacacacauacaaacacacauauacacacacauacacacacauagacacacauauacacacacauacacacacauacacaugugcacacauacacacacacauacacacacauauacacacauacacacacauacaaacacacauauacacacacauacacacauacacacacauacaaacacacauauacacacauacacacauacauacacacauacacacacauacacacacauauacacacacauacacacacauauacacacacauacacacacauacacacauacauacacacacacauauacacacacauacacacauacauacacauacauacacacacauacacacauacauacacacacauacacacacauacacacacauauacacacacacacacacacacacaaacauacacacacacacacacacacacacacacauacacacaaacacagaguucugagcucagcuccaggaucuggcacaucuaggccagcccucugccaacgagcuagaccuccauccccagagugcuuugugauuacaaaagaaaaguaagugacuucaacagaccauaaccagcugaccagcucccuaccaagugagggacagauggacacucugugucugcuggugggaugcgcugaugccacauuucuuagguagcauuccugcuaagaaaacagccugcacugaaucacgggugcgauaagucuuagcugggaacuuggugagaucucgaaucaccagggagacagaucuccggccaugucugugggauugucuucucuagguuacuugaggugggaagacauccacuuuggguggcaccauuccuugguccuucaaugcacaagaagaagagcugaccacaggcauccauuccuuuuugcuucuuugcucacacauggaguggccugucuuuccugagugugguauauaggacuuuggcuucauuucgaaguugcuuccuguucuguaugauucagauuguccuaucagaguuuaaaaacaauuacccagaaaucucaggggcugaauauccaguuuugucaaucauaaucucaauccaagguaugagguuucagugucaccuugcuauacuggcccacccaaaaugcccauccuaagggauucugggaaguguagucuuccugugagaucagagaggaaagugaaauaaaaccuaucuaccaugcauuguaugaauauuucaggagccaacauuguucaaauguauauguaaacugaacucuguggcacagcacuugggaggcagaggcagguggaucucugugaauuccaggcuagccuggucuacagugaauccuaggccagccaggacuacauacugagacccugucucaaagaacaaaaagcaaaagcaccaaaaaaauguauguaugugcacguaugguuugugauauguguguaugcaugccacuguacagacguggcagucagaggacaacuuuguggaggucaguucucucccuucacuuggaaguagggucuagggguugaacucaggucacuagguuuccauuguuggugugacaaguacuuguagauccauguguuugggcucuguugcuuuugagacagggccucguguaacucaggcuggccucuuggacucaccaugucacuaaggauuugcaauuauaaccccuccuccacuucccaaauacugggauuagaggcaggugccccaugcuuaugcaguggcgggacaucaaauccugggccuccugcaugcaaagcaagaaaucuacaggucucagcucugaaguagagagagauuugaauugaccuucacugccucugcuccacuuagauccggcacugcagagcccuccagacuuugcuauggugaaggcuccaagcaggaagaugggaagagcugucauacauuuucugagauccuguuaaaagucauugauucgaguuuugucuuguugacagguuuggauuugucucucgccaucuuugucuccucaucucucuuuggacuuccugcugcccccuuggccuucacugcccugugaacauguuggugauucuugccuucaucauugucuuccacaucguguccacggcacuccuguucauuucuaccauugacaauguaaguuccuguuccugucagccacugaggagucccuagguugggguggaguacagggagcaagcgacugugaucugggguguccuuucucuggaacaucucaucccaggcauccugagcucaggucuggaugagguccuggaagcccccaaggaugagcacagcuguccugcaguucucaguuuccacaccauugucauguggaguuagaaaacucuucuguuucucuauugaauauuuuuauuuuauucuuuaaauuuauuuacuuuaucuuauguuuaugaauauuuucccugugugcuuuugcguauaccaacugugguccgaaaaggaucuugaugcucuggaacuggaaucacaaaugguugugagcaccauaugggcucuggaaauugaacuuggguccuuuacaagugcucuuggcugaaccaucucugaaccaucucuccagcuccuauuuuacuuuuuaaauuagaauacaaaauaaguucuccaaagcuuugccugagcuaauaucuaaaauacauuaaaaacugcaaaacuuuuaaacacauacacagacauacacacucauauguacacauacacacagacacauauacucacacacaagggugaauucagcucucaugugguucuuagccuacacacacacacacacacacacacagagagagagagagagagagagagaguuaauaaauggaucaauaaauccaccaggguaaugaaaauuaaaucuccugugagauuucaccucacccuuaucagaaugacucuaucaggaacgcaaaugacaacauucucuucggugguguagccacuugugaguugccugauuccagugaacaaccccacccacacucaugcagacauguccaauuaaacucagugggucacacaacuaucagaaagaccugagaguacaaaggaauuuguuggaaagaagaggggaugcuguggggaaggaagaggagggcugagagggaggagagggcauccguguguauaugaaguacucaaagaaguuaaagaaaacaaacaagaucucccaagacuuugaggugcgagagcgugggaggagaggaugcuaggacgugagugagguagaugcaaggggaggucgugguguagggauggucaagcgcaggucaggaggaggaaagagaagagcaggagaagcaauccgcacagacuuacuuugacagugccggagugaaaccuaauacuguaugucuuuuuguuuuuuaaaauauauacuuuuuaaaaaaggauuuauuuuuuauuuaugaguacaucguagcugucuucagacacgccagaagagggcaucggaucccauuacagaugguugugagccaccaugugguuguugggacuugaacucaggaccuuuggaagagcagucagugcucuuaaccacugagccaucucuccaaccccauacuguaugucuugauuauuuucuaaauaagguaaaacuagaacugccacaaguucagcuauacuacacaucaacgagggagcacucccaaaggugcuguauccuaccacagagaugcucacacaggcaugcuuacugcuguuguauucacaauggcuaacggggugguaauucaugugaaggccaucuggugcccugcagauggucuaacaacaucccuggccuuccucacugggcaucagucuugcuugaaugcagaguugaaggaauauuuucuccagauguugacagcuacccuacagggaguaaaaucagucugcaugaccuaccuaggucaucucuuccuggucuccugcaucuucuuacuagccagaccccuguguuaggagcuuacucauggacucccaguagaucucaugaguggaacuuucuaaacucuccacaggccccuaacauauaacuuguucccccagaguccagcuggcagcuguauuauaauagcaagagaauauuugauucccucuuggccucgggcaggaagugaugcuucuaacagagaucugguccugacccaaaggcugagcuucaucucaucauuucaaacugcagagacuguuaaagggaagaaaacugcucagaaggcacaagucaguuggggaucucuaggaguguguguguguauauguguguguauguguauguguuguauguguguauguguuuaaacauacaccacacacacacacacacacacacacacacacacacacacacacugccuuccuucagcuuacucccaugcaggauaccaguucacuggguagauaacucugcccauauucagagcaggccuuauuuucuucuguuacccuuucauaucagcccucuuuggaaacauccucauagacacuuagaaguguguucagacuccccuagacaucuccuugucuaaccaaguggauggccguggucauauaucccaggaguuaacgugcacugugcauauggcacccagggcugcccacauaucuacccaguguaaucguaacagcagcaacauuaaucacuccaucugucagucugaugacccccuuggcaguauucagccuccuugugugcaucauccuggguugucugggagguagggacuugcaucugaugguucccagagaaggaauugaacccccaguugguccuggcccuugcuacacuguaguaggagguagagccaggacucgaaccaucccaggaacucugguucucaacucugccaagggauuugaacacgguuugccuguuggagagucuugcuaagcugcugaguggcccaggcuguggucacacagauaccuuggcuugaaguauuuggagcugccaaggaaagguacugaauuuuguucuagaauugucguuuuuguuuguuuccugcaucgaguccuuugagauuccggcaaggucccgagcuuagugaaaggacuggacaggccuuggggcaggaauaugcucccacacccaggcguuucuguuagcuugacacugagaggacagguggaaguguggcagcugugagacagccugugagacaggacaucuugauaccgugcugccccguggacaccuguaggcucagugggugugcaggaggcgcccggccuuuaaggcagggacaggagagggcugcugcgagggaaagcuaaggcagcgagaauauccacuggucgcgcaggacgcuccgcuuuuaguuuucauuuuaauucuuuauuguuugaauacuuuaacauuuaagcauuuauuuauauuuuuuuauuccuguggggguggggcacuuccuuucucucccucugcccuucuuuccccuuccucccucugcccuuccuuccccccucucucugcccuuccuuccccucccucccucugcccuuccuuccccucccucccucugcccuuccuucuccuccccucccucugcccuuccuuccccucccucccucugcccuucuuucccucuccccuucuccagcugggccuuucuccuuucacaguuagcacccugccucugcucaucacgugaauucaguuauguucuauuucccaccucuuccggguucugauccgguccuaaucccauggccuauaaccacacacagauacacacacgcauacacagcucugaauccaguucuucauguaagagaaacucgaguguuugucucccugagccucgcucgugugcucaccuauuuuccuccaaauguuaugauuuuauuuuuuuucuucuguguacaugugccauguuuucuuauccacccaucagaucuccuggucccuugaugucacccuuucuucuccacauuccccgugccauucugguagaacuggccuccacugacccucaggauauuucucccaugggucaugagaacaugagccaccucagaucccucugaagaccuggcaucccaugggacuuagcagagacucagaaccgaccugaggccucuugacucacaagugugcauuugaaccaaguccucaggagacucacuuguggucugcccuugagaagcagugaguccugagggcccacauugacuccuuggcccagcaggacucaggaucugcgcgucccuaaccagcggcuuccauucccuucacaggccugguggguaggcgacagcuucucugcugaccucuggagagugugcaccaacagcacaaacuguaccgagaucaaugagcugaccggcccugaagcguuugaaggugaguguggguggcuggggcaucaccauucccauauccccucccuccugagacuuggcagacccagccaggucagguccaucucagcagacccaggccuaucugcuugcucucugucccuguauguaaugcugacugagccccagaaacagucagcaguggugauaaacuggacccaucaagacagcuugcugaguccagaagcaguguuuuugggccucugcucuugguguuccaugccucccugugggaauuccuguauuacagcucuuuaaaucaggaauccgugaacuaccagcuaaaugcagcccaagaccugcuuugguguggcccaugaacuaagaaugcuuuuaacauuuuaaaagaguuguaaaaagaacaaaauccucaaaacaaaaaaagggggagaagaaauaauaauaauaauaaugugaccagaagcuuaaaguaauuuauugccuggcucuuuccuguaaaagaaaaaaaacaaaaacaaaaacaaaaacaaaaaaaaccuugugccagcuccaacuucuuccacauguaaauuuauuuccugaguaaauguaccugcagcaucagugguaaacuggugucacaagccgugaaaacaggaggaaaggcuaaauuaaaagccaaagacccucagugaagucuaacccaacugacucccucugucucuguuugucagaggccaugacacacacguggacaucagagagaacuguggggguuaguucuccauggcuccaacucagguuguccagcaugguuguggacgguggagaagccuuagcuagugagaucucucuggcccauccucuccuuacugauuuuuuugugcuaaacaaaaccaaaauuuaagcaacucaaaugcaguuguagcccauguagcugugcagggaguaguucugaaacccugcaaggauuccccaaggcuguggaagggugcacaccaccucugcaccguaguuucuagaugacuuacaacaccgaauacaaucucugcauguuguuucauugugugacccgguauggugcauggcagauucagauuuugauuucuggaacuuucuggguucucccuucaacugacacaccucagaaauaguuguugagcccaagacuacaggcacugcugcuauggggccuggcugucuuagcagguauuaugaggugguagcccugcaagcgagcccauuccugaggccuccaggaacccugagaccacagcaaggucacagcccuccccugacugacuuccugcuuuugguggccuggcuggguuucacccacacggacaucacggccaccagcagcacacucagcagcucaucgccaaggaaccuagucuaaaagcaccgagucauuucuucucacaaaaccaguuucuacaguugcuucgucacaggauaugaaucaccugggguacuugcuaaaaauauauuaucuuggcaccaaccccagaggaauggaggcugagugaggaaucugcauuuuaaauaagccuuccuagguggcuccuuggaaaauuuaauuacuaauguucaaagccacggggucacaacguuggcucacuuugaaauucccuaggagacuuuagaaguguucuccgugccugguguuccaguucauuuugucucaggaaagucugguaauauuuuuuagaauauagccaucauuuacaaacauggaaaugcauacuucuuaagggcuccuuggugcaaugaguuuugacaauucuuuauaauccuagcaaacuaccacugaaagcaaagcagaggacuuuccuaacaccccacaagguccuuuggcccauuccccucaacuccuagccagagagccccacccccccagcuuauuuaccccugauccuggacuuugaggagugauguguucuguuggagaguacguuuguuugccauaaggaaacaggaagcaggaccagguguuuucuguggggcccagaugugcagcuuaaugugagcgauacgauccauugcuguuaacgccuuacccagcccuuauaaucaaagcucccuccagccaucaggcaaacuaaaaagguugagaccuggcuguugcucuuuucccaagccaaauagguaggagcugcaauccagagcagggagagucuugguucuggcuucaucuucuguuuaaguugguauuugaucaacugccuagcuggaggagaagagcgagguagccuggcacacugccaggguggccagguauguucagucuguggcccacggagcacagugacuaggaauggggcccaacacaaugcuguggacucacuuaagacaugagcuuacccuggugucagaucucagugugaaguuuauagaugacaacccugugucacagugcccaguaguuggauggacaugcuuggcugcagacaguccuauaacccucugugugaagccuucaucuucugcccacagguuauucugugaugcaggcggugcaggccaccaugauccucuccaccauccucuccugcaucuccuuccucaucuuucugcuccagcucuuccgccucaagcagggagagagguucguccugacguccaucauccagcucauguccuguaagugaaccuggaagccgcguguacugccuguacacacaugagacagccugugcugccuacacacacacacacacacacacacacacacacacacacacacacagccaggaagugacucuuuagagcauacauuauucgaaaggggacagucugccagagcaaagccugcccuccuucuuuucuugggcuccucuaguggagggcaaacaauaaaucaauuccaaguucaggcauggccuucuggccagguggcucucaucucugagauccaucuuuccuccuccucaucucuugcacacacuaaggccaugaagucuugaguuccuucuccuucaccacuuuggacggcauguagauuuaugguuaacucagaacagacagaccauuagcaggugacacacagacuccuuccggcaaagugaagcucuucuccuauagcuugugcugcacuucugcauuguaucccaccaaaaucacugaaggagggaaguuggggaacacccagaaaggagaagcuggcacacacuccauauggaggaguuuggauuuagggggaaagggaaggugucugcaaagcuugaagccugagcuuggguaccauguguugucuggguguggaguggaaggaacaguuuggcaggcaaaagugcugggaugaagaagcagagcugugagggccggaaugaggagggcagacugaacgggcucucauaagccacggaaaggacuugaggucuguauccuaagcuggugggaagccauuaacaaguguuaggccagguccagauucuaguguggccugcaauauuucugaacccugucuuuguuccugacaggucugugugucaugaucggagcuuccaucuauacagaccggcgccaagaccuucaccaacagaacagaaaacucuauuaccuacugcaagaaggcagcuacggcuacucuuucauccuggccuggguggccuuugccuucacuuucaucagcggccucauguacaugauccugaggaagcguaaauaagugucagaagucugaccacccucccacaggguggcauccauggucacauaaccauuuuguauauaaucauuuuuuguguuuuuucuagcaaacauauuguuuccuuuaaaagcuuuuaugaagaagaagaaggagaaggagaaggagaaggagaaggagaaggagaaggagaaggagaaggagaaggagaaggagaagaagaagaagaagaagaagaagaagaagaagaagaagaagaagaagaagaagaaagaauagagacagagaaggaguuucugcauucuugggaucacaaaccagaccaugaaagcuggcauucagaaugccugccuaccaaaagucucagcaaggcccagcaagcuccacaggaugcuuuucaaggguggcucugugguguggguacggccaaagguggggaaagccagucuuugggagcagacucuuuguaggagucugcccuucccucuuccccugcccacuccacucugacagccacagguggaaugaugagggcccaaaugugggacaucuaugcucagauauuaaaccuaagcucacguaagaagugggcaaagacuggcccugguuugucuguaagagacccagaguuucccaaccccccugccaugagcuaggucaucacacuaauuuguugauguuugcuccuguuugccuuaaggauagugacccuugccugacgcagaugucauguuuaggcauuaaguguccauaggucauuccguagggcaucuaguacacgucgguucacaaaucuacuuccaagacccucagaauccuucauuaaagggcugggccugggugucugaauuucugaugagcucccugcaauaugguuaaaugcacuauaacuggaggucagagccuuagaaccggggggagcagagccaccuuguaaauguuaucaggcuaaucacaaugagauggccccacugcuagcuacgucucagccuccaucagcucuugcugccucuuccacagcugcuuacaucugggacacuugugccccauucccaggccauacaagccuggaaggugggcuggacagccuccucccugaccuacaugggaaggucucuccuuuucuucccgcccuuuuuucuaauguggaugcuuccauuaauccucuguuucuggagccuuggaagaucugucuuccauucauucauccacccauccaucauucaacaugaaugggucaugucacguguugggugcaagggauacucuuucaaaacaaucccucacgagacucacagucuagugaagagcacacgccagaaaccaauuagagaagcuaccaaccacgauggaacaucagggauucaaaaccucggggugagagggagccuacuuucucuguguucuucuaagagcccugauggcucucgauugcucugaacagagguccacuugguccagugcuaucauggguagugcccacgagguuuccccagagaauacuacuguagagcauucuauacuccccacagggagacaggaaaggauucccagagccauggcucuuaagaugguccucgaaggaaaauccagucauuuccaagugggcccugaacccugaggcuauggggaggucuucagaaguccuggaagagugacaacacccgagucccaggagcucugugauggcaaccuucucccuugaacacccuuuuccauuuuugagcaucgaguuggagaggugauucugggacaggguguguauauuuguguuguuuaaacacauucacauguaagcugccugaggggaggggauguuugccucuagcucagucccaguggagcuggggggaugaugagucugaguggcuuuagggccaucauugacaccaccucaguacaaacggacuccccucccuuccucccucucuucuauccuccuuuccuuccuucccuuagcagggcugccaaggugauaugggacagcgacagggcaaacgaucaccuguugccuuaaugaacuuuccacagcucacugcuggcuaggucguagaguuucuccuugucuugugaggcccaaggaaggaggccaaucuaaaguguccuccauaccuuccccuugggggcuuuucuguaauacuuguuuaaaaauuguucugaugaucaugauggaaacagacagaccaccuuagaaccagaggccugaaagccugaccugaccagcacagauucccacuucagaaccccagggcuauggaagugcccuuguccaacgcuaugggaauaguccuguggguugucucugcuugccacuguggccagcauuccagugccuacagccaccugugccuacagccaccugugccaugagaagugccucuccugcucuaugcccugcauuugggaugcuaagaagaggugagggugugagcgagaacagauccacccuucuccuagguaggaucagcucucaauuggugcuuaucacuaguuaucaaagaacagcagagacagcugcguuauccaagaagcaaguauuaggaccaaaaccuguuacuguauuuaaaggaacuuuaguuugcguaucuuacauuuuuauaaaguacuguaauucagggggugggguaugcaacagagacagacuaacccauguuugucauuugcauuaaaauuauuuugggucucuguuuaaagaauuuggaua

SEQ ID NO: 8092 - RNA, 3304 nt, Mus musculus
uuuuuuaaugacucacaaagggaagaaggggccagcuccagggagugugacgggagccuuuauuccuagcuguucuaccucaggcuuuuacagaacagcggaucugugauuuagaugugugaguaacaggaccugucaacuucagauaggaaaucccccuggcaugcugaagaacagcuucucuauucaccaugucugaaggagggccugguuccagccugugaaacagggaugccagcagugccacagggccaaccagaagcccaggugaagggcaacuguuuuaaaggugaccuggaacuggugaguaccaguacaagccaggcaacggugaggccucaccccaagagcuuuucuuugccuucuggccagccuguuccccaaaggcaggggcuuaacucccuggcggguccaggugucaagcagggguuucccagcuagcugccuccucccuccacccccaagcucuugcuguggggaucugcaugguaccacaguacucaccaggucucugcccuucgcccugcuagacugaaaagcagcauggggagaaccuuauucauucacacagcagguuugguccuccaugcucucuccucaccucccugaaggacuggccaugcugggauggagaaccacagccauucuaacgcuccagagaaagcccagacagugucagugugcccagagcagccacuuccucugaacgugaucauuaagcauuaggaaagccacuagaagcaugucccaggcugcaggagucacagaacucaugaagauggugugggaugugggccccugaugaccagcaagcuccaggcgucugucucagagccagugcuggguccuuucuagugcccugcuugugucuuggaacagcccuuccagcugggcuccuaacagcaccauugcuucagaggcccagaggcaaagggaauugcccaagccaccagcagcacccaggccccugccaccacagaccacaaagcagcuuucuggcuccaaaaaaguacacaaggcagaguggggagaggagggaaaagucaagccagcauggcccaucaucccucugaaaugcuugauggcuugcagaaccaccacuccuuccaaaaacucggggagcccuggccucucugccccacccucuuccuggaaguaguuguggucagagaagcaaagaaguuuccucucugucauccauuucaaauugaugcaggauggacaguuaaaaggcccaccucuccaguccaggaauggucugucgucaauuacccgucucucaguuuucuccucuguauacugggggcaacacaguacucagugucaggggcugucccuguaggaucccaucacagaaauaccagagaccaggcacggauacucaggagcggccaucuucccagucauaaaccacaacuagccuggaaguuugguccccaucacuguggguggagauguauaugauguccgacccuccccccuccccccagcaucccgaagacuucaagaaaagucagucuguauaccccacucccaacccaggacguuuggccaaagcauacgcucuaggaaucuuuguuucuuuuaaaaaaaaacuuucauaauaaaguuuauuaccuaaacuggcuguaaaaauauaaaauaggauauucugcacagcagaaaaaugaagccagagacccuccccgaccccugguuugugcaaagauacugggaauauguaaacauggagagguaggaguggaauucagguccuggccccagacacaagcugcuacaaccaggggggacccggagggagcaccaggaggggagcacccccaccccugagaggugggaugaggucuccagccagaagugggaggcaucucacccuccacaaccacucccuccgacccaggcggggagggcucccacgugguuccagaaaaauaauaauaauuaauaauaagaaauaauaaggcgcccccacuuaaugcugcggcacagcggcagccggucagaucuggaaggggaaggaacucagguagucacggaguaccggguuaagagggaugcgcgccagguucucgcgacccacggcggccacgaugcgcuggcgacacagcuccugcagcggccgcacgcggcgcuggcgcagcggggcccccaacaugcggcgcggcgccgccacguagugcuccagcagcucgaaaaggcagucgaaggucucgcggcugccguccaaguggaagcggccggccuggaagugcacgcggaugcucguggggcccgaagccaucuucacgcugagcgcgaagaagcaguuccguuggcgacugucgcgcaccaagaaggugcccacgggcucggcacgcagccgcucgugcgccccgugcacgcucagggguccccaauagaagccgcaggcguccaggagcgcgcugguccgcgugaugcgccgguaaucggagugggagcggaaggugcggaagugagugucgccaggggcuggggcugggaccgccgggcagggccggggacgcacgggggccgcuggcgaggacgaagacgaggacgaggagggcucugaccgccgucggggcucugcugccggggagaucgcauugucggcugccaccugguugcgugcuaccauccuacucgaggggccagcuggaggggugggccauagcguccggggcugcgcugaugggggagacagaggcagugagccgggcguccggguggcacaggccggccaacagaccccaaggagcgagagcggcacgcagaauccgcccggagcuugagccucggugggcucaucugcgaaguaggccguuccuguaugcggaacccuuccagacuggcgguggagcccugccuccccgcgcgcguggagaagggggcguggagaggggcccgacucccggccguccccgcugguggcuagucgccucgcggcugccgccuacuggccacgccggggacuggaacccgggcggaggaucagggcucagggccggagaggaggggcugacggcgccccgcucgagcgaggggccuccugggggagccggggcgggggugggggggcgccagaggcguggcauccucgacccugccauacagucugcgagguuaguccugccgggcucugcucccaucaccucccauccccucccgccugcucccucgcagcugccuuggcucaccuggcggcaggacgcggggagccgcggcugggggcuccggggcggcugucgcgcaugcuccggggcugggagccgugccgcugccacggccgcaguucucucugcug

SEQ ID NO: 8093 - RNA, 750 nt, Mus musculus
caaagccgggccugcugggaggaggaggaggaggaagucucugccccgaguguggccucccauggacaccaagaugcagagccuucccaccacucauccccacccccacagcuccucgcggccucaaagucacaccaguaaccagugcaaucagugcaccugcagccaccacugccggagcugcagccaggcaggccacgcgggcucuagcuccagccccagcccuggcccgcccaugaagcaccccaagccauccgugcacucucgacacucaccugcaagacccagccaccgcgggagcugccccaagaacaggaagaccuuugaagggaaagugagcaagagaaaggccgucaggaggcggaaacggacucacagagcuaagaggcguagcucagguaccugcagggcaagcggggacaagggaacacugcaaggcugcccaggcggucauggcuuaccugagcaacacgcacucaauugcuuuccagauggaguggaauggacuggggggaguggagggggagcagacagguauuaaagguccuuuuuccauuccugucuuuuagggcgaagauacaagugacgcacuccaggauguuccuguguccauuugaucccaaaaugagauagccaucacuaggggacuguugggaugaugucacaggaacaugucacugcagcaauuucuaugcaacauggauuaaagcuuguacccuggaagacuagucuugagucagcagcuuuuua

SEQ ID NO: 8094 - RNA, 6747 nt, Mus musculus
aggaaccagaguagagcaggaaacagagggacuuucccuuccuuuccaagaacaggcgucaggacuugaggacuacaggggacgcucagcaggagcuggccaaaggccccuauagcagggaggaacccuuuucccuccguguggauccucaucuuggcccuccacacccacgcuuuagggaagaucagauauuucuucuuguacuaacuguggucccggaacuugugaggaaugccuauugacgucacuggccaccaucuuuccuuaagaauguguccagagcaugugguaugugcccuacagcuaaguggaacuggucugcugucuuucugcucucugaaaucuuagggacaucuuucucccagccccaggccggguuccugcuuccugcucccagacaggaccccgcccauuuccuggauggaugggcaagagagggaaaccaucaacuuccugugucccagccuuaagaguauguaggcuucuucccagcccuggguccccacaguuccgugggccacggaggggauccagcggcuucaaggagaaugagagaaacagcugaggaaggaaaagcuucgguagcaagcaggacaaaacgaagagcaagcaaggagggucaggaccugccagaggggaggcugagagagaggaaagccaagugcaaaggucacugagcaccucagugcugaggggagagggaaagugggaugcccacaucugagguuuccccuugucccucaggaagccaccaguagcugccccuuaaauauaaagcccauacagccacuguggccucacuuucucaggcaccaacuuucgaucacguggggucuaccuagcuaaucuugugucuugcuugcuguggagugccacagacacacacacacauguacacacacacacacacacgacaguacccuuguuuuuacccucugcccaccuuccauacaucuaucuguucaugcuuuuuccaugcaguuucaagucccaaggaccucucagacacagacagaucuuggguuuguuuauuguuauuuauuuuguuuuugagauguggucuuacuauuuaacccugacuggccuggaacuuucuauguagaccaggcaggcuuucaacucauagaucuaucugccuguggcuccaggugcuggaauuacagagauguguccccacagccagcuguuuuuucaauuucucuugauuuacuaucaucauuagugugugugcaugugugugugagcauguguaagcguguguaugggugugacugugugugagugaugugugugagaguguguguauauaugugugugugaguguaugugaguguaugugugagugacuguauuugaguaugugugugugugugugagugacuguaugucaguguauauguauaagugaguguaugugugugugagugaguguauaugagugagugugugugugagugaguguauaugagugaguguguaugugugugacuguaugagaguguauuguaugugugagugaguguguauaagugacugugugugugugcaugugugugcacaugcuuugcauguagucacaggagucagcucucuggcucucaugacauccaaggacugaacuugggaugucagaugccguggcaagcagagcgucucauuugagaucaggucucauccccagccucuaccucucuagugcuggggugacaucugugacacuugggacugacccagcacuuuguucaugcuuccuucaccaacugcagcacccagacucucuuuuaaucuuuauauacacaaugggugggcacuguuaucagcuccauuauauggaugaagaaacuaagcucagagaaguuucuggaacagucccaaucacacagcuacaggggaguuaacucaggucuuggccuaggcaucuggcuccggaaccgucucuguucagucgcucuccugagcugcccuagcauggcuugcuuuguguaaucagcuggaacaaugacgcccacaguagggcaggugguccacaguagggcagguggcccacagacaaccuacuuagccuaacuggccacuucuugggaaaagugcuaaugaagucaagucuacccuugacuggguagccuucuggggcucagaaagaagacacuugguuagcaggguuucuccuucacugaccuuguccaggggauucuaagccccacacuccccucuaccugaggaaugucauggcagcucaguuaguuuauaggaucaauuucuuuucuccugacaacaccugcucagccagcaccugagauuccugaaaugcuuccccaugcuaaugaggcaguccagguccccugagcucccaguccauacuagauguuccugcccucagucccccuuuauaaagucuuuauaaaucuucagucaccguaacuaaaguugauccgacugacaagcgguccucauucacuguacccaaggggcuucugaaccccccccccccguuugaugucucugcauccaccucaggccuugauccauugcauguguacccuccuuuggccccuacauggcugcucuugaggacagugcugucagcuccagccuguuauucugacccacaggagaacaacucuagcccuuuaggccuuugagggcucuguuuccaacauuaaacuggugaaaaaaaaaucucaaaauugauucugcuguucuuuuugcucuggcugcuagaaagcucuaaaccuaccacacaacccaguguacauuaaccuggguaucagcugugcugguuugaaauucuuugccuuuauuaguuuuaaccacaguuucuuccuuucccauugauuuugucaguaaauuacaucaagucccugucaggaaguggcaagaggguaaguccacaggucacggacacauuacaagcucccaaccugggcacaguucacaagucugggucaggccccuuuuuacugucagguagccagugguuagggaguguuugucccuggccuuuagcugauaguugccacaugcugucauggugacccaagauguuucugagugacgccuaggaaccuccagaagcaaaagccugggccagcugaagacaggggacugacacagcacugcuggcccugagcagggagccuccagcugaagccacagccaaugucacuacacgguggccccuccagguuucucgacccagaacucucccuguccugccacucacagaaaccccaggcaccagaagggagcaacuaaaaggacccgguauccuuugugagauagagcauccuggagauggacuggggagcuagcugugccacccugaaaagcaauuggcuaucuauucaucuuugcaaaacagcaagacaauuuuauuuggaacuaagcaauaguacagauuaaagaaagauugguaacagaccaugucagggaggauacucaagugcuugcugucauuuuaaaugggugaauuguagcucaauaaagcuauaguguuuucucuuugcuaauaggauaaggagguggaagaugaucccagggcacuggcugaccacaggugagccuugacuucucugucuguagaugggcaugaagugguucuuuggucuagaagauaggguuggggugaggaguguccugccagagccagccugagaugucuguggagcuggggguccagcuucugcguguguccucucugcuuccccuuucuuugccugaauuccgccaaggcugguuucaggaaggaggcaaccccgaagucagaacccuaaccaccuuguccuagaaaggacacuaaagccuuuccugugucugagcgccaggcccugauucaugcuccagaccugaauguggccugccauuucugguauuaagacaacaggcauugugaggcauaccuguaacccuagcacucagaagaccgauucagaagguggcugugaguuugagggaugggcuagagugagaucagccagggcuacccagcaaaaucuugucucuaaaaacuaccuaucugauuagauaaauagaugaauaaaugaaugaaugaacgaaugaaugaaugaacgaaugaaugaacgaaagauggcaagugguccuccaagucuauuuccacugcuacuguuggcuuugaggaucuuagggaauaccacuaaugacugccacuaauccugcaugguaauccaggcuggcggggcugugugguaggaacccacaaagaggcgagugugcaagaagcuguggucauacaauggcccuucagaagcugguccccggggaaagcagaggaucucaaucaacaaggccaaagaaagaaaugucugucuccagucaggccccacccccacaggcucagggccaagaaugcagccaacaucuauuaaguuucuaaaauuaugccuaggcuggggcugggcacaucugaggauuggaauaggaagugguagaugagugggcaggcaggaaacuugcaacccggccccuccagcaucaggugagugccuaguuccggguagcaggcagggaacgcccaccuacagauguuacagaaaacuaaaagcccucuguggauggucaucccagagaaguuaacucugucacugcccucucaggucauugcagcuuuccacagaacagagaaggcaugggaggauguccucuagcugcccaauugaaggaagauuugaaagagaaaacagugucaaaaccagugagugcaggcagggucacucugucagguuguacagguuguagauggcaggacugaaaggggacacuuuucuugauaacacccuuauccaagugcccaaaccuucugucccucacugaaucuaagguggcagcaagcagguucagggagguccucaggaugcagggcagucuauuucuuggcauguugugcaguuccguuuguugcugcugcuggugcugguguguauguaaucauuuuuuccugugguuaagguuuuagggugcauacauguuauuagacgcguucucacgaccggccaggaagaacaccacagaccaaaaucuucugcggcaaaacuuuauugcuuacaucuucaggagcaggagugcaagaagcaagagagcaagaagcaagagagcaagaagcaagagagagagaaaaacgaaaccccgucccucuuaaggagcauucuccuucgccucggacgugucacucccugauuggcugcagcccaucggccgaguugacgucacggggaaggcagagcacaaguagucauaagauacccuuggcacaugcgcagauuauuuguuuaccacuuagaacacagcugucagcgccaucuuguaacggcgaaugugggcgcggcucccaacacauacagagcaaaggugcuucacuucugagcgccaucacaccuguucucauuuguuccccucccucgcugagcccaccccuccaccaagucccuuucuucuuccacacaguguccccucuacaauccaucacccugccacccccuuuccuugagagcucuuuccucuuuuuucccuuuucccagccagcaaacacacauguauaaguagagacauaagugcacacauauagauaggcauacauguacacauuuaugauagggauaugugcaaacaugucgauacacaugcacacauguagagaaaaauauacaugcacauauauagacauauacacacccauauacagagaggcauacgugcucacauauaaauagacaugcacauauauuuagauauagauagagacauacaugcauacuugcuuuguagaucaggcuggccucaagcucacaaagaucugcuugccucugccuccuaaaugcugggauuaaagggaugugccacuaccgcccagcuucaccaagucuucuuuucaggaauucacugaaacaucuuaugaaaacucacaccagugucuuccuucagagaacccaggcuccagcuguggcuaccacauaaggguuuuuaauacaagaaaaauaaaguaauuaagucugaaaaaauagauaggugcacuaaugucccuuuaaugagauaaggugauuugccuccccagaaccccggccuccugguaguuucuuacaaugugaccacauccaccugugugagugcccacgcuuucugaauuacucagggaaguguaaccucucuucuuucugucucuucucuaggcaugccuuccuaauacuuugggcuuccucacuguaaggguuagcuuugucagcuugacccaaaucagggucaucugguaaagggaaccucagcugaccaaaugguuccauuagccuggccuguggccaagucugugaggcauuuucuucauuagugacggaugugggaggggagggcccagcccacugugggugauacaggugggccugggugcuguaaggaagcagccugagcaagcugugaagcaagccaguguccccuguagcuucugcucccauuccuguccccggguuccugucuagagcuccuacucgacuccccuuggugaccugacaucuguaagaugaaauaaacucuaaguucuuugccuacauugccuuugguuuguguuucaucacagcaauaggaugcuccccucccugacaugugacugcccuuugugccuuuuaacuccagcaggaagaccggugguccccuucuccucccuguucuccaccuuccagcagcugcagagguuuguagcucaccugcccucuaauaaaguuguccuccagcuuccgucua

SEQ ID NO: 8095 - RNA, 14043 nt, Mus musculus
cagucaagccaaagccaccgaagcagcccuaagaaagcugcucacagcaaagaucugaggccccaaggaaugagccaucuuggaagauguaagagcguaagucagaaauguuggcacaugccuaaaaucaaaccacucuguacauagaggcaggaagauuacaagcucaaggccagccuuggcuacauaagacuaugucucaaaaaaaaaaaaaacaaaaacaaaaaacaaaaaccacuggguguaaaacuccugugaccaagccuaacacagcuguuccagguucaugaauacaguauaucuaaagcucuuagcaagcuagggcaucuacaucuuauggauuuacaucuuauagacgaggaaauuccagcuuggaaacgguauguguaaguccuaagucucacaguggccaaauguuaauguugggcucuuacguggcuccaaucuuuugucagagcaucuucagugguccacuggcuuuagccccaucuuguuucacuagccccugucccuuggaagccccgaggcuuggguccagagaacaggacauucugagcugagaucaaagccuugagaugggucuggggaacagcucuugccugaucucaaagcagccccagccugauagauacaugguggcugugaacacaugacugaggcugcauuugcucuugggauguggggaggagggacugugagcaaaugucuacuugccucaaaugagguacagaauagacggaaaagcaauuccauucaagucuagcuugguaaaccagugagcuuauuuggcuuucugacggaagcauggcugagggguuccuuacaggagcgcccgugaucuccgucccucaucacagaaaagucucaggccagcauggguacugacuuuccuguagcuguucagcugaucuccuuucagacaaucuuccaucuucugaacacgccagagcagugguucucagccuuuccaacgggcagcccuguaguacagcuccucauacuguggugacccacaaccauaaaauuauuuuccuugcuacuucauaacgguaaguuuugcuacuguugugaugcauaaucugauaugcaagauggucuuaggugaccucuggaaaggguuauuggaccccaccccaaaggagucaccacccauaggcugagacccucuagauccuccagagggucaggaauagcuggggcagaggugcaggacagaguggcugggaccucagaugagaauguaaugacucuucccaucccuuccaucuguaaaaggucacaggucucuucuugaagaucucuugaggauaguagcaacugcgcugauaaagauggcaaugucuguuaugcuggaggacagcaguccaccacaugcagggauucaucuccacugugacugacaguuauccaaggaugaggacguccucuucucuucucuucucuucucuucucuucucuucucuucucuucucuucucuucucuucucuucucuucucuucucuucuccucuccucuccucuccucuccucuccucuccucuccucuccucuccuucccuucccuccuuccuucuguucucuccuccucuuuuccuuuagauaaagucuuauuacguagcucaggaugguccaaaacucucagucuuccuggccucgaguccccugccagacgacagauguggguuaggcaagcugcacuucugcccccucaguuaugguucuggacuauggaggacaaacgcagggcuaagagccuuuugugaaauacacaagacuacuggcuaugcuggcgaugcagcuggucagcagaggccugccuagcaugggcaaaacucugguucuacucaguuaaacaccacaaaaacuggggccugugguacaagccugaagucucagcacuugagcaaggaggaaaguaagcaauaccuguuuaacauucagugauuuuccccgaaauagaaccauuuaaaaagggaccaguguguuacugucaaaaaugagaaagcaacaucuggcucauaagacaaagggaaccgaggcauaaaugcuuagaaaacaacaccuguagcucaggagugucagcugucugagaugggccaggaagccuucucucuguauguaagaggcagaacccgccacagauaacacaaugaagcuggcuauucagcauucagugaggccugagcuuugcuuuuuguuucgcagaaggggaaauucucuauguuccaccuagccucauucuguagaauucaccagcgguucuccucucccuggccaggaaacucccugugggcaacuaaguuucacuuuguuuuuaggcuuaagccucuccugggaauuccugggaggcagcugaccggcucagccuccuaauugcuggcugugcaggaaggcccugcugcagggugucuccucccaggccucucucucuacacccagccccagcaagccacgucuugucccagugccucuggcguucuggggaagugggcacagggccaggccggcccacagcaggcccagcugggccccagcgagcccuuaucuuucuuguuaaugaaaaucugagaaccuccagccagucccacugggaagacccugggccagaugucaccauagagaaagaaggggcccagagagaggaugcggguugccagaggagagcaagacauccugccugcuugucacggagagagaguaagggccuggguaaagcaggcuccuggcuauaagugcagggcucccagcugcccccguggcucaaccacaggcaagaugccugcagccucugccaccuucaguagcugacuuacccacugacugcucaaaguguguuuuccacuuaucacccacuccugggagcucauaagaaaagcaaaaucuaggccaggcggugguggcucaugccuuuaguuccaacacccaggagacagaggugggcagaucucugugaguucgagaccagccugaucuacagagugaguuccagaucagccagggcuacacagagagacccuguuucaaaaagccaaaaacaaauaaaacaacaacaaugacaacaaaacagaaucucagguucaaagcaacuauugcauugugacacucucuugggugacuuugaggcauauacuuguuuguacuccaguguccucaucuguacauuagggguuggguuugggaauaugcaguguuuaguaaaguaaucaauucauucuaagugccagacuggcacuuauguagcccaggcaggccucaaacucaaaauguagauaaggaagaccuuugaguuccugauucugacucuaucucccaaauacugagauuauagaugugugcugcuguguccucucuaugcaguccuggggaugaaacccgguccucuugcaugcuagacaaguguucuauuagccugccacuuuugaaauuaguccugucuauuauuguuagcaccagcgagguaacagagcuaucuggguuucugccagucacugccuuucucaccaucuccaacagugggaugcaggagacccaccaugaagccgaggagcugaggcucagagaggugaagucaccggccaaaauccaaauguggugaucugagucuucucuaaacuuacccauguuaguaagguaaccagugagcagguaggcguccuuccccugugcccauuacuugauggguucccaguuccaugagguuuguuugcugaugaccccauuuuucagaugaggaaaagugagacacagagguuagguuagcccuccaguaggcaaggcuagauuugaagucauuucugugguaugcugcucaccucuccccacguccuccccucagucauauauauaccugcucguguuuaucucccugccagccccagcucuggaguucuggaccuaccuauuccaggccuagaccacuaaugagaggcaggagcucugaggacgcacagcgaugggcaggucugugaacaggagcuguucagagccaucaggcucuaggcucuacggcagcuggcccagagcccugcuuccuucugccucucuacaccaaagccagcuuacuuccucagcccaguccuucagcagcagagacagccuugccaucuuacuauucauucauuauaucuuauaaagagccuacuguguacugacuguucuguaggcucaccagugaacgauucagucuuaguccugaaacggagacugaaagcuaaugagaugcccuuagaaaacacgauuucccaauggacaugaaaguccauugacugggaaagagagcaagggugugaagcugagaucugaaagaugguguggaagaacguuuaagauaaaagaaaugacaugggccaaaggaugagagguauggaggggaaucacucugcugaggugaagugagggaguucccacacuucagcuugugugcaggaccuuaagaaaguuagcagucccuagcuucccagcucccagggggauaucccagucuuaucugccccaaccaaguuauuucuuccuggcuucccaaguaccuugggccucagaggucuucaaacucuuuguggaguuccugguggccaucacggagugucccauccucucucagacucuuuuuggggggcagucaguacaccaauuagcaccuuuguguuccuagccaguugugucuagcuucaaauccugccuccaggacagcacaucagaguauuuuaagucuucuggaguguugaguuccucaugucaaaugggucgguauguuuuuauuuggcguucuuuugauguuguugaguggacugaacagaguacggcacuuggugaaggcuuaacuaagagguuauugaguccgcaucccugaggacaggaccugguuugucuggcuaguggcucaagggcgcagcaagauacaugaucagugcagaaggguggauagaugaaaggauaaugauggaauugaaggggaaaaaaggaaggaagaaaagaagagaaaagaaaagaugagaaaaggaaagaaaaucauucgucucugccuguaaucuccgggcgguguaucacacucuuaccgcugugcgccucaguuuccccucugucguuggguugacccucgaagaaagaggacgccaggcgcaggcccaguacugccggcacccaauaagcgcucaaggaagccuggccucccgccuucucugccccagcuccgggagccgccagcugagaaacacuacccacccccuugcuuacacucccucugcccauugugcgccuccgggcccagagcgcacgugacuccacccagcccgcuccgcuccgccccgccgucccagcgcgaucuccaguuggucgcaccagagcgccccgcccccaaucagggcggagcccaagcaccucgcccccugcugaucgggcucuggcgucuggcgagggcuccgcggccgacccggcuggcgcgcaggcggagccggggcggcggggcugcugcuggcuaauugcacaggacugcgggccgcgacauggucagcagggaugggcagagcaggcggguagggggaagggacgcgccggauggaucggggugcggcgcuggcgggucggcgcggcagaugccgcgcgcgggcgggggcucuuuguccuccgccgcgggauugggacaaaggagguagcggggggcggaggcugcuuggcugggcaucugccccucuccgugacccacgguucuauguccugcgcggauccuccgggcugcccggaacacucacuccgcauugacgggguuccuggcagcgccccagcguggucaagaugggaucgaggggaacgggggcccagggaaaaucuggcgcucguuucauugguggggagacugaggcugagccgcagcguuuggucccaggucgggucggcagugauugcgcggcgugggcuugaaugggucucugggaccccccccccagggaaaaaaacuggggucaggcggacuugauuugucuucagcugucguuuccuccucagcugucgcccccugaacaggccccuacuucccuagcgccucgccuugcuccuucgauagagugggagagacgcggcgucgccuggcaccgcgccugcacaccgcccgcgcucagcacgcgggagcugcugggacgcuugucauuaguguccaguccucucgacccaggucaccuagacuaucuccuaaggaggggucaaacacagacucauugugcucagcuuucaggagaaagaagacaggucagacauaugacguuuuagaaucagguuugaaaucgguuauuuaggaucggggcuuccuggguaucugcaccuccacuuuuuaaacugugugaccuuggggaccgaguuaacuucucuaagcuacagauuauuugucaaguaggaagagcagucauucgguucuaggauuguuuugaugcagaaguuuuggagagauccacaugagauguuggagcucaaaaguguggcaucaaggaacuuuucagcaucgacuauuauaucaccgccagaguuguauggccagaugggacccugacgagugggggcagaauucaggcuuggacuaugagauugcagcucaccucgggcaguucccaaacuucuuagucuuaguuuccuuuccuggcauaagaacugggaguaggguggcaucuggagcagauuucucuucuggaggaggaaggggaggggagaggacaaugggcacagccaugauagauguucccuuuucuuuccuguugcuguugguccuccaucuaagcucuuggauggcagaagcccucggugauggugccuuugggguuugaccaagcagaacccugagcaggaaauacuucuggucugggguccccugaagaggacacuuggaagguggccuugcuggaggauggagcagugcaggaagccccuggauguuaguuggcccugaaagcagggcaguauuucucacugccuuggaggcccugggagguggaagcuuuggauggaguggcagaguggugcccagcugaguacaauagcacuggugaugugcccaguuaagugaugaguaggcagaggauguccccagagaagaggcuauuugugacauggguccaggccaggcuuugugcccugagguacaagaaguuacagagaaaaaggcaagacauuaagaacagccugcuguggauaagaguggugagaaccuggccugccuuguugccuucuggguggggugaaagguuagcuuugggaucccaugaagagguagggauaacagacgccuuuccaaggaagaccuaaaggagagugugaauuuuaggagaccucugcccagaggucaccacacuguaugucauuuugagaccaguguguucuaggaccaguuacccauuggucugggccuugagaaaccaggcccagcaauucucagcauugcagacugaacuggcuguggugugcccagacccacauugaccagugcucaccuaaaaguugucacugcagcugcucccgaacaggguacgugggauggucuguggucugacccugugccucaguuuccucauaagcagaaugggaugaucaaggcaaguagagaggaguaagguggauguaauggcauagcuuugaggugguccuggaacuucccucagcuggguuaaauuaugccugacccaugggccuuggugaaugaaaugggguggucagugguuaugcagaggguuguacaagccagaugcagggcaucccagcauccucuggguucugcuucccuguuaccaccuaccuuaccccaagcauaaagaauuaccuugguuuucaaccuauggguuacaaccccuuugggaguagaacaaaacuuucauaugugguuacuuaagaccacccggaacacagauauuuacauugugauucauaacaguagcaaaacuacaguuacaaaguagcaaggaaaauaaugcuaugguugggggugaccgcaacaugaggaacuguauuauaaggucgcagcauuaagaagguugagaaccacugagcuagcugucaguuagcugucagaccugccauccucuacugccaugccuuggcccugcccugaacuuggguuacauccucuauuccccauggcugcuuccuagcaggcauggggaccugugaguaggcaacugggagaagucuggacuuagggagcuggcucaaaaauaggguccucugguugaucccaugagagccagcucucuuucagcucaucaucacaugccuggccuugguauacucagucagucuuuauugaguauguaugcaguagaacauagcugugaacuugaggggcagugaccuuuucuuagucucucgggagggcacaggccagaagaugacagccaggguacuacucuguaaaccagaacugcagagagcugagggccuuaggaaagauggugcauguagggguguaggugcuggccagugugggaagagguagcaucgggagucuugaaagcagcuccaggagucacugcugagaaagugcuaaguucaguccuaaggacggaggccaccaccgggcauguucaugaaguaugggugguagccagaccugcaggggaugccggggcaaucucaggagcccucccuucugaggcuaucaugucuggccagaacuucucaggaaacguuugcuaaaugaaaaaagaaacagaagcccuaauggaggccacagagcaggcaugacuggcugggucaaaagucauuguuugugcuuuuaggugagaggcauauaucugguucuguccaccuccaagccuagugggcauagugagcaggaguuugagcugccucaguuucuucauuagucacagaacagcuguuucccuuagaucauggugccauuguuugacuuuccacuuccgaucccagaaccaccccagaccccaaacacaaacuucccuuucugaauugccacugccuugccuucugguccagcccacaggaagacgugcagguggaggcggaguggguguccugugugggcuggcugugugggcuugugggaacugauggagccagcagagcucucuugggacacgcagcucugggaauguggggaagccaggggccaggcagccgaggcuuucugguugagagaggcuuccuuccuggcugguguaaacuaggucagaguuucuuccuccaccuccaugugggugccauuuggggccaagcuguucugcacuaagguuuugggaacuauccuaugccuugaaggguauggagcagaaucuuuggacucugccugccgaaguguggccaggugcauaguugaacucaacuugagaccuagugaucaaaggucagggaauggagcacccugggcagaaagaacuaugugaccaaaggucugggcccagaaggacaguggaaggcacauggcuggagaggagugagcgggaauggggaagcacuuggguacauucugugugcucugauugcaagaguggacggggagccaguugagagggagccgggcagcucagacacuagagacugaagaucgagaaucagagggugcucccccucccuggagcuucccugaagacuggcacaggcaaugaggaugguauucuuuggucaugcggccugcuuccuggacauuccagggaauugacuggcugccugugaccuuuaggcagaccugacuccugguagccuccaugcuugagugagagucauuucucucucuuuuuuuuucuuuuuuuaaagauuuauuuauuuauuauauauaaguacacuguagcuguccucagauacuccagaagagggcaucagauuucauuacggaugguugugagccaccaugugguugcugggauuugaacucgggaccuucggaagaggagucggcacucuuaaccacugagccaucucgccagccccgugagagucauuucuaacuaaggggauuauuacucaaggaugcaucacauuuggagugugaaucuuacagugccaucuaccugggugacaugaauggcaagacuuuggacauuuauggcauccucaguguagguugugccuggccugugcaggacaugccuauggggucuucaucccucucacuuacucuaauguucacuacugacaagcacuaguaagaaaguaggugccuguaagagacuggagcagccugcugcugacuucagcaccugggaggccucaguagcaaagcuuaggguuagcaauccuuggggcuguggcuggcugagcucugggguaccguuuaagaggaaagcuggaguccagguucuccaggcccugggugcaucccacaaccucucucucucuccuuuaccacucgcagccuuggcuaaggaugaggacugggaccuggaguuaucugagaucaaggagcugggaacagcucagcucuccguguccuggcaucacucccucagcaugcaugaguccagcuggcacucuaacagggcgaugcaccaggcucucucuccugccuucagaggccuagcaaugcugcucccccugugguaaaugcccauagcaccuggucccuugugcuccugaugugaucauagcuggacugacauuuuagaguguugaccucguggcuauaugguuucuauacuagaugguaagcuauauacagaaggagcuaacucccucauccaucccuccugucuuuccugaagcuuucccaguaccuaugucuuccaggaccuguuugcccuacauccauagacuucuugaaaaauggggucuucacugacaagcuguggcuacauggggcaaaucugucugcuguugugacuuucccccuggguucuagaagcgcagacgcuggagacuuugaagauugaggcguucuguguuacccgacucuuccacaggagcugaugcugugugucugcuucugggugcuuccucuccagccuucuggaccaguacuggaugcacacucguagcucaugccugugauccuaaggcuagagaaucaugaguuugagauggucugggauacagagugagccucugucucaaagaggagacaguguauaccuucagcagagccagauuaguggccaguccucuuguagcuucugccucaacugccauggugcccauuucccuuuccacucacagcggaagcaccuggguggcagaaguagcugggggaaguaggcuggguaagcaucuuggcagacacaguggaaagccaauccuaugguugucacuggguuguccccuacagagccccuuguauagucucuccuggcuuugucuuucaggacuguccugugcagcccgaauuccagccucguugagccaggcacaccaagagcuuuccaccaaagaagccccuccaagcacugaccaugucuauuauggaccacagccccaccaccggggugguaacggucauugucauccucaucgccauagcugcccugggggccuugauccugggcugcuggugcuaccugcggcugcagcgcaucagccagucagaggaugaggagagcaucgugggugauggcgagacaaaggagcccuuucuacuggugcaguacucugcuaaggggccauguguggaaagaaaggccaaguugaugaccgccaacagcccagaagugcauggcugagcugggcugugaaggccaaggccaugguucuguuugcagccagcccagaagcacugagaggguggaagcagacacguugcucugugagagggguugacacuugcuggcauggucuccucgggcuuugucaucgcaugcacuggcuccaggucccagcucuucuggccuucccccuccgccuccuggugggcuguccauugcaggcagugggcaggccugaccuugcuggggcuccuggccccuuagcgcuuuccuuacuugaauguuuuagcugagccuguuuuugauggagcuacuacuguaaugcgugaacuaaccaaccugugaacuguaaauaggcccagaagcacgugcuuaagccuuuuugcugauuuuuuuaaaauaccagauggagcccguggacuggcuugauaaugacuguacucaacguaagcugagguacgaccauggagggucuuggacuggucaggccccaguugcccucggcagggugcacugaggccuuagugaugcguauggaaaggagguuaagaagcugggguguugggguaaucucagcuugcuucguaauggaggaaaaccacaccccaccccucccuuucucuaguucagcuuuguuaaaagagcaguguguguagacggcggagucacugcaaggaagcuguugcgcuugcuuggaagccugugaaggaugagaccucaugaguccugaggguugccaggcagcuuggcagagcagucucuugcccuuugguuuugagcaugcccaguacaccccuucagcccaggcuuugcagaaacugcucugguccucugcagacaccagagccuguggaggcuacuugaagucugaaacccaguuggcucaagaagacaagguuuuguuuuuguauuuaauauuuucugcacuggaauggggguuggggguaggaguggcucccucccccccccccccccccgcacauccccacaccccaccuuuucacaagugagcuuccuuucuucuccaguggguauuggguuuuacuuugauccuuggggcuuuguagucagagcuuccugacacagcucucaaggcacucugugcuauagaaggucauuucuauugugcacauagcauuuacaagagucaccaagaguucagguucagggccugguucucacagguaagggaaccagcaacaugucuccaggauauuucuuaugucuauaagcuugcucagauguuaaucccaucaccguaagcauucugaaccauuaugauuaaaccugacuaugcugguacccuuggugaugcagagagcagagagcuccaggcuagucuggagacagcuuugaaaagcaugugaaacuaauccauuuccuagaacccgagggaggagcuguagggaaggaacacuucuuagcaguguauaccaauaugggguugggaggcagauguuaaacaccuuaguuacacagagguagucaaagauggacuggccauggacagaggcugcuaaggaguucuuggauguguguuaguccugggagcagugacucuguaggucuaggaggggaacagaagguaucaaaggaucuaccuggaguuggcugaggcggagggguuuuaccgauucccaccccacauccaccuuucuaccuccuacgucuugcagccagcagccuaaacacugcugauucuuuucuccaucauccauggauccaaggccagcuuggaucuacaccgaaauuugagcugguucaucgcugcagggucagaugcaggccgcagcuuguacuaugcugaugaaguuggcuuuucaaacagacaucaccacauucuuaucaguuacacuuugggggagcuuccuaucacccccuguugccagggggucuuucaaguuugagucaguccauccagagagggacgaguaaguucaggcacuguggggcauuggugaggucauauggagaacgaacaccuauagaacuguugaacaaccaugcaagucuucccuguccuuggcuaucacuggcuaccuuuuuaaguguauaccagagccguacacuccaaugguuaguaagucauaacuucucuucagauuuuuuucccaauaguguaacuauugagggucagggucaggucuucugaugguuacgaagcuagccuuucauccuggggagcuugcaggaacuccgaggcuaagccacugaagcaagaacugacuuuccuagauauauguucaaauggacugugcuacugcugugucucaaagcuaccagugugugcaauaaguggaagggaugccauuccugaucaauaaaugcuaaaugacauucgaguucauuuuguagaccacugagaaagaucuuuauuuacaauaaauuucaauaaaauuugcauaacuauauucccaau

SEQ ID NO: 8096 - RNA, 62601 nt, Mus musculus
caucucugaaguguggcugacguggagaguccggguuagugagcgccgcuggcugcgagguccgggagugacgugcggggccggguccccgggcccgagguggcggcagcgacgguauaaagccggccacggggagcauguaaugucggaaugcggaggccgcggcggcggcggcgggaacaacagcgaggacgccgaggacgaggguggcggccccaagggcucaggcucccucagcccugccggggcggcggcguccuuggagggccggauccgccgcggcuugcgcggcgccucgcuuauggcgcgccagcggccagagcugcugugcggggccguggcucucggcugcgcccugcucuucgcccucaaguucacuugcaggugaggcugccgggacucaggcuccgcggccagagcuaugccaccccggcugcgcggggccagcucggggccuccggggucgaggguuguuugucuuccucggggaagucgagccugaccuugccugcgaccacaggcuugaccuucccggcggccgcggucccccacucuccuaguucggcguggaggcguuuccagggugcugcucuauaucaauuauguaccgagggcguuuggcccuguuucugagcugcuucucaccuguuggggucucucggggugcacaugucaauucuugcucaggcuauaaugcucaguuuuaauucauuccauuuuccuuaaugcuugcagugugaugauucacaagccauuuaggggucuuagucgcuuuugggaauccaggcaagccuuugauauacugacagugcacguuuguacugagcacccguuaaugcugaagacaaaaauccccguucccuggaguucucauugaagugaugauauacaauaaacaaacacuucagagaccuuaauaagugcuaugcagggaauagaaggaugagguuggguagggcagaaagggccuucauaggaaaauggcauuagccacuuacacaaggaaaggaaggggcagagguggaagagcugggguaagagcuauuacaaaacaguuaagugcaaagaucuggagucugagcaagcuuggucuuuuugugaaacuuggaaaaggccugaguaggcuggaguuuaggaagaauggaagcuaaugugcaucuuuucagaaaauuguguagauagauacaaaguuuauauuucaauuauacuccuugccucagaucaucaguauaucauuugacauugcaguuuauaaaaucuguuaucacuugacauauccucuuggcacuucuguccagagggagauuuaugugggcacagauugaguguaaugaacacaauaugagaucccugaggucaagaugggccaaaaauuaggaguuuuagggggaagagacucguuuuuuuaguguuugcaauguguuaggugcuaugcuaaaguguuuaaagccaacuaaaaguguuugucaccacaccuggccuggaguuugaaucuugagcaacuagacugguacugucuuuauaaggaaaauacagaaaguauuuuacaagguggaauguugcaaccugucauuuggauucauauuaacaguccuuuucccacgucaaggaauugauuuacuucaguuugcccagcugugaaaacagugcucaguguuugaucugagacacgugacuuggugggugaccucugagagaagauugaagaguuuaaaucagucugaggagcugucaggaugagcuccucaacugcuuuuggcugggagagagagccugcagccucacuuccucaagcaucuuucuauggugcuggcaaugggacagcccuuuuaauaaacucagaugaauuuuuaaggacuuuguuugauaggaugguguuaagauauuaugguacaacugacccugacaucuuuguugcucuuuccuuaagaucuuuaauaaggacagaggcuucaggaagaauauaucaggucuguuuuucaaauuuaauuuuauucauaguacaacucugaaauaaaugacugcccuccucaguguugagugcuuagcuuaguucagaguagguggucuauaagaaggugaauuuggaguugaaccacagugaguuacuguggguguucagggccucugaucuuugcccacuucuguuuaugggcacucagucuccaugaauccauucugcuuucuuuucuguguuuguuuauuaggaguaaaguggcauuguguauaguugccuuuaggagggagauuuaagguauagauuucauuucaaucgaauuuacaagcuagcaguauggcuuagugggcaaagcacuuaacugcacaagccugacaaugugaguuucaucuucgagcucacgguggaagcagagaacagauucagguuaucuuugacuuccaugggaaugccugcacucacacacaugugcacaggcaguaaacaauagcuuuuucuuuuuuuuucuccuaagacaggguuucucuguguaauccuggcuguccuggaacucacuguguagaccaagcuggccuuauacucaagagauccaccugccucugcaucccugagugcugggauugaaggccugggccaccacaccuggccaucuuuuuuguuuuuaaacaugccuuuauuuuucacuaccaauucuuguuuuuguuugugcuacacaaacuuaagaguuguaggaagucucugauuuacauguaauuuuugaaaaauguaaagcaaaacuugagagauugaugaaaagggucugugguagagcagagggccguguuucucuuuccuggcuguuuaguuuuuguuugguuuguguuuuaucugacuuuuaacuuuaagaacuccucugcaccuguaaacaaauaauaaguugaugucaccuggauuuauccccagauugcauuauuuuaugcuaagcgugcagguuuucuuuuuguuucuuuuugggccuaggccucauguaguccaaggugauuucagacuccugauccuacugccuucuccacucaagugcuuucauuacagguguguauaaccaugcuuggcuuuaaauaaaacaaaaaccaaaaaaccaaacaaacacugaauuauguguguaugucuaaaugcgcaucuguguggguuugugcacaugagugcaaguacccacagaucccagaggcauuggaugccccagaaccugagucacagguggcucugggcacacaggugcugggaagcaagcuugguacugcucuuguagguacucuccuaacugcugaguuuuuuuuuuuuuuuuuuuuuccauuuuuuauuagguauuuaacucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuuauguguuugcuaggccccggcauagucucacaagagacagcuacaucuggguccuuucaauaaacugcugagcucuuaacaguccccugacuuuguauuugagucucacuuuaacccaggcuggccuggagcuuauuguccugucuagcugucugaaugcuggaauuauaaaugugugccaucaugcucaauuuaacuugcauuugaaugguaggaaaauaauuccaccaaugaacaaccuuuagaaucucuucagaacacauuuccucaccucuguguacaguuaucugcuugucugucauucaggccucacuuaagagauacuugguuaccaccucaucagaagcugccauguccccgaauuauagcucuauacugaguucucccacaacaauggccauuuuguguaacuuuuauugcugauuguuuauguaccuguuucuuugccaucuuccuccucuaggaagaaagcucuuggcagcagccucugccugugucugagccauagagcaguuacucaggcaguuugucuuuguagguauuuuguucccucuucuaaaaaggauggaaguauccacacuuuggucuuccuucugccugagcuucauguggucugugaauugugucuuggguauuccgagcuuuuggauuaauauccacuuaucagugagugcauguguauucuuuugugacuggguuaccucacucaggaugauauuuucuaguuccauccauuuaccuaagaauuucaugaagucauuggguuuuuuuuguuuuguuuuguuuucgaggcaggguuucucuguguagccauggcuguccuggaacucacucuguagaccaggcuggccucgaacucagaaauccaccugccucugccucccaagugcuaggauuaaaggcgugcaccaccaccgccuggcgaagucauuguuuuuaauagcugaguaguacuccauuguguaaaaguaccacauuuucuguaugcauuccccuguugaagggcaucuggguucuuuccagcuucuggcuauuauaaauaaggcugcuaugaacauaguggagcauguauccuuguuauauguuggaacaucuuuuugguauaugcccaggaauggcauagcuggguccucagguaguacuauguucaauuuucugaggaaccgucagacugauuuccagagugguuuuaccagcuugcaaucccaccagcaauggaggaguguuccucuuuuuuuacauccuccccagcaucugcuuucaccugaguuuuugaucuuagccauucugacagauuugagguggaaucucaggguuguuuugauuugcauuucccugaugacuaaggauguugaacauuucuuuaggugcuucucagccauuugguauuccucaguugagaauucuuuguuuagcucuguaccccauuuuuaauaggguucuuuaguucucuggaguccagcuucuugaguucuuuguauauauuggauauuagccuucuaucagauguaggggugguaaagaucuuagcagucauuucuuaguugaauggcuuaaucuuuuuaaauugugauuauugauacaguuguuuucauuuguaccuucugcguuuuauuuuuucuuugcuccuuuacuuucuuuugguguaauguauuguuuuagggcacuguggcagggcuuuaugcucuagcauuguauccaugugccugaugggagaauuguagccucucugacuguggggaaccuuuccaguuaaggcucuuacuauauucuucaucuuucuuaucacggauuaguauuaguguguagaauucuauguucuaguugcuuuucccugaaugcucuggauagauauaggucaacuccccuuaauaaauuauguuuucuaaaaguugagucaccuguaaaugucuccuauaggaacuguacucauggugcuguauacgguuuccucagacuugugagcaauagagcaguagcagcagugccuggagaucaguggcuuuuguugacugucgggcuacaauguugaaauuuuggguugugagcggugagaccguggagcgugucauuauuuacugcuucccuaacccacaccugcagggacaaugcccagcaucuguacugucccagccagguguugccuuagcaugguguauugguuucuguucagggcggugacuugcaagcucuuaauuucuuacucaaaagaggccuuuaaaaaaagucuucucucuucuuccguacaaaaguguaauggaagaaaauaaguaaguggagaaauuguuuguguuuacucuuuuuuagucgagcaaaagacgugauaauaccagcaaagccgccugucagcuuuuucuccucgagaucuccgguccuugaccucuuccaggggcagcuggacuaugcugaccauguccgccaggauucugaggugguggugcuguucuucuaugccccgugguguggccaguccaucgcugccagggcagaaauugagcaggcagccagccggcuuucugaucagguaaugugugcuuucacccaagcggugacugucaagucuauauuagagaagauggccucucagagaaaugaugccagacuggccgugauauccaggcaaacuccggggccuugucaggugcaaagcuugugaagaaacaggaacaagaauccuggcaugaggucaaguggcaagaguaagcuucaguucuguagcuucaggagaugugugcuugcccaggauaccagguugugggauacagugcugaagauaguagagaccaagaaccccagcucucucauguccagcuuauguggcuuguaagccuuuuauguuguaaguggcacacaggccauggugaauguguggaguuagcagacagcuugaaggagucgguacuccucuacuauguagccaacuacuuaaauguuuauacaggaaaaauucaugaauaaaaagacuaaauguugccagguguggugacacacacuuuuaaucccagcacuuaggaggcuaaggcaggcagaccccugaguugcaggucagccacaucuacaaagugaguucuaggacagugaaggcuacacagagaaacccuguccaaacaaacaaacaaacaaacaaaaaaacaaacaaacaaaaaaacugauugaagguacuucccaccaagccugaugaccugaguuaaaaucuuuggggucaguucucuccugccuuucuguggguuuuagggauuaaacacaagucaccaagcuuuuguggcaagugccuuuaccugcugauccauuucacuggucccuugguaauauaaaguguguguguguguguguguauguguguguguguguguguguauguauguauauauauauauauguauauauguguguguguuuauauauguauacauacauauauauguguguauauauauauauguauguauguauguauguauguauguauauauauauauauauauaaaauuuuauguguauggguguguugucuguauguaccacauaugugccuggugcauuaggaggucagaagaggguaccuucucuccuguaacuggaguuacauauuggugguugugaucuaccaugugggugcugggaacugaacccccacuuuugaaagggcagcagugcucuuaaaugcugagccaauuaccagccccaguuaauuuuugagguaguguuucuuguggugaacucuggucuugaguuccugauacuucugccucauccuccugaggauuagagguguguaccauggcacacaaaccugaaaauaacuauuuuguggugccuucuuuucugcaugugaggcaacuuacauuuuaaaacuucucuaugcauaugauuucagaguaauguagucuuaguuuuuuaauuguaacaggugggaacauggaaaaguaaucuauagcuaaauccuagauauuuuaguuguuaguacacaggcaaagcauuaugcuuuauguagagccacugugaauggagcaguuacagauguagaacugugguaagaagugaugagcugauggcucagaucccacagggacuuacuuuauaacuggauccacaauaggaagcagcucgugggagagccccuaacuaaauagagagauuucugucucaguuuauacaguagucucauuccucagaauuucccugaacccuuggauucacauguaagaugggcuuagaaucuggauuuggauuguaacagagcagacuuuuccugguaaaaagugcuagguagguauuucaaacuacuacuaccccgugggaugacagggugacuuuggcauaaucaaagcagauuugagccuugcaggacuucucucaggaccuuguucuccaugcauaguagcuuugcguaaccauuguagcaaguaaaaauagcuccauagauucccaaggccgcgcuguuguagaaccauaaucugagcuaacuuggacggagaacccugagcugcagaagucauucagaacucauucucaguuguuuuucuagaaauaacaaauauuuuuaaaugauggcuagguguccuauccaguucugcaaagccuuuuaagcuauuuuauaccucaagguauaccaauaauaaggaacuguauuccuuacacaguucacauuuccugagaggaaucucaacauugggagguagugacaggaggguuggaguucaaugccuucaucaucuauauggugaguuugaggcuagccugaacuacaugagaccuugucucaaaagaaagacuaugugaaugcauuuguguguguguguguguguauuauguguguguguaauguuccugauacuucugccucauccuccugaggauuagagguguguaccauggcacacaaaccugaaaauaacuauuuuguggugccuucuuuucugcaugugaggcaacuuacauuucauacauaacacacacacauaauacacacacacacagcugacaagauggcuuaguaacuaaagguucuuugugucaagccugaugaucugaaaaugaaaaguaauauaucacaucauuaugucuuaucaacuuuucaggaaggaaaugggaauucuaagggagcccugggcaagcacucaguauauaagcauaaaaagagcaccgcuuuccuagucacuccccuguucuucagaaucuggagagcaaaggucugucuccaaguaggaagcacagaguuuggaaacugucucaucuuaagguuaacuuaguuuguaacuguuuaagcaaagugugcugauuagugggauaguaacacaguauuccucugagccccaccaugcucauuucacagcaguucuucaaacugguguuuuaacuuuggcuuucuuaagcagagucucugguuuguaaaggcuuagcagucugcuaacguacuggaguuacagaugagggcuugugccacccgcagugauccaaccuguucauuucagguccuucuaaauugagaacuuauaguucuauguacauagcagggaaaagagugaauuuauuuuuagaaaaagauagaacucauuugagccauauuagucaaauuagcaagaugguauauugugccuuuugcuuuguuauguuuuuuuccaagacaggguuucucuguguaagaagucuuggcucuucugggacugagucuggccuuacacuuacagagauccaccugccucugccuucugagaugagcuaccaugcccagcuaaucaugcccuauuuuuaaguaaagaaaaugagacuucaaugggugaagauuguugcuuuagaaaugucccuagaaguggacucucgggggccagagagaccaaucagugguuagggagauugcuguucuuccagaggaccugaguuugguucucaaaacccacaucagggacgucacaauugccugugcugaccuccaggaaaaugcacaugcacauaacauacauuuacagauauaaguauauaaauacaacuuuuaaaaaauggccucuaaaaacucagaagaguuugagcauuuguacuguauuugugggcagaaagcaugucaagguggcuuuauguuugcugacuucauauuauuuucuucauauccucuugaaaaacuuuaaaauguguuuuaauuuuguguauguauguuucccugugccacacgaaugcucagugcucauagaagcuguagggcacugggucucuaggaaccggaguugcagaugauugugagcugccaugggugccagaaaccaaaccgaauccucugggaaugcugggaaucaucucuccaggccuagcaccccagccuuccuggguuucgguugugggagcugguucauuccuguugugggagccagggauggaacucagacccuuaggcuugcccacuggaucaucucacugacccugaauaacuuaugaaaaacuugacacauaccccaaaagucugugacuguugucuugcuuauuuuguaaugugauguaccccucuauagucaggaaguccuccauagagguagcucugcugcugagcucaggucacagaaacauuugguugugacacuugagagguaauaauggugucaggagggcagcggcaagaaagcugcaaauugcucuacccuaguucuaggaccucuuguacccaaaccagacaauccugauccuucaggacuacuucaguguagggacacuuguucugacucuuuauuaacagauugggaaacuuuccucuaaauacucaauaucuacuuguaaauguguauuuaacucauguuucuacuuucuagagcuuucuuuuuacuuuuuaaaacauggccuaaauguuaucuuuauuauuuuuuaaaauagucauugggcuagagagauugcucaguggguaaaggcauuugcuaccaagccuaaggaccugaguucaauuccuaggacgacgcgaugaaaagacagguuguccucugaccucuaagagcaugcugugguguguguguguguguguguguguguguguguguguguguguguguguguguguguggugugacuguccucugaccucuaagagcaugcugugguguguguguguguguguguguguguguguguguguguguguguguauguguguguguguguguguguguguguguggugugacucaaccuaaggucuuucaaagguuaggcaagugcccuaauacugaacaacacuacugacucucaccuaaaauauucccuucagcugggcaugaugguguaugccuuuaauccuagaacucuggaggcugaggcagguagauuucuaagaguucaagaccaacccagucuucauacuaagcuccaggccagccaaggcuauauagugagauccugucucaauaaauaaauaauaaaauagaauuaaaaucaaauccuuucaaaguacugcucauccauuuuaacauuaaaaacaaaugauuuuccucuugugacaggcgcgaagaguccuaggugaacuauggagaaggguuugucuuucuuugaaauuuauguauuuauuuuuaagacgguuuucauauauagcccuggcuggcuuggaauuugcuuuguagaccuggcuuguuucaaacuucaugaucugucuccuuuugccucacaaguccugggguuaaaagcacgcaugguuauuuuucauuaaaagaaaaaaggaaggauuuauuacuauuuuauucagacugacugacugacugacuguuuugccugugcauaugucuguccaccacaugccuggagaaagcacuggaucacccuggggguggagcuacaggacuuauaaauaguuucaaaucaccauauugguacugggaaucaaauccauguccuuuggaagagcagccagugcucuucugagacagcucuccauuuccuauuuuuuuauuuuugcaauucauucuguagaccaggcuagccuguauauaacucaugguaauucaccugcuucagcucucucacugcccucaccccacucuacccugccccuuauucccaugcccagaguugggaucacaagcaugaacuaccacugagcaauuuuauuuaguuguaacuaucaccuuagaaagcuugaagcaggguuuauuuguuucuuguuuaauaccuucuguucuagcacggggaaguaguucuguuucuacaauugugaguuuugguaacuguugaguugcuauucauagucauaugaaaccuguuuugccucugcagguguuguuuguggcaauaaacuguugguggaaccaggggaaaugcagaaaacagaagcauuucuucuauuuuccugugauacaucuguaucaucggagguaagggcuuguguuuccagucccacuuguauucaucaguugaucagggaacuuuuuuauccaaaaugauuagucaauguggaaaauuaagaaaaugcagauaggcaaaaauaaguuuaaaaaaaguaagggaguuugaugauuacauuagccaugugcaaccuggcuguuuugauuguccuuuucuauaaauauauaugucugcccucuaguuguaagccugagaugugaucggaaagaacguaauauuauuucugaaauuguucuucugugaacauaaguauguuuacaucaguauauguaugcuacacacuguuuuuaaaagaugaauuacuccauuguauggcuguacauuuuagcuacucaaaacuguuagcuacacaauacagaaguauacccuguuccuuagccuguuaaccugauaguguagcaugcucaagauaauagcuuuugcuaggcauggugccuaugccaguaagcuaagcuucuugggaggcugaggcaagaggauuauuugaggccaaccuggacaacuuagucucaaccagauagcugggaauauuaauuuaguaauaaugggauuuccuaacaugaucuugggcuucuucccuagccucgcaaugaggaggaggggauacagaaccauuucuuucaguuaagaagaaaauuacuaguauuaauuacuacuaguaauacucaagugacagaggauggaaauccgcaaguuucaugauuauuuuauuuuauuguuuccaguuguauucauuuugccuaaagagucaagcuaccugugguuuuuauuuuagacuauuuuguucuuguuuuuuuaaucuuuauuuuuaguuauauguaucugugugugucugugugguaugagcacauauaaaugcagaaugucauagcccuucgagcuggaguuacagacaauugugagcucccaggcaugguugcuggaaaccaaacucucguccuuugcaagagcaguuacauccucuuaacuguagagccaucucucuuaggcccaagauuuauuuuauuaucuauuuauuuauucuuuaugugugugugcuuaauauauguauguauaugaacuauaugcauaccagaacuugaggcaaucgaaaggaaaacaucauaucuggaacuguagcuacaggggauucugagccaucaaauuggugcugggaaucaaauccaaguucucuggaagaauagacaaugcucuuaaccacugagccaucucuccagcccauccauccauccauccauccauucguucauucauuuguuuguuuaauuugugaaggggugacaggaccuuacuauuuauuuauuuauuuguugguuugauuguuugugaguagugacaggaucucaccauguaauccuggcuagcuuggaacucaccauaucagccaagguugucuggaacuuggaaagauuggcuggcuuuuguucccuagugcugagguuaaaggcauuugcagucaagccuuccuuuguuggcuaaggggucucaugcuguagccuagccuggccuagaacguagugguccugccuuaaucgcucacaggagcugggaaaaugggcaucugccaccacauuggcuuuaagcuagucgcuucugcuguguauauguuaauguuugcuuuugcagguguacugagacccuacuguggauguuacgagguauuugaaaaagcugguguggggcuauuuauguagagacaggguuucucuguguagccuggcuguccaggagcucacuauguuuaaccagguugaauuuggauugagagagcucagucugccucuuccuucccagugcugggauuaaaggcuugugccaccccauccaguuuauucaucuuaaucuuugagguggucucauucuguaucccaggcuagccuugaacugauaaucuuccaaccuuagccuuuagagcagaagauggcauuuaggcugcagucagugugauugguuuaaaguccaugaaaggccaauggguaaaaacuugauuagugagagcuuuauuuucagggguuccuuucuccuucucauguaccuaccuccugggccucauuaguagggauucacaguaaucauugacaaacuguuagugacagacugacucucuauccuuuuucuucucaguuccacaccucuggcauaaacuguuguacauuguaguguuuuccuaaacaacugauuuauuuaggcaagacuacauuuuccacuuuauaugaagugccuguggaaucaaaggaacaagcuagcuucucuugguaaccauuuagauugguuucaaaucuccccacucugcuucuuauucaguagguucuuccucugcuuuaaaggcucaaguggggauucuuaaauauaagguacagucccagugacccucucaggccuaguuccuacuuuauagaggucaggagaaagcaguguacugaagcaggugaugcauuuacccugcuaaggucccuguguuacuccuuggcuuugaacaguggggugguuaaaauuuugcacacugccagagguggauucaaguugaugugacauuaaaaugagcauucccuugaauugagauaaaggucauuuugagaggccaagaauacacauuagcuguuuguguucccagauucuauagauuuuagaaucaacaguccaagccagguguuuugcuucaugccuuuaaacugagaacucugaaggcugaagcaggaggauugcugugagucuaaagcuagucugagcuacugucuuaagguuuguaaagagacaccaugaccacaucaacucuuauaaacaggaagcauuuaauuggggcugguuuacagguucagagauuuaguucauuauugucugggcagaaguaugguagcguacaggcaggcaaggugcuagagaaggaacugagaauuuggauccacagguagcaggaagagaauaccuccuccaaaaaagccacaacuacuccaaggucacacauccuaauaguagcacucccuauggccccaggggggcuuuuuuuaaaaacaaaaacaaaaacaccgcagcuacuauguggaauucuguuuuaaauggaggguaccuauccgagugcccuguuuucugcacuggggcuuugaaaugcccacaauucaucuuagcugcuuuacuuacugaagucuguucagaugccuuucugcucacgugugcugguacagcagugcugaggcauagaaccuccccagauaccuguucauguucugggagucucugccucaguuuuauaugugaugugcaugauugcuccugggcacuccugucacucacaagccuuuccugcuuacagugcucacacucccacugaggcucacagcugagcagaugcugcuguuuguguauuuuguugcugcuguugcucauauuuacuguaaugcuuuuaucuuugagcuacuuaaacuaacagcguucugcuuugugggcuagguuuugggguguguauugaugccaucccaaagcugaugaaauagaguuuggaacauggggauggcuucucgccaccuguuagugaccaggagcucuagaucagcucauccuacacugauggcuacaguuugggauucaacacuuguauaucugcaucuugagaucuuguugccuuuuacaauucacuaggacacuuuacuaggaaaacucagcaaagccuaaggccuugaauagaugagauuucuacauggauuggccuuuuugcuggacaaaaucuguuauuagaugcguucuugauuuuuuuuuuaaaucuaacucauugauucauugauccauuuauucauucguaguauauuugauacaaguucuaauguagcccaggcuggccucaaguuuaauacagauacagauacagauacagauacagauacagauacagauacagauacacauacagauacagauacacauacagauauauguagccagucuuugcuacuuugugaguuccucuuuuuccccacucuuuauuccccugguuccaccccuaacauggaagagaaacaaggauaaaagggagugaggaaauaggaaaacuccugagucuaacuucuuuccuuuuguucuuugaccacaacuacuaaccaaccucaaccagccucccuaaagagccaacaacuaucaacccugccucucggagguccuagcacugugugcccucuggauaguucccagaauuccaagcauaacauaaucgcagaaaugaucugcagauggcaaaaccaugcuucugcuagagcaugaggcaagucacggucagcugcugagaggacagugcaaagcauucccauauuccuacuccuggaauuaaaaugaagcccauucuuauaaucuguguuuguuaaagaaacacaaacuccagaauugucauuacagauauagauuuagauacuguuauagauacaguguagcuauaaauauauccaaggaucaccuugaacuccucuaccugggaaugcugggauuaaagauguacacuaucaaacuuggccuuuuuuuuuucuuuaaauuaaaauuuguuggcaauuaauagguuuggugaugauguugguuacugcaaauuuuuuuuaauuaauauuuuucaucuauguaguucuggcuguccuguaacucacuauguaguucagguugaccugaaacuauccaccuggcuaugccucccaagugcugggauuaaagguguauagcacugugcccagccacuugaguugauggugcccuuauuucugucucccagccaugcuuguagaaugcugugcuugcuucuguuccuuuguuguuguauccugcaguguucacugaagaacuuguuuaucucauguguuugaguuuuuauaacuauguuacaccaucaugaguacagcauguuugaaauucuuuccugagcucugugcauugcugcuguuaacaguaaacuuaaugucuguagagaaaagaaugguugcagaauugcugaauuucacaugucccugcccccugucauucaguaacauuuguguauauuguaggccauugagagagacuagagagacuuuugaugagucugugaggauacugaagcagccaggugaaaaucugauuaguuuaagaggauccccguguuacuguuucauagcuggaccagauuccugugcaucccaagcauagccaaaagggaccaggaggaggaucguuuauacaccuccuggcuuuauccuugccauuuuguucugugguaauaacacuugaagcaggugucagguucacuuaguuagugauccuuugucugaguaccuuuaggaauauuaguaauuacuuuuuaauaggcaaagggucaacuggccaguguucauuauuucacagcuucauguaaaaggaaucugucuguacaugcugaguauuauagcaaagauccuggaauucuuuaguauguggcuaguuuccaaggccagccaccuuuuucuuuuuacuagaaauauuaugggaacuaauuuuucuuuuggcgaacaggagaguuuaauuugcagcuggauuaagauugaucucauagaagugcuuguaucuucccugccuaaaaugcugauucucuguuuaccuccugagcaaagcagguugcuugccucugaaccagcugcuaaagugaagcugucuucauuguaugguguugauggcuuuuguuacacguuacagguuuaaugcaugguguauuguuuuuauuuuggugcuaguuuuggaccaaucgaauacaaaggccccaugagugcuguuuacauugagaaguuuguccgccgggcgaugaagccgcuucucuacaucccgucucaaucagcauugcuagacuuucucuccagcuaugagguaccugucuuucuuaucgccugcucccaaggcuuuucacuugcuagaacuggauuguuuguauuaagugaguuuuaguuuacuuuguuuuauuuugguguauauuaauuaauuguacaagauaguagguuuuuuuuuuguuuuuuuguuuuuuuuuuuuccaagacaggguuccucuguauagcccuggcuguccuggaacucacucuguagaccaggcuggccucgaacucagaaauccgccugccucugccuccuaagugcugggaucaaaggcgugcgccaccacugcccggcaauaguagguuucauuaugacauuuuuauacuuuuaaaaagucuccuggauuuuagcaauuaaaaaacuuacauugguggcuggagagcugguuuagagauuaagagcacauacuguccuuucuaagaccccaguuuaauuccccacacccauuaggugacuugaaacugacuguaacucuaguuucgggagaucucauacuccaguuaagagcucccugagauucuaauuuuaaggacagcuggcuaagugagcauuaaaaggccagacuacuugcaaaaucuuaucucuguuuuguuuggagauuuuaaacagauguuguucuugucucacaguugacuaggauauggaauuaguucauaguuucuaugcagcuacucuaagaauauucuguggccuuauaauauugcacaaugaggaccuggcuuuucuugucaguuuuaguuuagcuuuugacuccgugguuaagaacacuugugccuuuccuacauaacucagguucaauucuagcaccuacaucaguuggcucacagcugccugugccuucaguucuaggguauuugaagcccucuucuggcuuccaugagcaugcccacacauacacauaaauaaauaauaaaauaauuguuaaagguugauuucguauguauggguguuuugugugcuuguaugccggugcaccaaauaucccgguguccacagaaggaugaagaggauguugggcugcccuaggacuagagucacagauagcagcacuguguagaugcuaggaguuuaacccagauugucuggaagagcagccagugugcuuaacuguugggacuaaacuuugaucuuuuuugcaagaguagcaaguuaacuggagcuagcucuccagccccuacaacaaaucuuuauuuaaaacaaaacaaaaaaccaaaauaacaacaacaaaaacccuggaaauauacuccuuucugauuauuuaaguccuuuugguuuuugguuuuuugagacaggguuucucuggguaguccuggcuguccuggaacucucuauagucaaggccuuuuuaaauagaaaauauuuuagcuuacuaauauugcuuuuuuuccaguggcccuguugccagcuucaauaccucuuaaauuauuguuauuuuaagauuuuauucucuuggguugcugggugggguagugcaugccuuuaauccuaguacuugggagacagaggcagguagaguguguucgaggccaaccuguucuacauugugaauuuaggccagcaaagcauacauauuuuaagaacaaaaaccuaauccuuaauuugcauuaucuuuuaaaauaacuuaaaaauucauuuauuuaaauuuauuuauuuauuuauuuauuuauuuaucuuuugagacagggucauccugacuagccuagaacucacaacguagacuaggcuggcuugggacucauagagaucaccugccuuugccccuugagcacugggauuaaaggugugcaccaccacauuuagguuaaaauaguuuuuagaaaaaaauauuuuugucguguguauguuugugagucugaugucacuuguuuauaagugccuuuggaggccagaagagggcacuggaugcccuggaacuagagcuucagcaccauguggguauagggacuaaacuugauuuuuuuugcaagaguaucaagugcucuuagcugcuaagccaucuucucuccaguaucugaguuuucuucuuugagguagggaucucaugagucccagcucaaccuugagcuccgagcacaguugagucugaucuagggccagugaccccauuccucaccuccugaguuguuuggggacuugagaugagggcaguguuuuguuuuguuuuguuuuuuuaaagauuuauuuauuauuacacagaaguauacuguagcugucuuugaacacaccagaagagggcaccagaucucauuacgggugguugugagccacuaugugguugcugggauuugaacucaggaccuucagaagaacagucagugcucuuaaccgcugagccaucucuccagcccccuuuguuuuuguuuugagggggucuuggaaguaggguuaauaguuaguccaagcugaccucagacccucagcagucuuacagccucagugcuccuauagauuggcaguuagcaccugagccacuggagguaguucuccaaacuagugaaaaaccugaugucagguuuaagucaaagcuuaacucugcuacugccuaacucuauggccuugggcugaugauuuagucuccuuauucucauuuauaaagcagaaguaaucuagauaagacaaaucucuaagcaguggggagggcagaggcagacugaucugcauagugagacucucagaaaacagaaaaacaaguaaaaauuaaguaaaaaaaaaaaaaaaaaaaaaagaaaucguuggacuugguggugcacaccuuugaucccagcacuugggaugcagaggcaggcggauuucugaguucaaggccagccugaucuacaaagugaguuccaggacagccagggcuaugcagagaaacccugucucgaaaaaccaagaaagaaggaaagaaaggaaggaaggaaggaaggaaggaaggaaggaaggaaggaaggaagacagaggaagaaagaaagaaagagagagagaagaaaagaaagaagggaagggaaaagagaagagaagagaagaaaaaaauuuaaacaaaucuuaucaguaaaaauauuuugaggaaaauucuggauguuaguauugcaauaaagacuuaaauguuauaaugauaauauugaaauaccuuauucaugaggauuuuuuuuuaauaauuaagagauaaaaagugaucugcagaggucaacagcugccguccuucagucuugcccuauuggcauguuuguagaguacuuugcccaauuuugucuuauuugggucuucgcucaucuucuaaaagggaaaggaaaagagaaaugggagaggagcuacaaaauaacagcacauagcauaaagcuucagcaaucuacauauguggcaaagacgaucuccucuacuccugagaaggcgugagaggcagcucugucauuuuucagcuuugguuuuguuguuuauuuugaggcaggguuuaagucuagcccagacuggcuucaaacuugcuguguaacaaaagaugacuuugaauuuauggauccuucugccuccaccucugugguucugggcuuauagggcaggcaucaacacaccuaauauauguugggcuggacauuaucccaaggcuuccugaaccuuaggcaagcacucugccaacuaaauuacaucuuuaccccucugcugcauugauuuuuuuuuucuuuuaaaauauauuauauuuaaaacugggcagugguggucaaugcccuuauucccaguacuugggaggcagaggcaggugaaucucuuugaguucaaggcuuucguggucuaccuacuguguuccaggccacccuggggucucaaaaaaaccaaaacaacaaaaaaaauccauguguaugguuuugugugugugugugugugugugugugugagagagagagagagagagagagagagagagagagagagagacagacagacagacagacagacagacacagagaaagagaggggugagaggugguggugucagugucacacagguagaaacuugcaacaugcacauauggcuguccaaggccaucuuuggaaaugaguccucuuccuccaucaugaauuuaaaggaugaaaccaagggcgggaguuuuguggacuaaaugcuuucuugagccuguuguuggcucauucugcuucauuucuuacagagggcacaugucauagguaaagggcuuagcugacuucucuaaauauuuggcuagacaaucccucugguacucuugccuucagugguguuuaaagguuagaaagaguuuucagaagguucacauauuucuggucaaggaaguauuauuuugucucauguuuuugagaugauggucuguguugcccagacuggcucugaagauccuccuuccucagccucucuaauaacuaggaccacacaagaaaguaguaacucggagauguuacaaguccuuuuuaguguccacacuucagucuucauucuucuugaguuucauguguuuagcaaauuguaucuuauaucuuggguauccuagguuuggggcuaauauccacuuuucagugaguacauauugugugaguuccuuugugaauguguuaccucacucaggaugaugcccuccagguccagggacacuaugccccuccuuagaauugggaacaaaacacccauggaaggaguuacagagacaaaauuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaagaacccaaggagcuaaagggaucugcaacccuauagguggaacaacauuaugaacuaaccaguaccccggagcucuugacucuagcugcauauguaucaaaagauggccuagucggccaucacuggagaggcccauuggacacgcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaauaaaauaaaaaaaaaaacaaguccuuuuuauuuauugcuucaguguugcuaguguaucuguaccaaagagagaaagguguacaaauucuugguguuuucucuugcauccuuaguauuugcauuucagugauaccgucuaaguguuggcauggcccuccugugugguucaccaguguggaacccacuuauguagagugauguaccucaguaauuuagucuucuuugaagcaguaaacaaaugaguguuagccagaggggacuugaauuuuaaagacuucuguugucuugaacauaaccugcuuucuccuagaagcuaugaaugacauuuguguguuugugacaucuuuguuagacuuuuaaaaaaaauuauguguaugaguguuuugccuucaugaauaucuguguaccauguacaugcaauucuugugcaugccagagaagguguuggucucacagggcuggaaauauaggugguugugagcuaccauguuguaaaucaaaccuggguucucagauuugucauaguggcagcuuuauugauuugcuaugaccacuguagguguauuuguaacauagguccucuguacaaaucaagaagccagguaagccaggagugguggugcaugccuucugucucccaagugcugagauuaaaaggcaugccaggcaauauuuaguuucuuuauggcacuuaaaaucccuuuccuuccuuucucccucccucccucccucccucccucccucccucccucccuucuucucuucuucucuucuucccuuccucccuuccucccuuccauccuucuuuuuuuuuaugacaaagauucagaagguguuggcuuuuuaauuuggcuauaauuuuauuuguuuuuaugaaagacaaaagacaaggccauggcuaucagugcauauuaaagcaacaguuugcuauuucugguuacugagucaggauuuauuaugcagaaugggagugaccuauguaugauaaucacaaaacugagauuguaggaucuuagaauuuucuuccuagauaugcacuagcauaaugcuaacuugaaccucauguguguagcuaggaacugcagugaacuuucccaggggcacaauagaggaagaugagagcuucaaguaagucauguccauacaagcauauuagacugugcuucuuccaguuccuccugcuguagcucagacagcucuucuugccgacuuguuuauagacaggcagauguggucagacagaauguggguccuaguuauuuuaauggucuugaaguugauugaaaaaggaguaagacaguaaguaagaugaaauuuccacagguuuuaugucuucuaauuuuaaugggguuuuguuguugguuuuguuuugauuuuuuuuuuaagguauugucucuucgguguugguagcuucccuaucaaaugcuuuauuuuuaaaucacaucugauuuaaaucaucugauuuuuaccuugcaaccuaccuaccaaaugccaauaaauaguacuguuauuuagaacuuuuaucuuauauuugugccaaaauaguuccuaaaccuuuuugugaauuucuguaauuuacuuaagaugaauuauuuagcacauaucuauuaauuuagucuuaugauaaacuaaguuguuuuaaaauuaagcaggauguaaaaaggccuaggaaucuuggagggagcggguuaaguaggguguugauaaauuguuaggugagagaaaaccugagauuuuugccggaaaaacuucaaugcccagcuucuaauaucauagugcuuuuauucacaagucugucugaguguugagcaaguaugcagcauuucugucaguucauaguuuauacugcugugacuaagaaggcuuuauuaugaguuaaaaucaaggcagaaugguuuuaagugccgguaaguaaacgugcaugaagggggcuggagagauggccaagaggguaaaagcacaggcugcucuucagagugcucugguuccauucucuguguccagcuggugauucucaacuguugguaccuccaguuccagggcaucugaucccuucaggcaccaggcauacauguaguucacaugcaugcauauaggcacucacagacauauaugucagaaaagaaaauuguggaaaaaggggggaaaucuuuaaagaaacacaucaagguaauugcuaauuaggccacuagagggugugugcuaucugccaaaaucuacucuaguugaaaauggugccugcaucccuaacagcuguguugcaggagguaugaggauuugcugaccuaaacagcuacuaagagucuacaucguggccaggggugguggcgcacacaagaagaacaaagaccaaaguguggacacuuugccccuucuuagaauuaggaacaaaacacccauggaaggaguuacagagacaaaguuggagcugagacgaaaggauggaccaucuagagacugccauaucuggggauccaucccauaaucagccuccaaacgcugacaccauugcauacacuagcaagcguuugcugaaaggacccugauauagcugucucuugugagacuaugccggggccuggcaaacacagaaguggaugcucacagucagcuauuggauggaucacagggcccccaauggaggagguagagaaaguaaccaaggagcuaaauggaucugcaacccuauagguggaacaacaauaugagcuaaccaguaccccccggagcucaugucucuagcugcauauguaucagaagauggccuaguuggccaucaguggaaagagaggcccauuggucgugcaaacuuuaucugccucaguacaggggaacgccagggccaagaagugggagugggugggugggggagcgugugggggacuuuugggauagcauuggaaauguaaaugaaauaaauaccuaauuaaaaaaaaagaaaaaaaaagaaauauguguagcuaauuuauguuauuuuuuaaauaaugacauagcuucuguugaagagacauugcaaguuuggugaacuguagauuuugcuuuaccuacagcaugaccagaguuguuucauuauuuugaaguauuaauauuagguuauguuaucaagcauaccaguucucacaacucaguacagacugccacagaauuguaucuuagcuagcacuuaggauagacuauaccuguuacaauuuauuuuaaauuuuuuuauuuuuaguuaugugcauuuggaauggcauacacacauaaauacaggugcuuucagaggccagaagaagguguuggaggcccuggagccugaguuacaggcaguuguaaagugcccagcgugggugcugggaacugagcucaguuccacugcaagaacaguguauucucuuaacugcugagcugacuuugccaucucacagguuguguuuuaaauagguaguauuuuagaguuuauucaacuuuuaaucaccucauacagugugaagcuucaguucuucauugcuuugacagugaagaaugaaaugauuuuugcuguguucgccauuguaguguuuggugaguuuccuugcucagacuacuuacucgacaguuucaaugucaguuccucugaagacagagguuccuucauccagacaguaugugcugcagcaguagaacugggaguguagacaugaguuagaggguuugccuacuacacacaaaagcccuggcuuugaucccaccacugucaaaaacuaaaacuugcugcagugagaauaaacuuuauacguacaugcuuucaaagggcacugcaaauaguccaggaguuuuucauuuucaaagauuuaguguggaagcugguaaagacuguucaguggguaaaggcacuuguccccaagccugacaaucugaauuugaucugugcucauauaucagagagaacugacuccucucuaaguauugucuucugaccccaaaugucaccacagcauguagacacucacucauauguaaucaauaauugccauuagaaagaaaagauuuaguugagauuucccuugaaucagagcuuguauucugcauauguucauuuuauacauauguaauugcaugcacucauggauauagauaacauaccuaugucauaauacacaaccauuuccaugaaccucucuaagguaaugugaugugggaggagagauaaaauucacauggaacauuuacuuauuaauauuuggaacuauuuuacuccauuggcuuuggcuuaggagagugaucagaaauuaaagaaguuuaaaugagucguuguaauaguuuuuauuuuuggacagcauuaacaguuccuagaauuucugaaagguugucuuauguucaugauaggaaagcuuauucuguuguggaauggcuggaaauccuuaagaagguaaaugugcucugguguaacucuauuauaggcuggcuuguuuaaggaguucugaaggaguaggacaaaaacaaaaacaaaaacaaaccauuaguugccaguguuugcuuuuguacuggggcugguguugcaugggagaguguguccuuacccauguaggaggugcuggguuccaucuccaguacugcaaaugacaugaaacaacagcuuccuuauuucuucaguuugagaauaggcuauuugcuagauuuuuuucuggauguuaggauuaaacauuucaucuuaggguuugguuuuguuuuccagaggaagacuaguugacuuaauugaaucuagagaguuaaccaaauaguuuagcuugaaaagaagaaucuucaguauagaccagaaacguccucuuucgugcagcauacuauugggagggauguugggggacccgguggauuuucuguugucugaaacaguuuccugcaagccaggcuggccucaaacucauacauaauaacuuggaacuggggcuggagagauggcucagaggcuaagagcacugacugcucuuccagagguucugaguucaauuccuagcaaccacaugguggcucacugacccaugcuaccaucucgccaguaaaacgcacgcaggccacucggauccuucugcaguacagcuuuaauacaucucgagagauagaugaucagcuucaggagaggagacccagagagcagaaacccuucccuuuuauaggcugcgaaaaaaacgguuggagaugugcaccacugggauuggcugcccacuaucagucaguuaacgccacgagaaaggcagggcucggguaauggaacgauacccugacgccugcgcacauuuuacuacgagcaagggaugucagcgccaucuuguaacagcgacugugagggcggcuacucacaucucccccuuuucuuuuauuuuagaagcaacaggccacccaguacugagaguggagauagaggucaaauccccagugugcaagcauaggggccuuacacaaaaccuccucccaggcucgucacccggagggguuuugguccgcucccgugucguuuuuccugggggaaggacacuuggacacucaaccuucgucagcgccaucuaggcgacugugaggguggcuccucacagcucacaaccaucuguaaugagauccaauacccucuucuggugugucugaagauugacaauguacucauucauauacauaaaauaaauaaaucuuuuuuuaaaacggcaauguggaacucuuuaucucuuguuuuuaccaccaugcugggccuuuucuuugcuuauuaauuuuauuuuuacucuuuuuuauuuuuuugugagaaggucucacuguguaacccuggcuggucuucaaacucacuauguagaacaggcuggcauacugucugccuucugaaggcuggaauuaugggcuugagccaccaugacugguuaucauugguuuuaaauauuaucaacauaugaaauuucugugucaaauuuuugaauccauuuuucccuaaguaucugucuuucuaguuaccuauaagagcauggugcugagggcaccagagcuaaagggcucaucuguaucagacuaaugccuauaaguaagcuuuuccuucacuguuaccaugugaagaauuagcacugcuuccaguaagaaaccauugcuugcaugaucaccacaaggccauauauuuagcuccuggagccugggcuugagcuuaagucuucugacuauagcucuaucauucaucccucaaggaucucuaacugcuagggucuuuaggcagaugugauugucacagaaccaaaccagacaggggugcugugacaccucaaagacagcaagcaaagcagauguaugguagggaacagcuaauuguuuuggcauauggaagggcuauucugugcuaagcuuacaggaguagauuaagcagauggauugaguuugaggauaguggaggagggccagaguuucuuuguagcuaaccugaccagagaaggccuugccauucagugguauuggauguggagaaaaagaagggaccagguuacaggugaggccaaauauaaccugauuucuaccaaagggagaaagugauuuuagagaggaagugacugauagugaaacccaagaaagauacaaauacaaugauguuacuggucuaauauaaccagaguacugguuaauacugauacaauauacccagaacuacaaagaaugagaaucugaaccugugggguuugcugccagggcucugugcugccaauuguggugggaagguccgcuuaggguugggggaacccagugggaaggcugcugcacuccuucccucaccccaggaucuggcugaauggagaggaaguucaccacagcccacacacagcccuccucagguggucagauuuagaaaugaaauguggcaguauauucaccauccauuccuggcaucacaagauuuucuauacuuaagauaacagcuauucaucauucagcugacagugccuaugucaccaacuguacucuugccccugcagccuggaguacucggauacuuugaauucagcgguucaccccagccuccugguuacuugaccuucuucaccucagcacugcauucguuaaagaaagguaaaacgaauguguauuaagacauuggcacauuaagcagagauguacugauuuuuauauguuuuggcauauaguaucuuuaugauuauauuuucuaauuugcuagauuccuuuucucaauguauuuuuaaugaauauuaacucucguuuaacuucgauuaauaaagcauuguacuguaccagguauuuucuugcugggcaugguggugcaugccuuuaauccuagcacuuaggagacagaggcagguggaucucugugggcuccaggccaguuugcuguacauagggagaccaugccuaaaaauaaauaaauuaauaaaauaaucaggucuauuguuuauuagauguagcauauuauuauauagaguuugacccucuggcgccaaaccauguucuaaguuuuguuuggacuguuguuauguuuuaugugaagugacagguuuugaucugacucagugcuuaccuggucaauaguugaguaugcugugccauauaacucagggccuuuccuucacagggugguuuccaaaggucacagguaugccacagaacaucaugagccugcaucagucucacuccacaucugugugcuacucccauauccucuuccucuuuccauauugcuuuguguucucucaaggucauggccgagucugucuugucaguucuguuggauacauccaucuacacacuugucucugauucuuuuguuaccaugguggugcuucacucacaucuggacuagacagugggcacuuagcuguuuuuagucucugcccuccucuucccaugauacuuuucuaacuuuacaaauguuaguccuuucuagaaggcagaagagcccugagacuguuagacucuuauucaucccucaggguccagcucaaauaccaauguccaaugagccccauuccugaaccuaaacuguuccuuguuguuucucccuaguaauuauggauaccuuuaugaauguaauuauaaaauaauuuguugaaugucuuuuuaaacuuaaauuucuaggggugggagcaugaguuuuuuucuaguggcuggguauuugccaagugagugaucucuuuaaaugcuguuacacauuaucccaauagaucaaccaucuauuuuuuuuuuaacuggguauuagauuauuucaggcuuaaaaacuuacaauagagccgggcgugguggcacaugccuuuaaucccagcacucgggaggcagaggcaggcggauuucugaguucgagcccagccuggucuaccaagugaguuccaggacagccagggcuauacagagaaacccugucucgaaaaaccaaaaaaaaaaaaaaacaaaaaccaaaaaaaaaacaaaacuuacaauaguacaucauuauuauaucaaacaauuauaugacugacuacuuuacugugcauuguuuugggguuuuaugcacagagaauugacucugggagauacuaagggggaaggugaccuguuguauaaguguguccugucgucuuaugcccuuucacugagcuacauccccaacccuccucacugauuuuauuuugagacaaggucucacuaaguuguccaggcuggcuuugaacuugcaguuggucuacuguggcugccacagagguaagauugcagagcuguaucauuagguuuagcuccaaguuugaauucuaaaaguaaaauacaacuuaaauaaguuuagaagcacacauuuaaagcucuucaugaaagaacauaaauaaaguuguauuugaaagggaacccaguaaucccugaaaugaaggcagcauuuaauucuucagcugaagggcuauuuugggaucaugaaagauuguuuuuuguuuugauugcuuauauucuguuaugccaccuuaguaagucauuuauuuuaaacugcuuuuucauuugcaguuuuucagaaggaaaagccuuuccagauacaagacgguagccuuccuucccucccuuucuuuccuucaagcuagaugagaacaaaacagggauaaaugacauggggggggggggguugguggcauuuacagucugagcuacuuagugagcugaggcagggggacucauuugagacuaguccuagaaaacagcaagacccacauuccaguacaaaaaugauaaaacagaaacugggagaaagguauagcugguagagccuccccucuaggaugcucagggcccuggguucuuucuccauaucacagaagcaaaccacacaaagccaagaugaacaugcuugguaauucccccgcacccugccaucucugaugaccugugugguuggacuuaccuuuucucucuccuccuacagugcuucuagccaggucuuagaauccugcugcauacaguguuaggagcugagauucccacuugcucauccuaagugacuaaguucccacuuacacuuaaugaaccguuuucuuaagaagaagacacguuuggaguuauuuuuaacuuaaucuguauacccugaaggagaaccugagaugagucuuacccugagcaucuggauuugcccucccuuuucucuugcugacucuaggacuuauuguccuuauuguuaauaauaggucacauaagagaaacgugugcaugcucuuuuuaaaauuuauuuauuuuuuauauaugugaguacacugucacugucuucagacacaccagaagauggcauuggaucccauuacagauggcugugagccaccaugcuguugcuaggaauugaacucaggaccccuggaagagcagucagugcucuuaacugcugagccaucucucuagcucaaggugaucauuuuuauagacauaaauaugaugaauauauggcuuucuaagcuguuacuacuugguaaaguguagauagauccuacuuccccuaguucuugugaaguuuuuuuuauauacauccaugccuuccgguggauuaggguugggauuauguuaaauaugggaauggguuugaagucaguucauaggcucauacuuaccuucccuuucucacgcauagcaugguuauucauuuaguuacagcuucuuuugguucuucaguguaggucuuaguggguucucauuaaugcuuggucauuuccaaguauuuaacugugggccuguaccuggugcuucuaggaccuaaagaaaaacagccuuauccagacagcagagucuuguucuuagagccauucagugucaacagucuuuauuauucuuuugcuuaaagaaaugugccagcugguaggggugcgcaccuuuaacccaugcacucaggaggccagccugaucuauagcaugaguucuaggacaaccagggcuacacagagaaacccugucucaaaaaaccaaaggaagaaacauaauaguuggugaugguggcucaugauuauaauccuauaauucuagagguggaggcaggagguuuccugugaauuaagaccagcuuagauuucagaaggagaccuugucuuuaaaaagaaaaagaugaaaauuuaguagugggcuuaauggcuuacauguauuuucuuuuuuuucaucuuaaaggagcuuuguccuaguagccuuugaaggacacuucagcucuaaaaugccgagauccuucuacaguaauuauaggccugugaagcaagagugcuucucaugucuuuaaaggguugucuugagggaaagaaacaccucauguggaugacuugauuagcacauaguacagccuaaaauagguggaagagggcuuguaagcccauguucagacuggccaccuucucagaggguggaaaggaaggaguuuaaaggggacuguuugagcacuucacacugcuuugggaucugaugaacaggacugcugcugugagaguguauauuuuccugucauggagaugcgugacaacagcuauuuagcucuguaguguauguucuucuaaaauaauauaucuggaacugcaucuugcuuuuccucuuuuuccagcucacaagagaggauucucuguguuuaguggugucuugacaaacacugacauguguuuauggucuccaaaugccagauuucuuucuacacaauuguuuuagucuuuaugugaagaaucauaaaaauauauaaaccucaaaguuaacauuucuaggggaacauacaaauauugcgguaguuuauacauagcgaacauuucugcaauguguccuuuuuugcugggggaugguauuuugaggcaggguucucuguguagccucacuggccuagaacucacucuguagaccaggcuggccucaaucucagagauccacuugccucugccuccugagugcugagauuaaauuguaugccacuaccuaccacuugccuacucugcccucucucucucucuccccuuuuuuuuuaaggauuuucauuugauaggcaugucuaacauuggaguaugaagucgucaucauaagugcacugaggaaggaguccccaacuacagugggacaguuguuauccucuuuuagcauaaucuuauuuuccuuuuuccaauuuaucuaaaacccugaagaagaaaaagagagaaaaccagaaguuaaugagaauaaaauaagggcuauuuccaggccacacugguuugccuauugaaaggucacaguuaaccaauguaaagaaguuuaaaaaaaaaaugcccagaagagaaauuucccuagagguaaaucauguuucaaucgugccgauuaaauacauguagcuuaaucugcugauacuuaguuauggaguagaccaggacauccuuaucacuaggugucugcaucauuuucucuugacccaguguuccucuuuguucagacccugagagauuagcucauacagagcucuccuggaggucuaagaguccugccuuguucagcccuggcuuguuuguucuuuggggauccugggguacaguacucccagaacaccaggugcuauaggugucugaggcaauuaaauuguaucagcucaguuucuaguuagaaugucuaucucuuucugaagaaguggggaggaaaugucaucuuugaugguaauuuucacaacguuugaggaaugaggaaguuuaggagauacugucuuguguccuggcuguccuaaaacucacucuguagaucaagcaggccuggaacuuagagauccacuugccucugccucccaagugcugggauuaaaggucugagcugccaugccuggucuucuauucuguuuucuaaugaaugaggcuauucuuacucuuccuuuagcauuugaauugauguaguucauggcucagaagagguauguucucuuuaauauaaaauugguuuugauauuucauacugacuuuaagggaaaugguacuaaaaaaaacagacugaggugagagcguucagaaacccccuaacagaauucugaugcgagcaugagaguccagauugaccuggagggaaaccucagggaauuucaccuccuucauucuccuugcauccuuagagagcaaaagugguggguaagcugggcagugguugcacaugccuuucaucccagcacuugggaggcagaggcaggcuuauuucugaguuccaggacagccagggcuacacaaagaaacccugucucagaaaaaaaaaaaaguggugggucuugacaaaugugugugcaaggaacaggaaaagugacuaaagcugucccuagguuacaugggaauuggggugauguagucuguuaguggcaaagagccccaaccuucuaacaaauggccagaaggugagauugagaacucaaagcaagauagcugaccacugaaaacccaucagacuuuguggacacaccagugccuucuguuguucccuuugugcaguguucauggaacauguccuaucuuauagugugccuaagaguggcucagugagcucuaaggacacaggguccaugccucagcucuuacaacaggacaguuagucugaguguuuuccuguucccuccuagagagaguaaauggccacaguucaggcucuggucaccuuuaucugauuagcuauuggcacaugcagcuguuuccuugcccagauguucuuuuaagagcuugucacauuuauagucacuuuugcuaccauuugcugcuuugugguuacuggggaucuaaagcuggcuaaggaaaaggcuaauaaauagacuguaugagaccuauaagaauuaguugagaggccugaagagaugacucaguauuucaguaagugagcauacugcucuugcaggcaaucuaggaucauaucucaguauccaugauagggacucacagcugcuuauaacuguagcucuuggugcauguacccagauacauauagaaacagauuuuucuaaucuuuuuucuuuuauuaaagauuuauuuauguauuuauaugaguacuaugugcauguacaccugaaugcuaguagagggcaucagguccccguuauagaugguugugagccaccauguaguugcugagaacugaauucaggaucugaguucugauugugcucuuaaccauugagccaucuuuccagguccccuuuuuuucugaucuuaaaaaaguaauagaaugugacuuuucucauguuagauuuauuugggguuggggguucaagacaggguuucucuguauaacccugacuaucuuggaacuaggucuguaaaccaggcuggccuaaacucagaccuacuugccucugccuacauuaaaagcaugcacuaccacaccuggcucuugguagauuuuucuuggagggggaaagggaggagagaauaugagccuuaauuuauuuuaaauucuuuaacauauucgaaguuguuuuguuuuguauuuuuccauuagacccucucauggagccuagguuaaccucaaacucccaucauagcuaaagaugaccaugaacuccugaucguuguaccuccuauuacaucuggcuuucauaauucuuaauuaaaauauuggagccucauugcuuuuagaacaaaaggauccauuuuauaagugacaaagaggacauguguaagacgugccagugccugcuuuaacauggugcacucacauuauucuuagacuguaaacuguaauccaaauauuaauuauugcacaagaucgcaaacuugauguacuucuuucuggaaaauuuccaccauguucacaaguuucagaguugcaguguguuaggcugugcuuugugcagacaaccugcuucauucaugcuggugcaguuaaauugcuguugaguggccccauucagccuccaggcaggcugucacuuuuuauucuucugcugcagcauaucaugcuggagacacccuuuccugugcagugucacauaggcucuggaaacuucaacuguagcuuaggugcugccuuuuuuuuuuuuccugauauuuuuaucaucugaacuuaaugugucgaaccauuuaaaagaaaguggcucauugguaagagugucugcuagcauguggaagacccaggguccauccauaggacuguaacacacaucucucccugcuuuuuucccucucuucagccucuucuguaggaaccuggugccuucuguggagacugacaguuggggagaaggucugaaugcuggguauacucuuugguggcuuccagccauucuuaguucaaggucucagcagauagaaccaggaaacacaugcauuuauaccuauaugugaaagcauccauguauuaucuuaaagauuuauuuauuuauuuuauguaugugaguacacuguagcugucuuagacacaucagaaggggccaucagaucccauuacagaugguuaugaaccaccauguaguugcugggaauugaacucaggaccucuggaagaacagccaguguucuuaaccgcugagccaucucuccagccccacauccauacuuuuauauccuauacauaggugaaaaugaaaagcuagcuuauacaguuaucucugauuccaggcugacacaauaguauucauuuuagccuucuucuccuacaguguaacuucuuaccccaguacuaaaaauccugguucccaugauggcaauauacauggguaaaaagguguguuaguaguucaggacugccaguuacauagccucgugggaagcauuuuuaaugagauucauggacuuagcccaguucucuugacccuuaguuuuacaguucugcaguuacugggguucauugucucccuacccucacugugaugcacugacuugcaguuggauuuuuugcuagugauugcuuucuauaguaucuuccccaccauuuuccuugcaugacuguggcucugagucagaugcccagguacaugcagccuccccacaaaccacuauuuugcuuucuagucuauucuuucuguguuucucuugagucacuuuaagucgucagguuuguguuuaggauuguucaccuagagaggcaucccacuguuccagucagcugcuccucaccugaugguuaaggcuggcagugcuggaagugggacuugggauugaagaaaacguuuuccauuuuugagacaggaucuuauuaugaaacagcuuaagcuggccuggacucacucuguagaccaggcuggccucagacucacagacacucacagacaccugucugucucugccuacaaugcuaggauuaaagguguguguaccacagugccaggcuuugaaggugaugccuuuauguguugaauuuguucagauuuguauauuggcuacuugguaagcugaaauuuaacugaucuuauuuaacaucuacaguaaggaaggagagugggaaaggacgaaguguucccuacacuaucuucuacaucccccuucaacacugaacuuuauuuuauaauuguucaaacuuuauaguaugcauggucccugaaaaauaaggaggacugagcagggaaagcuaacaaccuggauucuguccccagaacuucccuuuacucucuacagucaugcuauggcagaugcacacacagcagacuaaagccuauuuagguauucaucuaucuaucuaucuaucuaucuaucuaccuaccuaccuaccuaccuaccuauuuuuagugaugaaaacaucacauggguggaugugacccucuuugugccccaacaccaaacuaaacuuuacucuccuuucagauucuucuugcucuguuugaggcaugucuccauauuuuguccaacucagucuuaagcucuuccuaggcucaagcauuccucuuccucagucuucagaauaucugggacuauaugugguaugccucuucacccucuuucagguucuuuauagauuucuacuccccugugcccauuaggaaagaauacuguuuuccaagcaugagagauguuguuuuaaaccuuaaacagaaguuguacuguguuggagguguuucuguucuucuccuuucuuuuucuccuucucugucugucucccucccucccuccucccuucuucccccucuuuuucucccucccucucuccucccccucucuguuugcuaagacaugguuucucuguguaacagugcuggcugcccugaaacuugcuuuguagaccagacuggccucgaacucaaagagauccacuuuccucugacuccugagugcugggacuaaaggugugcgccaccaugccugaugugcugucccuucuuuguugcuagcaggccacaaacuucuguugucaagugucgaacuuuacgaucucugcuuguguuauuucagggcccccgguguucuccuggucauugauacucuauauuccccaugccuuacauuucaggcucaguuugaaggucaaaagugguauuauuuugcuuuccucagagugagauuggguacuuuuugauguaaugauuauccagguccauucccuuucuguggugugcacauuucaaucauuuuuuuuauugucaauuugugugaguuguuuguauaugcuagauucacucauuucacauauaguuaguggcaugcgaugcugcucaguugguagagugcuugccuaacaugcauaaaacccuggguuugcuccccagcacccuauaaacugcuuguggggacacauuccuuuaaucaaguauugggaagguggaggcaggagggucagaaguuuagagucgucuucauccaacuaggguagcagcaauaaauaagaacuuaaauuccuaagaggaauuuggauaaaguaagauguaaauaaaugaauaagacaacauagguacuuacagguaccaucaaaguaagaagaaagucccgccaucuccccaaaacuucccuccccugaauacuugauacuaggcagguagugggggaaagugagcgcacaaugaguaaggcgaggagcuggaugugcucagagacagcagcgugugccuccccagagauaggcuugugugagcaaggaaaacaggguggcuaggcggacagucagauagcugcagguggaugucauguggcagucuccucaccccggcugacugcgagggaagggucuagcuucugcaacugcuccuuccagggccaggccagguuagcaagcaacagccgugcucucggggcuggugcauuaggacuggaucaguggguuuguguuguuguaaggccugggcccucucuuauuuaauaaaggaacauuuucuguuucagauuaccuaggaacagugcgauuugggguuaucacagauaaacaccuugcgagacugguauccuuagugcacucuggaaguguguauuuacauagacauuucaacacaucacuuguaaguauuuuaaaaucacauuuguauuagcgcagcgguucuuaaccuuaguaggucacagacucaauuaagaacuggaugaaauguaugagccucucccucggaaagaacaugugauuucauguacaaauugagaauuccuguaagcccacucuagaaccuaguccugauuaagauccgugccuuagaggacucuuaacugugcugucuagaaccuguuugcuuagauuuuagagucuggaauagcuuugcuggguuguugcccuucuugagugaagcugcggcuacucaguggugaucucucacucuaggugcaugaucucugagaugagcgucuacugggcaguauuguucguguguucuuguaugacgugcaggggcaugagcagcuuaucccugcacuaauagugcaguguugaaguuguugucaagacacagugaggagcugauagcuucucaccucagaggaccugguucucaccgucuccuuugucuccugacuuccuuugccuuugugcugagccugcugccacucacccacucugagcauugagcuucacaacuguguucuugcuacuuaaauagucguugcugacaggauauuuucugaaguauuuuauuuuuaauuauauuuauuucgucucacacacgccacggguccaaggacaauuuguaggaguucauuuucuucuaccacaaaugucguaggaauggaacucagguugucagacuuggcagcaagugccuuuauccacugagcccucuggaugguccucugaaguguuuucauugcugacaggaucacugguauuugguuucaguggagauuucuucaggucuuucuagaugcugucgaaaacucaauagggauugcccuugcuugccagucauuuuagcaucugucuaauucuuagagcucacagauauugugcuuuuuuucuugguauucauauucuguuaaaauguauuuuuguguuuuccaaauagaaauguuuuaaacccccacuguccuccucugagcauugcugcuggcugccucuccacagccugcccacucuccuugugccugucucacuuuuuacuuccucugcuuugcuagcucucauuuucucacaccaucguuuuagccgacguguauuuauagcacagaacacugcagaagaguaagggggaaaaggagaacugggcaguaguucugggcaguguuuaccagcauauaucuuuuaucaaaugaaguauuauuggaagguuagagucuuaaaaagcaguaggcacauucaugugaagucacuuaggucuccauucuaguguucccaacgcuucauuuugugaaacuuuccaaaguaccacucuggaaauuguuugaaacuugugauuuauaucaagugucuuucaaaaguacuuuuauauuacaaacaacaacaacaaaacccaaagggaaaacgccuccaagugucucuuuccugcuacacaugaugugaucuacagcccguguaaacucaggucacucugcugaaucccuguucaaugccaggaauguguccagcugcuggggugaccucgaacaaagccuuuagagcuucugccuaguggaugcuucacucuggccucugggacagaaucugacaagcuaagauuaagauauaacauccuguaacaauagacaauggaccuagauuauuauaaacaccacguggugcucuguaacucuccuuaggguguuuagaggucauuacagccaccugaagacagggagagugucuggauaguugagucucucaggggacaaaaggugaacccagugauaugaaagucaccucuugcucccaugguggcuuucagcccacuuguugagacuguguggagaggugggcuaaguguuggcuuuauggcccguagucauggccucugggugccuuuuccucccuuacagugcagcuugacccggccucuggagugcgguacuagucuuucgcucugccuugucuaacacaccucuacauuauucuguuauauuuguccuuggcaggucuuccccagggaagucaugaacuucacagcugagaacaucuauaagugggccucagaaaaccaggagacccucuuccgauggcuacagccucauggaggcaagagucugcuguugaacaaugagcugaagaaaggaccagcacucuuccuguucauaccguuugauccccuagccgagagacauccucuucuagaugagguaagaggccuagugauucugacaccugucaauagaucuccuuccacguuaaagggcacuaacuaauccaucaucacaaggagucaucaggaauaguugcuggggcucaguggcuuuugccugggaccgggauuccccagcuucucuugucuauucguugcuccagucuggggugaauagcagagaagggaaaugaacuuguuuccccagagaccuaguaaacagcacuucuucagauggcugcacugaccuuccuguugaggggcgaugggagcucaggcaagcugguaaagccuagggccugccacuuuuggggaccucgccaggcacagcugcacugaugaugugugucuuucucuaaaccuuauaggcagguuuccagagacagcugcccugccuggagucuucccucccuccugccuugcuuucugggauauccguucucucuagacaugaguucauuuuacacgugaaucauuuggaggcacuuagagggagcaauagcaaucagcagagagccugggauugcuaaauuggauuuacuaggcuuuuuuuucuuuccuucaaggaucccuuaauuggcccaaacuauaaucugaaucacuguaacacagcccaggcgaagcagacagugccugucccugggccucucagcacugcucuggaagcuggggaggaagucacuagccaggcucgccaugcuguucuccagcauuuguuucaaguugccaucccgacugggagcuuucuaauggcugcacagccuggcuuuaaaggaaaaguagagagaagugaagcggcucuguuccucccacugaacugaagugggacucaaggcuccauucuuuacaaagugugcacugcaugaaugcuuuaugguccaagaagcucuuuccaugcccaggccucuguaccaucuagauuaagaguugacaaggucuuuggagguuuuuacuuuaacuuuugagacgugacuugacuugagcaugcagggugcagggcaauguuggcaggagucuagucccucacuucagagggcugagguuaaauuuggcaccaaagggaggcuuugcuucuagccucauguucucagaugaucaugucccuacaccuucuguuucuauaaucuacuaacaggcuuuaaaaaaaaaaaauucaguuucaccugugacuccauuccccaagcucuuaugggugcucugagguagguggagucugucaccuccccuccacauauggcugguaugguccuuaauauuaugcauuucugcgacaagcagcaucugcucagcacuuucccuccacgugacaggucagccuggccaguguucauugaguacugggagcucaugggagaggaaguauguggcaaacacuggcaucuggucucagaagauggucuaaucuagaaucaagaaucugcuuauaacucaggcagaggacagucaggcucagcuaggccagggucaggaaguggaagaagagggcaggagaggcuuagaaggaagcaggcacaccggguaaggagggaacucagguagcuuuguuuuccauugccauugugggccuaggucugggcagacacuuaaaagcacuuacacaccugagggcauacuaggcaaggaugcuaguaacaguuguaggcuuuguguaguccagaagugaccaggugguggcuacaccaagccuaggagugccagcugccuuacacauguucuccacgaaugcacacuccauccugcauguguacacacaaagaaaacauacaucuugacaccaggaacaccagccccucaugucccuaagagcauucuugagacaccaugcuguauauuaugcaacaugcuaaaggaagcacuugucuccgccuccaaaaccccuuugacuuguuuucuacucugaguagucuuugggaauuggcacaugugcugucaagaaucuuguccaaaaagauaaugauguuuauaugggucaggggucauuuaaaacaucuaguuuaccuucuaaagugucuuuuuauucuaagaauuagucuguaaauauguuuugaacuaaucuucuauaaauacuguuauagaaguuauauaaguggaaaauuauucauuaaaugguucauacauacugauagacuuuuuguuugagacagucucacgggcuuugaacucacuaaguagcugaagauggccuuaaacuugaaaguaaagugguucaggaguuaagaaaaaggaggguguggccugagaagacugggcaggaauagaggacuagcugguuucuagcuugaggcuaaaaccuagcaacugugguccaaggaggggagagaugcucuagaaaggaaagauggguguggacuauugggagcagggugguuggugaucuccuguguggcauggauguauuuggaagaauauaugcuguaaauuuacuuaaauguccaauguguuugagaaguuuucagacuuacugaggacuagagaaaaaugacagcauuggagaauguuaaagguauaaagaaagaaugcucaccugagaggcaagagggcuccauuucuuucugucgggauacauuccugaucugaacaguuuugccugcuggacuuuaucuaucuauggugggcagguaucucuagaaccuucugacucaaaguagugguucauugugcgcugaaccacacaauguucagaggggaauguuguaaaaaaauaacucaagacuccuguauuaagagucuggugugagcugggcagugguagugcauuucuuuaaucccagcacuugggaggcagaggcagacauaucucuguaaauuugagauauguagauaugccgcucuguagagaacugucuguagagaaacccugucucaaauaacuaaaaacaagacaacaacaacaaaaguuugucgugacuacuucucuccugccugugacucagggaugccauccaagcagcagagcugccauuuuccacauccauaaaauuugggccucuuaccacuucugcucugucuuucagaucaccgaaguggccuuggaauacaauaacugucauggggaccaggugguagagcgccuccuucagcaccugcggcggguagaggcaccugugcuccagucccuggcaccagagcugccagcuucacugccugauacucagcugauggcagcaucccccugcuguaacacgguggugcugccacaggggccagcccucuccaggacucacaaugucugugagcugugugucaaccagacagugggugguaccaggccuagcucagugagugugccacagugcagcuucuucgagauggcagccgcucuggauucuuucuaccucaaggagcagacuuuuuaucauguggugucgggcagcauagaaugcagcaauuuuuuaaccuccuauagcccuuucagcuacuacacugcauguugcaggaccauaucccggggcauggcaagcuuuacuggcucugaacagaaugucuugacagccccagccaucgaguucucuuccuuagagaagagcugugaggccacugccccgagcuccauuccucacauugaggagaacagguaccgcuuuccucaagugggccucacuagcacagccuucacgggccugagcugcagaaccaacaagacccugaacaucuaccuuuuggauuccaauuuauuuugguuauaugcagaaagacugggugccccgagcucugcuccugugaaggaguuugccacaauuguugaugugaaagaagaaucucacuauauccuggaucccaaacaagcccucaugaaguucacucuagguacugugggugguuugcccuccuccgcauaaucagcuuuacuuagcuuaagagcugucauuugcacugauggucucauuauuccuaaucaugggggugacaccagcuucagagcucauguuaagucuucagacaacugauggaaaaacugucuuuaucuguugguuggucaguuugaaaagaagcuaguuuguccaggaaauagagcagaagcuucugucuaucaaaauuuggugcaguuugucagcuaaccuguaggggcuaagagucuaagacuggcaacuucugucaccuuuccaaagcagagcaaaugcuaaucacaaggaaccuggcucccaugccagacaaaguggugagagccuuucuaguggagugugcagaggcugauggacuuggccaguaauggcaccacaguugaaaggagcugaagcagaaagaagugcacuuagauugucuugcucacucuugcucuaugggguugaauguaugagucucagggccaccaggccccauuuguugugcugaacuuuuauagcauguugaagaagccugccuuauccuccagugccuacauugcaauauacaaguguugagagcacgugcaguuaaaaaccacgggagguggccuaagccuuuuuacugugggaaaacagcccagcguugacucccagggcuuggcagcagcagcagcagcucaugcugcccuguccccagacucugccgagguuucugacacgcaacacaagaaacuaagaauucaaaagccuuguuaguucagcaucacuggaggugcagggagagccaaugcuugccaaguggaggaaggaggagugugauagugagaggaacuugagcucuaaguuuagagacuaugaagacagggugagcauagcuccuuaaguccuaguccuuuugucuguccaggugaaacguucaaauuagccaccuucaugaaaggacucaugaaauguugguuauucugugucaaauuauauaguauaaucacaagagcucuuugaugcucaaagcaaaccuguggucagccacuuuauggaguacaguuacucccaguuuaugauguguugguauauuuggcuuucuuaaaaugaaacaaauauguauuuuguuuuuauguauauuuuuauuuuaugcgcaugaguguuuugcugcaugucugucuguauaccacaugugugcaguaccugccuaggccguaagaggaugucagguccccugaaucugaagcuacaggugguucugagccacuaugugggugcuaaguaucaaaccugggcccucuggaaaagcagucagugcucuuaagccauuucucugucccccaagcaugugguuuauguuuuauuuuuauuauucuguuuuauguauaugguauuuugccugcauguauguaugguauccagagaggccagaagaggcauugaaucuccuggaacaggcgauugugagcuaccauguagaugcugaaaacugaacccaggcccucugaaagagcagccagcuaucucuccacagcccccagcuauguuuuuuuguuauugugauuugguguuuuuccuccuuugaaacagggucuaucuuaacuuuggcuuaauagaacucacuguguagagcaagcuggccucugccucccaagcucuagaauuaaaggugugugccaccacacccaaaugaacauguaaguuuuaaagcaaguggugauugguuucucuggauucugugaguaauacucagcucagagaagcucauuacacauugcuuugaauuuacagguuuucugagagacucccucuugagguuuuaacucugcccagcaguuuucucuguucuagacuuuguagcagauuugggaguggcuucagaauuuaggcuucauucagauuaggaagccaugguuucacaguucaaaacuauggccaguuaaguuuugcugagcuaugauaaagacauguuuuuaguguucacgcacucucccuaucucccgcuucuacauuaugagucacugcuaagaccuccauuggagggaguuggaagaagggaaguuuauagacuagugcugcuucacugaggcagagggcucugagauguggcauugguggcaagggugagauuguugguguaaguuaagacuuuuuuacuuacagguuuauuuauacauuuuucacuauguauaauuguuuguuuuuguuagcuuuuuaaaaaaggaaacuuaaagaacuuuaauaaaggaaacaaaaagcuucuggucugagauuaaugagcucuaaacaccuucauauuguccuggcacugcauuugcagugaugcuuaaagucuuagcguucaaggcugccacuuucagagggguugguguaugccauuguguguguuuucauggugugugucuguggcaguuucuguggaaaagagcagggauggauccccacaaugcauugagcacccuaugcacacacuguuuaguuaguaaaggacuguccuuagagugacuacugccaaagucaggucuguugguacccugggcccuuguguuagguucugcuuaguugaggugauuaaaacaaacaaacaaacaaacaaacaaacaaacccccauaaauauggagacacaggccuuugcuccuauuacucaagaaucagguagaucucugaguucaaggccagccuggucuacauagcaaguuccaguuagccagaacuauaaaguaagaccuuguuuuauaaacaaaaccaaaaguaaaauaaagcaauaauaaaaauauacacaugggaaaucauuucaguuuugaaguguuugaaauuuaaaguaggccaccuauucugcuugcaccuagaccaccacugaucucauuuucucuuuauuuucagagucuuuuauucaaaacuucaguguucucuacagccccuugaaaaggcaucucacuggaagugauucugcucaguuucccacucagcauuugaucacggaagugacgacugauaccuucugggaaguaacccuucggaaacagguaugaggugggagcuagggcuucauggagagcacugugaggccccacagucgugggagugaagaccgcuccauggagagugcucacucuguagugacccguccugaucacuacaggaacaggauuaggagugccagagaggaacaaaagucaagcccucuaucccucuuaguuccuacgcugugguuauuugagggaaaacggucugguuuugauaggcagauugguuugugguggaacaugagcagauuacauggugcuuuucuaguuguccaaagaccauaaacaaaaaucgcaauuuuaacuaaagaugaaaaucucaccaugauuucugcacaggcagucgaguugacucaaugccuuuggaauucccagcccagcagaaagugagggccaacagcaggugugaguaaauacuguccccuucccacaggacguucugcugcucuauuauacacagugguguggcuuuugcccgucucucaaucacaucuucauccagcuagcucggcuccugccagaggacacauuuacuguggccagguaaggacaccagucuagcaucacgggccaugcuguucuugguuguuugguuuugguguuuguuuguuuguuuuguuguuguuguuguuguuguuuucacgacagguuucucuggcuguccuagaacucacucuguagaccagguuggccucgaacucagaaauccgccugccucugccucccaagugcugggauuaaagacgugccaccacugccuggccugcugcucuuuuaauccucucugccaacccacccaugcugggugggcuggaaguuaaugaucauaaaaaugcuuauugcugacuggaacacauaggaaaacagguccaggucuggcugcuuagacgucuugagaaagugguucccagaauugcaguccagcccuggacucagggccuuugcccuuauuuuccucuuuauugguguaauaaagaggaagacuuuguugauagccaugugucuaguuaugacugugguugcuuuauguggacuuuuguauaaacacauuuuaaaucuuuuguuuugagagagacucucacucuaguucagguuggcuugagcuuacuauguagccuaggcuggccuuuaauucuuggcaguccugccucagucuaucaagugcuaggguuacauaauucuuggcaauccuucugccucagucuaccaaguacuaggguuacagguguaagcuaccaugccugccuucaaacaccaguuuaauuacauguauucuuugacaguuggguaggugggagauguuugcuuuguucuauuuuguuuugagacagucuacuauguagcccuggcuggccuguaacacacuguguaaaaccacgcugaccuugaacucagauccaccuacaucugccgcaaaugugcuaggaaugaaggagugcaccauuauacccagcuccucggcaguuuuauauguggauauaugguacacccugaguacacucaaugcacacccuuuuucuacccucaugccuguuaaccuucuuucuuucuucccuguaagucauguccuacuguuuuuguuuuguaaccgagcuuaaccagagucauccacaugcucauggguguggagcuguacccuagaacauagaggauauaccaguggcuacacuucugaagcugaggacuucccuucccugggcuaaugaguccccaggagggacaggccaugagcccuucccauaucccugaguaaauguuauauguucaugaaugcaguggcugugucaugcucagaauagagcagagcauuucacaucccucccccaaucaucaguucuuacacuuuuccaucuuccugaguuccuucaucuaccaccguuggcugcagaaagaagucucucugaugaaggcugagagcagcauuugccuguggguauaagcauacauauuuacagagcauuugcacauuuaguaaauuaacacuagcagguuccccucuagggccugugaccuucauggccauggccuuuugaugaauuuugauggucuuuuugaguuaugaagcaggccucaaaucuagucaggaaauagucaugccacugaugugcuugugggccacaucuugucuggaggucagcauggcgcaggcaagcucugccauugcguaagaucauugaugccuuuucuuucccagcugccugauggcauuuuaugguccugugaccuuccacuucuuuuccagcuuaauuucucuguccugcaacugaauuguguugugucuacaauagguucuagucuggucagcaaccaagagcaauauauaauaagcacuuuaacaagaccucaaauccagaucaugaagugagcaguuuagaccagaucauggggaaaaagcagaagauagagauaaaaucuuuccagugaaagauaaugaaagguaauucauauccgcuagaaggauaugcagugaaaacaacauacucgaugugaaugguguucuuucuuucuuuguuagugacaggauuacaccuaggaccucaugcaugcaaagcaaauguucugccacuuagcuauauuccuagccauaauuuaaauaagcacauguauauuuauauuuuacuugcugccugcuauuuacucucagaagugacugugcaaagagauuguuauaugcauauauacuuaugccucagaacacuaggcgggugaaacugcugacuccaucacuuucuuuugauuuaaggcacagaaauauuaggcaacuuguccagaacugugcagcauguaaauuaggggccggcauucagacucgaguugacacuauagcuccaccacauuucaagugggccggagcuuuaguguggggugcagugcugucuggcaugcacagugccugccuuauuccuaagcucaccuuuaauccugguacugcacuagggagucagaggcaggcaaaucucugaauacaaugcuagccuggucuacagagcuaguuccaggacagccagggcuacagagagcagcugucucaaaaaaacuaagcaaacuaacaaagccagguaaucaaaugugaacaaagagcacaggccaaugacagaguaagcaaacaacaggggaaccagucaccuaagaaauguaaauaaggugucauuuaugcuuacuaaauuaauaaaugcuuucaagugacaggaucuaguauugauaaagguggcauaguccgacaacauuuacauuggcaacauuugcaagaagucacaaaaaaguuauacauuucugauucaguuaauuuuucuuuggggacuugggaaaauccuuacagcaacagauaaggcauguaucagugaugcuggcauaguggacauuucuguccauuccuaaaucaguauuucccugaauuaauggagaaggguaggguaggcugugucagcucauaagccacacugagaggauuccaagaaggaacccugguagcucggugcaguuccuguggauuugaaaggaucucacuucacagugaacucuuuauugaaguacacaauuggagggaaaacgcauucaacuaugaagaaugguggccaaaaccacuuggcuuucacaagcagaggcagacaugccauuuuguuaaaagauguggaggaaaaauuugcauuugguugugccaauuuuagacuuuucuguauguauuuaugaaaguaucccaggcuggccuccaaauaccuauguagccaaagaugaccucgaccuugugacccccuugguuuugucuccugaguguugaaguuauagguaggugccgccaugccugguuuaagaagggcuucgguauaaauuaugcuaaacaagcauccaucaccuugucuucuuuaggguuuuacugcugcgaacagacaccaugaccagggcaacucuuauaaggacagcauuuaacuggggcuggcuuacagguucagagguuccgucuuuaucaucaaggcaggagcauggcagcauccaggcaggcauggugcaggaggagcugagaguucuacauuuucaucuggaggcugcuaggagaagacuggcuuccaggcagcuuggacagggggucuuaaagcccacauccaccaugcuacaccaccuaauggugccaagcauauacaaaccaucacacaccucauccacauuccuuggccauauugcaguuuguacaaauacauaacacugguuuauacugccugaucaucccauacuacuuauaccuuuugaaaaaccccaccaaauuaauagguccaaggaagaugugcacugaucaugaauauccuccccuuaaaggaugccaucagcccucugauggaugggucagcgcacgugcuucucaucaccugcccagcugcugcuggagggaguucacucaccagagcaguuguagucaguucuacacuauacauaaauuuguauacauaaauuaaucuacuguccucgguggcacauuccaguaaucccagcacuaggggugcugcaguaagauggcugcugagugguugaaaccauccugagcuaagcuagcugaacuagaccaauugcagcaccaaggccccugguggggagaagaggaggggugggguugaauuggcauucuguuaagacaguacauugaucuuggccuucauauagauuuaucgacuauaaaguauacucuucaaagggaccuacugugugugcuguacucaguagcuuuccuuuucuagaacuaaugccagauccugaugaguagaugaaguacuuucaucgagacaacucgggauuuaugcuccguuucuauuacucaggguacacagugacauguuuauaaaguguaaaugccuugacuugcaccuguaguaggggucggucuagccugggccacagacacacuccagauucuucagguuuggggcuuguuuggccaaucacuccuuaccagucauuuucucuuugccuccgucaggaucgacgugucucagaaugaucuuccuugggaauucaugguugaccgucuuccuaccguuuuguuuuuucccugcaauagguaaggcuggauuuuuuuucaauauuguguaacugagcuuccauuguaaaucacucaucauguucuaaacuauuguuaaaguauuacuauuagagauagaguagaagagcuuuaguguuggaaugucauguauuaguauguuuauuauuuguuuuuguuuuucugagacagggccucacuauguagcucuggcuguucuagaacucauguagaccaggcuagccuucacuucaaccuaccaaguagcuggugauaccuauaaaguaucacgagauagcuggugugaaccuauaaagacgcuacaguugacaggaaagugcucauguuugugugggaugaauccugcuguuacuuaugugucccucucacccaaggggcacugacaguucucuacccacugcucuauucauagagagaugucucugcauguauacagucugcucugaaguugucugucacccagcugugcugaaagcuccaccaaacagagaugggacguuagcaaggaggguuggacuuagaaguguagauccgggcugucgagauggcucagcgguuaagagcauugacugcucuuccgaaaguucugaguucaaaucccagcaaccacacgguggcucacaaccacccauaaugagaucugacacccucuucuggugcgucugaagacagcuacaguguaguaaugaauaauaauaauaaaucuuuuuaaaaaaaaaaaaaagaaguguagguccaaacauuuccacaaagaaggaaaugaacucuacucuaaagccaaacaagcuggaugcuggcucccuugucacucacacacagcuucccuuuggauacauaauagagccacgugggaacugcucucaccccugugggugugugggaaaugcaggguccuuucaggagggcuagccuuggcacuuacaggucacugcagcacugcugugcucaucuggcuucucugccagagggcuuccuuggacuuccauugucucuguuuuuuucccuuuaucucagagaacgugugcuagaguacuuccugugguagguagcuugucagauaacacacuaaaaacagagugacucagucuguuccauuguuggcucuaacacaaugaacucucuucuuuccaaggcauguuuaagcugccauauagucaagaaaccaugggcacagccaccagcagcuccaucugugugugacccagcugggcauguaguguaaugauaguaacguuacagcacaugguaaaagccuuugcaggcagaggcucccagcaaaugggcugaugagcauguguaugugcagggcaagugcaccauaggagcauccaugcccagcaucccacuccuggagcugccuuguauaguagaagaccaagugcaggccagguauggucuugggaggcagaggcagguggagcaacuuggguugaaagcuagcaggaauuauaaagugagacccugugucaaaaaauaaacaaacaaacaaaaaccaacaaaccaaaaaaaagugaaacccuaggucccugcaaccccuccuuugucccuugauacugaagagcagaagacugucacaucuguuaaacacagagagcuuaaauuagagucucucgcuuuagaaugagauuuuccgcgucuccuaaaaaugggcacaaguuagucacugguccagagagcauuacuagaagcuuacccaaaagguagaagagaaaggcauaaugugacuauuuauugccgguacaaaaauaaagggggcagcggugcuagccuggcagggagcagucgucugaggacugugggggccacuagacagcuucuaagagcugaaaguggugcaggacuaucaacuaucacauccaaaggugcacagaagaggaaaugaaaccacuguggguggggucacauguaauaagacuuuucauguucaccugauccugcuauuuuuagugaaaguuuggugcacuguggaaaaugcaaauucugugcacaaaguggagaugugcagcgaagaacgcuaaggugucaacauggcugcuucugaggugugagggcugcgagcauuggaggaugcugcuuguauguucucuacaucccugcugucuaccuugacugugccccacuguugagagcacuuaccagauuauuaauagauacaguugacauguacacuuugaaauucuguguuguuacaugaaagucuuaaaaaucguaaaaagcuaccuacagcaccccccccccccauaaacguuacauaaaggggucuguaauuuaguuucuuuuuuguugugaaauaggaucuuacaguguaguccaggcuagcuucaaacuuugcuuuugccucuuaagugcuaggguuaccagugugggucaccauguguaguuuggcauaucuaauuaggucucuagugauuuuugauaggaagaguguuaucuauuaauaaaacauguucuuucauguuuaguauuugugugugaaaagguuauacaaguuuucaguuaaugcauauuccucuuuccauuuuaauuuuguuuaauuuauuuugguuuuuugaaauagggucucuagguagccuuggcuggcaucaauguacuauguagaccaggcuuagcuucaaacugauagagauccaccugccucugccuuccugaugcugagauuaaaggugugugccaacaugcaagguuuuuuaauuuaaaaaagaucauauguuguguguguguguguguguguguguguguguguguguguguuuuaucuaccuguaucugugcagcauguauuuacaguacccucagagguccgaauauggcaucaaauagccuagggaugaaauuuuagacaguugugagccacuaugugggugcugggaauugaagccaggcccucugaaaaaaguagccagcaaucuuaaccacuaagccaucucuccagccccagcuucguugguauauuaaggaacaaugcaauuuuuuuuuucuuuuuugagacauaguuuuacuguauagcccaggcuuguuucaaacuguggucuucuugcuugagggauuaugugugauaccauaaggguuaaaaaugcaguugggaaaaagcugguguucgacacucacuuaacccuuuaacagccuugugaggcaugggacacucccaccaccaccccauuuuacagagcucaagccauuugucugagaauagauggcacugagcagggcaacauaaaugcugccuuugggguccugucagcucuguuccuuacuuucugagggugcugaucccugccuguugacuagcuaagggaggacuguagaaagauguguuugaguuaccgugguuagacugccuaugcacaguaccugugagagaaacuuaggaggcugggcaauuagaugacaaguccugcguuagagcaugggagauguggggaccccuuucaauguaaccaucgucaacucuugugcuguugggguugagcuguaagaugagugaguagcugugacucaucuuaguccuucgguugauacguuggcuuagcaacuauccagguuugaggccaguguccccucucuggaguacaguccccucaguuaagaacacguugugcuguagguacuguacauuaaguguauacucuugcugguuuuguuuuguuuguauuuucaguuuuacugagcacucuugauagccaugguaacugaggacagcccugugccaggacuguguucaccagcuuuguagcucacacagagcgacaccauucuuccccgucccagaugcacuggguuagggcuuaggccuaagcaugcuuaucucucugaagguuaguacagaaacagcucuguccuuaggaacagauauacuuuauucaaauggccuuaauaacugcagugcaagucuguugggcuccucaacucuacaaagaaccacuugcccaggcagcauugccugccuuucagcaagaagccagcaucuuuucuuggucagaauagccagucucacauccagucccauuugucucuauugugccuauugagacccucacuuuuggcuuucccuuccucuccagaaaggaccuaagugugaaauacccuggagaccucccuaucacccucccgaaucugcugcgguucauucugcaucacucagacgcugccucugccccccaggacccuggcaucagcccuccuacccaagacuguguccagagcaaggcagugcugcagcgcgaacacaucucucacguggagaaugcgaugcagaagcugagaucugagaugagcagccuacgccguacacaggagcagguggagggcaggcuccuuagugcccgcagggaugggcaccgccugcugcgccggcagcggacccuggagcagcagcacaggcuacuccggcgccacagccagaaacugcaggcucuguauuuaaagaaggcgcgagagcuccaagagcuggcuagagccucaggaaccccccuccccgagcacacauggcucaagauccuuguggccacuauggagagggagcuggaaggccaagguggggcuaaggaaccagccccucugggaaaggcucgaccgaaccacuccaaguccauggguacaacucaguuaccuggugacaccccuccgcccuccaccaccagcuccacuuuggcuucagagacgaagcaugagaauaggacagacuaacuuuugaaggagccagaggugaagacuguacauugggaauauaguuaugcaaauuuuauugaaauuuauuguaaauaaagaucuuucucaguggucuacaaaaugaacucgaaugucauuuagcauuuauugaucaggaauggcaucccuuccacuuauugcacacacugguagcuuugagacacagcaguagcacaguccauuugaacauauaucuaggaaagucaguucuugcuucaguggcuuagccucggaguuccugcaagcuccccaggaugaaaggcuagcuucguaaccaucagaagaccugacccugacccucaauaguuacacuauugggaaaaaaaucugaagagaaguuaugacuuacuaaccauuggaguguacggcucugguauacacuuaaaaagguagccagugauagccaaggacagggaagacuugcaugguuguucaacaguucuauagguguucguucuccauaugaccucaccaaugccccacagugccugaacuuacucgucccucucuggauggacugacucaaacuugaaagacccccuggcaacagggggugauaggaagcucccccaaaguguaacugauaagaauguggugaugucuguuugaaaagccaacuucaucagcauaguacaagcugcggccugcaucugacccugcagcgaugaaccagcucaaauuucgguguagauccaagcuggccuuggauccauggaugauggagaaaagaaucagcaguguuuaggcugcuggcugcaagacguaggagguagaaagguggauguggggugggaaucgguaaaaccccuccgccucagccaacuccagguagauccuuugauaccuucuguuccccuccuagaccuacagagucacugcucccaggacuaacacacauccaagaacuccuuagcagccucuguccauggccaguccaucuuugacuaccucuguguaacuaagguguuuaacaucugccucccaaccccauauugguauacacugcuaagaaguguuccuucccuacagcuccucccucggguucuaggaaauggauuaguuucacaugcuuuucaaagcugucuccagacuagccuggagcucucugcucucugcaucaccaaggguaccagcauagucagguuuaaucauaaugguucagaaugcuuacggugaugggauuaacaucugagcaagcuuauagacauaagaaauauccuggagacauguugcugguucccuuaccugugagaaccaggcccugaaccugaacucuuggugacucuuguaaaugcuaugugcacaauagaaaugaccuucuauagcacagagugccuugagagcugugucaggaagcucugacuacaaagccccaaggaucaaaguaaaacccaauacccacuggagaagaaaggaagcucacuugugaaaaggugggguguggggaugugcgggggggggggggggggagggagccacuccuacccccaacccccauuccagugcagaaaauauuaaauacaaaaacaaaaccuugucuucuugagccaacuggguuucagacuucaaguagccuccacaggcucuggugucugcagaggaccagagcaguuucugcaaagccugggcugaagggguguacugggcaugcucaaaaccaaagggcaagagacugcucugccaagcugccuggcaacccucaggacucaugaggucucauccuucacaggcuuccaagcaagcgcaacagcuuccuugcagugacuccgccgucuacacacacugcucuuuuaacaaagcugaacuagagaaagggagggguggggugugguuuuccuccauuacgaagcaagcugagauuaccccaacaccccagcuucuuaaccuccuuuccauacgcaucacuaaggccucagugcacccugccgagggcaacuggggccugaccaguccaagacccuccauggucguaccucagcuuacguugaguacagucauuaucaagccaguccacgggcuccaucugguauuuuaaaaaaaucagcaaaaaggcuuaagcacgugcuucugggccuauuuacaguucacagguugguuaguucacgcauuacaguaguagcuccaucaaaaacaggcucagcuaaaacauucaaguaaggaaagcgcuaaggggccaggagccccagcaaggucaggccugcccacugccugcaauggacagcccaccaggaggcggagggggaaggccagaagagcugggaccuggagccagugcaugcgaugacaaagcccgaggagaccaugccagcaagugucaaccccucucacagagcaacgugucugcuuccacccucucagugcuucugggcuggcugcaaacagaaccauggccuuggccuucacagcccagcucagccaugcacuucugggcuguuggcggucaucaacuuggccuuucuuuccacacauggccccuuagcagaguacugcaccaguagaaagggcuccuuugucucgccaucacccacgaugcucuccucauccucugacuggcugaugcgcugcagccgcagguagcaccagcagcccaggaucaaggcccccagggcagcuauggcgaugaggaugacaaugaccguuaccaccccggugguggggcugugguccauaauagacauggucagugcuuggaggggcuucuuugguggaaagcucuuggugugccuggcucaacgaggcuggaauucgggcugcacaggacaguccugaaagacaaagccaggagagacuauacaaggggcucuguaggggacaacccagugacaaccauaggauuggcuuuccacugugucugccaagaugcuuacccagccuacuucccccagcuacuucugccacccaggugcuuccgcugugaguggaaagggaaaugggcaccauggcagu

SEQ ID NO: 8097 - RNA, 16580 nt, Mus musculus
cggaaauucccgcuaaugggaacugacaggucuccauucuuuaaggguggggaaaggaaaaccgagaacccucguacagucuccgaaccccggccgaacaccggaagccagucgccacccauacgcggggugggccgcgcauaacacccgcaaggggcgaacccgacaccggcgagcgcgcacucagcuggcgucgcgagcguccccaaaccgagacacuuacuaacacggacgccccgcgaucacccagcacccaggaauaacgaaaugcuaaaccaccaaaagcuagugcguggaugucggccaggcaguccagguggcaggggccgccgcgcgugcccggauuacgacucccgaggagcccgugcagccgguucggggguccgcgccccucccccgccugaaguccguuaacggccgcgcgugcucacgaagcgacgcggcgcacgcacgcgauuggaagagcgcgacccugcccgcgacgcccgcgcguccccuucccucaccugcggggcggcacccaggagccgaggggcgcggagugcggaggcgacagcgggaugugcguucaccggcucaagagcucucacagucucgcagcuucccugggcgacccaccgcagcugccagcccgcgacgcucggggcggcgcccucuggcggcgggaggccucgcgcgccgccccgcaaacgcuaccauuggcugcguugccagugucagcccgggguuggaggcgccacgucggggccucggggcugcggaagcggcggcgauaggcggaacccugggcggccacacggaagggggugagagaccgcaagcucuugagcccagcaucaucgcccucucccacaccgcuuggauaccaaaguaggacuggaaggagaccuagauucaucugggcaccagggugucacuuccuucggaaucuguucucugcaguaacuuauccugagcguccugcuuugcauuccgauacuguuaccgucacccugaaaacagccauacagucguguccuuucaaaugaaugacaggcauagggacccgcguugaacagggaggugaccuaaacucauucggacgccggagcgucacuucggaacuuguccucaauucccuauccuacucgcagucacuguuuuuaucaucuugaaaacaaaaugcgguauuuuugcaaaugaauguagggacggaucucagagccaacacaagcucuuguucucccuggccuucaucucaacuuauaugucgcuguauucaccgguguuucaguggucagguguacauuaccccagacagaacaauguaaggcugagucccugcgacuggagaugugaaaagugcuccaagucagggcaguagaagggagagugcuuccaggcagugggaaagauccugagccuaaguugcugagggacagggaagacaaaguguguguguagaaagcucaaagaggaugagccacugcaugaaauuuggaauucagugucugagauggaaauuacaaggucuaauuugcaguuuuagaaaguuucuucaugccguugggcggauauauagaaaggacaagcagaaaagugaaagggguugaggauguaacuuaguugucaaagugcuugccuagccuugaguuugauuuccagcaccaaauaaacuggauauggugggguacccuugucauagcaguacauggggguggggggggggggauaggaguuccaggucuucuuuggcuaugaagcaagaaauacccagguccaggaccacuggggacagagggaaaaguuuacauuagaaggaagacacugagaugcacucugucuggacccagagugcuacuguaagcucaggaagucgucaguacugggccaguacaaagugaaacuugaugagaauguauggacuuccuguuguuccuguaccaauggccuacauuuuuguugccuugaaacaacauaaacuuaagaguucuaaaggaccagagucugcagcagguguuucacuggugauguccaggugcugacgaggcuugucccuucuggaaacuaguguugagcucuugccucuuuuuagcuccuagaggccuccuggacucguaggucaugccugucaucuccagagccaguauuuuccucuaaaugaggucuccuugccacaccuucucugggucuuugcuuucaguugucccucaaagggcccuggugauugcauuugaaacaaggagguccuggaucccaccuggagauucccagugauuuuccaggcaagguagcaauaaucacaaguugcuggugauagagaguagauauaucugggaacccaucauuauauguacuguagggagcaaaggaaaagaagggcugagcauggaugaaccuucucuagccuugaagaauacuguguguuguaagggucucugcuucuuugucuucuauacuaguggggaaguccccggccucuuaccugggugcuguaccggauaggugcauuugcugaagaacuguuuuaggcuccugccucccaagggcuggcauuaaaaguucaucacuaucccagucuuuauucuguuuuccauccucugguaccuuacagaggcccggaacacacaguguuuuaugaucucuaugagauugaggccagccuggucuauguagaguucuagccagggcaauggagugagacccaguaucaaaacaacauaaacuguccacaugcugacuugccuuaacaucaauuuauaccugaaacuaaaugcaagcuaaccauuagucaguucauuagaaauagggucaauuuacacaaaggacaggggagaauauucaggagucaaugggacagauuuuauauuugauucaucaguuuauccaguaauuauaugcccccaaacaggugaugggauagaaagccuugcaugugcuagacaagcucccugccacugagcuauagccacagaccuuuuaaagcuuauuuuuauuuuuuaaauauuuuuuaaaaacuuuuaugugcauugguguuuuaucuacauauauaucuguauuuaugugucagaccacagggcgucagaucucuuagaacuggaguugcagcuacuugugggugcugagaauugaaccagguuccccuagaagagcacccauugcucuuaaccucugagcaaucucuccagccccaaaauuuauuuuuauuaaugugcauguguguguguguaggcauacaagccccaugaagcuggagaggugccaagauacccccaagacuacucgaacaggcuuaccugccuuuucaaguuucugucuuucaagacacaagcagccaaacgccacccugcaagggaaaaaaaaagcccaacaucaagccauacaaucccaccaaucccucagcuugccccaagaucaggucacaaaaucccaccaaucugacaccaccucguaagucuucacccacuccccccaagaaacccuauauacagccugccuccugcucaguccugugcugggucccacuagaaacccuauauacagccugccuccugcucaguccugugcugggucucacuagagcaagggcugucacccucuucuguuuuucccaugugagguuucuuguacagugugacuuugugguauuucuuggcuccuuacugccaggauaccuuuccccuuagagcucuuucauuuacauaugcauacacaugaaccgaaucgggaacagaguguggguuuccccacuaaguucuaucauuuggaggccccagcgagaucugcgugacacccaggaacccugaaagaccccuuggagguacguuuguuugugugagucuucuauguugucuguuaaguguggcaccgcugaauuugugucuugguuuuucaguucugagauuguggguuugagucccaccuugugucuugguuuuucaguucugguauucuguauucuggcagcugccacuuuggaccgugaggaccuaguggcugcaggaggaagacguucuaaggccccacaggcugcaacucuggaagacguuccaagggugacccuggaggaagugcccagggugagggacagucagaaaggucugacugucaucuggcagagugagaaaaauaaggugcuuuuucugccagaaagggagucgauguggaaucugacccccaucaaguaguguuuggcugguuguacaaguccaggagagaaugagugugcuuggauauacuggugucuuuuuucucuguugcugucuuguuuuuguuugugguuuucgucaugggacacagacaccguacauuggagguaaaguggaaucccucccugccugucugucuguaugucuaugugucugucugucuuguucacuuguguguccuccauuagaccaccuucugauucuguuuugcuuuugguuugucugguuucaggucugguuuugcucucaagggguugacugauuaucuugguuuggccccaagagacuuuucacuccugcuggucgggugaaggauuuccagcagucuaugucccuguacaaagaccagcaucuggcagucauggggccaaaacaguugaaaaugauauccaugcaaauucaacaagaccucugauuggacacugaaggugagccccucucccucccaacucuggagaaaagcaacuucacuucuccugcugugcuuucagucagugccaucauauggauuuggacaacugagauuucuugccagagcuacucucugguguagacagaaggucccuuuagccccuugcuaaaacaugacagccccuaacaggcauugccaaagacucuguaacuuuguuuuuuuuuaagauuuauuuauuuauuauauguaaguacacuguagcugucuucagacacuccagaagagggagucagaucucguuucggaugguugugagaugguugugaaccaccaugugguugguugcugggauuugaacuccagaccuucggaagagcagucgggugcucuuacccacugagccaucucaccagcccaacucuguaacuucuuaaaacaacagaacaucaacaaacccugguacaacagcagccaguuaaaagauaccagguggcugccaguacuaaaaucuaugggaaggcuuaguuuuuuuggaccccugaggaaucccaaugacuggauggaaggagugggacucuccagccuacaggcaggcuaggagacacagaaagggauucaccaugcuuuggagggagagagagucucaccagccaugugagauuucggguggaauggccauuggcuucuucuccaggcgggagauuagaaauuccacuaaggacuagagagauggcucaguggguaagggcacugacugcuuuuccagagguccugaguucaaaucccagcaaccacauggugucucacaaccaucuguaauggaaucugaugcccucuucuggugugugaagacagcaacagaauacucauauacuuaaaauaaauaaaucuuuaaaaaagaaaaaagaaauucaacuaagcugagggcagacacaggugcugagcaaggagaagguuaaguggacagcuaagcuaagggcagacacagaguugaggaaggaguaaaggaaaaggcacacuaaccaugggaggcuuagaagaccccagccacugagcuguaaggcagguuaaagaugagcagagugugugugcgugugugucugugucugucugucugucucucucucucucucucucucucucucucucucucucucucucucugugugugugugugugugugugugugugugugugugugugugugugugugucuuucauccucagauccaaggcaaccagaguaguagcugguauuguggucuauccggagccuaaagcaggguaguagaaacuacacacuucauccucccuccucccuaagugaacaaagccagaaaccuaccaaaaacauagacaaaaacccacauaaccccacagcuccccacacucaacucucuacuaugccacaguuuuguaauuuucaugacucuguugcaaaaacaaacucuuccucccauucuacuaaggacugcuaggugaagccagaaucccaaaacacccaaacagucccuguuaauguuaaccccaacucgaaacaaaacugcucaacugguauaaaaagccauccuccugaggacacaauccaagcucuaaauucuguuaaugcagcuauaaaagacaugacucuuuugagccagauaugacccaacaaugcccauacagcuccuugucuuuaacuccuccccuacacucaugggagccccauaucaaccccagggugagcugaaauggcuccacaccccaagggguaguguacccagaauucuaaaugaggcggauguacuagcuaauaugauuaaaaauggcagggucagagcccuacaaacuuuggaaaaagaaauugacauucuugucacccucuuuuucccucgccaauauucaaugucuaagcaaaacucacucucccuuugcuaucagcuuaauaggauucccgggacaaauuaacaaccauuauccugacaaaaaaaauggaccucugcccucccucuguugcaauggcugccuccaaacuauuuaagacaacaacaacaacaacauaauuggagcccuauaggaaaaaaaaaguuuuaaaaauuuauaugaguacacuaacacugucuuagcacaccagaagugggcacuggaccccacuagagaugguugugagccaccaugugggcacugggauuugaacucaggacuucuggaagagcagucaguccucuuaaccgcugagccaucucuccauccuggaaaaaaaaaauugcaaccuacuuuuaauaaggguucaaccucuccucuagccaaccacccaccagaggugguggaagagaaaaguuauucagauaugggggaaguggaccugcuugucaguaguuuucuuugaaggugaguuugagagcuugaucuucuugggcagcaguucagucccauagcagacaucaaauaugaugcagcagcugcagaccaguccucuaggcaggccgacaccaggcacaaaccagcagccacaguccagucuuucagcaaguagacaccagucagcuguaguucaguccugaagaaaaugccagguuugccaacuggccugaggugaggccucacaaguggcaagcugccucaagaaccucaugagcaguucuuggaggaguuuuucucaauggcugaguugagcucagcaaugaguuguaagguaggccaaugcauccgugucauuaguaaagaauagcgaagcaaaacaaaccaaaggaaagcccccacugucuguggcaccguguuuacgcucccucaucacggguccuuucauguguugcuauauccaaacauccuuucaccuguggcugcuucaggaaaacagucuuucuuucuuuucuuuuuuuuuuuucaaagauuuauuuauuuauuaaauguaaguacacuguagcugucuucagacacaccagaagagggcaucagaucucauuacagauaguugugagccaccauguguuugcugggaauugaacucaggaccuccggaagagcagucagugcucuuaacugcugagccaucucuccagccccgaaaacagucuuucauguguuugcuuuuuuuuuuccccccagacaggguuucucuguguagcccuggcuguccuggaacucacuuuguacaccaggccagcacugaacucagaaaucugccugccucugucugccucccaagugcugggauuaaaggcgugugccacuacagcccagcuacauguuugcuuuuagcaagacccuuucaccugugugccccagggagacauuugacauaaguaacuuuacaaagaaacuagaaguuuccauugcagagcccccucaauauuuacugauggaggaaagaggggugcugcagcaguaauauacuacuccccugaggaugaacccccuauucuacaauucugagagaugccccaucacucucugcaauagaaagguuaaggggucccaaaggaagucaaguggucccuuaaccucuuuucagacagugcauaugcugucaauuugcuccccugacuguccagacccuuggucaaacuagaugccaacccacuuucuccucuaaucacacggguuuccaccucuuaaaggaaacagccucccccaucuacauguggcgugucagaucucacaguuccaugccaggccagaucucucagggaaaugcacucgcuggccaaacugccucaacaggaccauuccuagccugcacugagcaagcagaccaguuccauucacacacacacucaaacauaaaggaacaaauguaucugcuuccuccauaccccucuuguucagcucagaggacaauaaaggcauguuccucuugugcaucccucauuaccaccccaacuuuacaguuggugggcaccgauccucaaggccuuaaguccaaugccuuauggcaaaucaaugucacauauuccccaaaucauagacaaaaaaaaaacaaaacaaaaccuguuuuuguugccauagauacauacauuguauauggucuacagcccaaacaggugaaaacucagaaagguuaauucuccguaugcuccccaccuuugccauggugggcauuccuuuuuguuguuguuguuguuguuuaauuguuuuuuguuuuguuuguuuuuuuuuaagacaggguuucucuguguagcccuggcuguccuggaacucacuuuguagaccaggcuggccucaaacucagaaauccaccugccucugccucccaagugcugggauuaaaggcgugugccaccaagccuggcuguuuuuguuuguuuguuuguuuguuuguuuuaauuuacuuuaugucugugaguguuuuaguuuuugcauguuuuuugguguacuacuugcaugcuggaugcccucaguauucagaagagggcaucauauccccuggaauuggaguuaugagaagcugugaucagccaugugguggugggaauagaagcugggugcuccacaaguauagguucuuaagcacagagacaucucuucaggucugggaaauggaggaucuuaguguaguaagaaaaauaguccaggauaaggacagacauccucucgcagcugcagaaaugcaagugguaacuuugcaugcauggauguauaaccugugaagcucaguagggccucuucauacaggcacacauguaaagcugucuucagaacuuucagcuggcauuaggcaagguacacacuaguuuaugaaagaaaugagcuuuucucaccugguacaauggguacauuuuguuguuguuguuguuuuagcagacuuaauucauuuauuuuucuugcauaaaaacccuuaugugguagccacagcuggagccuggguccucugaacagagacucugguguggguuuucacaagaugaucagugaauuccugauaagaagacuuggugaacacagucucuuuccagaggucaggagucuagcuguaggucuuggagauggcaucaaagguauccuuggcaaaguugcccaggguggcagugcagccccuggcugaaguggagcagucaucuaaacuggccaucaucaguugguucuugggcacaggagcagagacaaugccagugccucugggggcagggaugagucguaucagcacagagccacagcugcuugucacuuugccuggaacaauguggggcuugccaaucuucuucccccaguagccucuccgcacagggacgauggaaagcuuggccaagaugauggccccucggauggcaguggcgaccuaguuggagcacuuaacaccaagaccaacguggccauuguaguccccaggagcgaugaaugccuugaaccuggucugcugcacuggcaugauuuucagaaccucauccuuuagggaugcacccagacuccauaaugggcagggagaacagguagaucuccucgaaggacuugaucuucauguccuuaaccaggcggcccagaacucagaaauccgccugccucugccuucccagugcugggauuaaaggcgugcgccaccaugcccggcugggguuccacuccuuaucuucagcuuuaccuccaugagccccgaggccuugaccauggccacugccucgaccucgaccauggccauggccuaaaccuugaccauggccacagccucagccacgaccacggccgcaaacccuaagacugcugccaaauccuccgcagagcugcggccuccuaauccuggccccacccccccauccccggggguccuccggguccuucugcuguaccggcagcgguauccaccauuugguguuuucccaaagaagaagccaauggguacguuuuguuuuguuuuguuuuguuuuguuuuguuuuguuuuguuuuguuuuguuuuguuuugucuuucgguuuuucaagauaggguuucucuguguagcucuggcuguccuggaacucacuuuguagauagaccaggcuggccguggugaacucagaaauccacuugccucugccucccgaaugcugggauuaaaggcaugcgccaccaugcccggcucaauggguacguuuuaaguaagccaacaauuaccagaaaugguuucuuccaaagcaguaaggacuuucagaaggaagugucuuucaguggggagucggcagagcugacucaguuuuaugcauaggcccuugaaugcagaauugaagcaaccugaacucucaugguugggaagugggggaaggcguuccacuaaacagaguauccucuuaauuuauugaccaaugugagugugucaguuguucuacagagacugaagaaaauccuaacaagagaaggcaauguaguaguaagccggcccguggccuacaugaaccagguauuucuggaaggcaggcuggggcugaaagagagaauagacagcgagagaaauaaugaagccaagacaaauuuucucugaucaaggccugcgaguuuacugagacugugcuuaaaagggggaaggcccauuccaccaccaccaccccccccagccaguccauccuuggugcuuugucgcuaugcugucagcacuuggucgccaggcuguugcuuauucaggaaugucucaggaagacagguucagcuucuccgcagguagcagcaucucggagaagagcagggcaguugucacuucaaaggaagccagccaagucggaaagcuguacugcagguggccccaccucaguggcaacaaggucugcacaagcccgcuucaggcugggggaggcuucaaggcacaacacagcagcucccagagaagccuaugugagauauuucuaacauuggaagagguuugacguugcuggaguuuaugguugucuccaccugcugagaauuugguaaagaugguauuuauuuauuuauuuauucauuuauuuuuaagguuuauguacuuuacuggcuauccuggaagauccucuguagacuaggcuggcuucaaagucacagagauccuccugccucugccuuccaaguguuaggauuaaaggugugcacuaucacucugggcuuccuuuucuuuuuuuuuuuaaaugacuuuuuaaaaaauauuuauuuuauguacacucacugucuucagacauguuagaagagugcauuggauccucuuacagaugguugugagccaccaaguaauuggugggaauugaacucgggaccuauggaagagcagucagugcuccuaaccacugagccaucucuagagucuuccccaccccccagcuugcuuuuuuuuuuuuuuaaauuaaaaacaaacaaacaaagaugagccuuugaagcccuagaacucuggaacuugcuaaguagacuaggcuggccuagaacucaagagcuccugccucugccucucugccucucucucugccucucugccucugccucaggaguguugagacuuaaaugccucgucacaacuccuaggcaggauguugcuaaccaggagcuuuacagcuaacacaagcccuacacagcauuuuccauauaauuugagcacaggaaucauuugacagcuaacaaccagcacagagugcuaacauuagaccucacaccaugucaaaacccgggaguuauguaugcugaucauuuuaauaccgagcuccauucuggcucuccuucccuagcucucuaguuguuuuguuauuaacuagaaauuuuaaugucaaaugggaaauauuuucuuuuaggacagacgucaagaauugagacaucucuaacucuuuuggaaaacaugucuuacuugcuaaauuaucuugcugguccaggaccagcuacaacuuauggucauaggcuuugguuccugaauacacaggcagcuuuuuuuaugccucaugaaguccuagaaaguauuuuaaagcuuugucuaucccaagcuagccuugaagucuugauccuccugccuacaccuuccaagugauggugaaaucauaggcaaaggacauuaguugaugcucucaugagcagaacucuuauaaaugggcuacuuccuaggguggguuuuuuuuuucaguuuaauucagaagcaucuauaaucuacugucuacacugccacuuagucuaaauuugucugguuauuuaaacagagaaggcugcacacauuucaccuacgaccagaggaacagcaucuggguuggagucaagaugccuaaacuacaggccaaagucauugugcugcaaaaugcuuuacugcuuagaagcacuugggaaguagaggcagccuuuuaagugcauccauauucuuuugacagcauuucacuauguaacaaugcuggcucccuguuuggcucuuaagauuaaaaccaggacuuaggcuggagagauggcucaguguugaagagcacugacugcucuuccagcgguccugaguucaauucccagcaaccacaugguggcucacaaccaucuguaaugggaucugauaaucuguuuugggucuucuggugugucuaaaggcaacuacaauauacucacacacacauuuauguuuguuuauguggaguauacuguagugcacugaggcacugcauuaagacucuauaccaaaacccuuccagacaagccauacaaagcaagaaaccccucugcuccauuuuguaguugauuuguuguugggguauuuugccugcacgaaucuguguaccauucugugcuggugucagaaggcuucaaaucccuggaaccguaguuaaggggaggccuccuggaaccgguuguggaacucuugaaaaauuauugagcuguaguucuugugguaauauauauuuuguuuucuuauuccuuuuaucuuuauuuauuuauuuauuuauuuauuuauuuauuuuuacgacaaaauuagucacuuuuauuucaaagaaaacaguacaaacaaguaugcaaaaauuaaguuucaugauuaaauacacauaagguaacaugcauacuugacgucaaauccacaguuagccgauuacaggagcauaaaggaacuggcagagcugagagccuguugcugugcacaauuuaaauguuugcaaccugaaaucaaaacugcaaaacugagcuucuuagaagauauguaaaaaaacuaaacauauaccucaagugguacagaaacacagacucuccagucugugccaguaccaggaugugccugccaucccaauguuaguguguuccuauggaugcugggagagaugagacaggacaaacgccacaggccaaggcaguacccuccacaccgacgggagguagaggcacauggacacugcacugagaaggcuccucaguaaagcaaugcucucuucugggacugauuuuuaaagacuauguguuacucuguucccuaaaaauaaugggaaaguucuguuuuaacccaaacaaaaccagaagacccagcacccugcugugccucaaaugggugccacaagcauucugcucucugguaggucugggaugugacucacucuaauggccaaagucagaacuccccagugugugcucugaauagugcuccucaugugaggcagggggugcucuaccagacaagcugauaguguuaucucauuagaacugucuaguguuugagccccgacacacucauccuacgagcuucuguugauucgugccuggaucguucccagggauugcagggagucuacugucaugaauaugguggugccacuaaugcuagcaucacaggugaauugaagggaaguggccagaaagggcacgagucacccagagccacggagugucugcagaaccauaaugaugauccuuuaauaugggaugagaagccuugcucaggaaggcagacaaccacauauggcuucaagaccaagguccucugggggggccuugagccccucacccacaggccuggggcacuggcaccagccccaggaguccacagguugacugggugguggcaucaccugcgcucacaggcacagucacagcuugucaucggucaucucuaggaacugugcacacacguccaggacacacuugcccuuaggacugaacaggaacuuguaguagcugccaucugcacagauagcgaugacugcauugggcucuguuccaaaggcacagaugcauggcgagccugaaggaaccugaaacuuggaaaaacuccauuuggagcugaaguauuuuggaaggaaaguggcugaugccaaacuauacuguuauugcuuuuuggaucuucggcuacaaaaaugugcacagugccgugaucacuggacacacagaugagagaagcauccugauugaaguugaugcaauagauauuggcugcuugagauccucuucguagcuccuggauuaaaugccccaaugaaguaucaaauauucuuauaagggucccuuuuucagaugcaguugcaauucuuguucccuguaaguugagagcaauacagcucaggacacccucaugugcgggaauguccucugguggcuuuucaguguuggcagguccacaaacuguacauggccagugugagugucagggaaggcaagaagggaguuguuacuguugggacacaggacacagaggccuuuaggauuauagcagguuucaaagacgugcaacugguagggauugugugugagugugaacaccuuaaucauggaguccagaaccaccacaauucuaucucugcaacuugacagccuugaccucuguggagaauucucucaaugacugucuucuuccucagaucaucaccuuguugggaggguauuucaguuuuuuuuccaccaccaacuaaagcuaaauaguuacagcaaaauaacauuuccacauggccaacuccuccuccuaaaaauucuuguuucucuuuuugaguggaucaguauuauagacucggaaucuauuuuccauuccacaugcaaaacacccgugauccugguugaagccggcguacagcagcccauugccauggggguuacaugauaggagggucugugaaaccaggucgagcggugcuagggccaccgcggucggaagccagggucuuauuucuuuuauuuacauguuccugauagccuaggccaagaucuuaagcgagaaugguaaaaaaaccaucccuugagauugggucacuaguaugaccuuauuccccagggaaaucaauucuugacuuuuuauaucauuuauaaaauguagucuccccuccccuagccugaaaccugcuugcucaggguggagcuuccugcucauucguucugccacgcccacugcuggaaccugcggagccacacacgugcaccuuucuacuggaccagagauuauucggcgggaaucggguccccuccccuuuccuucauaacuagugucgcaacaauaaaauuugagccuugaucagaguaacugucuuggcuacauucuuuucucucgccaccuagccccucuucucuuccagguuuccaaaaugccuuuccaggcuagaacccagguuguggucugcuggccggacacaacaauaaaacaguuaugauagauuaaaaacuuucccaacaauaaaauuucauauggcuacaccuguguuaucagagguggguuuugguauaugguaaagaaagucuuaauuagaaagaauuaguuuaaauuuaugcauugaagauuuauaaaaaaucaggcacuagauguugaauaauugaccauauggggcuggagagcuagcucagugauuaagagcacuaucauaaagauuaaccugcucuugcaaauaugccaguagccuugaaugacugccucacugaauacauccuuuuagaauuguuauauuuugaugauuuauauuaauaaugauguuaccuguucuguaugugauucacugaauacauaguuucagaguuguaaugcuuggaugauuuuuguugguauuugugauugauucacuggauacaguuucuaagagaugcaauguuuggauuuuaauguauaaaauccccugcuugagagcuccaaaauacagucggauucaaauugcc

SEQ ID NO: 8098 - RNA, 1008 nt, Mus musculus
uuuagcagacuuaauucauuuauuuuucuugcauaaaaacccuuaugugguagccacagcuggagccuggguccucugaacagagacucugguguggguuuucacaagaugaucagugaauuccugauaagaagacuuggugaacacagucucuuuccagaggucaggagucuagcuguaggucuuggagauggcaucaaagguauccuuggcaaaguugcccaggguggcagugcagccccuggcugaaguggagcagucaucuaaacuggccaucaucaguugguucuugggcacaggagcagagacaaugccagugccucugggggcagggaugagucguaucagcacagagccacagcugcuugucacuuugccuggaacaauguggggcuugccaaucuucuucccccaguagccucuccgcacagggacgauggaaagcuuggccaagaugauggccccucggauggcaguggcgaccuaguuggagcacuuaacaccaagaccaacguggccauuguaguccccaggagcgaugaaugccuugaaccuggucugcugcacuggcaugauuuucagaaccucauccuuuagggaugcacccagacuccauaaugggcagggagaacagguagaucuccucgaaggacuugaucuucauguccuuaaccaggcggcccagaacucagaaauccgccugccucugccuucccagugcugggauuaaaggcgugcgccaccaugcccggcugggguuccacuccuuaucuucagcuuuaccuccaugagccccgaggccuugaccauggccacugccucgaccucgaccauggccauggccuaaaccuugaccauggccacagccucagccacgaccacggccgcaaacccuaagacugcugccaaauccuccgcagagcugcggccuccuaauccuggccccacccccccauccccggggguccuccggguccuucugcuguaccggcagcgguauccaccauu

SEQ ID NO: 8099 - RNA, 2174 nt, Mus musculus
auuuauuuauuuauuuauuuauuuuuacgacaaaauuagucacuuuuauuucaaagaaaacaguacaaacaaguaugcaaaaauuaaguuucaugauuaaauacacauaagguaacaugcauacuugacgucaaauccacaguuagccgauuacaggagcauaaaggaacuggcagagcugagagccuguugcugugcacaauuuaaauguuugcaaccugaaaucaaaacugcaaaacugagcuucuuagaagauauguaaaaaaacuaaacauauaccucaagugguacagaaacacagacucuccagucugugccaguaccaggaugugccugccaucccaauguuaguguguuccuauggaugcugggagagaugagacaggacaaacgccacaggccaaggcaguacccuccacaccgacgggagguagaggcacauggacacugcacugagaaggcuccucaguaaagcaaugcucucuucugggacugauuuuuaaagacuauguguuacucuguucccuaaaaauaaugggaaaguucuguuuuaacccaaacaaaaccagaagacccagcacccugcugugccucaaaugggugccacaagcauucugcucucugguaggucugggaugugacucacucuaauggccaaagucagaacuccccagugugugcucugaauagugcuccucaugugaggcagggggugcucuaccagacaagcugauaguguuaucucauuagaacugucuaguguuugagccccgacacacucauccuacgagcuucuguugauucgugccuggaucguucccagggauugcagggagucuacugucaugaauaugguggugccacuaaugcuagcaucacaggugaauugaagggaaguggccagaaagggcacgagucacccagagccacggagugucugcagaaccauaaugaugauccuuuaauaugggaugagaagccuugcucaggaaggcagacaaccacauauggcuucaagaccaagguccucugggggggccuugagccccucacccacaggccuggggcacuggcaccagccccaggaguccacagguugacugggugguggcaucaccugcgcucacaggcacagucacagcuugucaucggucaucucuaggaacugugcacacacguccaggacacacuugcccuuaggacugaacaggaacuuguaguagcugccaucugcacagauagcgaugacugcauugggcucuguuccaaaggcacagaugcauggcgagccugaaggaaccugaaacuuggaaaaacuccauuuggagcugaaguauuuuggaaggaaaguggcugaugccaaacuauacuguuauugcuuuuuggaucuucggcuacaaaaaugugcacagugccgugaucacuggacacacagaugagagaagcauccugauugaaguugaugcaauagauauuggcugcuugagauccucuucguagcuccuggauuaaaugccccaaugaaguaucaaauauucuuauaagggucccuuuuucagaugcaguugcaauucuuguucccuguaaguugagagcaauacagcucaggacacccucaugugcgggaauguccucugguggcuuuucaguguuggcagguccacaaacuguacauggccagugugagugucagggaaggcaagaagggaguuguuacuguugggacacaggacacagaggccuuuaggauuauagcagguuucaaagacgugcaacugguagggauugugugugagugugaacaccuuaaucauggaguccagaaccaccacaauucuaucucugcaacuugacagccuugaccucuguggagaauucucucaaugacugucuucuuccucagaucaucaccuuguugggaggguauuucaguuuuuuuuccaccaccaacuaaagcuaaauaguuacagcaaaauaacauuuccacauggccaacuccuccuccuaaaaauucuuguuucucuuuuugaguggaucaguauuauagacucggaaucuauuuuccauuccacaugcaaaacacccgugauccugguugaagccggcguacagcagcccauugccauggggguuacaugauaggagggucugugaaaccaggucgagcggugcua

SEQ ID NO: 8100 - RNA, 458 nt, Mus musculus
ggcaggcagcgcgaggaggcagaagucugguggcccaucugucgcaggguggggguagggguaggcucuacucggcuagggcaagacggugggccgagcccuuccgcacgaggcgacgauccacccuagccugugagaacacccgguccgcaggccuaaccuagaggaauuuuuuuuucuucucccuuuucggcgccuuuucugucucccagucuauauaccuuauucucuuucucuccacccgcagccagaguuugcccuacauuucaaagccggcgggaggcgucuuuccuuuuauguauucauuuuuggaagaggcaguaaaaccaugagauguuacagcugaaacugcguguggcucauaaagguccaaggauguccggcaaaaggauccuuaacuggaaaauuucagugacucauguuauguuugacuagucauuaaaagcccgcaccuaaaa

SEQ ID NO: 8101 - RNA, 3075 nt, Mus musculus
auaaaguaaauaaaauguguuuuuaaugaaagcccugagcacacacacauucuagccacacacccccuccccaggcuagcgcuggcucucugugcucucagaugaaagacgcugggacagaccaaggcuguuuugcauuuuucugggcuuuguuauuguuucaagguaacauuuguugauuuuucuuaaaauauucagcaacacacaaguauguugacaaucacaagguuaaugcaauaaggacugaggaaaagaaaaggaaaauucggaaauucuuuucuguaaaccacuucacuacuaucucuugaaauucuuauuucuuucugagucuccaaggaggacgugggcagccaggcccucugaccugcaccuucuauaagaacaagcacgcuacaagacccuagcuccuuugucaaagcugacggguccauaacuagauacauggccuaaacuggacggaucugauucuccuuugggccguccugucucuaacuguguuggucuucucuuagagacaguauugucugggaccaaggacgaccacugcucagugcucugaagacaaauuaaagagaacagaagagaagccgaggugagacacuggaaagugagacuguugguuuacuuccuguguccugagaggcucacgcggugggcacauugcucauagucgaucguaugaugccccugcauccuaugucaaauuuccuccgcccuaaagguugcaaugaaagagucuguuagucuguuugugucuugaggauccagcugauuuucuuccuuccucaucagucuugagccucuuccauagcccuguggguggcccucauccuccugggagucucaucuccucaucuauaaaacaugaacagaaauaacgacugcauggguuuaugaaacaaguuaaauaagauauaguucugcaaguauagaaaaacuauuauuauguaucaccucucuuuugguagaaaauaaauuacuuaauagcaaagacuaugugugugugugugucugugucucugugugugugucugugugugugugucugugugugugugcguguguguguaugugugugugauuguguguguguguaugugugugugugcaucuguguguguaucuguguguguguguaaaucccaggccauugcaagagugucagaggaaugagugguggauacuugaugaguuccugccauggaugaacuuguauguaguacuucaggcuccuagagauaguuagauauugugugugugugugugugugugugugugugugugugugugugugcgcgcacaugcacgcaugugaggaugcagaacacauaugauacaacaugcuuguagugcaacuucagauguggucucuugccuuuaaccuuguuggaggcaaaguguccuuuuguuguuagcucucuuauuccaaacuaguucacccaugagcuuccgaaaucuuccugucuccucuucccaucuuacuuuaggaaaaucaaagauucagauuugcauugcuguguuuggcuuuuacauagauucuggugauucaaaugcagguccuuucuauuacagugucuuaggauuuuacuaauaugaacagacaccaugacuaaagcaacucuuauaaggauaacguuuaauuggggccggcuuacagguucagagguucaguccauuaucaucaaggcaggagcauggcaguauccaggcaggcaugguguaggaggagcugagaguucuacaucuucaucugaagucugcuagaagaagacuggcucaugggcagcuaggaggaggcucucaaagcccaucccacagacacacgcuuccuccaaccaggccauacuuccuaauagugccacucccugggacaagcauauucaaaccaucacacacagcaagcaauuuauccccugggcugucuccucugcccagauauuacuaucaacuccuucuugccugugaggaaaccaaggcuuagaggaggugugugucccucggagccacacagcuugcaguagcagcagguuugcaguuugcuguuucugcccugugagcuuccccagcggcuuucccaagcuucagggccccauaacugcucugaaucuggaaggcauuggcagagcagaugggcugccagggagcagcaggcugagccuccugccugcccuacaucugcucccuggaagucccuggagcuggagcugauguggaaaccagggacaggacaggaacucuaccugccaccugcuuggcaugcaagccuuucuuuacagcaaggguuggugacaggagccucccacggacgugcagauuccucuugcucacccaguuuaaucagguggagaugccaagccgcagcaugaucaccuacagaugccacaugggcagacgccacccgucaccugcguaugccucagccucugcuccccacuccacccaagguucuggggcauugcuuugcuugcugcugcuuuuauuuuaauuaaagcaaaugagucauccauguggccaaaugcucaaacagcagcagaagauauagacagauauagaugcagauauagccucaaagcuccuuuugcaauacaguccuccaaggccaccucccugagagccgucaccgcuucagucucuuagccuuccagaaaaacuucaugcauacccaaaucuaagaaucuauuuuaaaagcacaggcacacacauuuuccucuaguuaaugugccaugcugggaccuucucagugucccuugguggagagaaugcuuccugugcugccccaggacugugugacgucguuuuguuauugccuggaaugggugauggccccacccagugccuuggugagcacuucacauaaccuggauuugcuucggaugcagggagcuucauagaaagccagcuccugguggcagaauuguugggucaaauguuaccuuuacuuuuaauuucaauaaaugucagcaacuuaccacuggaaauuguguagauugccagggcaaguuucuuccugcucaguuucccggugugggguauccagcugucuuugagagucugaacauuccuuuagcuccugca

SEQ ID NO: 8102 - RNA, 5443 nt, Mus musculus
gcauggauggaaggauaagagccuggcucuucacugggacaucauuucggggagugggugugggggggggguucguguagggaggucuggaagcuucaaggcuggagguagaagacaccauguuucuuuuguuccuucucugcugguuggcuuguuucaggggcacaaauugcuuuugaaaccuuaaaggaaaaugcaauaaaaauauuuuuagauauuuuagacauucacugagguaggcucugugcacaccgcugaagcagcugugccuuuugaagucucucucucucucucuuugccgagaguagguuucuucauauaguccugacugucccagaacucacuauguagaugaggcuggucuaggacucagagauauccuccugccucucugccucccaagugcugggauuaaaggccagcccucucuaaucuauuuuucggagaaaacugagggccagagguugacugauuugcccaagggagaacagcccacggcagagucagugcaaggagcccaucagugcugaagauugucaugggaugcgggggcgacaaggaguggggggugauaugcuucaccuacaccugccauaucguugagugacugcugggccaccccaucuguggagaaaagggacaggcuaaaaguucacauuugauugagguuugcauuucccagcaugcaucaguguucacuggcacucauagaagggaucucauagaggaguugcucacauuaugugcagauaggagcuuucagacuuggaucugggucaaaaagucuucagaucuggaagguagagcaucuaggguuugaucaggaagaguccugccaauuggugguggcucccagcaagaccacaaagugacugagcucuggggacagcuguggguuccguucuuuucagucucagcaaaugguauuggacauuuagacaggaaggggguuggaaugauauuugaagacuguuuggugugcucacuuccagauggccacaugggaacccggcugggguggagaaugguugcaaacaucucaaaagcauaugugcaaauaaggaacuugucaccaaaguugucauucaaugaacauguugaaugcccacugggcccugaguacauguagagacugccuauugcaaauucugcaggguagggcaaaagccgucacacaaaugccaggacguuggccuuugagcuugaggaguacaggaccagaagauagcaauccugcaggaagaggaggaaaggcaugaggcagaagaacauaugcaaaggcccagcgucaggaagagcugaugugugggaggaacagaucauguaucuguacagggacagagugguuaugagagagugacaaaggcugggguuggcgauguggcaagagcggggccaugcagacuccugccuaggugagagagagcucacaguggagguuuuuguggguagaaacacgagugauacagucucuuuuuccauaaaagaggucauucugguuucuagauggagucugucuuagucuucuuuccacugcuaucaccuaagauuaaguauggaaagagaaaaagaguuuaaauuggcccaugauuuguaaggcccagaagagaguuuccugcuucuucaacccguggcaggaggcuguguucaugcuugugaagguuuggucuuacucucuauuguaaugcuaagugugggcccucaagaccugagugugggcucccaaaaccuggagucugaacauagacccaaaugacucuucccacaaguuauuucugauugguaauaaagaugccaacagccaauagcugaguagaagagacaggugggguuuaagauuccugggccuaggggucagaggagaaugaggaggaggaggagggagaggaggaagaagaaggggaggaggaaggggaggaggaagaagaggaagaggaggaggaggaagaugaagacaccaugaguuaggagucaaaaagcauugcccuaagggcuagccaauuggaauuaagagcagcccagacaaaacauaguaauaacucaggguuaucgauagaaaaguagguucuaauagcauagaggguagauaucugccuggcucuugugcuguuuaaggcuuauuguaaauauaaagguugugugaggggcuggugagaugucucagcagguaagagcacugacugcucuuccgaagaucuugaguucaaaucccagcaaccacaugguggcucacaaccaccuguaaugagaucugacgcccucuucuggcacaucugaagacagcuacaguguacuuauguauaauaauaaauaaaucuuugggccuaagcgaggagggaaugagcgggguuaaccggagcgaguggggccaaccagagcgagcagagguucuaaaauucaauucccaacaaccacaugaaggcucacaaccaucuguucagcugcaguguacucauauauauauaaugaauauauaaaucuuuaaaaaaaaaaaaaaaaaaagguuguguguguuuuuuauccaggaacuaaauggucaaagcagggucgaaauccuggauuggaauuagcguuuucuccuccacaugcucaccucucaaggugaccccagucuagagcgaccguguccuggcaagcacaggaaagccauuuaccccucuuaccugcacacagcucauacucuacagcauccucagcgcucauucagugugaagucugacaagaugagccuccuggagcagggucagaggaggagugugacugaggaaugaagaggcaguuggcuuaaucugaaagagaaaagguggcagcuuagaugacgguggggauacuagagcagaggaaugggguggacagcaggcggagccaagcuaguggcuuacuuuucucuacuuucucccccaaauuuuaagcuucaugagcacggagaggauugcugcaucucucaccucugguaugcagaaguuguugcuucuauaauaaaucuaaaauaaauguaggucagugcccuagagaucuaggcuaggacagccccucucuucacacagacagcccacccaguuuuguggcauuuguugguauaguuuccuggagguucccuacugagcucugaagacacagacucuguucuugagggauuccgauucuaauaguagaagaccuggguuagaaaucuggcuuagccuuuaauauauuuguugggguuugcugcauaagagacaguucccagacuacacuuuaaagcagccuagagugaaugguuuuaugcaccaacugggugguuccucagcucaaugcaccuguuguuaaugacuaugguuguugggagugaccuucuuuagcaguguggagggacaguugacaucaguuauugacuaaauuaucucaguucuucacaaggcuuugcauuuuuuaauagguaagacuagcauccuuacccagcauuuaagucaucagcgcagaagcuucuagaacacucuauuaguagaaacacuaagagaacagccuagauucagaggaguagaaaaauagacuucaccuuauugugagcaaaggaagaggcuuauucugggcuuguugaaucugccacacuggugugagguccggagcccacaccuuggccccucugcaucuuugacuucagcgaacgaggucguauaacaucuguuuuguagaauuaguugugagagaaugaaggugauguuauaugaaaagucuguagugccuuacugguuccuuagaaagcugcuguuguucagguggugauggcacaugccuuuaaucucagcaucugggaggcagaggcaggugaaucccuguaaguucaaggccagccugaaaccugucuugaaaaaacaacaacacaacacaaaacaaacaaacaaauaaaaaaaaagcagucacuggaaaggaaauacuguuuuuaccaaagcaacugggaauuuggugacugcauagagaaugagcuuauaagauuaauaguaagucacauuauuccaugggguuuacaauaaacagcagcucuugagcucaaacaccuugauuuguaaagagcccugaucuauuccuuaugcucaaccauguguauuugucugggaagaggguaggcuagacaguuccuggccucccucagccgguagcugcgucccuccagccuuagccuuggagucucuaugccccucccuccucucuccuucccuuucucccuugcucccucccuccuuguuauuacacaggaucucacuagcuuuggcuggccagagcuugcuauguagaccaagcuggccuugaauucacagagauccacccgugucuguaccccaagugcuugguuuaaaaguguaagcuacuguuccugacuccucucuucuuauaaggucuguacucaaugaaguuagaacccacauagucccaggugaccguguuuggcuacaugauuacaucuacaaagaugcuacuucuggggacuggagggacggcuccgugguuaggcacuggcuacacccugaucauccagauugaauucccagcauccgcaugguggcucacaaccaucuguaacuacagugcuagugcaucugauguccucugcuggccuccgagaauaccaggcauggugcacaucuguccauccaggcaaaauacccauacacaauaaguacgauauuuucuauuuuuuuuuaaaaagaugcuauuucuaaugaggucauaggcugaccuuugguuucauguuaagcuuauagaacacaguuuaacccagcauggaaggcaaagcaaaagcagaugcuaaugggagaaaaucacagcuacgaaugcaaagcuauggggguuuaucccaggagugaacaaugcucucucaggaucuggaaagcaggccauaggauuugaaggugggcagacguacaggauucacacagugcacagaacuguggauccccagggaugcacuggcuugguucccauaaacucugcuuuuagagcacaccagcuuaucuaggacccuggaccacguauaacaguuucuccaggccuuguccuccaugucuucccuccaucugcaggugaguacccugccugccaacacucacaccauuauccugccucugucugguuucuguuauaacaaaguacucaaggucagguaacucaaaaagaaauuuucauuuagcuccuaacucuggaaggugagaugcucacaggaaggggagaugcucacaggaaggggagaugcucacaggaaggggagcugcucacgagugugaugucugcucagcuuccaucuggguucacacagcauuuaacagggcagacagcauccugcaucuagacggcaacuaaguagcauuugcauaaaugaugggcugauggaggcaggauacuagguccuccuguccuccugguugucuagcucaaagucuaagagcugugucccuagccgggacug

SEQ ID NO: 8103 - RNA, 9638 nt, Mus musculus
ucaagguucaaauuuuuaauggcagacacgcuuuauaaaagaggguggaaaguccauucccgccaauucauccuuggagccuggaaccagcugcaggugaugacguaggauagggcauagucuccagaagagcucccgggccucucagcagguagcaguauccugaagaggaacagugacuguggcucaacaauagagugagcuagggaggaaggcuccacccuagauaaucuccuuaguggcagcaaggucaaguucuaguuuacccugcuucaggcuuaugggaggcuacacuccuguaugugugaaggaugagguaauaguuccucuaaaguuucagugcaggagugagauagggaguggucaguauuuggucgaggaagaagauuggaaauauuaagaggugggcaugauuggaaggugagugugaggucuucuauuagagcuaccugaagagaaagaacccuggagggagguagaaucuguaagcuuuuauaaguuaggagcugugacaaguuaugagaagacaguuauaggugaccuaaagguuaguuuuuucaacucuugaauaaggaguucaguggcugcuaagaugcccaucccuggaugguuagaucuaguuuuuuuuuuuuuuuuuuuuuuuuuuugacaaguaugcuauggcugcaaaagaaggucccaguugaugaccuaagacuccaagggcaaaucccuccuuuucaguuacguagagggaaaaaggagaucagguuagggagauguaaagcuggggccuuaaggagagccugcuggagccuuugaaagggcuuggaauagguuugagaagagguucauggguggggccuaaugcugauucauauaaggaacaagaaaggaggggaaaggaaggaacccaggaacauuaaacacuagcuaugccuaggaaugauaaagucucuuccuuuguagaaggaacaguuagagacugaaucagauucuuucuaagguaauaagccuuuuggguugggguaauuguuagucccaaauaggugaccugaggaguggacaguuguacuuuagaaggugagauccuguagccucaacuggagaggaaauuuagaagagcagaggugucagcuuggcuagagaggggcuacagaguaggacaucaucuuuguaaaguaugaucuuagauuuaaggagagacagagauaguaagucagaagccagggccugaccaaauaggugugugcugucccggaaucccugagguagaacaguccagguaaguuggguagaaaaguggguaacaggaucuguccaggugaaggcaaauauguucugugacugggcaucuagagaaauagagacaaaugcaucuuugagaucuaggacugagaaaugggaaguccccgaggggauaguggaaagaaguguggagccuuccucccuagaucacucuauuguucaccacagccacuguuccucuucaggauacugcuaccugcugagaggcccgggagcucuucuggagacuaugcccuauccuacgucaucaccugcagcugguuccaggcuccaaggaugaauuggcgggaauggacuuuccccccuuuuuuccccccucuuuucuaaagcgugucugccauuaaaaauuugaaccuugagcagacuaguugucuugguuccauuauuucucaacccacaacaggauggagaggaaccacugcagaauuaaugugccugaggucuugaacgaggcgauagguaccauuagauuucuuaacugcuaguauaaggguguuaaagggggaagagguagggcaaagaagcuuuuuucugaaaaggucagaaaugauagacuuaagaccccugaggcucuggagagagaggggguauugaguuuggguuauguaccugguagaguccaguaauuggaugacaacaggagaaugguguuuagaaacaaagggguucuggacgucccagccucggggaucuaccugagaauguaguaaaggaaauaaauagcaugguaguguuaguaggcuggcuggcuagaagaaggaacagaggaacuguuggugagcuuggguuuaggcgaaugggaggagcaaaggaaauagaggcuccccacucagcuaaaagaucccuucccaaugaaggacaggacauguuggcacuaccaaaaaaagaaugggugagagguacaccccuuaaaauacaacuaagugauggggucuggugagggaaguaagacuguccuccuacccugacaacagaaaagcgagaaguggguccccaaaacucugucaggacugaguaaguggcccuagugucuuagaggaaggagaugggcugcccacacaccacaauaucuaccuggggcucccugcuagugauggcaguggucgggucaggggagcucaggccuugucagucggccauagccaagccuaggagaccaguuagaggauuguuugggggugaugucccucuguucuguguaacaugagggcaaucgacagcccaaugucucucuugauggcaccuagggcauggcccccuuggcuugcggaaguuagugcaggcuuuugcucaaugaucuuguugaccacauuuguagcagguaccugguggucucugggucuuagaaaaccaggagucaagggcagugacuggggcucguuggauagccugugccagcauaugguauuguuguuugcaaacuuucucaucucuuuuaugguauacuuugaaggccagcacuaaaacuucugccuguggaguuagggguccccuuucuagcuuuuuaaguuuagcucuuaugccgggguagcucugggaagagaaauaggucaucagaaguagcuuaccuucuggguuuucaggguccauauugguaugcuguaauaaagucuuugugaggcauuccaaaaauugagauggauuuuccugcguguccuggacaaccucuuggaguuuuucaaaauuuacuggcuuuaaggcugccuuucauggauuggagaaauggcucagcgguuaagagcacugacuccucuuccugagguucugaguucaacucccagcaaccacaugguggcucacaaccaucuguacugggacuucuucuggugugucugaagacagcuacaguguacucguauacauaaaauaaauaaaaucuuuuuuuaaaaggcugccuuucuaagaccugccaaaaggcauguaauaaaccugucucuggcuaaaauaccacauguggaguuauagucccauugaggguccuggucuuagaaaggcagccuuuuagaacugucuccgaucccauccgcucuguuugaugaauuucgucugcacguguucuugcuugcucccaaacucgccugcauuccucgggaaguaaguuaucaguaaguaucauauguacaucguggaaagucaagcuguaagauugagugauauauugaaacucuuuaauaaaggcagaggaguuagaggugaugguccacauggccgugaucucacugcuugugcggccccugcuguggugugugccauagcagcuguugaugcuacugcugauuccuggguuucagcgccaaaacgauguauuaaaacagcggcuuaugucugaacacagcacacuagaccaaaacaguuccaugggugagagguuuauuggggguggggggcggugguggcagaaagagaagggagaaaaaagagagggagggguguuccccuuauuuauaaugacgaaaugcagguaaagguaccacuggauuuuauccucagcuccagagcaaaauucuuuacagaaguuauagcuuaccgcaggaauuugacacucgugaugaccaaaucacauggaagggaaugaauuauccaaagucucccagauuauacuuggaauauaaaucaagauuauuuuugggagccgggcgugguggcgcaugccuuuaaucccagcacuugggaggcagaggcaggcggauuucugaguucgaggccagccuggacuacagagugaguuccaggacagccagggcugcacagagaaacccugucucgaaaaaccaaaaaaaaaaaaaaaaaaaaaaaaaaaagauuauuuuugggaaagccuucacccugagucuucucugaagauuucaggaaggccauaguaagcaaaguaaaguuguucuucuaacaacauuaguucuucaggauaagaacuagguuuaggugcaguaacauguaagcccaauucccaaagcuuuacaacaguacacauucauuucuuaggcuggagagaugguucaauggguaagagagguugcugauccuguggaacaucagaauuugguucccagaacuaagguuaggagguucaguaucaccuggaacuucucacauuccagggaucuagcaauccuucuggcuuccauaggcaccuguacucacaagguuauauucuauauaaagacauacauacaagcauaauuaauuuuucaaagaauuacuuauuuaucuuauauauacuuuagcuauaugcuaaacauuguagcuguuuucagacacaccagaaaagggcauucaauuccauuacagaugguugugagccaccaugugguugcugggaauugaacucaagaccucuggaagagcagucagggcuccuaaccgcugagccaucucuccagcccauauuuaauuuuuuuaacuuuaaaaagguuuuuuuguuuuuuguuuuuuguuuuuuuggugcgggugugugugucuuuaaucccaacauuuaggaggcaggagaacuucugugaauucaaaggcagccuugucuacuugucuauagagugaguuccaggacuacacaaagaaauacuguguugaaaaacaaacaggaaagauuucuuuccaauaccuuauaacuacaacagacuaagugcuuagccuucacugggaccagcaguucugagacugaaggaaugauagacaccgacacuugcuaccucuaaaagcuucugcuaaagagauaccuaggucccuuucaccacauuucauuggucaagugacccaacuuccagccugcuaggugaaaugaucaguguuauuaaugauaaggcauacaagcuacccaaacacuggggggggggggggguugguguguguguacucaucccgggcugccucuuaacucaauacguacccaagaccugaacuuguguucuuccagccucagccugcagacugaugggaucacaggcacacaucgucugguuuagcuguuuugcuuguguucuccauuaauucucucucucucucucucucucucucucucucucucucucucucucucauuuguaugugugcacacgugcacacuuuguuucuuuuuccaauacuauaguucucuucaaauauauaucuccagcuuugcaaucuuuauaaucagaaaauaaguuucuuccuuuugcccacaccuaaaucaaauacugccugguaagaaucuuuaggccuaggucguccaccagggggcggccuguaccacugcuccaggaauuccuauuggcagcaggaccucugccuagcugagucugucucucuuccuuuggugucuuugcuccauggucccaucacauuccuacguaucuggaaaguucaucucuuacguggcuuggagaguuuucuuuaagucccgaggaagaggaauugcaagauuucugucccugaccucauguucuaucucagcagauuucaguccuggaucuaaccaccagggcuauaacuagauucaucagcuucacccucugcagcauuuuccacggggcaacccucaaccaaucagagacaggagccuagagcuucuuucguuuguucuccgcaugggcacuuaggauacaauuucuagaugaauucccuagaaggucuuguuugugugagcucugcucacucagacacagaaacuuguucuugcauuucugccuuccucuggcuccauucucugcucccuggauauacuuuacagcccaggcucugcuuuugggaaaugacagaucauucagucugagacauggagguucauacccuggaaccaaaauccuuugcuauccugucauuguccugcucccaucuucacaucccuuaugucuucauccugucccuacagucaguagagacuucuggggacaaaacuguaccugguccucuguuguguuccauuaaaggaccugcccuugaggacaugguggucaguccaugcuagggacacggugaaugaauagcagagggacugaaucaaguuucuuuucuucccucacuaauggguguuggaccuccagccucaaacauacuuaacagcaagcacauccacugaucagcaucuccagcucucuguuucuucaacccccuuaucccugguuuaagaaggaugucaguugcucaggcugaccuugagcuaacucaguagcuuugagcuugaccucccuuggacuguccuugaacuugccaucguucugccucagccucccaagcagcucugggccuguagaccuaccugaguugauucuucuucuaacauuuauuuagcugauggagguggggaauguggcuaaugugccugugaagggagguggcucucgacuuucagcauacacuuccuggaaucagauucaggucccgaggcaauguagcaagugcccuuagccacugagccaucuugcuggcuccuagcuuucucagacaugcuuuuacucgguagcucaagcuggcuuagaacucacuauauagucuagucuggucucaaacucacaacaaucuuucuaccucagccuuccaagaggucaaugucuuuuucacagagcaaaacugaggaaaggugagaaagaacucccacgggaggugcuccaagagcggagugcucugcaugaagcgucuugaggaacuacguaccaccaugagcaguccugucccuacucucaacuucuguuuuucaucugucaguagaguacccaagcaucuuccaggacgucaauuucaaaacaaugcccuauggucaucugcagggacccuccuggaacagguggcucugaguguuggggucacaggaggccaugcccuuucuuagggugcugaacacucagguugucauuuacuuuuucuauaaucuaaaaacuuggaguauuugaaaucucaucuguccuauaucaaaaagguuugacugaguggugaccaaggccaggcagaguagugauggccacacaagaagcaugacaugagacuguagaaggcacgcacacuccaauggaaagagcauuacccacuggguagcaggaaaggaaggaagacuugucccugugaauuaucauagcagggaccaagacagauugaguaccaaguggaaugaguucuacucauggccccucuucucuuuucuuuuccuuccuuccuuucuuucuuucuuucuuucuuucuuucuuucuuucuuucuuucuuucuuucuuucuuucuuucuucuuuuuucuuuuuucuuucucucuuuccuucuuucucucucccuuucuuucuucuuucuuucuucuuucucucucuuucccuuccuuccuucuuucuuuccuuccuuucuucuucucuuccuccuccuccuccucauuugguuuguuuguuuguucauuuguuuguuuuaagacagggucucucugugguaguccuggcuguccuggaacucacaauuuagaccagaauggccucaaacuuagagaccuacuugccucugccuccugaguguugggauuaaaggcauggaccaccuacuuuuaauacuuaacauuuuaaaauuauuuuaguguguauauaugaacaugaugcaugggagggcacaguacaaguccagaggucaaaggacaacuguguagaaucaguucucuccuucccccuuuacauggguuuuaggaucaaacuuagguuucuaggcuugugugguucccucuaagccaucucaccaugccucuggcuucccaguucucagacccucagugucucucuaugacagugaauggguugggguccuaggcguacaaccuguguugugaaccuucaagccagggaaacccaauucaccuugucauuuuuuuuuuuuuuuuucuggagaucauucuuacccuuacuagaauuuguccauggagggggggugguuccaagguuucacucagaucagauaugaaaucuaaacaacaaaaauuauugaccaauugaauagugcuagucucaggggcaaaaagcaauaaugugucccaauuaucaugccuuuucaguaugaaaaguaggcaucaguugaguacaccuccuugcuuacacacauuccccagaagaaccauaaccauccacaaacgggaagccugaggcagacugcacgggauagauaacucccacacgauccugcucgcuccauuccagcccuugugucguaagcgccccucccccaccucuccgaggucugccucauuguauaguccaggcugguuccgaacuccucacguucuucugaccuagcuuucuaguccaccaccaccaaggcuccagcucuuuuuauuagaaauggcugccugacuugggacaacccuugacuaccucaguuucucgcuuuguggugguauuagugaggagauuguagaguguuaauugugacugccccacaggagcaguuacccgcguuguaaaauguuacaguaaauuagaauaacacggcgaaaauuagcauaccgucccccucccucccccacccccaccccgcauuuuaacugcagcgucagcagcaucuuuacacucuguggaggcauccccgaaccugauccccuuuuggccucagcauuccauuuggugucuggauuacuuuuuggaacuaaucugcagaagucagagacagucacuccucaaggcuccaggugaccacuccugcuugacuccgccccacggaaagaaggugagguagggggcggggcugguggugggggucggcaggauuggugaguauacuggcccuucuggucaguccuacaccugucacucuccuaugugugggccaccucugugacgggcaauaaugcugcugcuacugcugcuguugcugcugggaccuggacccggauucagcgaagguaagugaggacugacuggcuuccuccugccugggauuuuuuccucaccgccccaacucaacaccuaguuccagcacccugaagccuuaaaauccccagucccuucaucagaugcccacacauccaucuucccagacacccaggagucaugucuuugauuccuuccagagcccuccacuuaggcauuucacucaggaacucagaaggggaagagggguuggucucagaguccucccuuccugaaccccauaguuacugcgguccucuccagcagccugaagcuccuagccucugauccugagucaugugaacuggcuaucacuuauagaggggguuuuccucacucacuccuacuacucuagaaaggccccucuuggugauucuuuaauccuagaguacaauaaagcauagaggcacagaaccaaccccggccuuaccuggguacagaggugcaggugugaagccucucuccuccuggacaggcucacccagaccaacaucucagaugccacaguugcucca

SEQ ID NO: 8104 - RNA, 1355 nt, Mus musculus
cugcuucaggcuuaugggaggcuacacuccuguaugugugaaggaugagguaauaguuccucuaaaguuucagugcaggagugagauagggaguggucaguauuuggucgaggaagaagauuggaaauauuaagaggugggcaugauuggaaggugagugugaggucuucuauuagagcuaccugaagagaaagaacccuggagggagguagaaucuguaagcuuuuauaaguuaggagcugugacaaguuaugagaagacaguuauaggugaccuaaagguuaguuuuuucaacucuugaauaaggaguucaguggcugcuaagaugcccaucccuggaugguuagaucuaguuuuuuuuuuuuuuuuuuuuuuuuuuugacaaguaugcuauggcugcaaaagaaggucccaguugaugaccuaagacuccaagggcaaaucccuccuuuucaguuacguagagggaaaaaggagaucagguuagggagauguaaagcuggggccuuaaggagagccugcuggagccuuugaaagggcuuggaauagguuugagaagagguucauggguggggccuaaugcugauucauauaaggaacaagaaaggaggggaaaggaaggaacccaggaacauuaaacacuagcuaugccuaggaaugauaaagucucuuccuuuguagaaggaacaguuagagacugaaucagauucuuucuaagguaauaagccuuuuggguugggguaauuguuagucccaaauaggugaccugaggaguggacaguuguacuuuagaaggugagauccuguagccucaacuggagaggaaauuuagaagagcagaggugucagcuuggcuagagaggggcuacagaguaggacaucaucuuuguaaaguaugaucuuagauuuaaggagagacagagauaguaagucagaagccagggccugaccaaauaggugugugcugucccggaaucccugagguagaacaguccagguaaguuggguagaaaaguggguaacaggaucuguccaggugaaggcaaauauguucugugacugggcaucuagagaaauagagacaaaugcaucuuugagaucuaggacugagaaaugggaaguccccgaggggauaguggaaagaaguguggagccuuccucccuagaucacucuauuguucaccacagccacuguuccucuucaggauacugcuaccugcugagaggcccgggagcucuucuggagacuaugcccuauccuacgucaucaccugcagcugguuccaggcuccaaggaugaauuggcgggaauggacuuuccccccuuuuuuccccccucuuuucuaaagcguguc

SEQ ID NO: 8105 - RNA, 3976 nt, Mus musculus
ugagacagguugccuugauugacauugaacuuucaacaaucauccugcaucugcaucccaaaugcuaggauuauaggcauguguuaccaugcccagcuucucucucuuuuaauagaaacauaagucauuggguauauuuuauauauuuauaaauauauuuauuuauaaaucaaauauuauauuuauuuauagaauucaguuguucaaacuguauaaaauucaaguagccaaaaugccuguaaagauuuauagaacucugugaguucaagcccagucuggucugcaaguugguuccaggccaacuuggccuaaacagugaguuccaggauacccaaggcuaaguagagacucuuaucucaaaauaacaaaagauucacagaauauaugugucuauuucuagagaagaaaaacauacauuucuuaaaggaguguuggaggaaguuguaagaagauaauaacugcugccuaauauucaguucuuuccauuauugaacuaaaugcaaaaaaaaaaaaaaaaaaaaaggaacuggagagauggaugcccaguuaagagcacaggcugcgcuuccaaaggauccagguuugauucccagcacuuacgugggggcuuacagcuaucuaacuucauuuccagaggaucauaugcccucuucuguccaagggcaucagacccuacacacaccccaccccagaaaaaaaaaaaaaaggcaaagaaaaaauaagcucagcuagggguggcagugcauacuuguaauccugccacucuggaaguagaagggagaggaucagggcugagaccagcuuggucuacaugaggucucuguuaauagaaagggcauaccuuuaauccuaggauuugggaggcaaagacaggaagacaggcagaucucuaugaguucaaggccaaccugaucuacauagaccaaccuggucuacauagugaauuccaggccagccaaggcuauauaggaagacuuugucacaaaaacaaagaacaaaaacaaacaaacaaacaaaaacagcaccaagaaagagaagaggagaggggagaggaaagagaaagaggagaagagaaaguaaauuagcuagcucaggucccacauuuucacuuuagagucacccaacuuuucuuaugcauucaaagcuuaccuuuacauuguacaaaacguuuuauuuagaugauauauuuaaacagcaacuaucacuguugcaaacaggaaauuaauaucacuuggcauuaaguagaagugacucacugaaaaguguaugaauaugaagauuauuaaugucuagcugggaauagguuuugccuugaagcuuuaaaggggucuuaaaggggcauuuggaaggcacugccuccaauaaaagauagccucucuacaaaaaucaaauauauugaaaagaaauaacuuccccaaugucauuuggcguuaugucccuguacaaaugaaugcugucuucuuccaagagaacccuuacagaaucuaaauccuccaccuaucuccagaucuuauagcuuccuaaaagaauaauauuccccuggcucccuccucuaauuuuaaacacaacgaaagguuucauuauucaauaaaguagucaaagccuuaggucucaacuacucaaagagcuggucucaaaaaaucaucaaaaucgcuaaucccugaaguccaaggccacuuugcucccacuacaggaauugagaaagccaccagaacacuaacaauaaaaaggauaauaauguugguaacuuuucuuccaagccacuuacuuggcaaaggucuuagcagacauucaaauggcuggugucugaguccuauuagaaagggugacuuuuccucacuauccccaaagcugaaggguuuccagaacugucacacuacugagagucugaauggguggccuuaaagacaggcaaugaagagucagguugcuccugaguuaguuucaagcugggugcugggagagucuccaaagcuucagcacuuuaguucuuaggaaccuuccggacaggugaagaaaucugagaagucugggcuaaagaggccugcgggugcugagucugggcagacccagguggcaccccaggaacccccuuggccaaaguauggcucuuagaagcuuuaucaguuucaggaguuugagaggcaagaggaagauucuggagauggcuuuguugggccagagaucccuggauuuggcucugagaggucauggguaccacggggaaacugucagagggcaugggcacuaggaaguggcucuggcuuucuuccuguuccagaggguagaucugagaggccacacugaucuuagagcgccccugagagugggggcccaaaggcacacagcuuucagaagauacagagggcaggauuuggcucugagaggucacagguaccauagauaaacugucagggaucaccaagagauggcucuggcuuucuucucguuccagaggguagaucuuagaggccacacugaucuuagagcgccccugagagugagggcccaaaggcacacagcuuucagaagauacagagggcaggauuuggcuuugagaggucacagguaccauagauaaacugucagggaucaccaagaaguggcucuggcuuucuucucguuccagaggguagaucugaguggccacacugaucuuagagcgccccugagagugagggcccaaaggcacacagcuuucagaagauacagagggcaggauuuggcucugagaggucacagguaccauagauaaacugucagggaucaccaagagauggcucuggcuuucuucucguuccagaggguagaucuuagaggccacacugaucuuagagcgccccugagagugagggcccaaaggcacacagcuuucagaagauacagagggcaggauuuggcucugagaggucacagguaccauagauaaacugucagggaucaccaagaaguggcucuggcuuucuucucguuccagaggguagaucugaguggccacacugaucuuagagcgccccugagagugagggcccaaaggcacacagcuuucagaagauacagagggcaggauuuggcuuugagaggucacggguaccauagauaaacugucagggaucaccaagagguggcucugacuuucuucucguuccagaggguagaucugagaggccacacugauuuuagagugcuccugagagugagaguccaaauacacauggcugucagaggacauugccaucugagaauugcugucagacgccaaaggguaggucugcgaagucacugaaaagacagguugacuccuagaaguacaaauggaaagaccgguguggacaaugcccagaggcaggcucuuagaggucuggacucugcuaaacugauucagaacagccucaggcuucgcugaacggaacaacgcucugccacccgagguucuggcgucgcaguuccuuucuagcugccccggguccguagagcugaugcuacugauccgcuggacgacccgcggguggagucgccgccgccgucgccggcgaauccgcugaaaggugucggagacgcuccuaagggucagcgagaagcgacggcugccgcuacggugcaccccgcucucgcggggcgaagucccccucaaggggucuuccgggagcgccucuauguugccgguguaccaggagauccaccacaggagacugacgaagaugaugauggaacccaaauagagcagcaugucguagaacagcaaguuggcgaagacgccagugaacagcacugccacacccaccgcgucgaaggcgacgcccagccaaaaaaagugacugcagcgacccaagggcccggacugcaucuccgccaagucuguguucuuuugcggaagcuccgagaggcucaacaucuuccacgcaaaccccgccagaggacaccaggcccagggcgcugccacaggcgggcuuuagacacucuccauggcaacgca

SEQ ID NO: 8106 - RNA, 1805 nt, Mus musculus
caaaaaaaaaaaaaaaaaaaaaaaaaucaaccaggccaaaaagaagcaaggaaaggagcuuuguuuuuuguuguucuuauuauuuauuuguauuuauuguguauguguguguaccacaugcacacaaauacaucagauccucuggaacugaaagacccacaaugugaggacucccccacguucugacucaggagaggcaacaccccaaaucacucauaagaaauggucuugaugcaaaccgcaagagaacuuuuauuccaagagcacucuggggcccacagucuuacaccacacagggguaaaggaccuugugggcagaguagcuagguaacaggguaaaggaagaaaccacaacucaaggguuuggggaggguguuguuggaaaauaccaaaaauaccaguuaagagucacgaagaagugggaagucacaagaaaaauaccugauaguugugugguuauuucucaagacaguuucuaggagccucuaacaauagcacuuuugcauaguggguuccagcaauggucagggugacuuucuuugaacgaacacucccugaacccaggaagcagguagguggaagaauaucgcuaucuguuuuaugauuaggaugccuuggagcauugagucacaaaggucacauucucaagccugggccuaaaguccucguuuuguuuguuuguuuuuauguuauuuuuucagaacuauaauuagcugccugguguggaugcugaggauaaaauguguuaggugcucuuacccacugagccaucucuucggcccuuccgaaccccaccccaccccuuuuuuuucuuuucugguauuugguuugguuuugagacagugucucugaguaacccuacagagauccugcuguuuuugcuucccaagugaggggacugacgguguacaccaccauaccuuccugccuauucuuucuuguuagaaagauauauguauuugugugucugugugugggcacaugcucaugcuggugccugcggagggauuuccugaaacuaggcuauugugaaccaccuuaagggaacugcuaagccaucuuuccaaccccaagagaggaaauuuucuuuggaaaacaacagaaauuaaagcuuugagaucacaggggaaaaaggacuguaccccacugucaguaagaaagaaaaaugaaacuuuuggaagcuguauaaaaauuaugaaaugaaauuaucuuuagcaucuuguuaaccaaaaagcauaacuuuggugugcaauauuauaaauccaaauaccacucuucugucuugaagugauuuucuaucuaauguugucuuagaguuucugguggagaauguuaggcagaaauuacucaugucuccagaccaggggaaauaauugcacauuaggugguuuuauagaaaccuauuccccuccaucacaaagaaaaacaaucaagaugcauggcuaugaugcaugaggaauaucaauaaacugucaaguaacuguugauucaaccauaacuccauuaauuuuaaguugaaccuauacaaccuacaauugugccaccuaauuuaagaaacaaaccccugagcuauacuguuaacucccagaguccacuuuauucuuucuuccuuccaaaggugcucuuuguuguuuuugguuuuguuuuuaaaaggcauuuuaaagguuuugugguuuguuuugaguacuggaaauugaacucagggucuugaccauguaaggcaaccucuuuacaacuaaacuacauccucagcucugugaauauucuauaaauaaaauaaucuguaaauaaaauauauauucaua

SEQ ID NO: 8107 - RNA, 837 nt, Mus musculus
ugagcagagcguaaggaucgcagcaagaaggcggguaggcuugcgucugaccuuaaccggccugaagcuuuccuagaaauaggcuggcacagcuuggcggggcaaucgguggccgcauuccucagaaacuccuucaaaaagaagcuugucuuagaggcgugugcacgugaccuuggcgcucaggagguggaggcgggaggauaaaaggaguucaaagcggguuuccuucugggaagugaguggaggaggaaggucagcugggugcuuucucugccucucugaccuagcaggcuugcaccccagcaucuggccccugagucuucauugguaaaaucgaacggcugggauuuuuuugguuuucaaacaacauguuggcucucuuaacuuuuggcaagacuccgagggacacugagagaucacuccugcugaggacaaccugagaagccaucagauuuggucccgugcaucaagccagaagcagccacagggauggcuguguuucucaugaccccacacaagaagaccaccaucuucacugaggccaaggagucaagcuugguguuggcacucaagcgcaucauugagggcaucaugaagaggccuccugaggagagcugcuguucaaggacaaccagcuccuugaugagaaaacucugggggaauguggcuucacuagucagguagcaaagccacaggccccagccacagugggccuggccuucagagcagaagaugccuuugaaggccugccuaucuaccccaauucuuguccuccagaacuuccaggugugaugaaggauucuggaaauagugcuaaggaacaaguuguacagugag

SEQ ID NO: 8108 - RNA, 1778 nt, Mus musculus
ugugaaaugggggcuaugaggacaagagggugggaggaaggguccccauagcucuggggcacccacauaggggcuacaugauguugcacuggguggucccacagcaauccuugaugagugccagcccugucuuggccacuguuggcuugcuaggugggggcucugccuucuucucugcccgggagccugcagcaauggaaaagcagagaaagaaaaacagauaaagguaaggagaagaaagccuuggcuacuggcaguccaacccaacccuacccaacccaaaccaagccauaaccaagccuuauccuggcgguguagagaacugcuaugcauuuccugcccaucauuccuggucccucuuguuauucauucuuuagguuccaagugcaugucagccuaucuccuagacagcuccucucaucacauuagcuuccaggucuagcacaggauagauggaaaggcuuguucaaggcaauucgacaugagaguucauaccuuucaauuuaggaaaaugcucauguuaucuucucagaacacuguacuggucauccucuucagaauaccuacuagauguaaguuacagcuugccauucagucuccucugugguagaagcugcucuaguucccacgacugacuguuuguucagaacagggcgccccuagauucaaggcugagcaaucugcucaaggcugccuuacauuuuaagaagcaugcuuucaaauguguuuccuuauucuauccacuuauuuuuuuuccaguggaaguuuuauugaugagauuaauguuucugaaagucuguuuauucuucuccguguaucauucuacuucaucuugggguuuuguuccuugucucuuuaacaauuucaacaugcuuaguucacugucuccuuaagauaguucccuucauaaaucuuuuaaaaagaaaacguuauagauuucuuguuuuguuuuuuugacacaggguuucucuauguagcccugacucuccuggaacucacucuguagaauaggauggccuugaacucacagagcucugccugccucugccucccaagugccaggauuaaaggugugugccaccguggcccuguucuuuauucagaauuuaugugugugcacauauaugaguggggggcaugagucuguggaggagagaagacaacuguggaguucucuccuuucacauuuacgugggugcuggagaucaaaugcaggaugucagccuugugcacaaagugucuucauucacugagccauguugcuggccccugacaguugucuucuauaagguucuuagaaagucauuucuuuguugcagucauugacuccaaucauggugauucaauuguucauggguuucaaauuuuuacuaugagguaauuuucuggugaaggcugcaugcacgagguguggauggcccuuuugagaacuuuuacaaaccuaguuuuuuugugccacccguuaaugaccugugcaaacaaaguuguuagauguggagaauacagaagggauuccuuuuccuuacuugucacuaaaaccacaaggcacacagcccugccuaccgucagugucuucauaggccagacucuucuauaaaacgucaaauagaaagauucugccuaauagcauggugaaagggcacaaucauguuccuucuacauagcaguauggauaaaguaacuauuuuaacaagaaauuaaaacaccaaaugaacaccacuugcaaaggacuugauauguggccaaauuuccaccacugauuuuauaaugguguccca

SEQ ID NO: 8109 - RNA, 935 nt, Mus musculus
uuuuuuuuuuuuuuuuuuuuuuuuuuuuugccaaaaucuuuuaaaugaagccauugauucccaguucuuaguaauaugaccugccccggaugagcugcacuggaaauguugugcaggcuugccacucuuucugugcaagccugaagguacuuucugugcaggccuggaagcacuucuuucugaggccugauagcacuuccucuuuaaggccucauggcacuuccucugcgauuuuagugcauaggaagcaaaauggcacaugugcaauuucuuuaaggcuuuuaagccguauaauagaguugguguugagagugugaguugccuuauuugcagauauccuauggcuaagccugccugcucagacuucagguuugcaagcauagagggauuauggauuugaaaacacuagaugccacuaaaguuacuuggagucaucucaaaggucagguucuaugggcagcaaagaauaguuguguacagugaacggguauguguuugccauuugcuggaguugcccauauguuuggagugugugugacuaacccuuacuauuuaaagaugugaagacuugauuggaagcacgcugaguguggugugcccacaguggccaguccaaucacuauuucaucauccagaggcuuagauaaugaugcuaugauguaugcacguggagaugaugagacacuuuuucugcguggaaggauguaccagauuaaauuuaucuguugaaaagacaaaaguuaucaccagaauccccuuuccaucuucccaucuuauacuguuugcuuuugaugaggcuugggggacaaguuuuucuuaacugucuacuuuguuugaacauuuuugggggguggagggggcggggagguucaagugcuguuuguguguugggaccaaacaguugucaauaaacuuuaugagcaaucaucuguaau

SEQ ID NO: 8110 - RNA, 114178 nt, Mus musculus
cgcgcggcgcugcgccuccucgcucagccggccgcccgcauggcgcugcgcagcuucugcagcgcugauggcuccgauccacucuggguaagguggugggccgcgggggacggcgcgggggcgaccggggacucggaggacguggggggacgcugggacgcgcggacccagcugcuccccuagccggagcccugcucugcuuacgcggggauucgccacccgggccccggcguagccgccgcucucuuacucuggggaccggguuccgggagagcugggugugugcggggaggugccucugugcuuugggguucugccaucgggaagggacgccagaucuggaggcagcaaauuggggauuuucuguguuuuguggggguaggaucuccguuuaccgcgcacacacuaucauagagcaccgugcaggagcccagacucuagaaagggacuucccaucgcuuguguugggguuccccacuguuuguuuuaccucucguuuacucuggcuucauguuuuuuuuucucauccucucuccuuucugccuaaaugcuaucagggaacuuuaaggaaauaaggaaaagccaagagaggggagaagggccuuucugucucuuuuuguagguuuggggugcaguggaaaaugcccuggacucuguaaccaggagagugccuucuacucugagucagagagacuccgcugcucuggggaugucccggggacuucaggcccucuccagguagcuuucuugugaaaugauccuaggcuggguucccuggcugacugcucuaaucuccagugcuuguguauuucguguuccuguaaugcuguuccuguaaugcgauuugccuguuauuccagaacacuccugcaucacauuguccugauuauuagugacuacaauaggaaacccuggacacaaugacuuuucuuuuuguuugagaaacaagaaaaacaucccuguuucuuagcagcugaugguuagcgcccacaaguauuuguucuguuuugugguaccuccgugauagacugcauuaggaaugaugaccccugaaggcccccugggagacuuuugggugaggagggugccaauuuugguugagaaacuuaccauacuuggauaaaugguucauuuuaaagccaagagguuggagguuucuccagagcuggaaacagagcuugugauuuacauucgggagucugcaagagauaggugccuguuugccacacaggaacacuguguguccucuacccuugugccaaguguagagacaacgagguuauuuugcaagaacucagggggaucugggucacuaacaugggugcuggaguauuuccugaauuucuuuuuucucuuaugguggaggggaaguagacauuagauuuucuaccaguuugcauauuuuauuuuugcauauauauaacacacacauacauauauuguguguguguguauguuugaguguaugcauaccauggcacaugcgcacaucagacuuguguggaacucucuuuccacaguguggguucugagguccucaagccucucaccaguucacaucuggauguauccuauuguugcgcagugaugacuaggaaauguugggagguauucucuagcuucuaauaugcuaaaaagccuacccaagaagccugacuugguguucuuuccuucuuggaacuuuuugccacagaaaaugaagauggauggauuguguuuggcaguagugguggcuggccuuccccuuaggcagcuucccauccucccuuaagucucaucuugcagauuuccuuucggccccucuucucucucacuggucuaggcuugauggacacccuguuucuggaguccuggaaucagaaugggugagagggccacuggcaagcaagaacuuauguguagcuagagaauccaaacacaaaacagaguggguugguuggccuggugugcaccuaucuguaaucacaccauugggaaagcugaggcaggagaagugaaauucaggccagcugugcuagagcaagacugcuucaaagaacaauaaacuaaaguagguggcuuugcaccagcauaucuauaccgcugccacacccugccauucuagaccucaccaucuugaguuguuucauuguuuacugugcucaguuucuauagaacagcccuucugggcugcggccauggucuuaucaguguucguggucuagccuucucucauguauuguauuguaucccaacugcagcuuccccucccuccuccccuccuuguuccucccuucacauccccaucuuccccagaucugcuccuguuucccuucagaugggagcagaugcagagaccuacaaccaaauauuaggugggacuugaggaaccacagaagauggggaggaaggauuguagaagcccggugugaggacaccaggcgagcacagcccacagaaucagcgaagcagggcuuguaaggacucccggagaucgaugggagugggcugcuguccuuuugcuacugguacuuggauccuuuuaggaccaacauuaugcuuagagaagucaagauuccagccgucaggaacccucucggagucuugcuccugggcuagcucgggucuacugcugagaacuuacaaccuucccuugugcaaaggucuaggaugagaacagagaaacaauguuauguaaguggaaagcugagcuaagagcuggcaggggcuugcuuuauucagugggaguguggagcugguaggaaguccgugguuuuguggcugaucuuugagagaagguugggaaaagggacuugggccuuucuuuguaaguuacuuaaaaaaaaaaaaguaugaggaaauggcucagugcgcaagcgugcuugauguauuagcagggagaccuaaguuugagucccaggacccauguaaauagccagcccuggcucugucuauaacuguagcauugagcggguggaguuucccaaaagagcaaguuucagguucagugagagacccugacucaaggaaauaugaaggaugauagaggaagacaccuggcauacuccuuuguccuauaaauugguaugugugcucuuacacauguacacacauguauauaucccacaucuauauaucacacacaguaaauuagaaaauuagaaaauauguauuaagccuggugcaggccugucauccuggcuacugaagaagcugaagcaggaggaccacaaguucaaggcuagccuggguaacuuauaagaccuuguuuuaaaaucacauguaaaaaaggacuggagauuaguucugugauacaacacuugccuaguaagucugaggucccaugcucaauucccugaccucaagaaacaaaaacaaaagugaagaauaagaaaaguaucaauuucaugccuaauguagaaauauuggaaaacucagucaguugcauaggugacugcucagagcaagucccugugugcccuguguucagaagcuggcucugcagcuaagauggguucuacucuguaccucaguuuccccauguagaauaauggagugccuagccaagggugguaguuugagugcugaguagaauucuuggcaagcacugggaacagugcuccuugguaccuaguuagcacucaguagauguacgggcuuguaguugggugggacuccauaguugcaucugcugagaacaucugggcauacacaaaagucagcagcagaugggccuugcaggcucuggagugaguuggcuauggggccugauuugauuugugguaccuucuagcuuuccaccucccugaacauuguaaccgaccaguuggcaaacaggucccagugacugguguuccugggguagcaggaggcccuggaaagccugccugcuuugcuuugcuucccucucuccuuccuuaccucccucccucccucccucccucccucccucccacugccuucuaaacuccccccccccccaucuuccucucucuccuaagauugauugcuguagucagucaggucgacauuuucuuccccuuaccagauagauggauguagcaucagugugcagcccagaauggugggguguggaugccaagauaaccaggcuuugggaacuugugguaggaacugagacuccuguuccugcucuguggccucgccccuucgccuugcaggaggaagcuguggcucacacuguggccgagccagggucuggggauggguggaccaaggucugggggggggugucucuguuccuggagccugcuggacuucucuuggaggggcuucaccuugggagcauggugguaugugacuugccaacuugauuuggagugcuugcagagaaccccuguggggauucagggacauugggaggagcugaggcaccucuaggaagaugguccuuucucuuggggaacaaauccugugguguccuugcuuguuuuuuugugauuuauuuuaugugcguugguguuuugccugcauguguauguguguaugugugagagagugugugugugugugugugugugugagagagagagagagacagacagacagacagacagacagacagauucccuggaacugggcuugccgaaaccugugagcugccauguuggugcugggaauugaacuuggguccucugcaaaaggaaccagugcucuuaacugcugagucaucucuccagcucuugugcuucagugauggugaugauucucuuccuucuccuccuccuccucuucuuccuccuccucucucagaucaggguuucucuguguagcccuggcuguccuggaacucacucuguaggccaggcuggccucuaacucauaguccugccucugccuccugagugcugggauuaaagacuugggccaccacugccccugcuuguccuugauucuuguuuucuccuacucucucuaucugccuguucuugcaaaauguauccaaacuuguuagggaugccuccugaaucccaagguucuaucuacugacuuguuuuugcauuugaauacucuauuuauuuuuguagggcuggggacugaacuugggguuuuaacauacugagcuaucugcaccucuagcccucuuuagcuuuuuguuuugagacaagagucucacuaaacuguccaggcuguccuucaucuguauagucuaggugaccccugaacuugugauccuccugccucagcuuccccaguaguuggaauaacaggccuguaccaucacacccagcuuccugccacucuucugucccuguccucccuugaccccugcagucuagugucaguccagcagccagaaugcuugcuuuugucuuuuauucuuuuguagugcuggggauaggaucuagagccuggcauuagcuaggcuaacacuucccuguaacugcaguccuagccccgaggaauccuguuaagagagagcacagacccugcccuugcuaugcucagcacccuucagcgacuccccaguccuggaacaucugacccugcucucuccuguccuagucacugcagucauggggcuccccaggcaucuuucccugaccccugccacucuugcaugcccaguuuucugauucuaccucaucguucuuaauuuuucucauauaucaaaaaguuuacuuaguucccuuuuuuuguguuugugacucuaauccuaguaucuaagacagaguuaguaauuacuuguaaaaugaauaagugaccuaaaacccuaggauggcuuucaaguugcucagaggccucucugagaugaucaggauaaaaugcuauucuguguucagcugcuuguguuucauuuuguaaugguucacugaggucauguucaucuguuuuucccugggcccacugcuuugcauccaguaggcucaaccaacauuucuauaaauaaauaaaacgaaauuaagucuacuuauuuaauuagagacaugguuuccugaauauuccuggauggucugaaauuugauguguagacuaggcuagccuccaauucauaggcugccugccucuaccucucaaguguugggauucaagguauauggcaccaugucugacuuucuguuguuuuguuuauugagacagucuugcuuuguagcucgggcuagccuggaacuuacuaccuuccuuccuuagccucuugaguguugggauuauagaccagugcaaacagaccugcugugguguuuuaaguguguuuuccagccuaccucuaggcuggcugggcuuuauuuauuuacuuaaccuuucaucuuuuauuuauuuuuuauuuuuuaaagguuuauuuauuauuauauguaaguacacaucuucagacccuccagaagagggcaucagaucucauugcagaugguugugagccaccaugugguugcugggauuugaacucaggaccuuuggaagaacaguuggcguucuuaacuguugugccaucucuccagcccccuaauuuuuaauuuuuuuaguacacuuauuuauugauuugggagugggugcacaccagugccgugauguguguggaggcaggaggacaacuuucaggaguugguuuucuuuucuuaccaugcaaugugccuuugccuguugauuugucucacuagcucuguuguuggauagggucucauagucaggcuggcaucaaacuugcuguacagcugaggaugacccugaaccccugaaucucuugccuaugcucucaaggacugguaugcaucaucaccaggcgugguucuugacuuuauuuuaauuaugugaccuacugucaucuccacuauuuauuuacuggaggaucuugcacaaacaccuggauuucugacuucuccuauaauauuggauagcacuggaccucacuauagccacuacugggaagcaggccugaagaucccaccccuccuacuguugcgcucucucucucucucucucucucucucucucucucucucucucucucucggaaggccagguguccauugucuuugcuuguacuuugucacaccugguugagucccuuccugaguggaguccauguggcaucuguuuguuaauauuugaauuggauucuguugcuucauagccuaaccuuaagauaacugaacugggguuuaccugauucaguagguuauuuuauuuuguuuguuugggacaaggucugacugggacaaggcuggccuggagcuuacgauguaguucaagcuugcuucaaacucuugauucucuugccucagccucucaagugcugggauuagaagaugugugccaccaaggcugaccuuuagauuuuaaaagaaagauucuucauccuccuccuccuccucuuccucuucaucaccaucaacaugaucaccaucaacaugaccaccaucaacaugaccaccaucaacaugaccaccaucaucauugaagcagggucuuucuguguagcucuggcaggucuggaacucuagaccaggcugaccucaaacacagagauuggccugccucuggcuccagaauacugagauuaaguaauuaaguacuuuuuggguuuuuugagauagggguucucuuugcaacccuggcugucuuaggacacaguagaccaggcuggccuugaacucagagcucuaucugccucugccucccaagugcugggauuaaaagugugugccacuacccccuguguuuuuuuuuuuuuuuaauuaauuuuuuuuuuuggcagaauacugauauuaaacauguguucugcggugccuauuuuuaauucucucucugcuugucugugugugagugugugcaugcaugugugcaugcaacaugcccucauauguuugggugccugaagaagccagaacuuuugaugccauggaguuggaguuggaggcaauuaugagccugcugaugugggugcuaggaacugaacuuauuuuccuggcaaaagcaguaugugcuucuaaccaguaaaucaucucuccaacccuuagguucuuuccuuagcgcuuucuguguguguuucuggcuaaugaacccagggucuugaauaucuaggccagugcucagcugcuuagcuacaccucauucccagcuggccagacuggcagcaugaagauccugucucggacccaggucuguuugcuauggcaggagggugggcuguaggguuguuauucuagguacccuaggauucugaagcagguaucugauacacacguagucucuagguuuucaaguaggucuuaauagucaguaaaaacaccagcuuguaaaagcuugccuggauguuuuaccaagguaaguaaguggguugggaugcugagagccuggagcaagcuuccccugucuugacaagaaauuggggauagcgucugccuugguagagguguguacuuguguuuuucugcuuggggcuaccugcuugcuaaguggugagacgcugcguuugugggagugucaggguguggugagggagaauagagccuaguuucucaacccugccguguucacaguugaaccaaacuguuauuugugcugucggggcacccugaguauuauagguuacucggcaaugcccuggccucugcccacaaauugccagccauagccacacuuguuaaaccaaacaugcccccaggcagugccaaauggcccuccucugucccugagugugagaucaaagggugcuuuacuguguccagccauucauuccuuuuuguucauauguagagaccagaggucaaugguaggugacuuacuaggucaaguaccauguauuuugagauggggucucuuacugaaccuggagcuuuacccauuuuuaaucaagcugacuggccagaggccucuugguauuuuucucucugccuucgcacccugggauuacaaaugcaugccauugcucaaagcucuuccauggugcuggggaugcuugugcagcgugcacuguagacacacuuagucauccccacagcucucauccccucugagacaggcgcuuucuucucaguuuguccuggaacuuucccuucaccuuccucagucucucagugcugcgcucccccccacccccuuucuccucccuuucucugaacugccucagguuaaguaguuaccaaguccagagucagccugcuuuagcacuccucugacuuaccuaugggacuucucugugcuguuauugggggcaagggggguggcucuaggcugccauccugcuacccuugagucguaaagaagauuuuauggaacuuuucccugcucuuuuccugaguuuuauuuucugagaagcucaguuuccuuggccuucugggugguugcugggaauugaacucaggaccuuuggaagaacagucagugcuuuuuaacuucugagccaucucuccagcucaaggguguggcuuuguccccuuguuucuucacaaugaacacucacacuuuuuuuuuuuuuuuuuuuuuuuuaaauuauugaguaucugguagguguucuagcuuugcucuggauacuggggauguagucuugaacaagacaggcuggguccaugaacucaugggcuuugugcuagggaugcccccaaacaauuccaaaucacaguaaagcacacagagaccuaaaccaggaggaacuaggguggguauaaaccaccuuaacaagaagugacauuugucccacuauuuuggugguugaacuggcucugucccagaaagagggaaaacccaugccaggguccugaggaccgugaugugguuggaguagcauagaguacaauguacacacacacacacacacacacacacacacacacacauacacacacauacauauauacagauuuucauuuuauguguaugagucugcauugcaugcuugucuggugccugcagaggcaagagaggacacuggcuccucuggaacugugguuacaagugauugugagcugccaugugguucuuggaauuguuaaugugaguccucugccagagcagccugggcuuuuacugcugagccauauuuagcucuuacauauuuuuugagacagagugcgguccaaaccagcuuggaacuugauguguagcagaggaugcucuugaaccccucacuuccugcaucugccucugagugcugggacuauaggggagcacuaguggcucagggucuucagagugggggaugggaauuggcuucacaagcaugagaugaauacucugccaacucagcuccauucccagcucuguauuacugcauuuuagcucagaggaguuacagggccaguagaaaucucauugaaguccugcuucaaguuuuucacagaugcaugaagccuaauagaaagggccuggaaaucccaggccagggaggaagaaacacuuguccagagcgaucagggccuuugaucuguauuggaacaaaugggugugcugugcugcggauggaacccaagugcacucugagauggaccucagccccaguccuccucgugcuuaaaucaagcuuguacacuuuccccucuucucauccccugucucaucuguggcucagaaccucucgagcgagccugagcugggauaucccacuuuacagcugccuuuuagucuucaaacagcuuuuaaugaccaacacagguuuuccuuuuuuggcuagguagauuuucugcuggcuuuuagaaaacaacuugaaaaauuuaacuacaggucccccccccccaccuccuuuuuuuuuuuaaacagagccucuagcccaggcugcucucaaacucccaauguaggcaaggaugaccuugaacuaacugccuucacccccaaguguuaggauuacagguagguucuacuacaucuguuguuggggaccaaacccuuuuguguaugcuaagcacagcacagggccucacacacagcacaccacugagcuguacccucagguccccugacuuccuuuuauagucaguccugugagggaauuucagaauuggucaaggccuauuaagucugaauagugcuguuucuuuaagaaaaaaaaaaaaaguaauaagaauaugaagggaaaaagucagguuucaguguucuucccugcccacucccucugaagugagugagugagugaugaugaugagaaagagagagagagcacacaugcacaguuuguguuuaugugugcacauuuucucucuauauuuuucaugcuguaaauauuuuguaucuuguauccuucacuuaaccguaagaggcaauauccuucucuguagucuguggaauuugaaagaacaaggaagucacauuucuuaccgagcuuuccuuuuuaucuguggaaaagcuaagaagccacggucucacccuguucccucuuggugacugucagggucauuaucagucuuucagcugguuaaucagcacuggggaggggauggggcuguugggggcccgugggaacauuccugaucaugcuuugugagcagauacaugcauaugacucagcagcgugaguuuccccaccagaaguugccugcuugagagauauuuaccuuuugaaauuugcuaguuaauuacuaggucaauacaacagucacacucccacaaaugaccccuccagcacuuacuaaacaccuauuauauucaaggcacaugagucuugagcaagcuggaagccuguuggagcugcuuuucuggaugugagaggauuuugcucagagaaguuaaaccuugcauaccagggagcugagaucaggagaccaaaugagggugguugggucccuuccaguuuuucaaagcuguguuuaaauacgaagcgucuuuuuuuuuuuuuuuuuuuuuuuaaaucauguuauuuaagaaguaauuaacaguuagacaauauggaaggcucuacuuacauccuguccucagaugucacuaugaccucccccucacucauaaagcuucuaguugcagcacaaaguuuucugauuauaaaaaucacacaugcucuguagucaaacaaaccacacagauguguucaugaagaugcuguucuuuuuuuuuuuuuuuuuuuuuuuuuugguuuuucgagacaggcuguccuggaacucaguuuguagaccaggcuggccucgaacucagaaauccgccugccucugccucccaagugcuggcgugcgucacuacgcccggcucguagaugcuguucuauuggaccagccuguagccauguccuuccaccugcuuguaaaauagaucacauacuuaagucuacauagauuauaaucuuuauucugcugguauuuuugccauccacacagauacauagaaucucacaaaucuuuuccaggcuucagaacugugauauggaccaugccuagaguucccuuuuaucuaauauguauccuugugcaugagucaaaauuacauaaauuuuaaccuuuaauauaaaggcugauuauuuucaagaaguauauagcuagccuuuucugaauguaagugaauaaaaauucccauuucuagcugggugugguggugcauaccuguaaucgcaggcugaaacaggaggcuuaggagguagaggccagucacugcgacacgacacugugguaaacaacaacaaacaaaacaaaaacaacaacaauccauuuguucaaauccaagucaguaucucccagagaucggggaggcugaggcaggagguucacaaguaugagaucugcuugaauuacaaggugacuuccgugucagcccaggcaaauuaaugagacccuuucuggaaauuagugaaaguaaggcuauauguccuuauguaucauggugggucuuuuuccuguuaauguauacaauguacuggagaccuuggcccucuguuuuuccugagcauuguaaaaauucuuuccugggccauugcauauuuauuuguguacuaacccguaaggcuuagccuucucguguuuugagugaccaugguaguuaguugcauuccauuuugugguauuugcuguuaaaagaaauucccauccucacaugaccuuguaacaacaaccuucagccuccaccaccacacuuccucguaccuguggacuauaacucaugucauuauuggcuguguuuuaacauuuaagucacaauaguauuuuuuuccuccuuuguuccgcuuuuuuuuuuuucccuuugagagcaaacauuguacugaugcuaugaacauagggccuguuggcuuguuuccuuggaagccaucccugaaggagaaggaacagcucagaacauucaaaaggguuacaccccagccuuugcuuuuuuuucagaaaaguguuggcuagcucaaaguucuagcgugguccaggaauagcugcugcuguuguuguuguccuguagugaguguguguguguuacuggguauuccacuaaaggccucaugcuugcuggguaacgugcuguacuacugggcuauaguccauuccuauuaguguucuuaagagucuguucuuaaaaguagacgaagggcuagggauguagccuaguuugcuuguuuagcauuuacaaagcccucgaguccaucuccagcaccaauucuauacgcuggguauggugguacaagccugcacauccuagcauucuggagacggaggcaggaggaucagaaguuuaagaucguccucugcuacauagugaguuccagaccauccugggauucuugagguuucaucucaaaacaaaacacacaaaacaaagacaaagacaacacauaccucucccuuaaacaaaacccaacagauagaugaggacagguaacuuagcuaagugguagaauauuugucuagcauuacagaggcaguacagacaaaacaaaauagaugaaaaauggcauaaacagugacaacuucucuccuaucuggucccucugaccagcuuuguaggagaagaaggcuggggaccaguagccgacaugcaaguagugagugugagugugagugugugugagugugaguguguguguguguguguguguguguguaugugucugggaaggugaccuugugguuauaguuagguuugcacaucuuucagagcuuucauaaggcuucauugauuucuuucuuucuuucuuucuuucuuucuuucuuucuuucuuucuuucuuuuuuuuuuuuugguuuuucgagacaggguuucucuguauagcccuggcuguccuggaacucacuuuguagaccaggcuggccuagaacucagaaauccgccugccucugccucccgagugcugggauuaaaggcguuugccaccacgccuggcucauugauuucuuaacauaggauguguuccauaucaguauaucggguauugcagcuguaauucaacuagucuuuccuguuuucuuuggccucacacaugauucaugcaugaucucuggugggguacuucauguucaaugcuggggacagagcugaucuggcucuggguagcaguauucuugguaggaggaaggaauggagaaaaggcucccuugaggucaggccuuuuauuucuugaggguccaguuggaaggaagguguggccccaaagaaaucuggagauauauggcuggaaucaaugccaggaguagguggauuugaaaacuuguuacuucccagcacauagagugggcgagcugcuagauuuauggaaacuucuguuuccuuauauguaaauugggucaugcuacauauuuuuguguguacucagaucuacaugccuguggggauguauauaugaggaugccagagguugacauugggugucuucuuuuacuguccccuaccuugcuuuuugagacagggucuaucucugagcucauagauucaccuauacuggcuucugggaggaucugcagggauuugucucuauccaccuugccagcacugggauuugagauguaggcugauguaccaggcuuguugagggaucucaggucuugaugcuuguguagcagguucaugcuguguaccuuauaggaaaagaaagaggcacuaacagccuucucagugcaguguaguaccuagcacauaguagguguucuaggcagacuccauucuguggugauaagguggguggacaguaaggggcaguagagaccguauagggggauuuuugguguggugauugucuugggcucaucuaagcuguggcagaaucaggccagaacccagcugugucuuuccuggcuucagguagaccccgaccaggcugucugagacauuucagguugucuggguagucugucuagggccucuagggugcuuggcuguagggggaggcaggccugaugccugggacaaagugagcaugggugucauugucaaguuucaaaccccagacaaaggcugaggugcuuacuuaacauuucaaaguggaccaggccuccagguuucccagcaucccccaguuccuccuuguuacagggguuuggcuggcaugccucacccccuacccuaaacucucuagcccagagucugggcugcccuucccucagagacucuucccuauguaguccagacauuuggguuaccugccccugucuuugucccuuuggccucuuggcugcuguacucauucuccucucuccauucuuuucuuuucucccuuccccaucugccagcauggucuagggacauguccacucuggacucuccuacacaugucugccucuggcuaugucucccacauaucuuuaacaaacuuucucuccucuaccauaucgaggagcagucauguccuuuucuuuccuuuuucuuuucuuuuuucauucaguuaccucugcacuggacuuguaucuguagcuccuuuugaagcucagguggaagcagaucucucuaccuaaauccaaugcagaccaaccagccuuacccuaguauccauguggcaggagcagcagcuuuggagaacacuucuuucuuggggccugguaggagucacaggcugugagugacugguggcugggugaugggagagcuuguugcugccucucagccugggcuuggcauaaacaaguuggcccaggcauauggcugguguagacaagaagacagcuggcacuggagacagacugcagcugcuggcaagucccugaucuggccaggcagcuaccuuggcaguuacacucagccuuaccauuaaagguaauugagugucagggaguaacagugcagaggcggggcauguggaguucugucuuccaagaggcaacgauucuuucucauuuuuucccucauuuuuccuuuuucuuuuuucuuuuccuuccuucuuuuugugcagugcuggggcaaguauucuaacaccacugaguuacauccccacaaaagggcucuuuucuguucuuuuaagacagggucucacuaaguuacucaaccuaggcuugaacucaauuuguagccugcagaagacuugaaccugugguccucucaucucagcuuuuccaguaguuaggaugauagacagcauuccgugcucaguguggagugcugugccucuuucuugacucgagauagagaagaaagccucccucugaaugguguaguuggaugaaagaagagauauccccaaaguugugaccugcaucccaggggcagagagcaacagggagauguggccuggagcguugguggauagagaccaguagcugagauacugaaaucugaaagggugaggauuugacuuagauuacauccaggccuggguuugauccccagcccugcauaagcugguggcacaugcuuguaaucccaacaagugacuuggauuagcaacuuuaccugucugucaccugucuguaaguguucucauguacaacauaguaauggcucauuacugagcuaugaaauuaagugagcuaauaccuuauuaaugcaugugucuugucuuggggagagccauuugagugccuccucuucuuggggcuauccacaccacacuguuacaugaaccacaauggagaaugauaaguuuucacaggcuacugaauuggcugggaucacuuuccuuggugugagccaggcuuuuauaaucugccuaaguuuccacugugggcaaugaaaacagcacuuaccuugaaggcuuguguguggaucacauacagcaugguccagaacagguuuagcuuuuccugacgggaagguuccuuuucuaucauuugcgcugucccugaagucaggccugucacuaggugauuccccaggcccuccauaggcacguuuuggauugccauuuucccauuuccacuuagguagaccuuagugucugccuuccugaagcuuguucugaccucuaaagaggaaguaaggagacagucagcuccucggggucccugaguuccugucaguuguuguaucugcaugucucuuuccuguggccucagggaaguggcaugcgguccagcuugucuugguuuacuuucucuaggugccuaucgcagagucaaguguguaucuugguuuccccccuuugucagcgugaggcagaggaacuaagugaaguuuggugaggcugagggccacaucuuccacauuuucuuuagcuuaagaagcagguauagguggcugagauggcuuaggggguaaaggugcuugccucuaaccuaagagucucgguuuaaucucugggacccauauuguggaaggagagaacugacuccuauuguccccugccuuauacauacacguuguaucguauguauccacccaagugucccaccccauacacacgagaaaaaacaaaaauaaaagaagcaguuuccaagggagugcauugcaucauaguuggaauagaaaagguuggccacuacccuaguguggguuuagucagugcagugagcaaacacccccuugccuaucccacugcaguggagggaaggggugcucuuugugcccaggugugcauggucuucugugggccaggugacaaauggaaaugucagaacuagguccagccuucagagugcuugccuaauugugguccugggaucaaacaagaccaaacaaaagcugagaauguaucucagugguagagcacuuguuuagcauacacgagguccuauagguucagucccuaggaccaccagacaucuccucuucccccaagcagggagaaugguggggggaaggaagggaaaaagguaauuguaaaguaguuucagguucuacaggaagcauuugaaaagacugagugcugucuuuggaggguucauuugagucuuguuguugccuuaugggucuccacgggaacaagguauagacagacauuagugcugaagggaauccacgggauucuagacagauaugugucccugucuugguuucugacaaacguagagaguaaaaacaagagcaaaagcaaacagacagacagacaggaugaggaugcagcucaguugcucgaguggggugggauccaggugucuugggacugcucuguugccucccuuuccaguggacuuggcacuguuggaacugaaugcgcaucugcuuuguaguucagguuggcuuugaacuuaaaggucuuccugccaaaaccucuuuaaguauugcgauugcacaccuauucaucaugccugguggggccaccaaguaagucuuuacugaaugaaagacuggcaaauacgggaaggcagaacaggaugugggugugcaagucgggguggcuguuguaugccugggcucacacugaagcaagggcccgcuugagucacguucuccuugccagcuccucuuguaggaguucuguugagacugaagccuguccuugccuaaggcucuuuucgugacuuaccaggugguuggccugcacauaaggcacgagaauuugggguguuuucuugacuaugacagugacuauuucccaccccuccuuaagaggagccagccuuucagaacuucuccuuguguuugaggaguugaaggccagguguugauaagggugucuuuggggaauauggacucuuaacaauagucagggaugaauugaugaucagauagcguuccucagucaguguuggugacacuuggguuguuugccugcuggccugcucuguguauuggacugguuuaaauauccuugacuucuaucuacauaaugagaugauacaauccuucgauacuucauuuuggcaacuagaagucuuuccaagcaaucagaugucacucggaagucagacuggccccuaguuugaaaagcaauguuuuaaaucauauguuaagggacggguguggcucauugauggagggcaugccuaaccucugugaggacuugaguuugauccuagcaccaauaaaccaaaauaacagacccucauuccuggggcucagugcugguuccucacuuuugggaauggugcucagacaguagaggaaugccuguucccugucccugaucuguccucagacacacuccuguguuugguacauauuuaacauuccccaugcuucaucccagaccucaggugguggcagagaaguuuagugauacuccaggguccuacuuaaaaaagagaggggaaggccgucucuugcuuuuugagugcuuggcuugcacaucuggcaugaggauuuagguguuugccaggccaggacagugacuauuuuccaccacuucuugcuuccccuuguugguucaaaaaucuggcugugcuuuagucaguguuucugggccuuauucuuaguucuggugagucagaggucacaggagggaagcucagcuggcagcaggcagguggcauugcugccagcaugccaccagagccuuucuugacucugggccuaauguuauauuaaggagagggacucuggucuucuaaucaucacaagauugccauaggaaacaacaccccauacuuucucuuuaaguagggcuguguccugaagcucagagcaucucaggucagcuaccucuugguacccuuccucaggugcucuucucuugugccccuugaccaggugaccaugccugggccuguucugagcaggacuuuuguaagugaccugucugcuuggucccuugcccauugucaggagaaggagcuuggagaguccuggagcuagaucccuacauguggcucuggcacuuggagccugcagucucucuuuguccuuauguccccuuucugugaagcuuaggaguucaguggaaaaauggagggcuguacaugaguauacaaagaauuauucuuaaguuacuuucucugaucugcuggccuaauccuuagguuuggaccugcucuuauccuggauauuguuccuuauggcugcuguuucugauucaaagcaggcuccacccccugccaucucugccauugcucacucuugcuaagggccaguguuuggaguauucaugacucugagccagugcauggcuugucugcucugcacaggugaacuugaacucuguaaagccaaagggcauguauuggccauccuguaguaucuugucccagagagcuaucauguguagauugcugaaguugggguguugcagccuucagaguuccaggauugaguuucaagaucagagaugggagcucagguuuagauuccuggcuuucuauuccugagcaguguaugugaguaaucuaagcauccugccugaaaaagaacaaaguaggcuuuuuuguuuugcuuuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccaucuauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacauggugcauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauggcagcacauauacuaaaauuggaacgauacagagaagauuagcauggccccugcgcuuuuuuuuuuuuuuuucuuuucauuuugcaagucagggguugaaucugggguucacgugcuagauaaaagccacugaacuacagccccagcccuuuguucuaauucauauucccauugccucagccucccaagugcuggaaugauguccucauuuguuacacccagccucuguggcgacgcuggccauuggcacuggucaguacuggcucuuugguuuguuacuaccucagaaaggucaaccuuucagcuaugcugcuguuuguuuuuuaagugugaauugaagcuguuugcugguauuuuagaugcaauacacacagagaaaaaucuaaacaggaccaaagauuauaaacuccaaaccccuaguuuccauuuuucccucccuuuggcuucaggucaacuuuccagccagccagcuacuuggugccuuuuuugacugccuaagaaaauguuucugcccagccgugugucuuuuauagguugauuuuaauugguuauuuauuacuuaauuuauuuuguaaacuauaucuuguuauguaaucucggcuggcuuugaacuccuuauguucuuuccuuagccucccaggugcuggagucauacaggugcucacuccagugcccaacucuauggugauauuuugugcguguguaugaauauguguacaugcguugugugugcuuguacauguggaguccucuguccaucuuuguuuuuugagacagggucucuuaccaaaccuucagcucgcucuuacugagccuagagucacacacugcugcauuuggguuuuuauguggguucugguaucacacucagauacucauguuccauggcgagcacuuuacccacacuaccaccccuccccaacuaauacugauuuuagaugggauaguaguacacauagcugauaaacacuacagauguuucuauuucuagacaaauuucuauguauggcuucaggcuccuggcuguguauauuugucugcauguuauaugcuugagucucaguuucuauccccagaaaaugggucuuaggggggaggcuugaaacaagguuucauucuguaauccacauuggccucaaacucagggccaucuucuugucugugcuuugucgcuucugaaauuaaaggcaugugccagcauguucccuucauaaaauggguuuuaugauugcaccugucuaccugacuggauuuugaggauuugaguagccagacaugguggugcacaccuguaauccuaguacagggagaguggaguguugaggcaggcagaucaggaguccuagaacagccucgaugacauuucaaaagacucaccuccuacccauggccuccaacuaaaaagggucuaauguggucuuggguacuuggaguagagccggugacacugccgcccgaguaaaggcacacguguauccauucaguagguggauuucugucucucucugucucucucucucucuuuuuuuuuuccaagaaagaggcuaaccuugaacuuuuaucugaaccacaucccuaggcucuuuuuguuuuauuucuuucuggguuuugcuucaggugcuuuucuaccuguuugcuuggugccuccccugccccugguuaagagagaagagaaaagaaaaacaugagcguguacugauaaagauaccugacucaaaaaacaaaagaacccugcaagacagaauuuuaugggcacaugaaacuuaagggcuuuggacuuuauccuuaggucaaggggacacauuacagggugaucaacuugaggguggaauagaguguuaauucaguagccugggucacauaguuugugucagggcaguugguucucuggagaguucugagcuaaauuaggcuugaguucuaggaucacugguuaagagagaguccugggagcccgguaugguggcacgcgccuuuaaucccagcacucgggaggcagaggcagguggauuucugaguucgaggccagccugguauacaaagugaguuccaggacagccagggcuacacagaaaaaccuaaaagagagagagagagagagagagagagagagagagagagagagagagagagagagagagagagagagugugagugugugaguucagggaaggaagaccaggugacuggagccuuggguugguggcagugaguccuuugcuugggccuaaaagccuacaagcgacagccacaguucuugcgcaccuucuguaguggcugagguugaggcuggaugaagcaaauauugagaggcuccacaccuuguuccagcugugcucagagccacuguggguugugaggggagauggcaggugugacugcuggccuucugugguuuuaaguuccauauucucagcuuucccuuuggagucccuuccuuccccuucuggcucagcucuggggcaaggugcucacuucucagcaauuccccuuccucagggaaacgcccucaucugcaccucucucuuuccuugguggcauuucagcagaucugccuuguguaggagcuaaucucuagccugagccuuuccugcuccuuagauauugucugcaucagugugcauggcgauggaccgcgguugaucugccucugguagcucugugggauuaagcucuucuguauacuaccuccuugguucuugcagacucuuccaagcacuucaccuuccugaccgacauacuggaaagaagcugaagcucaggggacaucacuguguccugaccagauucacaugagguuaaggucuuaagguggaguccacauucaccaggucugaaagccaggacugcuggugacuaagaaauccgugaacugcuacuuaaaaagacaaaacaaaacaaaagccagccaaccaaucaucuaaccaugggagcugagauaagucaguaaaguguuugcuaugcaaguuugagaacuugaguucaaucucuuguaaccaaguaaaaagccaagugugucugugugaguuugcauucccagugcugacaacuugcagaccggaggaugcuaauuggugagcuugggauagugagaaugacgucucaaaaaauaagguggguggcuccucagggacaacacaccacaugcuuuggcauccguauacacaugugcacauucacauauacauggucacacacacgauagggaauaauguuggagagggaagagauggcuuugcauguuuguuuccaggugccugcuggguugggggaggagagucagagguagugaauacugacgccugagugcugaguuccuagagccccuguuuaucuguggcucuuagaugaguuccaguguaccuuguccuggaaauggauuauaguggauucuacaggagagcaaucgaguuaucaacugagccauuuccccaguccaccugugucaucuguuaauacaaggaugucagucugagucuuccuucagacuuucaacgguggacuaccuuguuuauuuaauuugucauaaagaacuaaacuuuggugggagaucugccccugucgggcuggccaggcucagagguuuaugaauaccuggggccugggaaguggcugccccguguaagcccaugugcuuguuuugaggguuuugucugucuuuuuaccccuccucccauaccaggaauagaauccagggccuugugcauucuaggcaaacacuuuaccaccaagcacauccccagcccuguuuccaucucuuauucuacacauuuuaguuucugugugugagugcaaaggucgguguggugugugggaguggguucugggggagcagacucagguccuuagacuuaguaguuagugucguugccuguugagcccucucacuggcccuaacuuuauuuucugacacguuucacauaguugccuagccuguccuuaaacucauucuauagucuagacaggucuuaaaauuucaaucuuaugccucaguuucucaaacugggauuacaucaagcugguaggagcagaccuggccaacuugucuacacuuuaaauaaaccugacuggccacuuugaauuccagagguuaucccacauggacaggugcauggcugccacagggaccugcuagcuucuuuaugucaugcuauguuguuuauuugcaaggguggauggaaugaagcagugggagguggaauuaaagucaagauugccacauguaguuuggcauagugguauucccaagaacaagggcccucugaagagaaugaggacaacagcagggcaugguagcaggggugggaaugggguggggugccuuccacuggacuacagaacaucccugggaguuucuguuacagaugcaccaggugucuucuguaucaacagccagguaucaacuggaaguugauaaugguuggcucuagaaaaaacaucagggcacugggagugauuagaaacagcuuaggacaaaaccucccccugucucucauccucauucucucccucucccucucccucucccucucccucucccccucccccucccccuccccaucucccucucccccucucccccucccccucccccuccccuccccuccccuccccuccucuccccccucccccucccuuuuuccuuucacucuccccccucucccucuccucuucccuuccuccuuuccuucuuccauccuuccucucucuuccuuccccuuucccuuccuuccucuugccaaaagaaaugaaaaugucaagauuaggcaaaucuugucagugauuuccauuggccagugugguugcacaugccuuuagucccacacucggaagcagaggcaggcaaauugaggcuggcaugguggugguggugguggggauauugagagagcacgugcaaaagugagagagcacaugccagcuccagggaucagucagguuaacaaaagggauaugguccagaaaaagucuuugcuuucaaacccaacaaccugaguuugaucuacaugguggaagaagagaguagacucuugaaaguuguugaccaugugcaucaugauacccuuuagggaaacuaaaguuuuugcauuuggaugguaccuggaagaaaaacuaauguguuagcaagggaagcuugccugugagguaguuucacagacugugaguuaggagagaaagacuaaucuuucaccauauauuauuuuauauacuaagaaaaaaauuuaacaugcuguguaauuaccugugaagggcaagcaaguaccaaaagagagaggggucauggcugaauuuaugugugccuggcugggugauggaugauuguacagguggagagauagacacgcagacagguaggaggcagggcgugauggguagguguguguggauauguggauauggcaguaaccaguuguagugggaggauugugcagagccaauggcuggguuugcacacuacucuagugguucaaccacugaguaacacucucugugucuccaucagaaggaggaaaugguaaaggacugaauacauagguuuaaaggacagaacuauauauauauguauauauauauguauauauacacacacacacacacacacacauacacguacacauacacacacauacacauauacacauaaacauacacauauguauauauauguauauauguauauauauuuauuuuauuuuauuuuaauuuuauuuuuuauuuuaaaaaauugauuuuuaaagacagggucucacuaguauccuuggcuagccugguacucaacuauguagacuuggcuggucucagacucacagaaaucuuccugccucugccucccaagugcuaggauuaaagguaugaccaucacauguagccaaaugguuuauucauuaaauuaaaaauuaugucuucaguaagaugguucagugaauaaaggugcugucguacgugugcgcgcgcgccccccccucccccccagaguaaaauguuaaaaguuguguuguauugccaggcagugguggugcacaucuugccaaguauacuaagcuggcuugccagggcgccguagguaucugugucuccauucucccaguguuagaauuacagguauguacugccacacugagcauuaaaaauuguuauuguugccggguguaguggcgcacaccuuuagucccagcacuugggaggcagaggcagguggauuucugaguucgaggccagccuggucuacaaagugaguucuaggacagccagggcuauauagagaaacccugucucaaaaaaaaaaaaaaaaaaaaaaaaaaaaaggaaagaaaaacaaaaaacaaaaauauuguuauuguuguuguuguuauuauuauuuuaauauaguaguggcugaccuggaacuugcuauauagugcagacuuuccucagacucagaguccaccugccccugccucugcugguagaauuaaaggcaugugcuacccugcuggcccccaacuuuuuuuuuuaaaugugaauccuggggauggaacucaggucuuguucaacaagugcuuugccuacugagcuaucucccucguucaaugcaguaucguuuucugugaacaucuaacauacgauggacacauaguccuggcauuugggcaguaugugugcucacggugauaaaggucuggagucuuuaguucaugaaacauacacguaaauaaucaguaugaugcccccggguauggaaucaagguucccucuggugacagccucccuccaucuuaugagcaggggacuugcugcugcacuaggaucaccucuucuuugcuucuguuacuugccuucaggcucucuggccacuggcucuuugaaauuuauauacuuguguugagagaucccuggauaaaggaaucauggucuauuucuuagaaccuacagcagcaggauuugaauccuguaagucccuguuccuucauggugugacaguugaccuuugcuugugcuuguguucccaggacuggaaugucacauggcacaccagcaaccccgacuuuaccaagugcuuucagaacacgguccucacaugggugccuuguuucuaccucugguccuguuucccccucuacuucuucuaucucucucgccaugaccggggcuacauccagaugacacaccucaacaaaaccaaaacuguaagucaccugguaucccugugggguggggcuucuggguacuuguguaguacaggcuagccuugugugaagaaggcagauggaugugugaaauuaaucaagagugaaaauuuggagccaaacaguucaaaacucaggccacaggaccuuugagugaacucuuuuaacuuccauuuccucaguuuccccauguuugcacuggggaugauggaagcuuucucagaggaauucucauaaggucuuuguuuacuaaagcaguuuccuuguauuuauuuauuuugacuuuggaaauguuuucagggccgaggaauuggcuuacuggauaaagugcugcacaaugugaggaccagaauccaugagaaaauugaaguggagacaggaauccccuggccagacuagcuggaaaggggucccagguucaaacaagagacccugccucaggaguaaagaggaagguacuucagugugcacccguaccuacacacacacacacacacacacacacacacacacacacacacacacacacacacauacacacacguguuuucccacccacauguacauacaugacauuaacauacaaaaaaaggguuggucuugaaauuauuucaggguauagggaaauugcaagaauaaucccagagccugugccagccccucugcccgaggcucccauuggccgugccuuccacucuugucauuuguuucuuucuuagucucugcuuucuccacguguacauaguccuacgauuuuuuauuugacuuuuugugaaaaggugacaucuaccaugcccuuguguucucuaauucuuuauuuuuauuuuuuuugaggcagguuccuacuuuguaacccaggcugaccuggaacuugagaggcccugccccaccccuuguccucucaugcuaggauuucagaccaccaugccuggcuugcccaccacucauggguauuucuuuccuaaaauugggcuguucuuuuauuaaguaucaucaguaacaggcagggauagaaccaucucagagcuguggcuagaggucagguucuagggguacuaaggggauaaaaauaaauuacaccgcuaggagcaguggagcauaucagucauccuagcacuuggguggauggcuaaggcaggaagaucaggaguucaaagccagccugggcuacauagugagacccuggcauaaagagaaaguguaagaagcuggacaagguuuaacugagaaccuuggaguugagcugguguccucguggugacuuuuuguggugcucagagagauugcaggauugcugcugcuguaucaagccgugguacucucuuuucuuccaggccuuaggauucuuucuguggaucaucugcugggcagaccucuucuacucuuucugggaaagaagucagggagugcuccgagccccaguguuacuggucagcccaacacugcugggcaucaccauggugaguguuggcugguggggcuggcggcgagaaauggaggacgugggcuguggugugucugggugguagaguguuugccuagcaugagcaaggucauagguuccaccaacaaaagagaaacuguguagugagccaaacaugguggcuuucauuguagcacuuggagagauggggaguucaaggucagucuggcgcuaauaguaaauuucgggcuagccugggcuacaugagaccuugucucacaaaaccaagaaauagaggcuggagagauggcucagugguuaaaagugcuugcugcucuugcagaggacccagguuugguuccacaguacacacugaguggcucacaaccccucguaauuccaccuucgagggauuccucuucagaccuuguggguacucacauguaauuggaacacacguagacacauacacauaccaauacauacaaauaaaucugaaaaagaacaaaacuuuaaccuaaaaccaauagauaagacugaagaaacggcucagaggauaaaggcgcuugugguauaaagcccaugggaagguggaagaagggaacagcuccacacagcuguccucugacuuccacauguucguuauggcaugcgugcacacucacacacacaaauacacauaauaauaaaauauuuuaaaaccucuaaaacaaaauaugcagaauuucuaauguuuaggggagccaugaacagcagcuacaguccuuacccugcccugcauuucccugcaucucuuaagugcagcucacagaaugucauuugugguaguuucucaagcgugauggauuugggagcucugaggcuuuagggagguaaaauacuaagugaaguaggaagcagugcuggccacuaggaucccauaccucagcagcacagacagcuaggacuuuaaauuuacagauacgcgguaagugaguuuugagccugguaggacuccuguuauuggguuugagcuugaggucauuuuagagggaucuuguggggcaggcgccaugugucuccuuacaggugauaagaugaaggcacagagaggccccgggcugugggugagauuauggguagcugagccaggcuuggauccugugugaagucuauaagguuuuuagagagcagagaccuuggcagcuggaagaagaggaagaagaacaagcuuagagcagacuugggggcagagaaucaguuuaucugaaggguuggggcugaaaggaggugcacagggaaggagaggcugugagugaggaacaguggaggcguggaagggagggguggggacaaagaagacacagugaugcugauggcuauguugaccaggugccaggcacaagacuaacuccugaaugacuuguguucaucuaugugcacuuucuucccauguuguagauaagugaguggaagcccagagaggugaagaaacugggccuaggucacaaagccaggagaugguagagccacauucugacugcuguccugauguuugugguggcucuuggcuuauuuucuggcucuccugcugggcucaauuccuugcaaacacuuaguaggcaguuagcaaacauauucuugcccugacuaugugugagauaaaaauguguggcuuggcuuagcacaaagacaucauuggugucucuauaaaagacuaaagcuguguguccuugugugcagaacuuugaacagggagcucugaacuugggucugggacuugaguuaaggaaacuucacugaagggaagaauaguggagcugaagcccagagggcgaauaggaugaaggggcugagggcagagggccauccuauugagaacagcauguccaacauucagaagaauggaguguuggccugagugccuggaacagggauggagagggaggggaucagagaggacgugccagggggagguagaggacuccaaggcacuguagccucacuggucugcguugucuucucucaaagcuggaucuuaguucuaaacuaagcuuccuucaaguuccccuuagggucuuauuacaaucccaugacucagggacuggaagacagcucaguuguuaagaguccuugcugcauaaacauuaagagcugcucaaaucuccagcacccauguaaagucuggcgugccauacauaucuuuaauugcaaagcagaggcaacuuggcuaccaacuucguucuagguuaaaugagaggcucugugucaagaggauaaggcagagagugagagagcagaauucuuagaaucaucuuccagccucugcacaugugcacccauauacacaugugcauauacggcucacauucucacaggaauacacauagagaauaaaaagagagaaaccuuuagaaaauagcuacaacucuuuagguagcggcagugguacagcugugccuggggugagggccucuccuggaccccugagucaugcaugcuuacucagcaccaugggacccugggguccugcuuucucuaaacucuuauguaccuuucucuuccagcugcucgccaccuuuuugauacagcuugaacggaggaagggaguccaauccucgggaauuaugcuuacuuucuggcucguagcccuacucugugcccuugccaucuugagaucuaagaucaucucugccuuaaaaaagguaauugauggccagggggagagaugcuuaauccauuuuguguggucauguguugccaugggaaccauaggauggggaccacauagguucugcuucuuuuccaggaccaucucuacgccagcgaaucagguacagacuuuguucuagacccgucuuuccugccuacaggcaaaugcuaacucacauuaagcuucugucuguagugccucuguaggcuagccaggcuggagcugagcugggagcucuguuugcccauuugccacaccaccuccaguaggaucugugugacaaguuccacagacugaggcgauugaccucaaaagggggaggccuccuggaaucgguuguggaacucuucacuggagaaaauauauugagccauaguucucauggcaaucuaucuguuuuguuuucucuuauuccuuuucuuauuuacauguuccugguagccuaggccaauaucuuaagugagaauaaugaguaagaaaccaucccuagagauggggccacuaacaugaccuaauccccagggaaaccaaugcuuuacuuuuuaaaucauuuacaaaacaauuaugguaaaaacuuucccaacaguaaaauuucauauggcuacaugugugucaucggagguagauuuugguauaugguaaagaaacccuuaauuagaaagaauucaaauaguuuaaauuuauacauugaagauuauaaaaaaccaggcacuagauguuaaauaauaauuuaauaaugguuauuauuauuauuauuuaauaauaaccaugggcuggaaaguuaguucagugguuaagagcacugaccguuaaagauuauuaaccugcuccugggaauaugccaccagccuuggacgacagcccccacugaauauauccuuuuagaauuguuauauuuuaaugauuuauagugauguuaccugcucuguuugugauucacugaauaguuucagaguuguaaugcucagaugauuuuuguguuuuacugugccaaaugauuuuuguuuuuauuugugauuguuucacuggauauaguuucuaagagauguaauguuucuuuuuuuaauguauaaaacccccugcuugagagcugcagaauacacucagauucaaacugccucuguguuuguuucugucugucaccgccaaauccuuacccaccuagcuucaaggaccuucauuccagggacccccauaccugacugcggugguccguggcacccaguggcuguuccccaaggacccuagacauguuaaccucgguguuaccaacuguaacucugacaggaaguuguugaggcuggccccugagugccacucucaaaaugucugaagaauguacacuucuuggcuagucuguaauuucuuguuaccugggagcuagagacuggcaugagcaugaaguggggauggaaggagggaacauggaggagggaggagagauguggagcaccuguaaaagcauagccucuggaacagggacaguagcuggcagaguugaguuuguguuuuccuaaaugcuucuccagggacuacucguuucucaugaauaauuugaggauccaugcauaaugauuccgaugaggcaucucuacuucagcacuaacugacaaguggacagaggcuuuuucauugugggacacuguccugugcuuuguaggauaucuagggccacccuccauacucugugugcuaggagcuaaggucaaacauccccagacacuggaauuauugucugacaugcaaaagagccuuugguugaggagcucagcgguggaggagccagggcauagaaagguuaaauaaauggaugaggucccauggccagaaggagcagagcagaccuguuuaggcauagcagaugaggcuaucuuucuccugucucauuuucaggggagggaaauucggggaugccuguggcagaggagguagcuaucugcagccugcucuuugggcuuaucuuaauccuuuuuacuguugcuauagccaaauccauagucaggauaauuuagagaaaacaaauguuuauugagcuugugguucugaaggcugggaggucugagguuuuggggcagcaucugaagaaagccuagcuggcagauuccugcagaggcccaugacaucucaugccauuuugggcccccaccacugaacaccauuccucgugacugugaggauuuggugugucaucuguguccugcuuucagggaagauuauauugaucugugcccccugccuucuccccugcucaggaugcucauguggacguguuucgagauuccacguucuaucuguacuucacccuugugcuuguucagcucgugcuguccugcuucucagacugcucaccccuguucucugaaacuguccaugaccggguaagugugacccagauguguaugcccaggucggggagcaguaggcaauugcagcuaacucugauuuggcucagguucuaaacccaacaccaucuggguacuuguucugagcccccacuucaccaaugcagacucacauugcauuccuguggaagcccauagcaaaaucguucuucucacuugucacguggaaaccugugcauggauacaccagugucccugugucccugacugugccuuacaagccagcugguaacuuuuacuuagcaugaugauuuuagaaaaugugaagagaacccacaggugaaaacuuagagucagcaaguaucagguaaauuccaacugcccaggcuuucuagacaaaugggaagucuuggcagaugaaggccauggucuuacagggcugaggucgguaggagcuacggcuggggcuguggauccacauuaucuuaggucuugaaucucugcuauggcacccauuaggcccucggccaucucugucaguuucagggacauccugugaccugcugcuuccuacuguccaucuuucuuccuccaucuuucuucuuaguuacccucuucuccuccaguacagaucgagugucagcccugugauuuguguccuuccaggcagccuggccuccggugggcuuccuaucaguccagacaggaaccuuuacuucgagcucuagacuagguccuagcagacagcagucccaggcagauuccugcauccauuuguuuugucuacaaauuuuuauuggaacauauucuugcuuauuugugaaaugucccacauggcugaugggcacuuacagggagaauuaaggggcugcccugagacugcauuucccuuacccccuguauuuccuaaccuugcuguuuggcucucuguaggugaaguuugcuggagcccugucuggaagagcccuucagcuuuguugauuugggaccuuguauuuauacuuaacuccuuuauuuuguguagggcuucuuucuuccagugaacacagcucagucacugaggggccaggacagggcagagcuguucaucagcucccugcugaacuaggcaauuuauaugcaugucucuuuuuauuuuucccauuuuucagaaagggaaauggaguccuagggacuuaaguggcagagcaggaauucgagcccaggacugguccuucuauagaaucccaucacuuucucuugguuauauuccacuuaagggcagguuuaauaaugucugaauugguuccuuaggcccaaaggcagagauuguccugggaucuugaugccuuaggcaauguuggcaugcgugggcugcuguaacaguguaggggguccucugaggguccucugaggccugggacauggcauaaugccaaaacuggguucccuuuaaaaacacuguguuuacuuaauaagacaaaauguauucaaccuaagaucgaucaucuuaacugcuuuaaaugguucggugccaucauggcuauugauuucauucauaacacaauuauuguggcuggcugauuucaacugggacuguguuaaggcacaaggaaucauggaucccuucuggggucaaaccuggcacaacuuugauagcguccccagaugguaugugcgugugugcgcgugugcgcacgugcucguguauggcacggaagcuuaaguggaaccaguuuaaagcucucagacuugaaugagauuuuguuuuuuaaaagauuuauuuauuuuauguuuaugagugcacuguagcuguacagaugguugugagccuucaugugguugcuugggaauugaacucaggaccucggcucgcuccagcccccacucacucuggcccugcuugcucuggcccaaagauagauagauuuauuuauuuauuuauuuauuuauuuauuaauuauuauuuuuauauuuagguauauauuguuuugacauagcuauauguugcaaaucaugaucauaucaaguuaacuaacauauccauccugucauaaaguuacuuaaaaaaaaaucccaguuagcaauuugccauauucuuuuuuuucucaagauuuuuuuuauuggacauuuucuuuuuuucuuuuuauuauuagauauuuucuucauuuacauuucaaaugcuaucuccuuuccuaguuuccucucugaaaaucccuuauaccuucccccuucccccugcuccccaacccacccacuccugcuuccuggcccuggcauuccccuguacuggggcauaugaucuucucaaaaccaagggccucuccucccacugauggcugacuaggccauccuaugcuacauaugcagcuagagacauauggggguacugguuaguccauauuguuguuccuccuauagggcugcagaccccuuucacguccuugggcuguagcugucuucagacaccagaagagggcaucaggucccauuacagaugguugugagcuaccaugugguugcugggauuugaacucaggauccucagaagaguagucagugcucuuaaccgcugagccaucccuccagcccugagagauuuuuuuguuggcuugcuuuuugcuaugcuggggaugccaguguuucacuauugagccacaucuccagcacuguuugccaggaccagggcccuuuuuauuauaaaaggggagggagcugucucugaagggggcacuguacuuuggcuguugucagugauugguucuagguguugguggagacuuguacacucucugggugguccagggcaguaaaggggugauuuuucugucccugguucugaaguuaaccaucuucagacucagucaugaauaucuaccugauccucucuuccugcuuuagcugcaagaacuuuauauaggaugucagauaucauccuggcugucuuuggaagcuacagccugucacguguccuuaugcuuggaagcaagcacuuuucugucuggguuuuccucuccuuuuucuuucuucuuuuuaaaacauuuuaauuuuagugugugugggcaccugugccacauaacaugaucuuagaagucaguggaucuccuccaagagucgguucuucccuuccauugugugaguuccuggggaucuaagucaggcugucagauuuggcaguaccuuuaccuacuuagucaucuugcuguguagccaucuagcuauguagucuagauagcucuggagucaccauccucuugugucaauuuccccggugcggaaucacaagugugcccuagcaggccacacuugguaaguuuuguuucauuucugagaucugggaugggaucccaggcugcccuugaacuugaucucuguccuugaggugagcuggaaggugugugugugugaaugugugugugugugugugugugugugugugagagagugugugugugugagagagugugugugugugagugugagugugugagugugagugugugugugugugugagugugugugugagugugagugugugugugugagugugugugugugugugagagagugugugugugagagugugagugugugagugugugugugugugugaguguguguguguguguguguguguguguguguguguguauguguguguugcagaaugggcagucagggcuaaugguuccugagucauaggaauaagagaaaggcugcugcucgggaggaaguuuugugaauauguucacuuuguguauuuuaugggagggguuccuaggagaaguaauaugugcaaaguuccagaugugugauggauacuuucugggauacuucuguuugacuccaucagaaggcuucaucccaggaauuaagugacaaggcccggggcagggaacagaggaggguacuacgaacugaguacaacacacacauauauaugaaugaaugagauuuuuuuuccuuugagacgaguucucacauagcccaggcugaccucaaacuccuuuuguaguggaaaugaccuucuauuuuugauccugcacucuccacuuccugagugcugggauuauaggcaugcaccacugugcuugauuuaugaaguuaugccaggcuagcuuccaccaaacagucccagcuccagcccuguauuguggacguuuaauuucauuguaguaagagucuaugaaagcaucuauaguguuaccuucaaucuggauguguuuugggggaccccuuggggcuaaaaggagacuacaugggacuuagggagguugguggcacuaaggaagcugucacagauggccaaacagccagagcaaggacauaacauuuaugugaacucaguuguggcuuagugaguuacuacuguagauuuuaccccuaagacaucugggccaacacucugcuauguauugccuaggcagauggauuuucuucuugccgcuuuauugagaguggauuuccugucucugcugcgcugguggucacucaccugcugaggaugaccuugaaccucugaccccugccuccugcucccagagugcugggauugcaagugugcgcuacugcacccaguuuuauuaaugggacccagagcuuccugcacucuaggcaggcauccucuaaccccuguuuuuuuguuucucuuuuuaaaaucauuuagguaaaaacaaaaagacauguguaggccaggcuggccauaaacucacagcaguuuccucgcuuuaguuuugcaguguggaaagucauggcuggcuugugacuuuuaucuugagacaguuuuguuugcaaaagguuucaaaaacaguagaguacucuuauaucuuaauauuuaagagauaaggguuuaaaaaaauauagagccauuauuuggcccaguaucacucauaauucuuuucaugucauaagauauugcagcaagccauuguaguugcaaaacgggccaucccgucauuggacgggcuuauugcuuugcuuauuagcugcaguuucucucugacugcccuggugugggguuuguuuagaaaagggaaaggaaauucuuauuucuuugcauuuaaucuguguaccggaacaauggcuugugucgcuaagugucuuuuuauuauccauguaaaucuguguauggcauauagugugauguguuuugguacacugcuuuucuaacucacccuuuucccagccaaggucccuucugacugcuucuagagcuuugcucgugcccacuccccuuuggacuaguagcucugggguauaauauaguguucuggcccuuccuuguuuguuucuugcccaguagcuuguuuucagacagaaacaaauuuugauacccugauucugccccccaaaccagcugcuucuggaacggugggaaugaaauaggaucaacagacuggauggguaacccaugauuagaaucggcggucucuucugcucuccgaaugccuucucucaacuguuaauuguuccuucacacaggccaucuuggaaauugagaucucaaugugcacauguuaagugcuugaccucugugcugguaauuucccaccuucuguugaacugaacuggccuucugccucugguagagauuuuuugauagcuggcucaaaaucucuguagcucuuagaguugccuauaagagacccaacauucauucauucauucauucauucauuuucuuucuuucuuucuuucuuucuuucuuucuuucuuucuuucucucuuucuuccuuucucucuuucuuucucucuuucuuucuagauauuuucuuuauuuacauuucaaauguuauccccuuuucugguuuccccucugaaaacccccuauucucuccuugcuccgccugcucaccaacccacccacuccugcuuccuggcccugccauuccccuauacuggggcauagaaucuucacaggaccaagggccucuccucucauugaugaccgacuaggccauccucugcuacauauacagcuauagagccaugagucccaccauauguuuucuuugguuggugguuuagucccaaggagcucugggguuacugguuaguucauauuuguuguuccuccuauggggcuacaaaccccuucagcuccuuggguccuuucucuagcuccuucauuggggacccugugcuccauccaauggauggcugugagcauccauuucuguauuugucaggcacuggcagaggcucucaggagacagcuauaucaggcucugucagcaagcacuuguugacauccacaacagugucuggguuuggugauuguauaugggauggaucuccagguggggcagucuggauggagacccaacauuucuaaccugaccuucaguauagacucuacaucauaaacugccagaucucuugccagauguugagcccagggcucuccacagucgaggcaaguguucugcuauagacuuaagucccuuuugggucccugggucugccauacuucuccacauuccugggcucugagcacauugcuuucugugaggaauguucuuugagccucaugaaccaaucugugcugcuuuaugugagcucugugguccuguccagcuacauuuagacccugguugcaguuaaguuuuacauuguuuccaggguuuauauagucauuguugauugauugucucuggagcccugacuaugugucucacaccuucugccacuuuuagauauaggagcucagacaggguuuuuuuuuuuuuuuuuucccucuguucucauuuaauuggauaaugagggugaaacauaauccugccuuguaggguggucuuggagaugaacuggucauuuauguaguguguugaacaccuuguagagcaggguaagguagguauacauggguugucucuuuguucauacuuguguauguuucuugauacacaguaagugcucagggaauaucuucuggauagaugagauagugauaagacaguuuucacagaguccacgggccauaaaauaguaaaaccugggcugggaguguagaucagugaggagcaugagccuagcauguacagguuccuggacuugauugccagcaaugcaacacaaaaguauacaucucuuuguaaagaguacauaguagaugcauauuaaaaaugugcucaauacguggauauguaaaguggggagaaugauaauaacaccaccucacaagguugagguaugaguguaggaagggaaaguccauaguacuuuagagagcgcccagcacauaguaggugcucauaaaauacuuguugaaugggugaaugauauggggcugauguuaacuuaaggucauggaguugcuaugaagauagguugauauuguguaauacugugcuugcacacaguagggacucaaggaacauuuguugggugaaaauagagggaugagcucugaggcucaggagaguaguccauguggcaugcagaacugugaagaugugggccauggucuuuugaaggaagaaugguuuagcuauaccuagcucuccuagacauggaaaguuaaguuuggauugccuuucuccucccucccuugugccuucugucuccuagaauccaugcccagaauccagugccucuuuccuuuccaggauuacuuucugguggauuacaggguaaggcuggaccuccagacgggguagguagugcaacaugaaugcaggguguguaugaaugcuucuauggaucucagcuuccuugaauguccucuuauacugucugcaaguuauaucuuaagaucaguaacuaaccuucaauguuaugaaugccugagugauuaauccauaggcugugagcacccuuaguuucugccauaggcuuuuagcuggcuugccuaggcucuagguuugccuuuugguugaagggauuuguaacuaauaggguauuccaccagucuugguuccaggacccuacagauaccacacugacugaugcucagucuucauauaaagcagaguagcaucugccuugccuucugaaucaugucuagaugcgcaugaccccuaaugcaacuaccuugcuguacugcuuaaggaaugaugacaaggaagaagaugccauguccucugaagacaaaacuuuuccaacacggauacagacuagugacauugucauuuucuccugacuuauagcaaagucauauaugcaugucauaggaaacacauaaggcagauauacaucaccaccaacuagaaaacaucuagaauuugcagauauuuccauaggaagcaggaaggucagagguucaaggucaaucuuggcuacauagagaguuugaggccaaucuggucuacaugaggccauauuugaaaacaaaauaauuaaaauuuacaagucacaucagaaauaagaaacaucuagauauuucuuucuaaacagaacgugcaccuguuugucaagaugagucuguuuuguuucccugaaagaccuaguggaaucagccaauugauagcuuucauguccacauagucucagguuuuuccagucauggcuggacagcaauagcagggguguaaggggaggccuguagacucuucuuucaaugcucauugugucuuccuuugugccuugcucccaggaugauggugcacggcuaccgccagccccuggagagcagugaccucuggucauugaauaaggaggacacaucagaagaagugguaccugugcuggugaauaacuggaagaaggaaugugauaagucaaggaagugaguaucacauuucuguguucuuccaggcaaggcagaugcagccuaggcugaccugucaccuacccuuagccacugugacugguucugguucuagggagacugcaccaccuuccuaggcugcaguuccucuucucucagauuggggaguggagguguuuaacaccauaggaccucccaacagcugccuccugucuugucugcaaguuaggucuuuagcucuccaaaaggagagaggaggccaucugccaagguggaauugauuuuccugguuacagcccucagcuugggccuugcccugcucacacagucagucuuuaacuuuuuccucucugggcaucuguuuggugucuugaauauucccugaauguucuuguuggaguugaaugcuuuuuguugaacaugucaaguauggaacuugaaccauggugugccaccugaggucaaggccucaguguugagcucuggaccuggguucaggcauugggacaaaguaggcaaaaugccuugcacauuggauuguauaguuuuauaguaagaucagaagaagugacgggcacauauauagggaugaguauucagggacugcucccgugagaagauggcauucaaaacacucauucaaaggagggagugagcgaugugcauaccuugggacagggccuucgaguuagagagacagcugaggcaccuguuuaggcuugagcgaaugccugagacugggaggugucuuugcaggggacccaggcuaugcuagagaguuauacugaagguguaguaggaagucaggggcagauucuauacagggcugcagagcgguaagacagugacauccacuagagucucauuuauaaauguauuuguauguuguauuagucaggguucucuagagucacagaaccuauggguucucuuacggguaguaaaggaauuuguugaugacuuauagucugaaguccaacucccagcaauggucagcagcagcugugaauggaaguccaaggaucuagcaguugcucagucccacacggcaagcaggugaaggagagagagugugucuuccuucuuccaauauccuuauguaggucuccagcagaagauguagcccagauuaaaggugugugccuccacaccuuuaaucccagaugaccuugaacucggagaucucccuguguuaaucuucuggaauucauagccauuaugccucaagauccccaugccaagauccaggucagaaaugucuaucucccagccuccagauuaggaucacugcugagccuuccaauucuggauuguaguucauuccagauauagucaaguugacaaacaaccaggaauagccacuacacauguguguguguguguuuacaugugugaguguguauugccauagcaugugcauauggagaucagaggacaacuuaugggggugguuuucaccuucuacccuguggguucagggguugaacucagguugucagcguggagagcaggugccuuuacccauugagccaucucacugguucugagcuuaucuuuguuuccagcccagugugcaguugacuuguguacugacugguuuggugugucaacuugacacaaguuagagucaucagagaggaaggagccacaguugagaaaaugcuucuuugagauccagcugugagguauuuucucaauuagugaucaguggaggagggcccagccuguggugagcggugccaucccuggccuggugguucuggguuuuauaagaaggcagguugagcaagccacgugaagcauggcaguaagcagcacuucuccauggcuucuacaucagcuccugccuccagguuccuucccuguuuugauuuccugaccugacucccuucagugaugaacagcaauguggaaguguaagccaaauaaacccuuuugucuuuaacuugcauuuugguccugauauuuuguagcagcgauaggaagcauggcuaagacaguuugugauguuacuuuguggucuccucagccugugcuccucuuauggugaggccauuuuggaucguguuuccaauuggcuugcauaccggguggcucagugacugugaaaagaguuugguaguguauuuguuuuauuuuuaaauuaaguagucacuuaccugucauucuguucccaggcagaugccuaagaaaacuagaacuuagguucuaaaaggcuuuguacagacuuguagcugccuuguuugugauagcccaagacagaaucaaacccaaaugccuauuaggauguaaguagaaguuaggauuacuacucagagcugagggaggaagcaccaaguuauuaugcuaagugaaagaguagacagacaguuguccuccuaguauuugaugcuuaaaggggcuugaacaacaaaacuggaggauuuaucagcaaugucccaguauaucuaauuaaaagaaaaccagugcuggagagauggcucagcaacugauuaaaguacccucuuccagagguuugguucccaguaccaauguuggacaacucauagggcuugagguuuauccagaaucaauaccuugagaagauggaagaccuauuggccugccagcuccaucuuggggaacucugacucaaagaguucuuauagaggucgguugaguucuacaucgaggcugauggccccuugucauuuaggggauguuuauccuccugucaguugguacauuccuggauuacccauggccuugucuccugaguacauuucuaauucuuuagguaaacauuauuuuuggcaagucaguuuuuuuuuuuuuaaucaaagaacagacgaggaaguccuuaacucugcuuuuugauuugauuuaaagaccacugguguuucauguucugauaaauuaaaagcauucuuuggggacauuuauggacuagaaauuccuuuuugaccccuuccuuucccugucauaguugacugucauagcucuuuuuuugucagccauugcaagguuuuuguuguugcugcugguuuagaaguuacagcauuaggcaaaggggaguagaguaacuuuaccagggacacauuuguaaaggauagcucaucucaaaauagguaguguaaaacaaaauaaaguagcuauuaauugcuuauucguuuaaaagacugagguaugcucuucuucccauaucuauaguuuuaguuacccaugaucaaacaagaucuggaaauauuaaaucuaaaauuccauuccuaaguuuuaaauuauauauaauucuuguuccaccauauucugucauccaaggugacaaaauucuuuugucuacugugucuguccuguuaguucagcaaugaucuuggggaguuggcucaguaguuaagagcacuggcuguacuuccagagauucugaguucaauucccagcaaccacauguuggcuugcaaccaucuauaauguaaucuggugcccccuucuggcaugcagguuuauaugcagauagagcacucauauacguaaaauaaauaaauuaaaaacaaaaaccagacuuagguagcagucuaaaguacaacacaggccugucguugccucagucugcugucucugaggaccacaggaagggugaggguaguagacguuguuuugagaguaacagaacacacuuacauugugccauuuuacuacaggaugguguguuuccuuuuuaaaaaaacugauguuugacuugaagguuaaacuuuuaucauagguauuuguaagaaaacagaaccagucguauccauggauaagagggaguacuguauauaaauguguaagaauacaaucuguauaaacuugugucuguagauaggggacuucagguuagcauuuuagugguguggaugucuggugggguauuugucuuuauucaggacuauccuauguaggacaggacagaacuacaacaccacacagaaggauggucacagggcuaagucauugugacucaaguuuaugaaacaagucugauuggaaacuuguguagccauacugguuuguuuuguggugguggugguuuuauuuuguuucaccuuugauauaaaguuuuggcacauaacccuacccaggcugguauuuucuuuccuauauagcugagagugaccuugaacgucaagguucuccugccuccaucugccaagugcuggacuucaagcacgugcaggucaugcuuggcaggcuuuauagcucuuggcuucugcauguagaaguuggauccuuucuaaguguauuucuguggggcuggagagaugacuccauggguaagaccuccugcuuccaguacagaggaccaaggguuggcuccuagcacccaccccagguagcuuacaaccaccuguaaccuuugguuucuggggauccaacacccguuucuggcuuucacaaauaccugcauucauauagugcacauaaacauaaauagaaaaaagucuuugcuuuuuauacauaauaugguaucaugguccagcuuauucuuugcauguggcuaucuaguuuccuauuacuauuuuguuuuguuuuguuuaauuuuagagaggcccuuccuauacauguauguagcccaggcuccuggcacuccuccuaccuacuucccaagugcuaagauugcaggcaugagccacuuugccuggccuaucaccagcuuuugaggaaaaaaaaaaagauuuauuuccagugaauagacuugacagaaaucaccagcuucugggcccuuaauugugggcccagacugaucccuguguggcuuccuuguuucugucuugacaucugucagcuuugucuucucuuuuaggaaggcuuuagcuuaucugggucucuaguucccauuucagauuuuagaacugccccaucacuuccugugaugcgaagcagccgucugagcuucugauagggauugugaaucuguagaggaguuuggggccaucaugcugccaugcuuuucagcuacagccucuuaggauugugugucuagcugagcuuggggccagcacgccugucauucuguccauccaugagggaggcaggacuuccaguuuauugacucagagccucauuauguugcucaucguugccgacaauuugugaccucuuucucccagcuucccagcacuggaguuacagucacauuccaccacgcguggcuacuaugagcccugccuugcaaacgaggaaacuagccuuaguaucccugcaguugcagccagcagauggcccagggggaaucugaacccauggcucccaaguccaggguuauacucacugcauuaagcuugacucuauggugauaugucuuggguucuguucuucuuuauucuguuuuuuuuuuuuuuuuuuuuuccgagacaggguuucucuguguaguccuggcuguccuggaacucacuuuguagaccaggcuggccucgaacucagaaauccgccugccucucccuccggagugcugggauuaaaggcgugcaccaccacgcccggcucuucuuuauucucuugacugugggcuaucucugguagaccagauaacugcuuuacucuccucucauuauaggcagccuguacggauuguguaugccccucccaaagaucccagcaagccuaagggaaguucccaguuggaugugaaugaggagguggaggcacugauugucaagucaccccacaaggaucgggagcccucucuguucaagguguuauacaagacuuuuggucccuacuuccucaugagcuuccuguacaaggcccuucaugaccugaugauguuugccggccccaagaucuuggaguaagaaccugguuccccauaaccuccugggcgguccugucauaugccagagcaggcuuguuaccggccccuuaccuucaucuuccccagcuuuguuuaauuacuaucugaguuguggccacuuugauugcaagucacgaaaaccuccugaauccaaaguuaggaggauaugggacugucuagagcaagggugcagguagaucucaugaauaucugcagcuggaaaccaagaauccagcaagcgggccucugccaucuuucucuccaucaccuuggucucagugugcucuauuugacuaccuuugagugacgugcugguggagagaccuaacuaucgguaucgugaucccaaggcagaggucucuguuguaauaaucugguaccuggcagucauagcaccccuauaagguaaaguguugccugguggauggcucagguggaaaucacuagggugacuugaaaguauuugccccuacuguauguaucacacuuaaaucucccucccacccccacagauugauuaucaacuucgugaaugacagggaggcucccgacuggcagggcuacuuuuacacagcacugcuguuugucagcgccugucugcagacacuggcacuccaccaguacuuucauaucugcuucgucaguggcaugcgcaucaagacugcuguggugggcgcugucuaucguaagguaggccaggcaccacacccaauccugugaccccauaauccagggacagcuagcuggagcucuccaggaccuguggagauuuccaggccagcauccucagcaaagaaaggaugggggcuguggggaccauggggccaaagauagcucucaucacgcuuaucucuuaauaaaauggcucucaguggcaagugugagggauauuagugagacuacauguuaccuguggguagcuggguuucuuagacagauuggcucucuuugaugaagucuuggauggaaauucaaguucagaaccuggggagaugucuaacuagguaaaguguaagcuugacaaccugaguuuggauuuccagaacuagguaaguuuggcaagguagugcauauauaugcacugagcagugaagauaggagaauuccuagaagcuccugagccagguagccuuggguacaguaguaaugagacccugucucaaacaguuuggaacgcuaggacaacaucugcccuccacaugugcuccguggaugcaugugucugcauauacauguucauacgugugcacaguuuuuuuauuuuuauuuuuuaaagaaaaggaaucuguguuaaauauucuaguuucacauccuggguuugccuucacugucacccuacauuugaacugaagagagagcgugcuucuugaauugaggcagacaagcuuaaauauuuuuauuuguuucaccaugcuggaagugcacauggcuggcagggacuguucacagagcuugggccauagccccauuucuacuuuuugguuguuguugauguucaguuuuuuuuuuuuccauaauuuuaguuuuuauugaagauaagguuuuuuucauacaguauauucugaucaagguuucuccuccuucaguuccucccagauccuuuuccucuacucaaguccguacuuuuuucucucauuagaaaacaaacagguaacuuaaagggacccagcgauucagcccacacauguccuggcuucugcaccacggggcucacaggcuggcaagagaggcaguuuuccuagugcuucucaccccugauuacaaauugcacucaucuauuagcuugaguccugguauguaggcagcaucccagaccagugggaccuugaagucaagguugcaguguucagagacauagggauauuuuuaaggccauugacaccgcaagacacuuuagguaucauagcuugggaugagggcauuuucugcguugaggccagggacugucuuucaguuaguaugcagacuggccaaacaaagcauugucuagcucccagugucaggguaauaaggccaagaaccuuguguuaggaucugaggccaacaacauggaaauccagaaucuuagccuaaacacagaccugcugauuaaggaccccaggugacacgccugcauaugaaguauauaaggucaugguuuggaaagugccuggaacagcucaggauggagaggagaaagauaggcacguacugcuguccagagucuuguccagggucuggggagguccaugacccuuugccuucacugguaggcucaccucuuccucucuccugaaccccacaggcucuuuugaucaccaaugcagcuagaaaaucuuccacggucggagagauugucaaccucauguccguggaugcucagcgcuucauggacuuggccacguacauuaacaugaucuggucagccccucugcaagucauccuagcccucuacuuccuguggcugguguguguuuucccuuggucuccuccuugugcagggagggcugaccucgucuaggcacugacaggguggguaugggugggaaggaauguuucuugcuuccauuuaaauuuuauuuucuggucuuuuugcuaguuucugguuauucuuuccuuauaucaucaggguuuaguucuauguguauaguauguaugcauugucauuucuuuguguaugugugugugugugugugugugugugugugugugugugugugugagagagagagagagagagagagaugcgcaucaucucagguauccuccucaaucucucuucaucuuguuuuuugaaagugugucucuuacugagccuggagcucacugauuuagcuaggguucuuggccaaugaacuccagaccugccuccacucucccuacuccagcacuggaaugauagauguacauugcuauacccagcuuuuuuauuuauuguuuuucuuuugagacaagguccuugcugcccugaaacuugcuauaucuaucaugcuguccucaaauucacagagcuccuccugcuuaugucuccccaguacugagauuacagacaugcaucacuaugaucaacuguguuagucuuuucaugaaguauauagaauuaacauuuuuauguuagccuuuuauguuguuaacccaccaauucuguucgauuguaccaccucaagugugaaacaaacucauuuauuagaaccuaaguauauugggcaggagccucuugguuguaaggaauaaagauccaccaugcccugagcagacucaagguauuguaggggaggaguucucauuucuaaacaauccagggauccgcagguauggacagaucuuagagaauggcaguguuugaaggguucaguuuuucucuuguuauuuuuuggcccugcuuucuauaauuggcuucauugauaucuuuacaaacaauaauauagaggagcaaauugcauucauugcuuccauaguuucucccgggguacuguguuuaaccagcucaguccuuuuccuauuccugaaccaauggcugugaccuaggaagaagucucugauuggccagccugagucuugguuccccuccaugcaaaaggaugugauauuauuucuacugugccauuaguaguuccagaauugagaagacagugagccagaggaaagagcagcauauguccaggaauuacuucucucucuuguucuuccuuccuuuuuucuucuuuucuccuuccuccuuuuuucucucaguucugaggaugggacuugagacccuuuugcaugcuggguaagugcucuaccacuggguuccuuuacagcugaaggaaugaccuuccuuaggcccacugauaauucuuacccuguccuagguaggcuaccuuucauuuuuccuuaauuuuuagguauguguaugugugcagucauguuuacauauuuacaugugugaguauggacacacugucaugagugucacaacucuagacguagugggacguaggagaauggagccaauaaaugaggcagauugaaaucuuaugcaguagccaaccuuauucagagccccaggcaauuuauacuccugaggguuaaaaaaggucaccugauuaaaguuuuuaaguucaaguuauaaggacaagcuacaguugucaaaaauauguuuuuccauagagguauauaaacaauuauuuaaacauuuaauugaacaacaucaacaaacaauaaugaggaaucugaaguaagcccacucuggucuguaacacagaggagcacaagaacaggugucgggcaguggauuggggaaauaaaggaggugggggagaacuugugucccaccagaguucuggcucucugggcaggugagugcaaggaacugaugugugcucucuaugcugccugggugagugacuggcuuugggaagccacgaaaucccaguccauggggguagagaggauccgggucucugggccucacggaggccagagaugauagguucuagcucuuggacacuguggaguagcugagaucaaagugagggcccuggggccgaagggagaagaggacggggagaaaggggcgcugggcuguucccaugccagugagaguccuuggcccagccuggugguuggaaacgcugggaggccuuuucuugggagauuagacacugcucuuugggggaaggccuauuucaucguucaagcacgcaagacaguccauaguuuagagcuuuauuguagaaaggcagagagaaagaaaguagaaaaugagaggcuggucauggccacauggggggggggcuggggggugggagaaggagagcuagacaugagaauaagaaaggugagagcuuaagagcaaggaggggccaagcagccccucuuauagugggcugggcugucuugcaguugcuggguagcuguccagaggagcauaccuggcuauugucagguaacugugaggguggagucuagacagaaugccagaggcuuggggcuuugucugcaugacugacugauagucacaggauuauggaguuggggaauccguggugucagacaccuaugucugucugggagcauggcucccuuguagaguuucuacugggucuccagaguaagucucacucgaccagaaacaggcugccauucacagucccacguccaagaauaauuccuggguugaagaaacuggccuuauuuucuugggguagucucccaaacccucagaauucucauauaaaucaguuccuagcccguguucggacacacuugguuagaggauaacuuugaauuuugguacucaccuucuaccuguuugagacaggaucuuuuugauccuagcugugaauacuaggcuggcuggcuugcaagcuuccaggauuuuccuaguucuaccucccuucacagcuguaguucccuggguuuacagaugugcauacauggguucugaggaucugaacucaggccacacacuugucggacaugggaccuacugacccagcuccccaaacauccugccccugauauuagaccucauggugugcucuucccgacacccauggauguugcuuguggacagacaccauuggagucugguggguguuguaccugauaacaccagcaaaguaccuguugaauggaauuaauauuuaaacauuaagaaauuacauuuauuugugugcauguuuauguguuacggcucaugugaaggucagugaacaaauugugagagucagguuucucuuuccaccauaugagacuggguucaucagguuugguggcaagcaugcuugcagacaaacacuuaaccagucuucccagcucgccuguggcaagcacccuugcucacagacucccacuucuuuguaucgauagagaggaguggugaguaaaacccuuaugaugaugcaggugagaaagaaaaacauuagacccaggaccuggcccuuggggagaagcccugcacuacagcuccugccccacacagagaacauacauagcuauauacgagucuucagguauauacuguggagcauguacccuuuccuaggaauuguaaucuaugugaaauguugagaagcuuccaggacuguuuguaaauuauaaagaaagaaggaucuaacuuggaggcuagucugggcuauauauaguaagacuguuguaaauguaacuuuuauuugccagauguaauugucaucuuagaggcuuauugccaaauaaguuuacccuuucuagaucuuucugaacgguggcuggcugguucagcccagcuguucuggcucaaacuccucuccacgcugacugauucagucugguuucucuuagcuuuauuuauugcucugcuugaccucagacuaacuggcaauuuauucaucuucuggcuccuucauuuuaucuggcuuguucugucuucaucuguaucuaguuuguucucucuguaacuuguccugauaaaacugccugguaaaauugccucugaacugaacucagccaaacucaauggacucagcucaacucucccuuucuacacggcuccuaagcagccucucuuuccugugcuguucucaggagaguugggcguagccgaucucugacucauucugucagaccuuucucugauuaguuacauuaccccuccauuagacugcuuccuucuacaaaauaaccuuuccuuugucauuagggauuaaagguguauacuaagggcaugccugcauuccagcuagaucacauagacauagaaggucuuuggauaugaucccuugccagagcagccauguuguuggauuaaaauuuuucuacagaccagcaagauuuucuuacucagaucagcagcccucaagcguaggaugguggcugcuggggaccaggcuggcuauuacauucugguuucucugaccuugggcauccucuuguccccugaaauauuuauuguaacagaguacauccccagugucccagauugugacccuuggcuaaaagaacaugugcuacucagggagacuaugcauauaucagaaguuugcuauauaacuuuauuucccaauauauuuauauugagugagaaagcaguaaguuggcuggagaguuggcucaaggguuaggagugaauccaagcuugguucucagcacccuuuucagacagugcacauugccagugauuaucuccagggaucugauucccucuucuggccucugcugaccagcauguguacucauguggcauauaaaaaugcacacacauggauaccauacauuuuuuuuaaaaaagcagaaaguauaaaauugauauauuaaaaauuuacuugaauggucagggagauggaucaagcugcaaaauacuugccagacaaguacaaaggcccaaguuugauccucuagacuuucucccucaaaccaaaccaaaccaaaccaaaccaaaccaaaccaaaccaaaccaaaccaaaccaaaccaaaccaaaaguuagaaauucucuauuguauuagauguggcaaaugaggcagaaaaaggcaaaucucuagggcuuacugacuuaucuaacaagccaaguucgaagccagagagagaaagauacccuauuucauaauacaaggcagaugauaucccaaggaguuacaccugaguuugagcucugaacacucacucucucucucucucucucucucucucucucucucucucucacacacacacacacacaccuguauauugcaccccugugaacauucaaccuguguauugcaacccucaugcauacacacuuauguaucauuccuugcccaacaagcacaaguccacaugcaaaugauuguaauaaacauuaaaaaaaaaagagagaaugcauuuggucauaggauguucugccagccuaugcugggagugucauaaaguaugugaccuguacuaugucagguucccagaguuaugccaggcuuuaugauucugugguagagcaguagagucaaaauugauuauagaaaaccaucagagaugcuagggagauggcuuaaucuauaaaaggcccacugugcaagcaggauggccugaguuuggauccucauuacccaugcaaaaagcugggcccagcagcacaugucuguaacccccguauuggaaguuagggcagagagcucacuggcugacugguuuuaacgaaaucggugagcuccagguucaugaaacuaucuguccugucucaagaaaugagaugaaaaguuauugaagaauacaucaaagucaaccucuggccuccgugugugugugugugugcaugugcauccacaaauucucauacauguacacacacacacacacacaaaucagaaaggauaaggcacagaugcaaagacagacagcaacaagcuugagucucuagcaagucaaggucacaguugugaagcuaggggagauggguguugcaguucaucuguauguaugcucugccuggcaaauacaaaaagccuaaccuucuagaagaaaggaggcuggacacaagccacacuguugaugcuagcugauauaaagcaagugucucuuacuuguacuaugaguaccaggaacucaagucccacagugccagugaccagccaaucuuguagucacuuuuccagccuucaagauaaguaaguuaucaggguugacccaacacugaaaacucuugaugccccaucuuuggguaaaaggaaaaaaugauugacaccauucuugcuugguagggucugccuuacguauguaguucacauuaauuuaugugagugcuaggcucucuucuguuugcugagugauugucaccuguuuuuccuuagagccugggcccuucugugcuggcuggaguggcugugaugauucucaugguacccuuaaaugcugugauggccaugaagaccaagaccuaccagguaggauguccaucuccaugagacuucauucugaguccuggccugggucuuuccaggugauggucacccagcuuccugaugcucaggccugagauggacagccugaucuauuauaggugccaugauacagggacacugcuucccugaguggcccagccuucaaauuucugcaacuuuuccaaagaacagcuauuggcagugccugccgcagacccucugggucucuuugucugcguggagucucuggggcagaugggcaaggaguuggugagugacagacagaccaacauucgagauuguguagaaucugaauguaaugucacaaaguaaacaccagucuuauauaguacagaaaauacaagggguagcaggcaaaguacauugaaguagccggacacaaaacaaaggaaugacuucaaaaggauuuacaggaaccagguaaauguuuacaguaaagauaaagcaguccugccuagggucagcuuagugacagguaaggauuucacacucuagugcuauaccuuugagccuugcgaaggcuagcaccaggggguucugcucuuagcaggccucaugaauaaugcaauaucacaaccccccuauuuccuaggccuugcuaaauucuuauaugaguguaacuuuuaaguaucuggagauucuccauuugucagaagauucaccaacuugcuucuaauaugcaaugcagccuggacugaagauuuuuaucucagugggauucccuggcucuuuuaugguauuaccuuguuugggcgggauuugcuacuauccuuaguaaauauuuugcagaccagcucugagcuacuggcucugucuuuuuuaaugcuuaauuaguuacugaacagguaacugaauaguuacugaauaggcuucugggaccuuggaacacuggggagacuuaacuauaacagaauuuaauguuagaaggcacuuauaauaaaauacuaaaagagagcucguaguuccauacaccagacuaacgugggaauaggguaugagcauauggguuaaugagaacgccaaagcuccaggaggugaguuuccuugaaauucuuuuccucgugagugcuuacagacuuuucagccugacaagcagacuugaccagagugccuggcaagugcccuagaguuggucugagcaggaaggcagagacucuaugguaguagcugggaaucaaccaaccaaccaaccaaccaaccaaccaaccaaccaacauccuucccucucucccucucuuccuguuauucauuuuucauauugcugugcuuucaagaguaaaauaaggggguguaucuggagcccaggugugcucaccaugagagaagaccuggguucuaccacuuccagcaaaauaaguagcaacuucaccuuuuuuuauuauguugguuacuuaauuuuuuaaauuauucauuuuuauuucaugugcauugguguuuugccugaguguauguuuauaugaagguguuaggucccugaagcuagaguuauaggcaguuacaagcugccaucuggguuccuggaauugaaccuugguccuuuggaagaacaaccagugcucuucacuggugagcugucucugcagcccucuauuggugacuuacuauguguuguguugacucuguauuuugagagacacuuuguuuuuuaaaaguguuuuaacacaguaagugcuuuucuaguauaacaauuuuaaacuacagaagaguguagguuugaaggaaugguguccuguguccuaccuucuuggccacugugaacacacuggaguggauucuucuaguaacuucucccucucccccucccccucccccuccccuuuuucucauaaccuauacuggacucaauuucagucuuccugccccaaacuaugaggauuacagucuugcaccaccauuuuaccuauagaacuuuucacagauaauaguuagcucuaacuaacuauauaauuagggcuuuauuuuuuuuuuaaguuuaaguuuuaaaaguucuuuuucucccuuucauugaaaaugaauuuuuuccccucacauaacacauccugauaugguuucuccuccuucuacuccuuccaauuccgucucaccgucucucccauuggauccacucucuuucugucucucauuagaaaauaaacaggcuucuaagggaauauaauauaacaaugaaagauaaaacaaaaacuaacauauugaaauugggaaaaacaaauagaaggaaaagagcccaagagaaggagucagaacuagagaccuacuuguccauguacuuaggaaucccauaaaagcaguaaaguggugacaucuuucaccauguguuucuguccagugggugucuaugccuggugcuuuuccuguaugaaucauggucucuucauagcccacauucuucaucuuccauguuucucugccccauuguuugguguuugcuauccuuggcugcacugaugggcccagguggccuggcugugauggggcgggggguggcuguguaggcugaugucauggagcaggccagccaacagguuugggauaugaaguaggcuucccugagugguuuaucuccaaaacuguccuuaucuguuuuguuuucagguuuaguuuaguuguguguggcucccugacacaggacggacgaugccacugacugccugagcagggaauggcuaugucugaagugcuuagaaaguugucugccaagggugaugagccagaugguuuuaaaguauuuaacaacuguaugucuuuguuguggcuugucaggaccagugcuaguugguuguuuuaaugaccagggaguggcuagaaaucaguuaugagaaaagaaaaauagcagauguggugauacacuuuugucagucucacacugaggaagcugaggcaugaggagcaaggguucaaggccagccugggcuucuagaguaaaacccucugaugaagagagagcuagaggagggaaggaucaggaggaagggagggaggaaaagaaggaaggaggagaaaaaugaagagagugccugcaaggcuuaucucaccuccaucccucaguuuugaguuggucucucaaucgaaaccaaccugauuugaagccuuuuaaacauuaauaauggcugaguuucuugccaugguccgagaacuggcauuauggcacaugggguucaggaccagcucugccaucuucugggaggagccuuuucuauuugaagaugucccuaggguucagaaugccggucuccccucccucugcagguggcacacaugaagagcaaagacaaccgaaucaagcugaugaacgagauccucaaugggaucaaaguccucaagcuguacgccugggagcuggccuuccaggacaaagucaugagcaucaggcaggaggagcucaaggugcugaagaaaucugccuacuuggcagcuguaggcacauucacgugggugugcacaccuuuccuggugaguaccacagugacaaauggcucuuaugucuucuuguguuuaucuaucuaucuaucuaucuaucuaucuaucuaucuaucuaucuaucuaccuaccuaucuaucuauuagauauuuucuuuauuuacauuucaaauguuaucccuuuuccugguuuccccuccgaaaacccccuaucuucuacccacuccuccugcucaccaacccacccauuccagcuuccuagcccuggcauuccccuacacuggggcauagagccuucacaggaccaagggccucuccucccauugaugaccgacaaggccauccucugcuacauauguggcaggagccauggguuccuccauguguacucuuugguugguaguuuaguugcugggagcucuggggguacugguugguucauacugauuguuccuccuauggagcugcaaaccccuucagcucauuggauacuuuuucuaguuccuccauuggggacccugugcucaguccaaagguuggcugugagcauccaccucuguauuugucaggcacugguagagccucucaggagacaacuauaugaggcuccugucagcaagcaguuguuggcauccacaauagugucuggguuugaugguuuuauaugggauggauccucaggugaggcagucucuggauggccuuucuuucagucucuacuccacacuuugucucuguaucuccucccauggauauuuuguucccccuucuaagaaggucuuaaguauccauacuuuguuuauccuucuucuugagcuucauguggucugugaauuauaucuuggguauuucugagcuauauaaguggcuaauauccacuuaucagugagugcauaucauguguguucuuuugugauuggguuaccucacucaggaugauauuuucuaguuucauccauuugccuagggauuucaugaaguaauuguuuuuaauagccgaguaguacuccauuguguaaauguacuauauuuucuguauccauuccucuguugagggacaucuggguucuuuccagcuucuggcuauuauaaauaaugcugcuaugaacauaauggagcauguguccuuguuauauguuggagcaucuuuugguuauaugcucaggaaugguauugcuggguccucagguaguacuauguccaauuuucugaguaacugccaaacugauuuacagagugguuguacaagcuugcaaucccaccaacaauggagaaguguuccucuuucuccacauccuugccagcaucugcugucaccugaguuuuugaucuuagccauucugauugguaggagguggaaucucaggauuguuuugauuugcauuucccugaugacuaaggauguugaacauuucuuuaggugcuucuuagccauuggguauucuucaguugagaauucuuuguuuaguucuguaccccauguuuaaaaaggguuauuucguucucuggagucuucuuuuuuuuuuuuuuuuuuccuggagacaggguuucucuguauagcccuggcuguccuggaacucacuuuguagaccaggcuggccucgaacucagaaaucugccugucucugccucccaaguguugggauuaaaggcguguaccaccaccgccuggcugagucuuaacuccuuaaguucuuuguauauauuggauauuagcccuauauugaauguaggguugguaaagaucuuuucccaaucuguugguugcuguuuuguucuauugacaguguccuuugucuuagagaagcuguguaauuucaugaggucccauuuguugguucuugaucuuagagccuguguucuguucaggaaaaauuucccuguguccaugagcuugaggcccacuuucuuuucuaugaguuucuguguaucugguuuuauguggagguccuugauccacuuggacuugagcuuuguacaaggagauaagaauggauugauuugcauucuucugcaugcugaccacuaguugaaccaguaccauuuguuaaaaauguucuuuuuccacuggaugguuuuggcucccuuuucaaagaucaagugaccauagguguguggguucauuucugggucuucaguucuauuccauugaucuaccugccugucacuguaccaguaucaugcaauuuuaccaauauuguucuguaguacagcuugaaguccaggaugcugauuuucucagaaguucuuuuauuguugagaaugguuuucgcuauccugggauuuuuguuauuccagaugaauuugagaauugcucuuucuaacucuaugaagaauugaguugggauuuugaugggaauugcauugaaucuguagauugcuuuuggcaagauggccauuuuuacuauauuaauccugccaauccaugagcaugggagaucuuuccaucuucuuuuucgaggucuuuuucgauuucuuucuucagagacuugaaguucuuaacauacagaucuuucauguguuugguuagagucacacgaagauacuuuauauuguuugugacuauugugaaggauguuuguuucccucauuucuuuucgcacucuguuuauccuuugaguauaacaaggguacugauuuguuugaauuaauuuuauauccugucacuuugcugaaguuaauugguuuaggaguucucugguagaauuuuuggggucacuuaaguauacuaucauaucaucugcaaauagugauauuuugacuucuucuuuuccaauuuguauccuuuugaccuccuuuuguugucuaauugcucuagcuagaacuucaaguacuauauugaauagauagggagagagaauacagccuugucuauuccaugauuuuagugaaauugcuucaaguuccacuccauuuaguuugauguuggauacugguuuacucuauauugcuuuuacuguguuuaguuaugagcccugaauuccuaauguuuccaagacaugaagugauguugaauuuugucaaaugcuuuuucagcaucuaaugaaaugauccuauuuuuuuuuugaguuuguuuauguaguggauuacauuaauagauuucuguauauugaaccaucccugcaucccugggauaaagccuacuagaucuuggugaaugaucguucugauuuguucuuggauuccguuugugagaauuuuauugaguauuuuuacauugauauucaugagggaaauuggucugaaauucucuuucuauguugggucuuugugagguuuugguauuagcauaacuguggcuucauuucugaguuuguuaauuuggauacuaucucugcccuuugguuagucuggccaaggguuuauguaucuuguugauuuucuccaagaaccagcuccugguuguugguucuuuguauaguucuuuuuguuugcacgugguugauuucagccgaguuugauuauuuccugcaguuuacuccucuuccaucuuuuuguucuagagcuuucaagugugcuguuaagcugcuauuguaugcucucuccaguuuguuuggagacacucagagcuaugaguuuugcuguuaggacugcugucauuguaucacauuaguuugaguauguuguaccuucauuuucauuaaauucugaaaagucuuuacuuuuuuaauuucuuacuugaccaagcuaucauugaguagaccauuguucagauuccauguauaugugggcuuuuugcugguuuuguuucuauugaagacgagcuuuaauccauagugaucugauaggaggcaugggauuauuucaaucuucuuauaucuguugaggucuguuuugugacugauuauaugguuaauuuuggagaagguaccaugaggugcugagaagaaggcauauucuuuugauuuaggaugaaauguucuauagauaucuguuaaauccauuugauacaaaacuucacugugucccuguuuaguuuguguuuccaugaucuguccauugaugagagugggguguugaagucucccacuacuauugugugggaugcaaugugugcuuugagcuuuaguagaguuucuuuuaugaaugugggugcccuuguauuuggagcauagauguucacaacugagaguucuucucaguagauuuuucuuuugaugaguacgaaguguccuuccuuaaccuuguugauaaauuuugguugaaagucaauuuuauucgauauuugaauggcuacuccagcuuauuucuugggacuauuugcuuagaaaauuguuuuccaguccuuuacucugugguagugucugucuuugacacugaggugcauuuccucugcagcaaaaugcuggguccuguuacguacccagucucuuagucuaugucuuuuugucuuuuuuauuggggaauugaguccauugauauuaagagauauuaaggaauagugaauguuacuuccuguuauccccccccccuuuuaaaaaaauuuuauuguuuuugguuuuuugagacaggguuucucuauauagcccuggcucucccggaacucacuuuguagaccaggcuggccucaaacucagaaauccgccugccucuaccucccaagugcugggauuaaaggcgugcaccaccacugcccggcuacuuccuguuauuuuugauguuauuuuuauguuuuuguggcuaucuucuuuugaguuuguugaaagaagauuacuuucuugcuuuuucuaggguguaguuucccuccuuguguuggaguuuuccaucugugauccuuugcagggcuggauuugugggaagauauuguguaaaugugguuuugucauggaauaucuuguuuucucuaucuaugguaguugagaguuuugcugcuggguauaguagccuggguagcauuugugcuaucuuagugucuauaugacaucugcccaucaucuucuagcuuucauagucucuagugagaagucugguguaauucugauagguuugccuuuauuuuacuugaccuuuuucucuuacugcuuuuaauauucuuucuuuguuuugugcaucuugugguugguuuuuaugugacaggaggaauuucauuucugguccuaucaauuuggaguuuuguaggcuucuuauauguucaugggcaucucuuucuuuagguucaggaaguuuucuucuacaauuuuguugaagauauuuucuggccuuuuaaguuuggaaucuucacucucuuccauaccuauuauccuuagguuuggucuucccauuguguccuggauuucuuggauguuucggguuaggaacauuuugcauuuuucauuuucucugacuguuguuucaauguuuucuaugguaucuucugccccugagauucucucuucuaucucguguauucuguuggugaggcuugcaucuaugauuccugaucuauuuccuagguuuucuaucuccaguguugucucccuuugugauuccuuaauuguuucaauuuccauuuuuagauccuggaugguuauguucaauuccuucaccugcuuuguuguguuuuccugcaauccuuuaagugauuuuuguguucucucuuuaaggucuucuucuuguuuaccuguguucucuuguauuucuuuaagggaguuauuuauguucuucuuaaaguccucuaucaucaucaugagauguuauuuuaaauuacagucuugcuuuucugguguguaacuuggguucccuuggugggagaacuggguucugaugaugccaaguagccuuggugucuguuccuuguguucuugcacuuggcuuuugcuaugugguuaucucugguguuagcuggucuugcuuucucugacuguggcuuuugugcucaguuuacaagccugugugucaguacuccugggagaccaguucucuccaggaggaauuuaguuauggagagcuacaguacagggucagcucuggggugcagguggaaaccagaaggauccuguccccagcuguuccuugguucuuguguccugauggcucugggagguuccuucuugggccaggaauuugaagagaaaugguggucuuaccugugcuugcagguguguaggcacuccugggagaccugcucuuuccuguugcuauuuuuguauauagcucuguggcacaggaucagcucugggugcagagggaaacugguccccuggugcuccucaauuccuguguccugacaguucugcgaugguuccucugagcagcaguggugguccuaucuggacuuacaggccugucugcacucgugggaggcuugcucucuuguggcaccaccuggguauggagcccuguggcagaggaccugcuccaggcacaagcagaaacgggaagguuccugucccaggcagcuucuuggcuccuguguccugaggguuccgggucaguuccucugagcagcggugguggucccacucaaaggcugucuucacuccuuggaggcuagcucuccucuggcgcuguuuggguuuggagcccuguggcagaggaucagcuccaggugcagacagaaacuugaagucuccggugucaauguuuucugugguauguucugcaccugugauucucucuugcauuucuuguauucuguugguuaugcuugcaucuaugacucuugaucucuuuccuaguuuuuccaucucuagaguugucuuuugugauuucuuuauuguuucuguuucuauuuuagauccuggauggucauguucaauucuuucaccuguuugguuguguuuuccugcaguucuuuaagggauuucuuuaaggucuucuuccuguuuaccuguguucuccuguauuucuuuaagggaguuauuuauggucuucuuaaaauccucuaucauuaucaugagauaugauuuuaaaucagagucuugcuuuucuggugugcugggguauccaggacuugcuguggugggagaacuggguucugaugaugccaaguagccuuguuuuuuguugcuuauguuuuuuguugccuuuugcuaucugguuaucucucaugaugguuggucuugcugucucugguuggagcuugucucuccuguggaccuguaagccuaugucuguacuccugggggaacagcccaagcuaccggugcagauggggacuggaaggauccugucccuuuugcuccgcuguucuuguccccugugugcuccucgcugguccugcccuggacaguuacuggagaaaaaguggcuaucucaccuccgugcuugggugugagaccauuccugggagaccaugucucuccuggcagagcuuguguacagagcgcuguggaacagcccaagcucuaggugcaaauguugacuggaaggauccuguuccagcugcuccacugucccugugcccugcacaauccuggcuggcccugcuccuuacgguuauuagagagaaauuaggagaucucaccucuugacccaggagugauaccacucucuccuggcaggauuugugcuuagaggcuguggaauagccucagcuccuggguacagacagccucacugaaguuucauauagcgguucagagcuugccugaacuccccuuacagcagccagcaguagcacacagagcuugacacaccaaccacuccagucuccucagcuacaacauugaaccaguaguccuucuuguguuuuuaaccuaaauauuuauaaaauuuaaaaaucaaacuucuguguuuuugugcauguguguagggaagaugagugcuguagcaugcauauagaggcuagaggacaaccagaauucucuccuuccacgugugcacuccagggccugaacucagcuugucagucuuggcaacaagugccuuugccauugagccagaaccuaacccuuuuccaaaggcugcuaguuuggugcuaggguuuagcucaggagcaaagcauuuguuaagguaugauauccuggguucuguccuugucaccaugaagcuaaaagauugccauuugagcaaggucuucuucaucaccccucucuaagacugaugccuucaucccucuuuaauugcacccuuggcaguuccccgaggcugguccagcuagccaucuguuacagaaugcaaaccugugcuaucagcuuucuucauugagaaagucuuacaggaaagggcuaggguggggugaugauucuguagugaaggacucacguuacaagaacgaagaccaacguuugaucuuuagcacccauguuaaacaauagagccaggaguaguggugaggcagagaaaggcagauucauugccucccuggccagccagucuagucuagcugaguuccaaggccagugacagauccuguuucaagaaaccaagguggacagugccuaaaaaauggccucuacauguacucacauacacgugcacauaaacaugucuaaguauaaacaauauuaucugaacuaaacugcuuauuugauaccauaacugauagacuccagggaaccagugacuucuucauacuaacugauugcaagcuauggcuugucaguagccuaagaccauguguccacuagcacuguucuaaaauuaguuuucuuuacugccuguguuugaaaugccaucucugggagggagucuguggacagugugucccuguuccucagagggacuaaaggcuaucacuuaguacccugcuguucacaguaacaaucagaucacauaggaaguucuaaaguguggaugcauggugucccugacaucuuugcuaugacaaguccuuugcuucaaugagaucguggugugcaucuuuagaaaacagugucuaaggguauacauauuuaaaaauaccuuuaugagggcuggagagaugacacagcacuuauaaacacuugaugaacaguucuuccagaggacugaauuuaguccccauacccaaagugggcugcugacagccgucuggagcuccagggcaugugauguccucuguaucccuguggacacucacaugugugccacaugcacagagauacacacagauaaauaaaaauaagacaaaucuuucaaagaguuucauguauucuaguagaauuauacuacucaaugcucaagacccuggguuugauuacaacucucaaaaaagugucuucugacaugggcaagucacccauccuuccguacccugucagcugccucuuucucaggguccacacuuuucucagacacagaagcaccuugcauuucauucucuuuacuuugacauagugauuggaggcacugcagaagucuucauuguugaggauuagguguguggcgaaugggggugugugacaagguuuaccugagcaauguuccacgcuuuagaacuuccuaugugaucugguuguuaugaacagcaggguacuaagugauagccauggccccucugaggaacagggacaggcuguccacagacucccuccuagagcugacaucucagacauaggcaauaauuacaaaacuguaauuuuagaauguaugcggcaguaccacuggacacauggucuuaggccacugacgaugggccugaaauacuuuuuaauaaaacguucuaggcuguuaauaaacaugcuggccuucaaagaucuuuuuuccuugccuccauuccaaagccagaaaguacuggagagaaggauucuggaccugccuucaaaccugccccuugguuucugacugaguuggguauaugauacguuuuuaauugccgugacaaaaaucucggacagaggcaacuuaauggaggaggucuugacuuugaucacagaugcuagucuacuaugguuccuaggauaguguugcuugugcggcacacugagagcuuucagcauggcucucguccaucuugguggauccggaagcaaggccaggcuaagcuggaaagcuuacccuugaagccaguauagcuagcuaagccuggugucccaaaggcuccaugucuacaugguaccauuuguaaaacggggcuccuaacacaugagccuguggagggguuucacccugaaaccacaguagcagcaaaggcugaaaaugcugggcucccaggagucugcugagccuuuuggcaagaaacaguuggagccaguugucagcggggaccugggugcugccaaagugcccagucucugccuacauuaggagaaaauauguggucugugcuauggagccuuccgcuggcagguuccuggcuucaaggaugggugauagccaccuauagugauagaagacagguguggcguacagagaugccuugccucuuguucugggguuagagccuagggucugucacucgguguuauuuucuaagccaguguuuuggauauucucuggugaucuguaagcugcuugccucuuauuuggccuggauuccucuguaaaguaguuuccagccacuggaguaaugcugcuauguggcacucuauugaucagaguuuggcaugcagaucagcagggacuuagcauacugauaucuacaugguaccuguguauaggugggcgaaugagugacucccaaaaccuaguaguucagcuaacagauagauguuaugugaccacuuccuggagaacauaagauucagagccugacagggagacugagagcaaacaugacuggaaaaagagucagacuggugguagaacaacuucuguaaauccaguaggcccugugcugaccaagacuguggcuuuuauauuagagcucguuggcuuuagauaguuguuuucuucuucuucuucuucuucuucuucuucuucuucuucuucuucuucuucuucuucuucuucucucucucucucucucucucucucucucucucucucucucucucucucucucuguguguguguaugugagagagcgagagcgagcacacuaugcauggugcauauguggaggucagaggacagccugugggcguagguucugugcuuucacaugaguuuucagggauggaacuuggguuuuuaggcuugguggaaagugcgugccuuugccugccgaguccccuugcgggccccucuccccucuccaagcuuuucauauuugagauguagcuccacgugagcauauagugucucaguuucucuaguagaucugagcaugcucagcaaggguuuccauuacccacuaggagaccucauacauguuacaaguuacuucuguucucucauuccacugauucugguacccaucagugugcuuccugccugucgauuggccuguugggagcauuuagugcaacagaauaaaguacguuggcauuuuguuucugucacuuaugaugacacuuuuuguuucauucaaguaauaguguguauaagaaugccauucuugccgggcggugguggcacaugccuuuaaucccagcacuugggaggcagaggcagguggauuucugaguuggaggccagccuggucuacauagugaguucuaggacagccaucgaaacccuguuucgaaaaucaaaaaaaaaagaaaaaaaaaagaaugccauuccuuuuuauaguggaguaguuaauauuccauuguguggaaucuuuuuagaggauuuugagcccauacuuuuucaugagaaaaagagguaggaagagguugauaggucagugugaaauuacuguuagaaggaagcacagugccaacaggugaaacagauacuucugggccauuuggaaaagcuacaacaaaagaauguggguuuuuaaaaaaaauauuuauuuauuuuacacaccauaucuuuucuucccucuuguccaaccuggccucccuccugcccccauccacccuccuacugcuccauggagggauggugugggacccgaguucaugugucaauguaucacauaguacaucauuaaucuguacuguuuuuaaugugugaguuaagaaauaaauuuuaaucaguaucccuauacuggcacacaccucagcacucaggaggcagaggcuagccugcucuauauagugaguuccaggacagccagggcuacauaguaggcacaugucuaaaaaaaguuuaaaaaaaaaaaaaaaaagaaagaauaaucuacgaggcuaauguuccaggcuucuugaaagagcuaccaucugggacuguucauaugauagcguguugaugggcuuuggagcaccgccucccuccuugaauaauuuuucucaaaguuccuuggguuugcuggcuggcuaguggcagguauagcagaaaacaggucuccuugcugguugcaucagacccaggcuuccaggaagauauaauccuuggcagcauggcucaggggaacugggcaaguguguaagguggaauaaacucagccucuugggugaugcaguagaauuugcacccagcacuuggcuugguuguaccucauaggugugucaacucuauauggggagcagagcccauacucagccacagaacugauguguucugagugaauagguucugguuuuauagcccacugccuucuagaagugauugaaauggcauugaugugcaugacugcuugugcaugacugcuuguguaugacugcuucugcuuggguuuuguccaggggaaagccuuugguggcuccaggaucagggcuugucaucuguccuauauauaugguuuucuggauugcuuaucccauuuguguuccagaggaccgaccccccccacacacccccccaaggggcccuguggcugcccacuagauuacaccagggaggcucccaucucagaauuagaggagggaugugcagacccaccaaucugucaugugccaugugauauggggacuuucuggcuuuuguuuuguuuuugagacugagucucucauagcccagacuggccuugaauucccucuguaggaaugacuuggcauuucugauccuccugguuccuccucuccaguguugggacuacagacauucaccaccguaccugccucauguacuacugggggugagcucagagcuucauguaugcgaggagagcccuccaccaauugagcuguauuuuuguacguuugggaguggaccccagcguuaccugcauaccaagaauacuuacauaguggccagguguuugaaaagcugaucauccaucuuucugguccauucuuuacgaugcaggaguccugcuucuguaccugccccugccccuuuccuaucucccuugggcuuuugccauuuucaacccuguagaggggguuugucuugauugaauccucaccccuuccagggguggugcagcuguggcuccuccaccauucaacacuuugcucuguuugcagguggcccugucaaccuuugcugucuuugugacuguggaugagagaaauauccuagaugcaaagaaagccuuugugucccuagcccuguucaauaucuugcgcuucccacucaacauccugcccaugguuaucagcagcauugugcagguguguaucagacagagggggccaagaggguaccauaggggcucucagaauccuaccacggucagcagcagcauccugcaggggugugggggacagugggaaccaggauuggaugugggagcuguugucauuuucucauggucauuagcaacauuguauaggcauguggguggcaaggaagcaggaggggacaugugcacuccagcccauggaauccacagauuucucagugccauuuggacccaagcugccccacugguuuauuugugcagccuugaccaugcuuuuccaaauugcucaugcugcuguguccuagagaacucaguagagcccuaugcguggauccacuuacuggauccacuaccccagcauggcuccucucucagcaguaagggcucacuugauucuacucugagaaagaaacacauuuuccuucuuggcacagaaugucuggcuuuguagccaagguuggccuaaaacuccagcccagaugggagauacggacuucacagcaauacuucccuuuuaaucucaaagaaucuuucuggaauauucuauguuccucuggccucucuaagcugguguuuugaaaaacacagaucuuggccuacuuuuucaauuucauauuuugcugauggguccugaugugcuuguugaaaacugaggaccucucuccaucccuccuuccuacuuucauucuuucucuacugaaggaauuuuuuuuuaagcuaacccagacccuuugcccauauguacugcugcauguauugucguuccauaauuaggacccagaacccaguaauuuguugaggucaaacucagucugccagugcagagguggcuaccuuccaaaucccauuguaggaggaagccccuaccuuucauguagugauuccuguggacaucgaguuuuauucuaaggcugcaccaggcucaguguggcagguggcccagaugcuauccaggugacacacccugugcuucuuccccaggccagcgugucccucaagcgucucaggauuuuucugucucaugaggagcuggagccagacagcauugagcggaggucgaucaagaguggugggugccugucuucugcccacuuuggcuccuuauccuguccuccccagagcuugacucugcccagcuugccuaaaagacccagggucccaccucugcagagagggcagaaaugggguucccgauuuuuguuguucccuccaugcuccugcagugugagugacacuuugggcuuuucagcccaggccuugguucugcccuggugggggaucgcccaguuucuguuccugccuaauuccgagcacucagcuucauuuuucucaucuggaucaugggaguaaaagugccuuuaauugaauuguuuuuaauugauugaucgauaauuuacuguuggggauugaacacaggacuucacauagcuagguaagugcucuacuccugagcuacagccucggcucacauuuuacuuuuugagacauggucuauguugcucaggcuggucaaacuuggggucuucagucuccuaaauaacugggaguucagggcugugcuaccaggccuagccagccauccuauggauuuuuaucacuggguuuauuucuuagacuaguugauccuucugacuggccccugagcuggggucuuguaugggagucuaggcaguuugccgucacuguuauuggcaccaggagaguuaagccuuuucuggcauggguguuuaguuaaaauacgaccacuguaucaugacccuuggagcaggaucagggucaacaaacuugccugagguccccagaagggaaguucuugacuaagauuucuugaucaccugcucuccugccagccuuuguucucaggccucugugugcaugugcuuccuacuguaguggucuagugugguagcuccaggacagucuuggcucacaggagggaagagauccagagagacuguccagcugggaagugguaguccuggggcucaaaccgacaccuuuuggcucagagcccagaaaacagaauugaugacaguaccuggcuauuggugaugaggugccaauguauguaguaccaggagucuugugggccguuguagggugugaguggugacgugcgagucacaggucugcuguucugugaggguaguagcugcucuccgccgcccuuaccagguuaucacacuggcgccccuugggguucacaguccuuguugaggacagcuuuaugacuguggguggugaguagugccccuggcaucucccuaugucucauaguagucaucccauugugacaauaaaaaugaucuuuaggaacuuucaaguguccacuaggaggacaguuguuccuuucugagaacuacagcccaagcaaaugcugggacuguuuuccaugguuuucuguuguccaugguuugcuggucuguaugggaccagcaaaguagacuccagacccagagcuccuacggccaagcuguacacaguucucugcaagugccacugagccacugguccugagcagugcuucuguugcugaaguguguaaccacuuugcagcccggccugucauguuccccuaaagcucaggcugcugccgcucacccguggacugcagcagcuuccggccaguucuuuggagugacaugccuagcuuccucuuuugugaggauacaggcucugcuuagcgugcaccuugguuugaaccuuaccacagugagaaacaagccuuuuccuccugggggagcugugguuaauuucauuuagcuacuaaccuccuugcuauggccuaucacucucugaaaguguuucuggcagcuaauuaagggacuuaaaaauuagaggcagaagcaaaagugcagccaggggagagaaauggaggcggguagcauccucaggaaucugggccuuguaaugugggcacuggccaaaugccuccccucccccaccuuucugcagcacguccuguuuccuaguagccuuccaguggaugcugguugauugucauggaagcaauagaaacauugaucugcuaggagggagguaggcaggguggaguggcuaagggaggggagcaggaagggaagaugucuuaggauccaagagcugagggaaaagacccugguggagagagguuuccaugaggcugcaacuuuuucuccuugaccuuggcucauacucagccuuuccagccugagaaaugggaagguguccccaagcacugagugaccagcgagguucuucagccucaguagugggccagaguagggcaucugcacauggugcaccuguugacuccugacauguugucccuuauguuuuccaggcgaagggaauagcaucacugugaagaaugcaaccuucacuugggccaggggugaaccucccacacugaauggguaagccugggaggugggcacacugacacuggcucuaaauacucuucaccucugugaccccaacuuuugccuuucugagccucaguuuacccaucuggaauaagguccagucacaacugcuuagguuguugugaggagcagcucagaaggugcuugguauaggugucccuucugauugugacaggaagucauguuccugggccacaaggggaguuugggguuuggggcagugagaaagucuguuuucagguaaagcaugacccagggucucaggggccuguagagcucugcugucacugggacuggacuggugccaaucuccuuaaggaauccaaaacacaaggccaguggaaccuuuuuggaaccacauuuguuaugugugccccuaagcaguugacauggcaacuugccugcuguauuuuaucaggcacaguacagacuguucagagaaaggagucucucccuuucugcuuccacuaacuacucagaguguaaaggccuuucuuagggcuaacuuaaauccugccuccuuuauuuguaaugcuuuucucuuuccugugccaauacuccacugcccacaucuuucuggcaucaggauuccugguccuuugauuugccacuuugaaucuccagucuuuucuguuuauccuuugacuccccuuagccuauaagaauaucuuggauauucuuauaucccuagaagaagggaggaacugcuucccuggguguucugcguaggguggucccauggcauugcuccucacaaaugcagcacaaaagacucaacagcaaugaguguuucaggggcuagcgaggggacucaauaauuaaagauccgaaugugguccuuagaaucccugugacaaaagcuaggcauggugacaccguguaaucccagcauuggggaaacagaaacaggaagauuccuggggcucaguagccuguuaggugaguucuaggccagugacagaccuugucuuaaaaaaaaaaaaaaagauggaugguaccugagaaaugacaccugaguuuucucucuaccuugcacuccuaugugcauacacagaagaaucaaacaguugauccauauaguuagccagcuuugaaaccaguacccaaggaagggaccuugcuugcgagccugggaugcccauguggcuggcuggucugggcacggagaccaguguucugagcugucagcugcagaagcagcaguguuacaagccacugaugacaagccacuguggcuguagagccuacagcucuauuucuucuucuucuucuucuucuucuucuucuucuucuucuucuucuucuucuucuucuucuucuucuucuucuccuucuccuucuccuucuccuucuccuucuccuucuccuucuccuucuccuucuccuucuccuucuccuucuccuucuccuucuccuucuccuucuccuucuccuuccuucuuucuuccuucuuucuuccuucuuucuuccuucuuucuuccuucuuucuuccuucuuucuuucuucuuucuuucuucuuucuuucuucuuucuuucuucuuucuuucuucuuucuuucuucuuucuuucuucuuucuuucuucuuucuuucuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuucuuccuucuuucuucuucuucuucuucuuccuucuucuucuucuuucuucuucuuccuucuucuuccuucuuccuccuucuuucuucuucuuucuucuucuuuuucuccuuccuccuucuuccuccuucuuccuccuuccuucuuccuuccuucuuccuuccuccuccuccuccuccuccuccuccuccuccuccuccuccuccuccuccuccuccuucuucuucuucuucuucuucuucuucuucuucuucuucuucuucuucuuucuucuucuuuccuccuccuccuccuccuccuucuucuuuucuucuucuucuucuuuucuucuucuuccuuuauuuuuuuugagauagagccuuacuguuccauguugacuagcuuguaacucaugcagaccaugcuggccucgaacuuacacagauccaccagccucugucaccugucuccuaaguggugagauugaaggugugcaccagcacuucuguucguuagcaggccauugcaaagcugagcauggugguguacaccuguaaucucagcauuugggaugcagaggcaggaggagcgggagugguggaucaaucuugcuuacauagugaguuggcagcuagcaugggcuauugugagaccuuaccugggauggggguggaagguucuggggagauggcuuagucaauagagugauugcugugcaagaagaggaucuggauguaguaguaugugcuucagauccguggaacuuacugccuaaccauccugguauauuugaaaaacucuagguuaguauagaccuugucucaagaaaacuacaaggcagacagacccugaggauuaguguugaccucuggccaccccaaguauacacacauguacacaaacauaaagacaacaguugauaaggccauucuggaacucagcucuggucucucugcgcagccccucaguguuuugaaucuuuuuccagaccuggccuguuacccuggucuucugucuucugaauuuucucagccaaguugucacuggggacaaaguguuguggugucagauaggcgaauacccucuaucaguucucuugggugacauguagcaagccccugggcucuguguugccugggcuuuguaauacauuuacauugggccccugaggccauggcccuccuugccccacacucuuggaggucuucagguguugaccagcacacccuuggcagggaggguauaggacauuguguuauuucaggcuccucauuguguccuugcagcaucaccuucuccauuccugaaggagcccuuguggccguggugggccagguaggcugcgggaagucaucucugcugucagcccugcuggcugagauggacaagguggagggacaugugacucucaagguaggauggggaccaggauggggagagauggucugggaggaaggcucagcccagugucucuuacaaacugucaaaagaagcagccaucucggcucaucuaggaaagcaagguuucagugacagccacuucuuucuuugcucagugccuuggccagugugacaugugauagcugcucagucaacaggccgugaaugcuuagauguacugccgaggagugcuuguucauggcucuugccuuccuucugaauuuguuuuauuucacuucacaugaucuccagccccaaccauuuuccuguuuuccuggcugaauaauacacgagggugugugugugugugugcgugugcgugugcgugugcguguguugaaagcagaaagggcuguuugagggaggaagaaaccaagaaagggagaggcacaauggugaauaugaccaaaauacaaugauguaucugccugaaaaugucggacagagggaaggagggguaaagacucuggaggaucucccagcauccugucagggaaggcucccccaacccccgcucucacuucauccuguggucucuggauagaaccuucuggcuucuucuuucuuuugaaucuuguaaauagggcauaacuucaguacugauugauguggcuggaauaaucucagaaccugguguaagaaacacauuuuaaaucuuuaguguuacuugaauucuuaauacgggccuggagggaaagcguguggcuuuagcaauucaaggcccagcaugcucugagcugagcuaaacuuucugugaguugacggcugcugugaaaaugagucucuugggacuuuucuacaagugcuuuauucccuuggaggccuuugccugcuauguaaauaagauccagaguaucaccagcagccucuggagcagcuggggauaaaaaaacacaauacaaccccagcuauuuugcuugagccagcuugugccagauguguuugccuguaccugccugucaucugcauccccuuccccugagaacucgaguguggggauguggucuuacgucacuguuugauuucaauccagaucuuccccuugcugguucagugcucuuuggaaguaagugagcagcaucuggguccaggcagauagcugcugcuucuggaugugcucgcuuguuucuuccaacaugcccaagguugacaaagggaaauuguuugucauuagauccaugcugcagucuguuucauaguuccuggguuccugccaucccaggcacuggugcccuguguccaagaacuauuuauagcuggugauuucagaaaguauauugaaaguguuaguuuuccccagugucuugguagacauggccuauggcugaguauuuuuugagcuguacaauugagggguccugacacuugaggcucauagaaacuggaauguuuaaauagcaauuuggucuuuuuuuuuucugagauuuuagauacagauuuaggucauugauuucuauuccuguaguuuagaauccuuugugacuuucuaucaccuuuuuuuuuuuugauaaaggugggcaugacacuagccaugugugaacuaaucccugacaccugcuuuccugcuguccugcugucccaugaguuguccuugaccagucaagcuggccuuucugucccuuaaaggaguuggauucuuuuguuccuugucuguuguuccaguggaucagugcccuccuuucuucuuauccuggcuguguguguuuugggaaguugguucuuuucacaggcaggugucugcuguugucuuuuuaucaagucugucugucuuuuccacugccugccacacagggcuccguggccuacgugccccagcaggccuggauucagaaugacucucuccgagagaacauacuguuugggcacccccugcaggaaaauuacuacaaggcaguuauggaagccugugcccuucuuccagauuuggaaauccugcccaguggggaccgcacagagaucggugagaaggugagugugacauggguacagcuggcagcaucagcugcugcugugugacaaacuuuguugggaccgccugugaguggauugucagggaccugcugucucuagccuguggcuaagcuccuuuugccaugcuauguaagucuggccaggguauccaccauauggcucuuggugcuguggucuuaguugaggugucagucgccaucuaagugggagccucucacguggugauguagaguaagagaauaaaagccaaagguaugcugugcuuugccacauacugugccacccgcaggacaagacaaggucacaguguaccuaggggaugugcauacgagugaugauggggacugaugauggggacggcucuagacuagcugguacccacuucucucugcugccauacuaacauuuuuaaccuaagucaucugcaugguagcucaugagagggguuugcucugaucccuaaugcacugcugaggaaagggaggcucagggaggccagcagacuugccugaugccgagucccagggaaagagauucuuaagucccuccuguccccuguucugcugccacuuuggaagagggacgagacucccagcccauuugcuguggggcaagugauugucuugugugugugcuggaagugcagccaccuccagugucagggaccucuugggagagcugaguuugucuguuccuagucuccagccaaggaucuucuccccagcuugcuuauuugaugcauggugucuuuacuuggcauggaccuggagauccuuuggguugccuaggacccuuguuuaaauagguuggaggugccaagcaaaccgaagggucuaaguauuaugugggauccaaggcaggauugccagggucuucgaaacaggcuggggguugguuggcagccugcuuaucagccuuucccguuuuguuaaugcugggaucucgcacuuggagauaccugacuguccccuucuagucucagugccagaguuugaagggagucaaggguugacugauuuugucuacuucaguucaauaugcagggacuaaagggaucuucuuuaacugggccuaucaucccagaaugcaggaagcugaggcaggagaauagguaaccagcaagaucccaucucaaaauaacauacuaaaaauggauagcaauguggcuuaaugguagaauacuuguuuaguaugggcaaaggccccgagccccaucccuagcucugccuauauaugugucuauguauaucauauguauauguauaucauauguauauguauauuauauguauauguauauguauauaugggagcuggcuacuaggaucagucuuggcacagauugggucaguuuacucaguaggugucacugggcauuugagcuguacauggccacaguguuggucccucauuguuggaaguugguugcugcugcucagugcugaacccuuccucugugagugaagugcccugggugccgccagcuucacucugugacuuuaauaggaaugguagcucauggugaagcucaccacagaacacuuaacagcaacaguaggugugucagcuacugccuaauaauauaauagguauacaaauaauacuaucuuugucauccacacugugucuucuauagacucuucuauaggcugaugaguuuuaagauaccauuagcugccgcuuccuccucuuucuguggcacuacagaccccgggacaggcugggcucauguucuguaacugagcugcacccgcagcccuucuuuuacuuuucaguugagauguugcccaggcucacuuugaacuugccgucuuccugccuccucaggcucugagcagcuggacugauagacgugccagcaggccugacugucuacuucccuccccugaguaugugcugggggccaggugccccagucagcagcucuucuguccccauucuuguuuuguaugguucugggguccuggggaucccaagaaacccacucuucccacugucuuccuagggugugaaccugucagggggccagaagcagcgugugagccuggcccgggcuguguacucuaacucugacaucuaccucuuugaugacccccucucggcuguggaugcacauguugggaagcacaucuuugagaaggugguuggucccaugggccuacugaagaacaagguauucucccagggccaggacuucaguugauugacaguguggccuuggacaagucuuugauccuugggcuugcuuucaugcguccucuguguguguguguguguguguguguguguguguguguguguguguuagcccagcacugaggaggcugagauggaagaguuaggcuagccuggccuauacagcaagaacuuaccuuaaaagacaagggcuugggaugcagccuugugguagggugccugccuagugugcagaggcuuugaauuuaguccccaguacugcaaacacacaaugggcucuaaugcagguagugugguggccuuacuauccccucguccacacucuugguaguuucugucucccucuuagagguuccuccccaaauagucuucucaacucugcauuagcauucucucuacacugucuuccccuaucccaauacuacuuccaugccugugguucauuuugucuuuaucccuggagaccaggcaggccucugcucucuuuguccccugcugcuccugccugauacaggguggguccuguggagagagugagagaggguguggggggugggguggggggaagggagggagagaggaggagggagagagggaauauaugaaugggugugcgugugcccacagccuuuggaccugaaccaugcccugagauacuccuaaucucaacggugcugugacagugucuccuccauggugcugauggggccaggucuauguuuuacccauagacacggauccuggucacccaugguaucagcuaccugccccaaguggaugucaucauugucaugaguggcggcaagaucucagagauggguucuuaucaggagcugcuagaccgggauggggccuucgcugaguuccugcgcaccuaugccaacgcugagcaggaccuggccucggaggaugacaguaagaauggcagggaacuacaggagcuggcucugaucaucauagcugcuuaugggagggucuuaccugggcucuaggggugcaauucaugaggguauuggguaggagcacauugggcuucuggagaccaauaggucaguuuaaccuugcaggucagguagagaggguucucggcacuuggcacccagguucacagggucagguuuugguuuuaugaccucaagaugagucuccauucuuacugugaaguacuuucucuugugggcuuuugguucuucaguggcuaaaauguggauaaaaauauauuuugucuauucguaagagggcugaguacuagugacagccaugguguagcuuaggaugcacgaggcucacaggagauggccuaaugcggagugugaacgcucauggugggcauguucuucagagcuuuguggccuggagcccuuccuuuagacugucugacccgugucugucucuacccucaccucuacccacauagaacaaugugacagcagggcuaccuggcaugugcuggccauuaguguagucuugggcaucugggauguccugaguguuugauagccauagcuguacugccccuuugacacagaacaccacagaucagaccauugcagccaccucaccuacuguccugggguucugcuguuggccugaauuuuaggugcuaguugaaucugucccugcagaccuuguugcugggggacuuaggaagcaaaugccgggcuccagcagccugggucccuccgucaguggcuggugaguuagggaccauuaugcagccuucucagguagccucuuauucuauuagucacacaggcuuucucagaggacccucugguuaccugugucuugggagcaguagcuucaguugacaugcacggagaugaugccagccagcgucugcuuugcagcccacagggaugccccuuugaucugggcauccugcuuuaguuacagcuauuguaaaaugucugaaacuuguuugacagcuucccaccuagcuauuaccucucugggaccugucuguuuucccacauguccccagacagaucucagguagauggcccucagauggagcuacagggccacucccauuguacaguuucccagaaguaaaacucucaucaaagucaaugaauggagauccugcaaauagcagccuacagucucaagacuggccugugagcuuggugucacuaagaaaaagcuguuugcuggccacucaccuggccaugugagcauguauggaacaccuacuguauaugaaguacuuaugcuuccuuagcccauauuguauacccucuauugaaagcaauuccuaugucagagcuuugagccugggaguuggcuauagagugugggcugugcugugcucaggccucucuguuuaucuucacaucucucacuucuccauccauccgaucuuccugccagagcugggauuauaggcaugcaccaccaugccuggcucacagccacguuuuuguggagaaaggagugaagugggaguugugcugccuggcugaagugugacgcaucuuggguuuaguaaucuuucugaagaucccgucucagacauuguaauagucucugggggugaggucuuuauauggcauuuauaaggggaaacacacaguuuagguuuggugacaaaauaacaugacacccccucccccccggguugaccuuaaaauguagaagcagaaggauucaucagaccacggauucagcauaggcauugggagccuaaggagaugcuaggcauggggaggaggcaacccagagacgcuguaggcacacgcaaaggcuucaggaccagcuuguuuuaagaaaugaacaggaggcuacagugguagcuacugaaucaggguaggagauaggaagugagacagugaggggcucacccaguagggccuugaaggagucgguuugaauuucauucuaaauuuaguagggaacucuuccuacuuauuuuuuguuuuaaguguauguaugugugugugaauaugaauagacugugcaguugccugcggagaccagagggagucagauccucuggucauagacaguugugagcugacguguaggugcugagaaucaaauccugggccucggcaagaucagcaaguacucuuaaccaccaagccaccaaguggccaaguggggaaacucuugaauccuugaaugucagagaagaaacaucugucuaaggacacaaaguggcuggccgcagggcaggucucacguuuggucucuuguuaggggauugggacucauuuccauggcagcauuaggguauuaccaguggcuccuugaaguuuuuuccuccccaguaggggacaggacugcuggagguugaggaagggucucacuuuguagucuuggauggcuuggaacuuccccuguagaucagguggaccuuaaauuaaaacaaaacaaaaugaaacaaaccaccuucaaagugguaggauuaaagacauauuccacuaugccuugcauaucauagugguuuuuaauagaugucauauuaagaugccaggauuacaaccucuaaucacagcacuugaggcgaaggcagguagauuacugggaguuuaagaaaaaaagcuuuauugaacuguaauucaguaccaaccuuauguccccauuggauuugugucaacugguguuuguuaacauccugucuuguagccacagugauuaacuuuagaacauucuggucacuucaaaggaaaaccaagaguccgcaucccuuggcaggcacuccuggacucauauccagucuucucugaucuuuucaugccugcacuaugaaaaguucauguuuucuggcugagucaaaccuuacauucucaaggcuugucugcauugcagccauaccuccuuccaaggcugcgcaauuugucauuguacugcaguguauacuuagagcuugcucaucuagggaggugggggcagggauugcuucugcuuguugacuguugcuaauuauuguucugcucucuaguguuccgaaagaaaagcuacaguucugcaaucccagcagcugggaggcugacggagggcucugaguuuaaguagugugugcuggagacauagugaggcugugucugaggaggaggggcuacgucuuauuuuuugccugugugauggccugcauucuugcuagccuuccuaucugguuggaaugaguuuucuuccacauguucauguccuugugguugcaaaggucugcccuaagucuggucuauuuguucucaggcagaauuguccuuaucucuuagcucaagugauggauugugggcagucuucuguuacuguacuucacuucacccuccccccccucucucuuucucucuuucucucgcucucucucccucucucccucucucccuccuucccucccucccucccucccucccucccucccucccucccuccuuccuuccuuccuuccuuccuuuucuuucuuccuuuucuucccuucccccuucuucccccuucuucucccucccucccucccuuccuuccuagauuuauuuauuuauuuguuuauuauauguaacugcacuguagcugucuucagauacuccagaaaagggugucagauuucauuauggaugguugugauccaccaugugguugcuggauuugaacucaggacuuuugggagagcagucagugcucuuacccgcugagccaucucaccagcucucacuucaccauuucuaacuugauguguaaggguauuccugaaauccuguuugugaaggaagucugucugucucucgucuuguccccaaacccaaccgugaggguccuuuguacacaucauggaggacuguguguuuuuuaguugccuuuuuuaauauuaaaaaaaauaguucuguguuuagugugugcgugcgcacacauguauguauguguaacacuuagaggacaaauuuuagggauucaaacucaggucuucaggcuuggcagcaagcacuuuuauucacuaaacccucuccuugaccccaguuucuuauuuucuaugaaugucacuuuguuuggcagugaaaauaccucauuccuaguccaaugguggguucauuuccccaguucagcuacccagccuccugcuaggugugauguggacuugucucugucuuacccagcccaggcaggaggauugcagguuugcagacagccuaggcuccuguuucuugcccucuaagcagcagaugcagaaagcucccuguguagggcacaguucccucagcagcugccugucuuccucacaccuggagagguugggaaugacgcugggggugcugaaauuguacaggucugauuuggggggaaaaugaggaauccacuaaggggcaauugagcuguccccucaaaggaggcuaguccacugaacucaggaggacuucugaagccuucuugaguacaggaacuauuggugacucuuuggugccugcucgaggauggcaggugagcacagccaagcaguaccugugguguaggaggggccagugccuggcuuguagagucagugaccuuaacagugcuaggagagacuccagggauguuuugugacuuuucauguguuaauguguucauuuaaaaaauacugguaaaggacuggggugguaguucaguggacaagcaagcguauuugcuccaaugagaucugaguuagacuccccauugccacuugugugucugucagagaucccugugcaaauagagcuauaaaaacaucugaccagaagagccaagcuuguuugcccauuucccucagguuuugcagcaaacauuguacauagacucugagggcaagaugcggcugcuguggcuccuagaggcauuggagagucaguuccacuuccucacugguugucacuugucagucauauacaucucucaucagcuguauugaauagugccccuuuccaguguuguccugguauaccaggagcugggaguagaauggcagauaaaacccaguguguauucuagacucuggcaggagagacagacuaaauuacaaagaaugucauggugcuaccugcaucugugagggagacugagggacagagagcagcacccagagaaaagguccugaggagguguccaggacacaucugagcugagugguuuuaucugaccuuuguguugaucugcaugcagcuggcccaguggaaggguuugugggugaaggauucauccaccuccuacugucacuccuuccugagccuguaaucugucaucuuuccccgacugcagcacuuuccaggcccauccccccaacaguguggggauggaacucagggcuuucuuugcuugugccaagccaaugcucugagcuacaccugcucuccuuuuucuuuuacugcccaagcuggagaccaaauccagacccuggugcagguugggcaaaucuguaacugaacuguaaccccagcucuuccuuuccuuuucauguugagauguuguccaggcuugacuugaacuugccauccucuugacucaguuuccagaguaguuggaacuguaacucugugcaccaagcccaggugggauggugaugcugaagcccaguuuaccuauucagucucccaggugaguuaaguaggaacacaaagaaggcacaguucuccgaaucucaugacaguggagugguccugaggaagaucauuagcaucugggcuauggugcugggcuguaggcuucugagacagucacuguugcuagugcucggugggaaucugggauggacaaauuucaucuuaagguuuuguggugacucugggauguauuuccagauccaggcuugcuuaagugacccuggccagcauacugcucagaggucauggugggaaaugcuggguacacagcagaacgauagggaaaaagacaggguucaaagcuguuuaauauauuucugggcaugaaggaugaugcaggugacguugggaguagaggaggaauguuaugguuuguauaugcccuguccaggaagugccacuaucagagggugugguccuguuggaguaggugugucacugugggugugggcaacgagccccucauccuagcugucuggaagccaguauucugcuagcagccuucagaugaagauguagagcucucagcuccuccuguaccaugccugccuggauacugccaugcucccaccuugaugauaauggacugaacuucugaaccuguaagccagccccaauuaaauguuguccuuauaagaguugccuuggucauggugucuguucacagcaguaaaacucuaacuaagacaaggggugugcugcagcaaaaucugauagcuguacugcggcccccacuuucucuuauauguagcagugugggguugagguucagaccaagggcucuuagacaggcaacaaaaccuacucaaccuauuuuaaacaaagaguuguauagcuaaccagucagucagagaccuagagauggaguggaacugaggccucuaggcagagccugcuagggcagaggaauggagugguccuuggucuuaugaccacugacggucauaaggucauaagggucucgagagagggauucuggcaagcacugccuaggcaagggaacacuggguaacaggagaggugagcaagaucucagauuccuucuugcacaauugagccccaagaagauccagguguaccaucaacccuuggacaccugguagguggagaaggagccacuacagaaguucuuuuggagccacugaggcaggggcaggaagaauagggaguguacuauccaugauugugcaugcuuaugucugggaagucuugcuuauuaucuuuuagccuaguaacauggcuguuuugggguuuguggcuuuuuuuuuucuuuuuucuuuuuuuuguuuuucgagacaggguuucucuguguagcccuggcuguccuggaacucacucuguagaccaggcuggccucgaacucagaaauccgccugccucugccucccaagugcugggauuaaaggcgugcgccaagccgcaguggcuggguuauggagauaaaagugagugagugaggcacugccuuaaaagugugaggaccugauucagauccccaggacccauguaaaacaucaggugugugugugcuuauaaacucagcacuagacaaguggagguaggcagguccugggucucacugaccccaggaugggggugucccugucucagaauucaaauuggacaggacccaagaaacagcgagugcugagauguuguaaccucuguccaugugcauacacauagaaaugucuugguguauucuuaaaauuauuuuauuggguucuaaaaccucuaccuuccaacccuuauuuuacccuaauuucuuccaaccccucaacauuagguaggagagaaagagggucuagacuucuauaggcuacuuccugcugauuaggagcaacuucaaucuucgacacaauauccaguaguuuuacaaaccagcaauuuagcaauccaccaauagcaaacauaacugcaguggggcagguguguguguguggcagugaugacaagagcaauugcugccuucuuaugagccccuccuaccccucuuggagcucuagcauuuauucccucuccagagcccccagaauuaaacuauuugcaucugguaaaaauuaugccccuccuagagcacaagucagucauaguuauggcuguagacaaacugaagcagccccauguuccacaccugggguuaaaacaaaaauguauuuguagaacauaacuggguuuuaaaagaagccaaaccucuuacuacagacaugucagcucauaagauaacauacuaaaauacagacacugaucuucaaacauuugugcuuacaagacagcauacuaaagaaaacauagacaccgauguucauggucuuguuuaaaggagugagucuuaucccagccaggucuagaauuaccuggaacacauuuacagauguucauacaagcagaaccucgugaugucaccucggccucggcuucauaggaggucagcagcauucccauuuagaggcuuuugcauuuccucagggcacacagcuaagugaaagcucagucccacaguccuggauucuugacugcaggaacugaaucucuguaaggauccaggcaggauccugcuguaucugcucauuuacagagccacucccaccucagagugacucuuuguuaccuaagacuaacucagcuuggagcccuaccccaucccaacaacuauccugggacccucaucccucuagcucucaggacugucaugagggaaccuggcucugcauuugguguuggucugugugucauucuuuuugaguccccagcuguuauuugugagcagccuuugucuugcgcgugcacacgagcgcacacacacacacacauauauucucucucucucucuccugcugcaguccuggauaccuuaauugucucugucuucuucuguuaauaugaaagaauggaggagacaguguagggugggaauccagauuaguggcuguugagcaggaggcacaguggugccccuaaucgccaucaagugacauuuaguucugaucuuguugacaccuaguagauccuucugggauuaggucuagcagcugauucccauguggucucaccaguuguucaaacaucaaaacccucuuacuggagacauggguguuguaucaggccugcuuccucagacucugggcaucgccguuguaauuggagggugugagcucuggcacuaagggccucugggccuuugccuaugguggaugccauugucacaaugguugacauuuguuuguuuuugagacagggucucaacauguaacccaggcugguuuuuaacuuugaaucuucccuuuuccugugacagccugacaucacaugggagcagaguugguguuaagcgguuacugggugcuuagaguccagugcucuucccgccucuccucccugccuuggcuccagcaucucccccaggaaccugaacuugcuuaugggugauuguauuucacccauggcuccuggugcugccugccccagcuaaacagucaguagaacuuuucaccuuccuggaguccugagguuuagguggaucucagcacaauacaauugucuucccaagcucccugguagccagagucgcaguugucucuuguagaagugacuggguuccuggccuuuuuuguucuugcccagcucuugaugccacauucuucccucugccugucuucugucaggugucagugguucagggaaggagucaaagccgguggaaaaugggaugcuggugacagacaccguaggaaagcaccugcagagguaagcauuauguauguguguguguguguaugugugugugugcccagcccugaguugcuccugcccggcccugaguugcuccuucuuggaucugugggauccgagaagggacugguggccuuucacucuaccaccauagcucccaggaauuuggaauuccugucuauucugccugccucaucauccuucgagagccuucccaggaaggaccagcacugaccuauaacucauucaggccugcccuugaauuguauguuccugcuucugaaacuugcccuccacccccauaugauuugugucuuucuucagguagcugauacaggguuugacauguuggguuuugugagcuggcacaugaucacagacagucacacuaauggugauacugcuuugggaacuaggcacauuuguaggccuacagucuccugggcucuagcuugcugcuagccuguuccgauccacaucagacagacagaggcuuaccaguucugcagcucuagagaugcccagugcugagccagugacccuaagcuuuaucuaugcugcuuucagaagacugcuuugguuuaguuugaggguuuuuuuuuuuuuguuuuuuguuuuuuuuuuguuuuuuuuuuuguuuuuuguuuuuguuuuuguuuuuguuuuugaggcagggucuuauguauccuaagcuggccuuggacugaauagauagcuaaggaugaauuugaaugcccgguccucgauccucuugcuucuaucuucuugaugcuaggauuacagguguggugccgcuaugccuacuuuauccagugcuagaguugaaccuagagcuucaugcauucuaccaacugagcuacaucuacagcucccaaauaauuucuuuacaugaaagauuuuucuguuuccucuucacacgcaccacagcagcucucauucgugacauacacaucccugucccuggaaacacaggagcacagcuaugugugagcucgcacucccuaagguucuuugacuggcucccuacucuccuugguaacaggcaucucagcaacucgucuucccacaguggggauaccagccagcaacacagcagcauagccgaacugcagaaggcuggagcuaaggaggagacguggaagcuaauggaagcagacaaggcccagacagggcaggugagugaggcacagugcacaaugauuugcuugguguguguaucucacagcaagccucucagagcccagggucacagacacuaagugacuuuugcuggaguugggaucugagcugcugaauccauguugguacuugagucucaugucuaccugacugugagcagcccggacuauugaaugagaccauccaggucacaaggcagcugcaaccacucgugcauuuuugucaccucccuaaauguauugugcucucucacaccucagggccuuuacaccuggaagguuagcccuucccuuuuuguuuuccauucacagcugguaaacucuacaacaucacuuccucagggcaaccucccgggaccuacucaccugggcacuugcauggguucugugccucuuauggaccuuacauauuucagugggugauugaugacagggcauuagccuguucaggugcuugacuggaagcucugugggaggcagaaaaccuggcuuugccacugcuggcugauaucauuaacuaauggagugauaggcucuugagggucugggaacaggagggagggccgggcugugaggagucacgaaggaauagcuaaccuuaugcuaauauucuauggguccuaggugcagcugucaguguacuggaacuacaugaaggccauuggccucuucaucaccuucuugaguaucuuccuuuuccugugcaaccauguaucugcacuggccucuaacuauuggcugagccucuggacagaugaccccccuguugucaaugggacucaggcgaacaggaauuuucggcugagugucuauggggccuugggcaucuugcaaggugugucugagaugguuucauucuuaauuucauaacugacuuuccaaguccucagagaauuuacauccccaaacugagccagacugaucccauuaaaagguagacccugaaaugauugcugaauucagacccacccucuaucucucccaguccucucuucaaagagccccacagcucaagccacauggcuaauuacugguugagcuggcauuaaaugaaacagcccagaguauuugaucuuguugaaggucugugcacucauaagacugguuuguauacacguccuuucccuauccuugauucacuggugcgggcagugagucuguucacuuugugugcuucuccuguaucuagcaugcugcuggggaaggacuuaguacugacuguacgcucagagcugaguaucacuguccccauuuuacagaugagauaacaugggagggccagaugacaagguuggcagcaccaguuccagagcugguggaagaggcucaaauagaagucccagaaagaauucuguggacuguggacuguggaaugcgggcuguuuggagggacuacagauguuuccuggucucugagguagcuugggaacaagcccucagaucaggugugaugccuugaguuucucuauaacacccccauuccccacagagccaggaucugcugcagccuuuauaguguaguugagaaaaaaacaaagaacagagaggauauggcauuuucccagguucacauagcaucagcaucugcuauuagagcuauguugccugguacaguaacugcuagccaugggaaaugauuugaauuuuaguucauuagaauuaaaggaaaauucaguuuuucaaaaguuccagcacugucacuggcugugacagccuucagaucacucuccuacaucuuacacuuacaucucuauugcuauccuaggugcagcaauauuuggcuacuccauggcuguguccaucgggggcaucuuugccucccgucgcuugcaccuggaccugcuauacaauguucugcgaucacccaugaguuucuuugagcguacacccagugggaaccuagugaaccgauucuccaaggagcuggacacaguggacuccaugaucccgcaggucaucaagauguucauggguucacucuucagugucauuggagcugucaucaucauccuacuggccacgcccauugccgcagucaucaucccacccuugggucugguuuacuucuuugugcaggugagccucagacuggugagaaugugaccauggcacucagcucugcucuuguguguugugaauacuuaagugggcugcuuuuagcuugcaguagcuaggugugcucacuuucaucacuguuacucuuuugagcuguauauuaaggggaaagcucacagcucucaaggcaguuguuacuagacugaauuacuaaauucuucaguggugacaugaaaaacagcagccucaucaggaggguggauguugaugcucacagcagauuaggaugcagcucguuuugagacugguguagucccaugggucagucaacacccuagguuauucuugcugccauuaacaccuuccuuuuuguuuagcucugcuuugcugucuucacauaaaucuucaaucuuuaaauuggucucaugguucaaaaugcuuaucauaucuguaauguguguagcucugauccugagauugacagcagggaccuguggccacuggaucagaauugaaguccucaagucaucaagcacaguuaugugaccguugcuauuugcaagggagggcaggggacauucugguuuucagcuaccaguuuccaucaggagaagggcagcuguucugguucaugccuugucuccucuguagaaaccacucuuucuuugccuauguguacuuucuugggucaauucuguguagauuacauacucaggugacaggugaauggguagagacucagcuggcaagccaccagugggaccggggugugugguuuugagucaugugcucagagcuuuagcuggagcauagucauucauaaguuuggguguuaagguuguuggggaauaauggcaauguaaacaccugcugaccucuguuugucagggagcugaggcaggaggauggagaguucaaagcuacauagcaagacauugucucaaaaacaaaacaaaaaauuaaaaauaccaaauagugaguuuuugucacauagggucuagggaccuugguacugccaucccauaccugggccccaucacauugcagguuaaugaucuuaccauaaagaaagaucaaauugcugggcgugguggugcacgccuuuaaucccagcacucgggaggcagagacaggcagauuucugaguucgaggccagccuggucuacaaagugaguuccaggacagccagggcuauacaaagaaacccugucucgaaaaaccaaaaaaaaaaaaaaaaaaaaaaucaaauuguagggaaaaaguccauuuccuggacuucucugguagcuucuuuaaaccauugccagcuguuuacuagaauaucuugacugcauuuaccaaaaugugguaaauggccucauggcugccuggaaagcuuccugaagucucuaguucagaacagggacaguguagcacuagaaacuagaaauggugugaccucagggccccauggaggaguaauguacuuaccuuacaaacaugaagaccugcauuugaucccuagagaaagccaagccugggccaucccguugcugccaagcccagugaacaagcgaaacucauguggugggaaaugagaacuagcuuccucaaacugccucugaccuccaugcaugcuguauagcauaaauguacccugcucugccuuccaaaauaaguuaguguaaauuaaaaaaaaaaaaaauuaaaaaaaggcagguaaaguguguuaaucccagugcuggagaggcagagcagaaagaucccuguggcucaugagccagacagucuagcaauucagugaguucucgguaaguucagugggagagccugccucggaagccaagguggaaaagggaucaaggaagauacaucgauuccuggccucuacacacagcaaugugcggacacagaaauacauagcuuguggcacaguuguguaugucaaagaacaacauugguagugaauucucucuuuccaucuugggaugugauuuaagaauaagguuuauguagcaagagcugagcagucccuacuugcugagcaaucucagcccuguuuuuacaguuaccaaaaaacaaacaaacaaacaaacaaacaaaaaacccaaaaaccaaauguauacugacuggcaguuugaaugagauugagccccauuggcucaaauguuugcacacuuggcucccaguugguagcacuaugugguuaggguuaggagguauggccuugcuggaagaagguacaagacuugagguuuuaaaagccacaugugccauucccaguuuguucucaaguuucaugcuuaggguucaagaauugaguucucagcuggucuugccgccaagguuggugccuguccugauuuccugaugugaugaggcacaaggaaauaagggucagucaaucucugaacaugcaaaaugggauaggaaaaguuuacaaaggucucaacuuuuauauaccauacaggugugcuggauaguuuuaugucagcuugacacaagaugaagucaccugagaggagaaaaccuaaauugagaaaaugccuccuuaaaacggggcugugugcaagucuguggggcauuuucuuacauagugauuguugggggagggccuauuccguuauugguggugccaucccuggguuggugguucuggguucuaaaagaaagcaagcuaugcaagccaugggaacaagcuagaaagcagcaucccuccauguucucugcaucaguucccaccucuagguuccugcucuacuggaguuucugccuucauugucccucaccaccccccacccccccaaacaggguuucucuguacagcucugacuguccuggaauuugcucuguagaccagacaucagucugccccagccuccugagugcugggauuaaaggcaugugccaccacugcccagugagcccucacugcuuuuaaugaugaacuguuauauggaacugugacugaaagaaacccuuuccgccccaaguugguuuuugucaugguguuucaucacaacaguaguuacccuaauuaagacaauaagcaacugacugaagcuaggaacaggagaaguggcccuccccaaggaagagcacaccauuugguuguccagugccaaugggucaguccucaaagcaugcauacagguagcauuauuuguacgcaaacagguuauauuuaggaacacacacacauuuuuaugcaugcaauaaugauuagugaaagaggccaugaauuugaaggagaacagggauggccaaauguacggaguggccaugcacgugaggcugcugacacaggcagcugcaccuucugguuuaguggaguuaauggauuucaugcuuguugacauguaugugugugugugcugugugcaguguguacaugaaaacagugggacucacacugaagaacccauggcucuuaccuguuuuccucacagcccacuguacaaaauagcuuuaguguugcuacaguacagaagaaauaaaagcuaagacaguacaaugacuuggccugguuucugguuauaaagccugucucuaaaccuguccuagugggagagcaaagccccaagcauuuagaggacuucugagaguccagccagucuggagauuaguuuagguccauccugaugcuucucagccauggacccaaagaggccacuuggccuuguugucuccaccuaaacacaagaaagagcauugcuuggguuuauagauggcacacaggacacacuagugucacugacauuacuguaucuucagaguuuuggccccuggagguuaugagccauguuuagcuucucucaguauaccccaggaggaugagaugagggaucagcacugaucauguuucucucccacagagguucuauguggcuuccucaagacaacugaagcgccuggagucugucagccguuccccuguguacucacacuucaaugagaccuugcugggagucagugucauccgugcuuuugaggagcaggagcgcuucauucaccagagugaccugaaaguagaugagaaccagaaggccuacuaccccagcauuguggccaacagguggguguagcgcucaguagaguagaggaaacuagcugagugccuagucccucggcuuccauggugacacaugccugcagaaggauuaccaugaguuugaaguggccuugauuacuuagcaaauugcaggccagcuaggcuauagaaugagaccuugucuccaaaauaaagcaaucuaggaucuggaaagauagcuugguggcuaaaauugcuuacugugcaaguaugagaacccauauuugaggugcagauggggguggucucaagagcucagugcccaaccuuggaauaagcaccuuguuucuucuucauguugaaguucaucucuugccaaaggacuaauuuuauuuaucauuauuuauuuaucauuauuauuguuauuauuuugugguuacucucaaaaccagggcuuucugcaugucaggccagugauccaccacugagcucggccccugucccaagauacuuauuugcaaauagcagugccuucuauaguuuauggcaucuuaggaaucuccaggaaauuauuuuuuuauuuuaaugauuucuuaagaaaaagucagucuuccuaaagaaaaaaaaaaugagguuccaggauaaagauuguuucuggagaauuuuauuuuagucccugggcaagccagacucaggaagaguuguugacuucaaaucccaugggcccuuggugugcucuuuugccuccauccaguucucacauccuggauucauaguacccacaaggucuuucucuagaagugcugcucagcuaucagaagggcccagaucugccuaugagcuugaaucuaggcaccuggcugucugauacauaccuauauaucuccuuuauguaucuccauauagguggcuugcugugcgccuugagugugugggcaacugcauugugcuguuugcugcccucuuugcagucaucucccggcacagccucagugcuggcuuggugggccucucugugucuuacucacugcagguaaguggcucuuucuucggcugaauggucuccucacggcaacccgauuuugaguuucuggaccuuggcuuuggguaccugcaggguggggaaaggagagggcuuuaauggaguuuaaaggcauagagccuggugccagcaugggaauucugacacauggccuacaguuuuuaucaaucaaaagauucuuggugacuugaugcuuucaaaacuaugaauuucccccugaguacuguguuaguugcaucuuaugauguugguguuagcguagaacuuagcacaagucuccugauccagucucuggagcacugggguuaauuauggacauuaaccaucacauggaaaucaccugguuccaaaauauuuuuguuuccuguauggcuucucugucuaccucucccuucccugccuuccuuguacagggugcgccacagugcacauguggcgggcauagaagcccucucagcgugggcucucuugcacaucacuguucuggagguagaacucagggcaccugcccugcucagcaagugauuugcccacagaguugucucacagguccugaguucuuucugauaacucguguggaccaugugucaccuuggaaggugugaucccuaagagguacauaguguccacucugggugauggcucuauguggccuacucauuucuguguuuguuugaaugauaucauaaugcauaauuaaugaaaaugaagccacacuuccccuaagaagugaguucauggcuuuuuucacuggcagauaacugcauacuugaacuggcugguucgaauguccucggagauggagaccaacauuguggcaguggagagacugaaggaguauucugaaacagagaaggagguaagacaggaccucagccuggucucuugguuuugacuuuucagacaccucauggauguccucuaccuacuuggagggugagcuaagugccuuccaggaccucuugggauugaucuguuuuaacuugcuuagaaauaccuuuguuuuagaggaagaaaauuguccacauguccuauuuucuccaagauaccaaguguccauauaugaggucccaaggugcugucagggccuguggccugugucacuuauuaagugacaucucaugucauucuuuccuucagugaugucacagagaaaguccuaaugcugauuguugcuugaggcucaugaccuucuuauuaaugaagaugguuuccucacaacugccaaguaaacugcaacauccucucucacagccuucagcaggcaaccuuuuccugccaaagccuucauaggcagcucuuccugccaaaaccuucauagacaacucuucuugccaaagcucucugcuauuugcucuggagguuuacaggggcucuuguuauggggaauuaaacuguaauuaaauuacaucuguguagaaauuuuucucauacauugaagacuuaaguagaaaugugauuaggacuguuggaggcuggggagaugguucaguggguaaaugucugaggacugaguuuggauccccagaguguaggauggcagcuugcauuugcugauuccucuuauuccucuugugauccaggcuccuuggcaaauccaggaaacagcuccacccagcaccuggccccauucaggccguguagaguuccgggauuacugccugagguaucgagaagacuuggacuugguucucaagcacauaaaugucaccauugaggguggagaaaagguggguguguaccgucccccauccucacccacucauaggcaauggaguaaaauaaaagguggcuagaugccauccuccauuccuguugucuuaaggucuaucaugaauccccuuaagcuguucacagcuccucuauacagcugugucuagaugaugugcuaccuagugccaagaaaaugcuaggaaaauagcaguacgucgcuuagggauaaaagccuauguaugguauuacaugcagaugcuaaaccuguaaaaacaaaccaaaccaagaaaaaaacaaacaaacaaaaaaaauccaaaaccaaaacaacaacagaaaccuagucauaggcuccaugacuaaagggacaucccaccaagcuugauggcuugauucugaagcuugguggccugaauuucauucucagaauccuguuaucauucacagcucauacuaugagauugagggacuuuuacuggguagaaucauggaaauaaaagaugcugaguguguaaguguuucugcuuggaugggacaguuuccgggacucagcagcccaggaaacacacagcucugagaggaaaccuccucaguggcagggcaucacgagacauggggcccaggaaccucagagcucugagagggagccuccucagcagagcauggccacucccaggggaaggauccccagcugagccuaggagcucaagagccucagcccugcuccuucucuucauugcuucuuuuuuuucugggcuucuguugagagagucacaccaggcagaaaaucucaugaaucagauuaauugaaggguccaggguguggagggacaaauccaaggcuguugaucaaagggacaguauuuagauauuuauauaggauuucugagggggcggagcaucucagggcagacauuucccauuuccagagugaggauuggugggauuucaaguccugagugggggaggauauaucagggaauugugaauuuccugcucagggauugauuuuuuuuuuucacccucuugcccccugcguugggaccauggguuaggguggaaaguccuuccuggcugcagccggguuuugcugagguaccgucucuggggggcugcuggggugaggggugcuggagaggagguguugcuacuguggacagcuccugcagugguguuuuacuaaagauguaggcugaggcaggaaagaaggugucuccaucgugaacaguuccugaggggcaguuccugcugagguggaaaaggaggugcaccaccauggaaagcuucuguagcuccugugcccuguaggcugaggagacauuguggugcugccauuuugacaggaaccgccauuuuggacagcuuaugugggacauuuuacuguggugacccuuggcuggggcaggaaggaggggcuugccgcaacuuugauagcuuuuguggcacagugauuuuuguaaugugccgcucagggacuacagaauguauucaacagguggcaccauggacugcugaaggacaaggcccauaaaucugcagauacguuuuggauaaacauuuacacgaacuauaaauacuagaauguccaugauauuucauauaauggucccuuugcuuuucuuggacaguuagaacguguagaacauguucuacucacagacacccuccagcucaucccaguuucuccuaugugguucacaugccugugugaucccuuuaaggcacugcaguucguaaacucuagaguaguaaggggagguuaccaucacuagggugggcggacauagggacauaagaaauuguugggauuuuaggaccuucuuauggucccaagcuauuccuggaagacauuccagacuaugacacauagaauuuucucagaaacuuggucagggaucaccccaaccauuuguaucguguccauguugauuuguuaaacuguccauccacauggauuagaguauucuauucccgugagauagucucugaguuuuuaugcguuaugggaauucaugauuaggauaacuguuagagggggagggagccuaucucagguucugauguaaaauauagaaagaacugucacugaagauugggaaugugagucauuggccaguaacugcagugcccaggucauaucaaagauguucaagggcuuugcugggaucugagggguuaucauggcucaguucuagcagaggaaagaggaaaugggugggaaagaccucauuauuuucugacuauugcaacugaauucaacuaaacauaauucaacuaaagauuccucugucugcaccccaucccuuagggcguuuuuccugacuuauaaaaagacuuuagccuuuggaagccuacaaaacaaagggcaguucuuuucaacuguuuguucaaaguagcucugaagguggguccuggagaaggaucagccagaugaccucacagcucugacucagacaccugcugggggaagaccgagucuacagcauuccuaccucaccacagccccucucucuccugcagguggguauuguaggucguacgggagcugggaaaucaucucucacccuggguuuguuccggaucaaugagucugcagaaggggagaucaucauugauggggucaacaucgccaagaucggccugcacaaccugcgcuucaagaucaccaucauuccacaggcgagugaggcugcuggguccugcacgcugaagccacaugcucugcauccauagacuuagccaacuggagguggggaugguguuuuuacauucguguaguuauugagaggaggggagcagaacacauuugaaggucagaaccaucugcaggaguuguuuuucuccuuuuacauguggauucugagaaucaaguucaggccgucaggcuuggugggcuaugccuguaauccuggagaccaugccgucaagcuuggugggauaugccuguaaucauggagaccguggcuagguuuuuugcuuuuguuuuuguuuuugcuuuuucagguuuagcgucugcauguaauaccauucguagauuuucaucccuaaaugaggcacagcuauuuucccagcauuuucuugguaguaugucaucuagacauggcuguauacaggagcugugaguagguuauguaagaauaacucuaccauucauacaaagaaccagagcaucuguggguuuugguagugguaggggcuugguaagccacugucuccugccagugugcuaaucucugacucgucuggagcuaagccacagaucguucucuaaacgaaugccuguggguaucaguucccugggcuuugcuuagcuuaugacuuuuccuuaaguuucucugagacucuccucuggaggugggauugagugucugauucguuccuuuucuguugcucugaugaaauaacaccacuaaaagcaacagaggauuugcauauugaaacuugggagaaauuuuguaaaaauacuaauuuuagucugguuaacccagggguuuucagacauuuucuguuacagaaaucccacauaguucgugcuuuggagggacucggaaaccucuuucuguucuggugucuagagcucaggccuugcaucucugagcuucccuugcucaggguggucaucugcucuuaguuacuuuuuuuuuuuuuaaucaaaauaccuaguagaaucaaccuccuugaagagaggcuuauuuugguucauaguaucauaggauugcuguccuucuuaguggggaaagcauggucacgcaguaggguauguguggugauagcuucuccgugucaagaaaccagggaguaggggcccagccagaaucaaagccaaguguaaccuugagaaguuagcagccuacuuguuccacccaggcuccaccucuuugcaucccaaaguaacaucaccaacuggggaacaagugcucaaagcaucaguguguggggaaccucucgauguaaacucucauacgugccaugugcuguccuugcauaggauccuguuuuguucucggguucccuccgcaugaacuuggacccuuucagucaguauucugaugaagaagucuggauggcccuggagcuugcucaccuaaagggcuuugugucagcuuugccugacaagcugaaccaugagugugcagaagguggagagaaccugagguaaggaggcaagcuugagcugugugugggaagauccuacccacuugccuugggcuaacuucagcuauccaucaucagggagaccagcucccauccugcuucaaugcuaggguggucagccaguggcuguguugcugaucuuggcuggggcaggguuggagggugcagcugacaguuggcggaucuacuuguccucagugggaucaaugcaugugcuuuuuguccucuaacagacuagcccaagcguguugucauggugacagcaaauguguaagaaugaacauucucaguguccauugccgugucaagcuccuacuugccauuaguuggacaacaucccauuggcuaaggccaggcacauagcugaguccagccauugcuaaggccucugcagcucacugagaugguggauacucagcccccuuuguugucuuugucacccacacugaaccgagccgauacuuuaaauaucacuucugagccuuuuguugggaaugacccuaagccuguuuccugcucaccaggaaauaaccagguauaacaugauugauuaguaauagccaucauauguauggauauggggcauggccuuguucuucugccaaaagcccacccugagacugucugcuagccuucuccccccgaagccuggcucagcaucagggcaguuugagccacucucucuggguuuuuucucccuuccuaguguggggcagcgacagcuugugugccuggcccgggcucugcugaggaagacaaagauucuaguguuggacgaggcuaccgcagcuguggaccuagagacagauaaccuuauccaguccaccauccggacacaguuugaagacuguacugugcucacgauugcucaucggcuuaacaccauaauggacuacacgcggugagguccccagagugcccugugggcuugcaguguuaauccuguauccaucgauccauccauccaucaccaucacuaugcucaggggcaaccccaauuggugugacucuucugucaugggaaaaacagguuaugaaacauauuuauaugcaugagguaccugauuugugcuccauauuacgcuggacucugggguccccugucuaacaaggcauaggggccauauuaaggaccagaacauuuacuuaagagagaaggacaaugaucacagcaacaaacacugauuucagagggagacaugugcuagauacaagugauaaugaggaggcaggaaggcagguaccaggcugaacccuuuccuccagccccuagaguuuauaauacuucuuucaacccacagacaucagcugcaucuccuugcauaaugguaacaucugugucccuucccauacagggugauuguccuggacaaaggagaaguucgggaguguggugcacccucugagcuccugcagcaaagaggcaucuucuacagcauggccaaggaugcuggcuuggugugagcuggucucuggcauauccaaugaggacugcagggccaggaucccagaguccaggcaugagccagcaacccuggaaaccuacgcuucccagacaaaacccaaaaauuuaaaacgaaaccaaacuaaaaggaagcaaaauacuuaggcgucugucaccauuuggcuucauccuggaucugaccuugaagaagcuggaagacagaugcaccccacuucagauacacgucuggccucuggcacccugaaaguucacccaugcuccugccguaucccacggcaaguccaugggcagcuaaacauacuagugaccaaacacaagccacacugccucaugucucuucagccacgucuacggaugccaagccuuguagccucuccuggccuugccagcucucugucaccuauagucguguugguuacagaagagugcaucuugccuucaggucuugcaguugaaacaugggaaccaaaaugaacaaaaaggagagaaagaaaaccccuaaaaaguuccuguccuuguuaugucagugauguccccuuccugccaucuggucuucaugcacgcugacacuguccccugcguucagcacagcuuucacaggaccugcuuaagacacagccuugugaagggaccuaggcagacaggcuuggaacccggccaggcaacacucccuucacaaggacuuacaccuugccccugcuuucuguuucuuccuguucaaagcuggggagggcucacuccucacauaaggucuaugaauaguuauaagcagcaaaagucaagagcagaagggauggugcccacgggcaagaaucugguaucaaagacagccagaguuccuuauagggccagaagagaaccauucacaaauaucagugauuucuccccccuacuuaugagcaucguuucguggagaaggauagucccaagaauuugaugucugggagaagguacuagauucagggagcagccaugcccagcucugcacuugauccucagucugaauacuucaaagugguccucuagguugugugaguuacagaccaaagagagacccccaugguuagcaagaacuugaugccagccacaguucauacuugcuuugaauuuuggcucuaaugucagucccagagaagcauccuuuuucuuuagguggcaauauauguauuuauuuuuuguaaguuaauaccauucuuucacuuuaaagggcccagauuucuccugagagucuuuuuguaaugacacuggaaacaugacuauuugaaaauaauuugcaguaaagaaaaauauuucauuucuuucuaaacgaccauuuuauuuuuauuuuuuauuuuuugggcacaaaggucucaaccucuacuguggaagaaccaggcuaagacagcuaugauaccacugucaucaauaguggcagggcaggacuggagagguggcucagcaguuagugcuuguuccucuuacagagggauaagucucaguucccagcaccuguguucagugucuuacaguugccuauaucucuagcuccaaagggccagugccucuuuugggcaaauuaaaaauaagaaagagaugggggagggcaaagguaagagcugccuggagucuggcagugaggcagaauggcaaaguccauaaauaccugggcuugcguccuacugucgguuuuuggacaugugacccuggacaaagcugugucacaagugucccaaauacuucuugguaauaaguggggcugaucuguacugacacugcuuaugaucuugggaaauggggcuagugagauggcucaguugguaaagugcuugccaucugugcaggggaaccugcauuccaauccucaacauaaaagccagguaauauauccauacaaaccccugcacuggggaggaaacgggagcaacguugggguucucuagccagucagccuagccaagucacugagcuccuuguccagugagagcauaaggugggagcuagagcaauggcucagagguuaggaaugcaugauguaccugcagaggacccagguucagucccuugcacccauauuggacagcucagaacuaucuguaacuugaguuuccggccucuaaggucaccugcacucaugugcauauaaacacaaacuuacacaauacacaaaacaaaaugaaucuaaaaag

SEQ ID NO: 8111 - RNA, 3556 nt, Mus musculus
cagaggagcucagucgggcagggagccgggugacuucagaggcgccugccugucccccgccgcaccugagccaccgcgaugcuauaggaccgccgccuggaccguuauccgcccgcgcccgcccgcagccaccaugccgcgcuccuuccuggucaagaaacauuucaacgccuccaagaagcccaacuacagcgaacuggacacacacacagguaaaaaucgccucuguaaaucugugcgcgaguaaaccgcgguucuauugcuugacucagagaacacaccgggccgcuuuccuuuuaaugcugugccaaaacuguccuugcagucucuugauuacuuagguuaaguuuuaauucaaaaccuuugagaucuuugcugacaaggaaagcuuccuuccggucgggcaguauaguucucugagccuguguguacgcaaaaggagugcacggacgugaucgcacccuuccccucgccugagcagcaaucuccugaagccaagcacuugggaaagcagcuggauucgugcaugccauuacccgccacaggcacgguacagcuagaacagcccacgcauaaaaugaaaagcaacuuuauaaaaaguuuuaauauagugucuaguucuucguucuaaauugggacagcaaggcuaguccagaaugaagguuagucagggcaacugucagccugcacgaggacaguaagcccaggugaagggaagacuuuauguguguccugugaguaaggcugucuucacuagagagucuccuauggagucuccugcauguuguuauggucucucucagacuguguacauauauuuuaaaaauauuuugccuuaauuuuuucuuuccuuccuuuucuuucuuccaguuauuauuuccccauaucucuaugaaaguuacccuauaccugucauaccaaaaccagagauccucaccucgggagcauacagcccuauuacuguauggacaucgucggcagcuccacuccacucuccuuuacccaguggccuuucuccucuuacuggauacuccucauccuuggggcguguaagucccccgccuuccucugacacuucauccaaggaucacagugguucagaaagucccauuagugacgaagaggagagacugcagcccaagcuuucagacccccaugccaucgaagcugagaaguuucagugcaauuuaugcaauaagaccuauucuacguucucugggcuggccaaacacaagcagcugcacugugaugcccagucuaggaaaucguucagcugcaaguacugugacaaggaauaugugagccugggugcccugaagaugcacauucgaacccacacauugccuugugucugcaagaucuguggcaaggcuuucuccagacccuggcugcuucaaggacacauuagaacucacacugguaagagaaauguagaaaaccaugccucucagcucaaacaguggugugacagagcugucugcggggugucuuaagggacugacaggggguguuuuucauaaggugaaccacugauagcugcuuucugcucuaaagcuuguuagaacagcaagugcuccuuuccagccucugcuccagggauuguaaacagcauuuagacuuuggaaagcacaugcaggagauuuggucucaaagaucaguuagaaagcaagauugagguauuugguguguguucugcagaacugauagucaguaaauacaaaugucuggcuccuaguguugauuugauaaacaggcagaggggguuccuauaguuuuuuuggcuauacuuuuugcuaugaauucugccaacucuugacuaauuuaguaaaugaggcuaaauuggaucuggccgugugcuuguuuguuucauuuucuuguugcugauuuuuaaaaaaagcccaaagcaugaaaucauaugcaggaagucauggaauuuauccagucuuagucaucauacagaaagaggagacauacuggaaauggagggagcugcucaucauugcugcaccuguugaagcagaaacccuuagcaagaaaaagccccaauucugaaugugugucugucuggcagaacggaagcuguuuggcugauauuuuaaaguuuuguuuugaaaggccaaauaggaauagaauuacauaacuggggguugauaugaucaagcuaugauaauucuuauucuucuaagcuacuguugauguucauuaauauuacuugauuuuguguccuauaaaaagcugacugucuuuuauuuucccuuacccuaccucaaacaggggaaaagccuuucucuugcccucacugcaauagggcuuuugcagacagaucaaaccugagggcacaucugcagacccacucugauguaaagaaauaccagugcaaaaacugcuccaaaaccuucuccagaaugucgcuucugcauaaacaugaggagucuggcugcuguguggcacacugaguggcgcaaccaguguuuacucaaacagaaugcauuucuucacuccaaugacaaaugacaaaugaaaguccaaagacauuuucucaugugcuuaccaaccaaauaguauguauaaaaccacaaaagagucacacacacacacacacacacacacacacacacacacacagagagagagagagagagagagagagagacagacagacagacagacagauacacacacacuacagaacagaaucuauguacuuaaaguuaauucguucuaugugaaguuuaaaauuauauuuacugacagcuagauugaaaggauaaaagauaagaaucuuucucuuuaaagaugaagugaaaagcacauugcaucuuuucuuacuaagaaagaauacagagauuuacacugcugccaaaccauuucaaccaaaggaacaguauuucuucuuaauagaauuguaauaguguuuccaagaggaagagagucugccagacacuaucucaggugccuuauaaaguacuccaaguuuacuuccuuaaauguaugaugccugguugucaucagugaaugacagccuuuucuggauuaccuacaauguuuuaaaacuauauuguuaagagaaaaaaaaccaaaaacaagaaaaagaacagaacacaagagaauguauuaaaguauucuuguuuuauuuuugccaugugugccuuggaagaggagggaaagacaaacuucaaacauuccuggugcgugucccaugucuuucuuuuuaaaaaagaaucuuaauguuuuauaauacaaaguaaugaaaaugugcaaaagaauuucuuagacauucaguaauguacuuagacuuuugaaaauucaugugauggaugcaguaauacaaugccccuccaagugccugucuuaaugacuuguguaguugaugaacugauguaaauuuguguuuauuuuuauacaacugaaugaacucuguaugaaagugagguacgguuaauagccacgccuauauucaaccagaauacuugugaaaucaauguccuuuuuuaaaaaguaacuuucaaggucucuuuuuuacaauaaacauuuuugaguaaaaaguaguuacuca

SEQ ID NO: 8112 - RNA, 13508 nt, Mus musculus
uauaauucaaaugguuuagagauuuauuguaauauuuacacaagauuuaaugcuacaauggcuuugaaacuaauaaucuaaggaucuauaaaaauuaaugaaauucauaccuugauuuuuuuauaaccuauccagcacuauuaugauuucaaaaaauauagucuuuagcaaaguucugcucuuaaugagaaauaauuuuaaaccaaguauuacuuuucuaucauuuauuuaggaaaauguuuuacauauuaggaaaaaacagaaggcaacuugauuuaauaauuuuucaagcauaucuuuguucuaauaauaguuaugggaaaaagucucuguaaagaaaguuaaguccaggugcuauaaaaaucauuagcccaucauaucacaguaaaggauguacggcugccaguuauaccaagcacacaaugcuccacacaguaaggacauagccucuacauacagcaugcaugguacucuuaccuuccuccccagcauugcaacacaacaaaggcacagccccuacauuaaaaaaaaccuccaaaacugggcuuaggcucucuguguacaaacagguaagaagcaagcugcuuaaaaaauauggcauauugagaauauaaacucuacuauauguugauaauuuaaaauguuaaaaaaaggugaaaacauacauuuacuaacaaaauacauuccaggaauagaagagguuuauauaguggaauacugccuuucagacuccuuuugcagcaauaacaacagugagugacucuaguccgagggccaugcagcucagagcaggcggacagucuucccagucacuguuaggaaaucaucaucagccaaagcucgcagggcuucuucaaacauguccuugguaauugccuagaaaacacaaaugucacagauugucuuuacugucaggcacacaugcuuuaauguuaaaccaccgcuuaaagucuuugucuuuuugguggcuguagacaauucauuuugcauauauauauaugagauacaauuaucuuauucauuuuugugugccugugggcugguuauaaauggaagucaaaggacagcuuuccaaagucaaguuaguucuccccuucuaccacacagguuccagagauagaacuuagcucaucaggcuuagugguagguaucuucuuuacccacugacccaucuuaucaacccugcuaaagagcauuucuuauccuguaaaucaggacggcaaaccggcaaacauuucuuuaaaguacuaggugucuagucuuuucuaagcucugccuucaccaugccaacaagcaggcuuuaacuuugaccaacaauuuuuggggggggggggagggggaggcaggggcagggguucgagacaggguuucucuguguagcccuggcuauccuggaacucacuuuguagaccaggauguccuggaacucagaaguccgccugccucugccucccgagugcugggauuaaaggcaugcccggcaaaccagcauuuuuuuaaacuaacaauucaucuuuaauugcaaaaggucaggcaaauauuucauuccuaaaacaaaucuaaacuccaaacaggugaacuaauuuuaacaauguauuucuuaauaauguguauauggacaaggcaaucuuauuugcgauuauuacuuacacacauauaaacacuuacugugucagacuguccccgaauauccucaaacagcuguugguacuuuaaggcugguguuuuacccuuagauaaaauaaguuuucucaaugcuucagcuaauucuucuuuccguuuacgagaaguggcacucauuccuauuucaaaaagaaaccaauggaaauguuucuaccaugauuaagugaaauguuagagucccauaaauauuccuucaguaguauugccaagaaagguagaacaaccaaaugccagagcauauucaagagcacgagguuuuguuguuuuaguuauuuuaucuaucauuagcuauuugccacugaaagcccauauaagcuguuuagcaaguauaaccauacuuauuagaucaaauucuugcuugucugcuaaugcucgaaacaaauuuuaauagauauaaaacaccagaggagauagaaucucuuuugauuuuaaguuucuaguucaaagcaaguaacuaaccuguaguaagaauagaaauauccacaaugccaguacgagggucaguugcagacugcuucagagccucccgguggaggcguuuugccucuuccacaucaauugcuucaacuuuguuugaaaaucuuacuuuagcaugggcuucugcuaagcgaauuaaugacucuagcugucgaggguaagcagaaaccaucccccggcuacucccaaucuuccucauguuuacauaagccuauugaagguagaaaaaaaaaaaaaaaaaaaaaaaaaaaaacucaagugaaaaccacuggcaacaagaaccuuaagcuuugccgggcgugguggugcacgccuuugaucucagcacucaggaggcagaggcaggcggauuucugaguucgaggccagccugggucuacaaaguuccaggauuauacagagaaucccugucuugaaaaacagaaaaaaaaaacaaaaacaaaacaaaacaaaacccuuaagcuucauggaugacaucaaacaguuaguguucuguuaaauaacuggaagccugucuaccugcaguggaggguuacuguagguaauuacaaauuggaucuaggcuguggacuuaaaacucaccuacacagaaacacaggauuguuaguuacaucgauauaugacacaccaccaccaccaccaucaagcaaaaaggaacagugacagaggaaaggaaugcaucagagggccugaggaaaaggucuggcaaaugacagccaaaagauccacuuugcaaggcauguaagguaacuggauaaugucucaaagagaauucaaucauuuuacauguaguuucauuuauuuuaugauaugaaugaaaaaccacuaccaucuguaaccuucaccuagccuuuuguaaccuagcuaagauaaaaguccaucaaagagcaugccaaaacauaauacgcagcccaaacaagcccuagcccauuccugcucagcuuauaauaugugggaaucuaaauaucacccaucuuaauguugagguuuggucuuuuguuaugcauuguaaugguaagugucagcucccaagaccugguugcuccagagagaguggacaggacagagucuacacuuaguuccaaaugacacuaugugacccuguccucaacuauuccugauugguaaauaaagaugccaacagcuaauagcugggcagaagagacauagguggggcuuaggguucuaggcuucugauggggagagaaccacaagggggagaaggugaagagaggaagaaggugccguggguuaguaaaucaggaaauaauggccacguugguuggcuaauuggaguuaagagcagcccagaugaaacauggcaaauuauauaguaggauuauuggcugggaaauagacaaaauagcauagaggauagcuaucuucccagcucuugugcuguuuaaggcuuaacguaaauauaaagguugagugucuuuuaucugggaaccaaaugaucacaggcaggguagaaaccccggaaugggacaaaacauuucuauaacuucuuacuuguuaaaaauaagccaagugaaguuaagagaaacagauaacucauccagaguuacaaacuuauguuucauaagccugguuaccucaaugagagccuggcuggccuccucacucagucggggcaugaugguacuaugggcauaugcaauguagucuuucagcacggccauguccaggaacuccuccuccacuugcuccucacuuugguaguacaaugaaaccaggugaugagcuagacgccggucauaugccucauccugagggucuagcaugaggaaaaugagaucaaaccugacaagagaaaaauaccaucuucuuaguugagacacuaaaacguaccuacauauaggacuuaaaagguguuaaagcggggcuggugagauggcucaguggguaagagcacccgacugcucuuccaaaggucaggaguucaaaucccagcaaccacaugguggcucacaaccauccguaacaagaucugacucccucuucuggagugucugaagacagcuacaguguacuuacauauaauaaauaaauaaaucuuuaaaaaaaaaaaaaaaaaaaaaaaaaagguguuaaagccaacuguacuguacauauucccacagaaagcugccauuucuccagcugaccagucccuaguccugccuagguaagagcaaaguaaaaaaguuauaacucucuucugagaaauggauacaauauacaauuggauauuguauuuggauaaaaacuccuucuacuguuuugaggacauaggaagguacuucagugauagagcccuugccuaacacaugggaggccuuucauuaaaucucuaguaccacaagaaacaaagcaaauuuauuagucaaauaauuaagacacauaaaucuugccaaugaggcccgacaaaccaaaucugagucaguguuuaaugucaguauagagacuaauagcaguugucgaccgcuucucaaucuccaggugucaauucuaagaauaagcaaacagaagcauuuauuauauaaaaauguuuuaguaccuugacaacaaugugugcgguaguuggauauuuucaaugguuguuuuuuuaggauuccacugagacucaauaggauuugcugcugccaggacagaggugcgcgcauugagcugacagaugaucccagccuaucagaggaagaaguagaguuaaaagccuuuuccugacucccaugaggaggaaaaccaucuucaucugacauuugcucugcugguucugcuuuccaagagucucacugacuucagugcauaaugauaguacucugcgcucagauucacgucuaagauugagcuuagacauaauuauucugcagccacauuuuuaguuuaaauuauuuuauguacuggguguuuugccugaacgccuguuuguguauuacaugugugccugguaaucuuaagaguucagaagagggcacuggauccuuuggaacugcaguuaccgaagacagaugguugugagccacaugugggugcuaggaaucaaauccagguuuucaggcuaagcagcaacugcucucaaccacugagccaucccuccagccacauuuuucaaaucagaaagcaaacugguaguaacuuuaacacaaacucagguuuguaagcacuacauauuacagaguaaaagcaacuaacguaagaaguuucaaaauagaacuguaacugcaaacuguugugagccugcagccacaguggacaucagcacucaccuuugcaauggacagagucugcuguuccaugaccucaugcagcacagaccuugugcuuucauucauuuugucaaacucaucgaugcagcauaucccauugucacucaggacgagggcaccugucuggaggacaagcugccuggucucagggucuuucaucacauaggcggugaggccgaccgcacuggagccuuuuccagacguguacuggccucuggggaccagguuguacacauacuguagcagcugggacuugcuggugccaggguccccacacagaaggauguugaucucagcacggaauuuaccccucccagugugacugaaauccuuccuuguuccaccaaagagcugaaguaagauucccuaaauaaacaaauaaauacaucuaaacagucauuuguuguacuguauaugcuuagcuuauguucuagagguacuuuucuuuucuuuuuucgagacaggguuucucuguguagcccuggcuguccuggaacucacuuuguagaccaggcuggccucgaacucagaaauccgccugccucugccucccgagcgcugggauuaaaggugugcaccaccacgcccggcugguacuuuucuauuuuauaaguucaaaguauuaccaaaaaucaucuaagagugcucaggccauucuacauauuccuaaccauuauaaaccuaaguaaauauuguccuacaacuugaccagcaugaauccuuguugugaccccacauaaccuccaauguuuaggaacaugaauaugcacagcacagauaaguguauauacaacaaaacaguagcacucaacuauuaaccaaggcaggggucagugccuugcuauguuaaggcgaacaguuccuacccauagaagacaguaacaguggcaaauauaucuuaguuacuugauucuaaguaacuguaaaucucaauaccaagcuaaaaaguccauuguuaccuuuuugauaucuucauguucauaaaugcugggagccaaggcugaagcaagccgcucauaaauaucuggcuuccuggaaaguuccuuaagcaauuucacacguuucucugaaaaaaguuucuguucugcuucuucaucaaggccaugcagacguuuugcauccguuuuccgauaaugaaugacaucaauguggguuuuauagacagacuucacguugcucacucuuggauuaacucgaauugguacugcucgauauaugccuaagaacauauguaggagacaugacguuaccucucuacuucucuguaagcucagucgacagcgaaggucagaccugggggcuccaucucacuugagcaccccacuaccuuuuaaucucccaggcuaaggcccccguuaagaaagucaagauacagaagaaauagucaaggagcaaagaaacacagguuuuuaagaacagacccaaaaucauauuuguaaccaucuguguuguaugagcuuagggaauuaucugcauaacuacucuacacaauuguagguucaaagugaaaaacaaaaaggcugugucaugacaguauuuaauauaguaaugugacuucccuaaguuaaaaguaaaaagaaucuacuuaguaaucagcauggaagaacaagagaacuuccauaagcuguuuuccugacuuucaccccaauauacaaaauuucaaaaaaaccagcacucaaaugcaaaccagauuacaauucacccagaguaauguggacuagguuauuauuaaugacauuuggaacaguuuuguuccucuaguaauagcacugaugagaagggcaaggagugggggcaagauaggauuguauggcucucuucuauguuggggaagaaauccggacugaguagcugggccagugagcccuagacgcaggagccagggaucccugggcucaauucuccaugaagaacaaugcuguuacuuaacccaucacucuugaccaacugcccauauaccuccaaaauguagaaagucugccacaugccaacggcauugaaaacagggcacuuuuugcgugaagagaccgcacuaaugcagcaaugaacuauaagaaucaaaaagucagcaguagcuuugcccuguguacaaaguggucuguccuacucuguaaguaaugcuaauccuuagcuguacauguaggaaauaguagaaaagcauuuaugaacccaaguuggcauucugucccugaguuacuaaauguucccucuuaaagcugcucuugugacgucaacauuaccaaucucagacauauacaaaguucugagagaucuauauaguaagggcccaccaggacccugaguucuaaaaccugcaucugggaacuuaaaagguuaaauaaacaguaguaagccauaguauaacuuugucuuuuugugacaaaccuacauccuuaccugugacguucacucuguccccugguugaaccuugucaacaaggucauugugggcaaaaaggacaauagugugaggugucugcccagcaggcaugucuucaggagacucuugaaguuugaucugcagaagaauaaagaguaaaauuggagaaacaaaguaaguaccauggaaaacaauuauaggucuuuguauauagcccauacaacgguugagacguagcaagcaacacugaagccucagugugcucuaagcucaagucauuaacaaaaccaacagauaugaaaagagcagaauuccacugaggaaggcugaguguaaacugacaaauuaaauuugguagaggauuuagaccaaggcagaacacagguagcagugugugcgggggaaccucacccugggugcugaguggccacauaccauuugcuugucagagaagaaugaucgguuguggaucagugccaugcuguggguaguguggcagugcacacaacugcagggcucagcaauucugccucgaucuaucuccacccggguggugugggcacagacuuggcauuggaaaaaggccuccugcaucuccggaaucagcugugauguucugaugaccaugccacugauggugaugagcugaucaaugucuggaaagagaaagguuggcuugucuaccagccacuucccuuagcccacucaagccuggguaugccgcuaaaacagagucuuaacucaugcagaaguauagaugaccaacagagauccagcaugcaccaucaccagggacagcugguuauauccucacaacuagccuaggauguucugccuauguccagccuguuuuccuucuucucagcaccaguauacugcugaaucuuuucauuuuaccauuucuuuucucucuuucccccaacaccccaucucgugaguauaugaacacaugcaugccacaguccgaauauggagaucagaagacaauuuauggaagucaguucucuucuacuaugugggugcuaggaaucuaacuuguguugucaggcuuagcaucuuuacccauugagcuaucuuguuagcuuacugcuggcccauguuggggccuuuguuccucaggugugcugcuuagaagacaucaacaggugagaaguuugauguguagguauauugucucccagccuuucaucucaccaacaaagccaccuggaaguccugaaaucucagguuaaaaaucuugggcugaaaaugcuugugguaugggggauagucugcuuauaauuucagcaccagggagaagaaaaacagaauuuuagggcuugcuggccagccagauaaucuagucuccuugcugaguggaaaaaacccuuuagaaaugauacccucuggcuuguauagcauguccugacacacaagaacagccuggacucuagaccuggacaacauggacaaagcauuuaugaccccggggaucucugagccgcucucugucaccuacaaaauggaggaagggcauaguugaggacaucauaaauacacacaucuauuuuuguaguuagugucuacaaggaaaaaagcacuuugccucucagcaguaacaguaccuauaaaacaaaugucuuuuaugcucuuacuacuucuacacuugcuuaugccucuccucuauuuguuccuuucucaacaccuuugcuggacucaaaggcccuccaccccaccauuccaguguugacucacaaggccuuuaaauacauuucauccauuuccgcuaccuacuuuuugccacucuuggcuaauccuuuuuuuuuuuccacuuagaaaguauaugcaauuugccaacuucugaaauuagcugaucaaccagcaauccuugccuucuaaaaaaguauuuuuuguaaaaguagauuuuaccuaggagcuaucuuccucacuccuuuuuuuuuuuuaaugguacacacauagaagagugaucuaccacuaauuuacacuauaaccaucacacaugaaaacagguaauucugaccugcuuacagcaccauaaaaugucuaaguuagaauccuaaugucccagaauugagccaccaucagaaucuaaaugaacucagaugucaugugcuucacugaauuacauacacgaguagaaaaaucuuucucuucuaggauuuuccuacuuacuuugaaagaaaacuuaaauucucuguugagauucuaaauuuucuagagcuaggcuuuuuuguccuaaacacuggcucagaaaucccugcuucagccagucacagaugcaaacagcauuuucuacuuucaucacugauuucuguuaucuaaaagaaauucuaccacauucacuuuucaaacgguccaggacuuugccuauccccuuaggcacagacgcuuaccuucugcccauguaugauuuauccccaagcuagaauucuuucuuagguuuaaaggagagcucagacacuagguuugcucagcaacugcuuuuauauuugagccacuuuucgggucuucagaauuuuucaucagugaugaaaaaagugcauaccuacuaacuagcaauuuauuauauuugaauaaauuaauuacagaguaacaaauuguuaagucauuucuaucagguauuccaguuaaguuaaaaaacugcauaccaaguucaugaaaguauacagaauaaaucuuuucaacuuauaauuuaaugcuacacaauccuugagaucucuuucuacauaaggcauuuuacacuacuaaauauauuaccuucuggauucaaguuucucauacucuuugucuucaacgcauuaaaaggucugacuugaaucugauguucuaagauggagucaggauaacggucaaagaagaucucauugacagccaugucaaagguugguauaaccuccuguaaaaacaaagauguaggagaugaagaggugacucaggaguugagagcacuuguugcucugacgauaggacucaggucucagcgcuuuuaucagguggcucguaaaccccuuaacucuagcuccaggggucagaaacccucuucugggcuccacagaaucaggaguucaagguucucuucaacuacaaaacugcuccugaacacuacccugccucaccagcucccaauuaacaccccauccccaacccaaaaaagauaauuuacuucaugauacccaagaaaccacuaauaaaacucauuauuuuuaagaaauacuacucguuagcaaauauaaaacauauucauuuuaacugcaguugacaguuuuagaaaauagucaaccuuagcaagcagccuuuuacccaaauguaaaauucuccuuuccaggaaccuuuacuaugaucuggaagcucaaagucaacuucucaccuguggguaggagaugagcugucuauacagauuuuugcuaaaugauuuuauguguucgcaguucacauuuaaaaauggcucuccuguaauauuaaucuguaagacauauggacaagucguauuuuacuaauuauauuaucucaaaaaccaaaacuuucacuuguaaaucauauuugauuaccucuccaaguuguugcauguacaaagguugaguaauaucuaugccaacauuuucuucuucuuuggccagaggaucaguaaaacacugaaggaaucucuagauguagagaaacaauacuaagcauuaaugaacuuaggaauauguaacuauuauuaaaaugcaaaacaaugagaccagcaagauggucaguaacuaaggaugcuuggcuggaagccugacaaccugaguugauuuccauaacccucacagcgggaagaaccagccccuacaaacuggccugaaaccuccaaauaaaagcugugaagggcagguaccccugcccccagcaauaaauaugugacaaauuuuuuaugaguauauagcuaucuguacacaaaaauaauuucucuguuuuggguuugagacagggaucccauuaagaagcacaggcuggccuuggacuugcuguaagcauuuacuaccuagcugcucgugguggcaugcacuuuuaaucacacucagaaggcauaugcgugugugagcuccaggaaagacugguuaacagauccagcuccaggauagccaggggaacauagaaaaaccaucuugaaauaccaagaacuaaggaaaaaaaaaguauaucaccauuuuccgcauggcauaucccuuuucuggaauaaaaucuagaccacuaacaaccugcuauuaugcaccauggcuauucacacauagguuauacuuucacccgaagucucagacugaguuuuaguguacauaagcuuaccugaaaauucucuuuacauguugccacauucacaucuguuccccaaaucacaagcuuuuggccuagagacuguucacuugguacgaugucuucugcugcugccuauugagaaagcgaggauagaaacauguuaaugggaugaccuacuuuaugcucucaagguaacaccaucagagaucugcuuuguacucacgccaucagacugcagauccaccugcaaacccuuucgugcugagcccagaucuggccucugccuuacaggugugccucucaccccacuucuugggguuccuuccacucgcgagcugggagugccauaugucaauggugaacuaacaucaaaguccaaaggaauagcuauaaagacaagauauuuagcuuuaccaugaaauccccauaagcacaucaaaucccaauuccggaaugcuguuugacaauuuaaacagaauacuuuacugcaaucuuucauaccccaauuguaguucuacuauaaaguaugcuuucuuugcucacuagguccuaaaauguaccaacucugcuucucuccucagguguuucagugaagaaucuaucaguacacacagaauaauagcaacugguaaaccagcaaaaccgacggcugacccaccuaaagaaugcaucugaggagggcuggaaaacaaggcauucugugcaggugggcucugcaggucggcuccuggugaggugggcauuggcaguagcucuccgguggaagaaucuucgccucuacgucuccgauugggugacgaccugcuuuccucacuucgaacuuccgucauacaaaacaaaaaagacgaucaacgcucaagcuuagucuuccaggaagugccuuaggguagucauauuacuuaaacaagaacaccccccccccaaaacccucaaacuggaacagagggacaagguguaggaaaaggugggucaacugaacugaccacgccagacugccuggagacgagagcccaguaugugggugacagaggcuacuauaugcucaaggccugucaaccacacaccaggcucgaaggacucaggacuuuccacagugcugcgggaagagacacgaggcggaaagggggcagaugaaggagggaacucacgggacuggguuggggugacucguccgcgucggcugcugcggcggcucgggguggaugccggggacgacauggugcugugguugcugcgcgacaaaagaaaucuggcucucaguugucccgcuccgggaccucucguaccucggauccggguuaguugcaaacgcgcacaaaacggcgagucaggguucugcgccacccaggagaacguuccugggcccgcagggugaagcgauucccgccagccgcucugucgucacagcgaccgaagacgccuggccaaucaaagaggca

SEQ ID NO: 8113 - RNA, 14960 nt, Mus musculus
gaaaagcgccugcaaaagcaaaagccaaucaagugcagaagcaguuggccacaaggcgcgugcgcagugacguccucaguugcucuuuacuccccaaguuuauguauuucggggucgggggacaggagugcguauccguuuaaaagcaaagcuguuuagggaccgucaacagaacugguaauuacacgagaucgugaauacucgucauccaacaggcauuugcuaaguacccgguauaugccagguacuauucuggggucugcuaccuaagccagcaguccaagucugaucgucaggcagugaucagcuucccaccaccccaccccaugccuagcacacugcccugugcacaguagacguuccgaacaagucaaguaaccgacuguguaaaggccucuuggaacucucgccucggugcuggagcuguugacuugcagagacucuguccaacacagaucccuuuucaggcuauacgaauggcggcggcggcggcugcugcugguggugcugcacucgcgguuuccacaggauuggagacagcaacgcugcagaagcuggcgcuucggcggaagaaagugcugggggccgaggagauggagcuguacgagcuagcucaggcugcuggcgccgccaucgaccccgauguguucaagugagaaagcgggggucgggacuuugagcucauacucccuacagauaaugccggcuuuaggacuccucauuccugcaucugcuacucuaagauauccgugucucuuuaagggguuucaagacggugacccagcuggcgcgacuccuagagcauguccgcccuguggcuuucaguauucgcuaagcacugcauuuguuuccccaggauccugguggacuugcugaaucugaauguggcuccccucgccgucuuccagaugcugaaguccaugugugcugggcagcggcuggcaagcgauccccaggacucggugcccauaucucugucuacauccacaucagagacccgagguuagagaugggcuggguacuucugccuagaggguggccgagguggggaaggaguagagaaccucgugccggcuugucuuagaauugcucaaccugucuauaggccuccucccaaggucugcagacccauccaccuuucagggacuuuaguuggcuccaccuuucggauuguacugcuggaccaaagacugguccaagcaagcuagacuuggucuuucugacucccucucaccucuucaucaugccuccauugcacagguagaggaauaaacauggcuuuggucuccaucuaccacacagccucaaggaaguguucagagagcagagcagacaacgccucccccuccgagggccacgucuagcuccuguucaucucaggccaggcccgaacaccucucaucuggggauuuuuuuggguugcaggacugaagccaucugauuccuuugggacaaaaaguagaggucugacagaaagauucacccaguucucaggugugaauggccuggucaugagugggaccagguguaagcagaugguggugagcagaguguaacagggaucucagguccuccagccugcccauccuaucuguuacaucuguucucucugccugucggacccucugaaauacagcuuguccucccagacaaguggaugcaaguccagugcucauuuccugccuguaagugcaagaaccacauggaaggaauccaggugggguaaagugagcagucuggcccagugaaggcagacugucaggccuggggacucacacauacacgcugacccacccacuuucugaucaaugugugucucuggccucuaucacccuuucucuuuguggaagagaaacaaggguaaccuuucccucaggccugcagccucuccaggucugcuccauggcccuccucccaagcaccugccucccugcccccaccccucacccugguucucuugcugcccaucuucuccugucacaggcauuugauugucuaaucuguggguuugguguugaugugcacucugccgcuggaaguugccauugucccacaaggccagggcagcuuugagcuacaauaccagggcacuguaggccaucccagccaugcaacucagaacaaggacauguuuucuugcuuagucuaucaaagacacaguacuuuuagaauaugcaauuguaccggugcccccggaucauccaacacccccacacuugcacacuuuaaagaucccuacccaggcagaggauguaggucagggacaaacaugagggaucaugguaugcuauugggaacaugaccucagccucuucaacacugucccuuggcugauugcaaguauggcguagggaacagaugccucucccuagccuccuugacaacaccauuaagaaugacauuuuguggucauacacaucuacuuguaaacugaguuuucuuucauaccucauuuguggccugagguaccucugcagguauuggcaguauggguccaguaucagggugugugaguucccagggugcaugaguucccagggugcaugaguucccagggugugugaguucccagggcuuuucuagcugucccucuuccauagccuucccauguugcugcucucucucccaggugccaccuuuagguugagaaggcugaggagaaggauuggagauggacuacaggaugaaaugagaacuaccuggugaggacaggaaccacagacuuguuagcucuggagacuagaaagucccgagggacauugugaaaaaaggaagcuuaggaauacuggguguuguggagcacagguggggcuggaccuguagcucauaggcuaccaagugaggcauagagaucacugacuucuguguaucuuagcauccauaugcacaaugaccaaguauggaacggaaaaaguaauagguguggucagacugauccagcuggaggcaugugauggccugucaugucaaguuugugaccauugagguuugucauagcuuuccuggaggaacuagauugguauugcuucaggcugugaguuagauacuguucagccccgcgagucuguacaaugcugcaggcaucuugaugcagcagguccgccuagauugcuggacccuggcuguccauguggccuuuagugaaucacucaugucuaguacagcagacgcuggccacaguggucuggccgugcugaggaaagcaguuucaguucagugcuccccuauuuagaguuagggaaacuagacaguuugaaaagcugucucuccagaaaguacaaggugaaauuuugaguguagccagauaucauucauaaacuggacuauaaguguauggacacuuagauaagugucuugagccauaacagggcagcucuugucaagguuggauuuugaaggacuaguaugaaaaugaacacaacaucucaugaauauauauggacauauaaugagauaauaaucaaguugucccuugauagcuauagggauucauuccaagacuacuccuccccuacaaauaccaaaaacuacaaaugcuuucauauaaaguaucucucaugcaugcuugcuuuccuuuuucuuccuuccuucuuuccuuccuuccuucccuccuuucauuuuuuuuuucuaugcuaagaagugaacuuaggaauuuuguacuauguucuacccuuaaacccugguacauucguguucuacauacuagccaugaaaaaugccacugagcuacaucuccagaccuuucugauaccucugagucacaaaucugagaguacggguaccuggcauguuguagaaauuauuuaauucccagcccgggguuucuaccccaccuuaaaccaauuaguucccaaaugaaagacacacucacagccuuuauauuuacaauaagccccaaauggcauaacacccccucccucauccccucaucccucuuuucucagaaaaaggaggcuccccauggauaccagccuacucuggcacaucaagucacaguaggaccaagcacauccucucccacugaagccacacaaggcagccuagcuauggggaagggguccaaaggcaggcaacauaaucugaauuagaugcauugugugguuuuaaaauaugaaccaugcuaaauccagcuaugcaccugcaucaguggucucacccacccccauggccagccccaagcagccaucuugcccugguucucauggccagcugcugccaagccacuccugucagaaccccacucccagucugguucuucaucuuggcuagccuugccagagcuccaugauaaccaguccaccaccucauggccagcugugggagcauucucaccaguccgugcuaagcugugguuaccucuucccugguucuugguucuuugcccagucuucccauuccaaagccuggccaaauuccacccugucuauguucuuuccccacugcucaccugagucacugcaaauggaaaacaccagacaaucuuaaguuuaaaaucaacaguugacacaaccacugggggcugaaucuaucaucuuaaauucaucaacuauucuguuagaaaucuucugguggcggagaucaccaccaggugugauaguucucagucuacauccugccuccucuugcuccugccucacuguaccaaaagaggaaagucuccucuuccucucugacucagaaggccagccuccuccuuuucaccuauugauugacuucuguagucuuuuauuauccaaucaauuaauuagggaaaguuucucuauagugagagacaacccccaccgugccuggucaacaaucauuuuuuuaguugaaaauagauuuuuuucauacaauaaauucugauuaugguuuucucuuccuugacccuucucagaucuuccucaccucuccaaccacucgaaucuauagccuuucuugcucuuuuucagaaaaaacaaacaaacaaacaaacaaacaaacaaaacaaaccaaacaggcaucuuaaaacaacaacuacaacaaaacaaaaacacuccaauuauuaggggacccacaugaaggccaagcugcacagcuacuacauaugugugggggaccuagguccaaccccugcacauucuuuggcuggugacccagauuaauuuacucuguagguuuucuugugauguccuugacagauugggaaaauacuuuuaugaauuuguuaaaaauauuuucugugacuuugaccuggauuucuucuuccuuuguggcuguucuugcuauguuugaucuuuucauagugucccagauguuuuggauguuuugagccugaauauuuuuugauuuaacauuuucuuuggccgagucuuuaagaucugaaauucucucuuccauguugagguuuuuguuugacauccugaguuuuuuuauuucaguuuuauaucaauuuggguuuuuuuuuuuuuuuuuagugauucuguuacuuugucagaaucuauuuuugugacuguuuucuuuauuucauucaguuguauuuucaaguuuuuuguuuuguuuuuuguuuuuguuuuuuagacaggguuucucuguggagcccuggccacccuagaacucacucuguagaccaggcuguccucaaacucagagaucuaccugccucugccugcugaguguggggauuaaaggugaaugucaugacugcccaacuuuucaaggucuuuauuaaggccucucuuuauauccucuuuaaagucuuuaaauauauucccaauugcuauuuuuaaauucuugucucaugcuagggugcuuuucccagggccuaauacaacuagguugcugguuucuggacauauugucuugguuguucaugcuuguguuuuugaaauggggcauaggccuguggaguuacaguguuuggggugcuucuuaauguaugugucuggucuugucuuuauugggugaguguuccaaucccaguguggguccuaacgagguguagagucccagccaaaugugaaagcuguggcuuccuuggaagagagugguucuauguccuaggcaaguuuguugguuaagagguuccugguagaaagcaggucaguggggaguguggugguuugaauauauuuggcccaggaaguggcaguauuagguguggccuuguuggaggaagugugucauugugaagguaggcuuuaagauucuccuccuccuaggcugggcggugguggcgcacgccuuuaguccaguacuugggaggcacaggcaggcagauuucugaguucgaggccagccuggucuacaaagugaguuccaggacagccaggacuacacagagaaacccugucucaggaaaaaaaaaaaaaauccuccuccuaggugcugaggagucagucuucucuuguuugccuuugaaacaggauguagaacucucagcuccuccagcaacaugccugccuggaugcugccaugcuuccugccuugaugauaauagauuaaaccucuguacuuguaagcgagccccaagaaacuuaaaagaauugccuugguuaugaugucuguucacagcaguaaaacccuaacuaagauggagucauaaaggaauggagaugggcuggaaggaaaggcugagaggguggugggaaagcauguggggagcuuguguuuaauaaaacauggagucuguaaggggauggaucagacuggaaugaggagcucauaugggcaggcugcagcaggaguaagaguaagccuggagaggacagaaaggaagaugaaggaccuuaccuaagucucagccuugugugacaccuuugagucccuggccaaaggagguucuucagggauggagagucacagaggauuagaaaugugguaggaggaaaggccuucagggcugccaggaagaacugaggggacucugguuugccucauggaaaggaguugggagcucuuuguaucugagucaagagugagugugugcacggccaucauuauguacaucuuugucuuuuggagaguaugcucuggaaguaucaauaaggcccagagaagagcaguuuugacuagugacagaacagaccuuggaucacucuguguguccauccuucuuggccaccagacccugcccaccagccuugagaacagcugugcacacugggagaacugaaguggcuccuaccuggacccuuuaugugcucgggauggggaagccagggugaugcagaugugucccaccuucccugcagcacuuguagaucaaggacugggcagguuuaccaucugagcaguuucugucucuccuuguauagcuaacauuaacaacaccugcaugcccauguugucaggucacauucccaccaaaaaaggagcauggucucucggaaggaucaacuggaagggguagaagcagcaaaguacacuguucuuuaccugcuggcagcauucacagcagacaggaauuccggacuucagaggacacucuaaugcaaauagcaaggagggucucacgccauccuagccaaugucuagcuucagggaugcaucacgucaguaaugagugacaggcuauugccugugaaguuucucuauuaucaagagauauaacaugcugaauaauuacucccuguuccccuguguuguaggcuuucucaucacuuucucuucuauuagauucaguguaucugguuuuauauugauuuucucaaagagcuagcuccugguuuuguugauucuuuguauaguucuuuuuguuuccacuugguugauuucagcccugaguuugauuauuuccugcagucuauuucucuuggguguauuugcuucuuuuugaucuagaguuuucaggugugcuguuaagcugcuaguguaugcucucuucaguuucuuuguggaggcacucggagcuaugaguuuucauguuagcauugcuuucauaaguuucgguaugcuguaccuucauuuucauuagaucugaaaaagucuuuaauuucuuucuuucuuucuucccugaccaaguuaucauugagaagagaguuauucaguuuccaggcacauguaggcuuucuguuauuuuugaagaccagccuuaggugauuugauaggaugcauggcaucauuucaaucguuuuguauuuuggccguuuugugacugauuauaugaucaauuuuggaaaacguaccaugagaugcugagaagaagguauauucuuuuguuuuaagauaaaaugcccuguagauauuuguuaaauccauuugguucauaacuucugcuaguuucacugugucucuguuuaauuuguguuuccaugaucuguccauugcugagagugggguguugauucucccacuauuauugugugaggugcagugugugcuuugagcuuuaguagaguuucuuuuaugcaugugggugcccuugcauuugaagcauagauuauuucaaaguucaucuugguagauuuuuccuuugaugaguaugaaguccuuccuuaaauuuuuugauaacuuuugguugaaagucgauuuuauucgauauuagaauggcuacuccagcuuguuucuugggaccauuugcuuggaaaaaaaauuuccauccacuuacucugagguaguaucugucuuugacauggaggugcguuuccuguaugcagcaaaauguuggguccuguuuauguauccagucuguuagucuaugucuuuuuauuggagaauugaguccuuugauuuuaagagauauagugauuguugcuuccuguuauuuuuguuguuagagguuguuauguuugugugguuaacuucuuuugaguuuguugaaagaagucuacuuuguuuuuucuaggguguuguuucccuccuuguacuggugcuuuccaucuauuuuucuuugcagggcuggauuuauggaaagauguugcauaaaauugguuucguaauggaauaucuuaguuacuccaucuaugguaauugagagcuuuguuggguauaguagccugggcuggcauuuguguuuucuuagggucuguaugagaucugcccaggaucuucuagcuuucauagucucuggugagaagucugguguaauucugauaggucugccuuuguauguuacuugaccuuuuucccuuacugcuuuucauauauuucuuuguuuugugcauuugguauuuugacuauuaugugaugggaggaauuucuuuucugguucaaucuauuuggaguucuguaggcuucuuauauguuuauggacaucucuuucuuuagguuugggaaguuuucuucuauaauuuuguuaaagauauuuacuggcccuuuaauuuggaagucuucacucucuucuauaccuauuauccuuagguuuggucuucuuauuguguccuggauuucuuggauguuuuggguuaggaacuuuuugcacuuuucauuuucuuugacuguuguaucaauguuuucuauguuaucuucugcaccugagauucucucuucuaucucuuguauucuguuggugaugcuugcaucuaggacuccagaucucuuuucuagguuuucuaucugcaggguugucuccucuuuuuauuucuuuauuguuucaauuuccaauuuuagauccuggaugguuuuguucaguuccuucacauguuugguuguguuuuccuguaauucuuuaagggaauuuuguguuuccucuuuaagggcuucuaccuguuuaccuguguucuccuguauuucuuuaagggaguuauauauauuuuucuuaaaguccuguaucaucaucauuagauguaauuuuaaaugagaaucuugcuuuuccuguguguugggcuauccagggcuugcuguggugggagaacuggguuucgaggaugccaaguaaccuugguuucuguugguaagguucuugugcuugccuuucaccauuugguuaucuuuguuagccggucuugcugucucugccuguggcuucucccuccuguaagccuguguguuagcacuccugggagaccaguuuucucugggagaaauuuggguauggagauuuguggcacagggucagcuucagggugccgauggaaaccggaaggauccuguccccagcuguuucuugguucccauguccugauggcucugggugggucccucuugugccaggaauuugagcaaaagucguggucucaccugugcuuucaggugugucagcacucuugggagaucagcucacuccugguaggaccuguguauggagaguuguggcacagggucagcuccagggcacagauauacaccuuauggauccuaucccaggacacuccucguuuccuguguccucagggcuccaggcgggucccucuuaagccagguauuugagcagaagugguggucuuaccugugcucucaaguguguccaaaguccugagagaccugcucuaucacggugugaucugguccggagugcuguggcacacaguucagcuccaggcacagauggaaaccagaagggcuggucucuucuucuucuucuucuucuuuguuuuguuuuguuuuuuucgagauagcguuucucuguauagcccuggcuguccuggaacucacuuuguagaccaggcuggccuugaacucagaaauccgccugccucugccuuccaagugcugggauuaaaggugugugccaccacugcccggcgggcuggucucuucuuaaucaccacuaauuucuuagcuccagauaaccagcaucuguuguccuugacuauugaccauaaagccagagucaaaugaccaaagcuguugaguucugcuguuuccuggggcuggaaauugccccccuuguguagcguauguucccuguccaauuauguuaaauauuaauacaagaagccugugauugaacagggaaaagggagguggagcuaagaguugcagagauagggauagacacagaagaagaggaggaggaagauggaggaugaauaggaugauucagauucuccaugacuuuaaauagccacagguagcuauuauaucauauagggauagaauaauugggauaacuugucuaaucuaggugggcagcuuguaucauuaucaauuggcucugaaauuauuaggugagaaucuugugaauugcaaauuuauugauacauaaauaugacuguuuaauuauaagcaucuagauuuuugauuuuaccggguuacugggaauugugacagcuaauggugaggugugaggucauugcauggggcugguuugccagugaccugcccagggagucagguggagaugucucaguagcuucgucaagaugagaacacccugcuggagccauguggccugccagugcccagcauagcuugugaaacuugccauuucuuuuucaucuuuuccauaauguccuuuuuauauuacauuaucaccagcuuuguuuuccaacucuuucacuugccaagcagucuggaucuuggucuguaaauugaccuugaauuuggagaucaacaugccugucuccugggauuaaagggguauaccaccaagccuggaauuaagcuuuucuucaccuagaucuugcucugucccaggcuggccuugagcucagaucugcuuggcuuuaucuccuggaauuaaugauguguaccaccauaucuagauuuaaauuuagcuggguggguuuucaaaggccugcucccuuaaucugcuauccccuagaacacaggauuuggcuccauuucacuuccuggugccccuuuaaacucaaaccauauauuuucuauuuuuccuuucuaagcuugcuacgcuuguucaaaaugcucuuuaugagauuuaaccagagaacaaagucucuaucucuacugggcuuuuuuuuuuagacuuccuuugccagugcaguuaauauaaaucucuuuaccuuagccuuauguagacucuucagauaugggcaaaaagcagccaaguucuucaccaaaauaacacaaaaucugucucuaugccauauacugaaauucuucuccauugaaaccucuugggucaggucugcacaguucaaaucacucacagcaacaaagucuuccauauuucuucuaggauggcucauuaaaacacuuaaaacaucccauggcuuuccaaauccaaaauccucaaauccacauucuuccaaacaaaagcauggucaggccuaccauggcaauacccuagucccugauaccaacuucuaucuuaguuagaguuuuacugcugugaauauacaucaugaccaaggcaacuuguagccauuuaauuauggcuagcuuacagguucagaaguuuagucuauuaucaucaaggugggaguauggcaucuuccagacaggcaugguacagggagcugaagaguucuacaucuucaucugaaggcugcuaguggaagauugacuuccaggcagcuaggaugagaguauuaagcccacacccacagugacacaccuauuccacaaggccacacuuccuaaugcuaccacucccugggccaagcauauacaaaccaucacaaauagcaaaugguccauggccuaguuucugaaugggauaugaaaaaugaacuccuccaggucaguccauuuggauguugcuuugucugugcugcccacgagcauaccuaucccaccuugucucuguggaaucagugcuacuccguguuuccccugcaccagggcccaauuaaaaccacauuuaacucauucagcugagcagcacuaaggccuggcacaaagaacagggcaagagcaaagcuauuuaaaugugcugggucccucucaugauuuugugucuaaagcaacacuaaaggacaugucuucugggccuucccauugugaagaauuuggcuuacacaguguauccccuuuaauuucucugagccuuaaauuccucccuucaucaacaccuugccaagggauauaagacuccuuuucagucggccauuuuuugacaaaugcuuuagccaaccaaucaaacaaacuuugauacuguuuuuaaacugugggaaggaaguuuuuuguuaaaccuauauucuucucugagugggucccugucaaaaaacucagucugaucaaguuuuauguuucuuccacuauuaauuuucauccuuaaaaucuaucccuacacauagccccaaacugcuagaaugagucaucagacuuauuaagcccuuuaguaguauaacacaccucuuuagugauuacacuuucuauggccccucuaggagccugcuuagccuuaaaccugguucuaaguacccaggcagcuauuggugggcccuaaggacauugguauuguguugccuggcuucccuuuuaggggaggucauugcugauuguuugaauucccuuagacagagguagugaauccugcaggggcuggggugaggaugcagccucugguaaggguggagauaauacuuccugggauaggcaaaccauucaaaacugaguguucaaaguucucagccuuaguaggacgccccccccccccccccgccugcuucccaagguacagauuccgguuccuuaccagucagugagugcaccuuaacuucuacaccucugacaugggaacugaguuguuuguaacucaacaagucuuaucaugagggcaucaguuugauuuucugcaaauugaacucuauggcugcuuaagagaggauucucuuccacuuagaaaccuuuaaacuuugucaguuuauccagagaugcuagaggcaacaggccagcaucauuauuuucuuuauuuuucccacauauugucaaaauuuuuuuguguagugucacuacaauuuaguccacuggacaccuguucuguacaguagguaagccaggauaaucauuuaucuugaaaaguuauuuaaauaauucacaccaugaauuuuugguuuucuccaugcuacugaagagcauccaauaacuauagcucuuggugacuuggaaaaccugugccagauacauaaaagguuuauccuuaaaguucuauuucucuauagccacuccuggugugauagucuuuguuagucaggguucuuuaaaggaacuaaacugaugaaaugaaagcauguauuaaaauacuauauuuuaaauauauauguacagauguguguacaugugccuguauauauauacauauacauauauauguauguauauguauauauucagagauucagucagugauacaguccagcaggaaguccaagaaucaaguaguuuuucaguuuacaagauucagugucagcauucccaauuugcugcuggagucuccagagauucccucagggcuccuugagucuauguuggaauuccaaagaaggagauucuaacacuaccaaagaaaugcuucagcaacaagauaaaugaaccagggaaaaugagaacaaacaggcaaaaagcaaaaacugccuucuuccauguccuuucaugugggcugccaacagguguagcccagaguuagugcuggugcucccacaucauauaauccaguuaacgaaaaucccuuaccaaugugccagcaucuuagguuuuaguugauuccagaugucgucaaguuaacaaucaagauuacuaaucacauaugugcagcugaaacagguuguaugcagcaggaaggugggcaucucuccugggaaacgaaaugaugagcgugcugcagcuggagucuaccccggcccuaauuauuggguucugucuuuucaggaagaaaccgagguggccccauucuuggcaaugugaccauaucggcagaacguggaagccgugaaagacccauccagagaaugccacgccagcccagugcgacucggcugcccaaggugggaggaucuggaaaaagcaacucccgaagcagcccauaggcugggacagaggcugcacuugacaccgucuucaagacagaugcuauccaccuucacuccucaaacccuucugaggagcugaaugucuguagcuuuuugauacuauuaaaaaauuuagauuuagaaugaguu

SEQ ID NO: 8114 - RNA, 944 nt, Mus musculus
auccccacacucagcaggcagaggcagguagaucucugaguuugaggacagccuggucuacagagugaguucuaggguggccagggcuccacagagaaacccugucuaaaaaacaaaaacaaaaaacaaaacaaaaaacuugaaaauacaacugaaugaaauaaagaaaacagucacaaaaauagauucugacaaaguaacagaaucacuaaaaaaaaaaaaaaaaacccaaauugauauaaaacugaaauaaaaaaacucaggaugucaaacaaaaaccucaacauggaagagagaauuucagaucuuaaagacucggccaaagaaaauguuaaaucaaaaaauauucaggcucaaaacauccaaaacaucugggacacuaugaaaagaucaaacauagcaagaacagccacaaaggaagaagaaauccaggucaaagucacagaaaauauuuuuaacaaauucauaaaaguauuuucccaaucugucaaggacaucacaagaaaaccuacagaguaaauuaaucugggucaccagccaaagaaugugcagggguuggaccuaggucccccacacauauguaguagcugugcagcuuggccuucauguggguccccuaauaauuggaguguuuuuguuuuguuguaguuguuguuuuaagaugccuguuugguuuguuuuguuuguuuguuuguuuguuuguuuguuuuuucugaaaaagagcaagaaaggcuauagauucgagugguuggagaggugaggaagaucugagaagggucaaggaagagaaaaccauaaucagaauuuauuguaugaaaaaaaucuauuuucaacuaaaaaaaugauuguugaccaggcacgguggggguugucucucacuauagagaaacuuucccuaauuaauugauuggauaauaaaagacuacagaagucaaucaauaggu

SEQ ID NO: 8115 - RNA, 944 nt, Mus musculus
accuauugauugacuucuguagucuuuuauuauccaaucaauuaauuagggaaaguuucucuauagugagagacaacccccaccgugccuggucaacaaucauuuuuuuaguugaaaauagauuuuuuucauacaauaaauucugauuaugguuuucucuuccuugacccuucucagaucuuccucaccucuccaaccacucgaaucuauagccuuucuugcucuuuuucagaaaaaacaaacaaacaaacaaacaaacaaacaaaacaaaccaaacaggcaucuuaaaacaacaacuacaacaaaacaaaaacacuccaauuauuaggggacccacaugaaggccaagcugcacagcuacuacauaugugugggggaccuagguccaaccccugcacauucuuuggcuggugacccagauuaauuuacucuguagguuuucuugugauguccuugacagauugggaaaauacuuuuaugaauuuguuaaaaauauuuucugugacuuugaccuggauuucuucuuccuuuguggcuguucuugcuauguuugaucuuuucauagugucccagauguuuuggauguuuugagccugaauauuuuuugauuuaacauuuucuuuggccgagucuuuaagaucugaaauucucucuuccauguugagguuuuuguuugacauccugaguuuuuuuauuucaguuuuauaucaauuuggguuuuuuuuuuuuuuuuuagugauucuguuacuuugucagaaucuauuuuugugacuguuuucuuuauuucauucaguuguauuuucaaguuuuuuguuuuguuuuuuguuuuuguuuuuuagacaggguuucucuguggagcccuggccacccuagaacucacucuguagaccaggcuguccucaaacucagagaucuaccugccucugccugcugaguguggggau

SEQ ID NO: 8116 - RNA, 3213 nt, Mus musculus
ccacaguguagaccuuguuuauuugcaaaguauuaaguaagcuacguuggaaaaucgagucaguauaugucaugcucacaucccaacugauccugacgaugacucugcaaaacaaagcacccagcacacuccacacaggcauucucuauacaguccacucugggcuucauuggcaugguucaucucugccccacugggcaucaacugguacccucaagacaaggcuguagccacagaagccugcccagccagggcuguuggcccaacuuccucacaggcccugacugggcuggccaacuuuccuaacugagcuuaagacaucucuaugucccuuccacugcacuaugucccagaccuaaauuugagaacauagucgguacgucuagcccagaccugggaucaaacucuggucacggguagauacccuaggaacccaaagcugugcuagcuacauucucugcccucuccagcuguccagcuccuuggccguagcugaccugaguuccuugucagcugccccguccagaggacaggcuauagugcccauugcaguccucucuaggcuggccaucacuucugcagucuccucaaauuugcauuuuuauuuuuagcccuacacucacugaaaauacucugcaguuagauccauaaaagccuagccagggcacagccacaccagggacagaugcugcugcccaguaccugugucugugucuggaggugaaaaucucccaagauuaacuauguggauaaaaccuccagucacauuacuagagcacaaacagaaauguuuaccccaauguaacucaagaagaaauggaaucuaauugaagagggaagucuggggcaagcaccaggaaauccuuuggccacaaguguugcuagauuggggaaguguccccaaaggaagugggagacauaugcaagccaaaagcccagcccccauggaagagcaguacuuccucugcauauugucuuccaaauccuguccuaggccaguuuauccaggcagccacuaaaaacugccagacucaauuaucauaauaaaguaguuuauuuugcucugauaaaggggauuuuuauaauccacauaccccaacucccaccccaaagccuuuuccguuggaaggaaggcugcagcuuaugaaaggaaggaccuuuguccuggcuguggcaucguuguugggaacaaaauguccaggaacccagggcuguuugcuuuaaccagaaugcuucuaucacugcagaguuaugaaguggagagcguccuugggaaggagaugggaccuuuacucugcuuuguccaguccaucacuacacagcagagcagcugugucgucacccuggaagagauugagcugcugaguacagagggagccacugcugcucagccuccucccugacaucugugcgcuuggcaaggggcuguguguuaacucaguguuucuguuuuuaaauuuaguggguuucuuuucuuucuuuuuucugguaaagagauuaauaggauaguuuuaaauuaaaaaucaagauaccucuaauacacauuuuuuuaaacuuuaccuuccuacaaguuugauaacauguuucuuugaguguuucucaugucuucugugucuucauuuugcagcuacuugggcuuaggaaaugugcuuuguuguagcuuuaaaguaguuacaauuuaucaauauuauauauguuuuuucuuugcaguaucuaauauucucugcuagauuguucuguaaagcuucagccaguaucucauauugaaauauuacuguucuguuacaauaaauaaauguccaaccuaaacacuuugugguuuuaguguucugggagcugccagagguggcacugucacccauacaauguugggugugaggagagcuguauaaaagagaaauuucuguaccuuacuccacugcccaccugucagagacccugaagaacugcagagggcaaagaucacagacucacagcaguccacaagccugcacuuugggcagggauuugaauuacaaacaaagcuauguauuuagacccuggaggguuuguguuuucuguacaacaggccgugcagaucagggaagggguuggaacaaccaguaucuuaguagaaaggcacauagcuuugggggggggggggguuaagcccgcaaacauuacaauuacuggcuuuuggggcugcccuuuuuauauacuaggauauuaauuuguacugguacacauuuuuaaaucuacacguugucccuagauugaggaaaguagaggcaacgaggaaucaaguuucagacucccagcucucuuccacccccucacccuucggcaaccaccuaaaaguuaggccaacuguucuccgccccaggucagccuacucugggaucacacacaugaauuagucaugcuuucccguguuccuuccgcgggcaauagagaccgcgaggaaacgcguccaucuccuuaccccgugugggcaacgcaccuggucggguggcucccaggugcuugcuuuucccuggugaagucucaguauguugugugcgggagagaaugaacauaggaagcugcagcgauuuaaaugcuucuuuauucuuacaaauacuguaaaaaugaauauaaaaagcaugcgcagucucuuccucuuaucuacaaaagucugucggaaaugucuuuucuacaaauguaccuuagcugcaaugguaauaagacguagaaaaugcuaccauuauaaaaaauaauuuaaggggaaagauuaauauagcuucucucgcaguccagugcccaagcugcagcuuccugucgcucgcaggucccaaagaaacuagcgauucgggcggcgucugcuccccgcugucggggucugagguauaggucguucagagucucaaaggcccacgccgcgcguuaccggcagucggcgccggugggcggcaggaaaggcgggcugggcaguuuuuugaagaacugccggaggccagccaggucccgggugagcugcuccacgcgcugaugcagcuucucguucucggccgacaacuccaccagcuucugcugcaucuccugguugcggcgcuuggccuugucgcggcucuugcgcacagcgauguuguugcgcucgcgccgcugccgguacuccgggcugccgcgguccggaccccucuugcccgcgcccuuuucucggacugugccgggcgcgaggcucggccccgggcugcc

SEQ ID NO: 8117 - RNA, 457 nt, Mus musculus
acucuguauaucuuuuuuuuucaaaaggagcgcuggcaaaguuuuauuaaaggaaaacuuucuuguuuacuucucaccagucuguucuggcaugcuucuaauaauaucagaaucaccugggucaaugauagccaguguccauacucuguaguguuuuccauucgcugugcccaguucaauauuuuugccacuguagagauggaucccaguuuuagccaacaugacauaguacucuauuucagauuuccucaaagcugggcagcuguuggcgaggauaaccaacuuggcuuugccuugucugaucaucuucagagucuguuuguagcccagcacguacuucccacuguucauaacaaguuggagccuagaguugaucgacuccagagacuuuuccgucuucuuugcggccaccaucuuccugccuuaggugugggacaacccccaagcccgcagagcu

SEQ ID NO: 8118 - RNA, 47129 nt, Mus musculus
uccaaaacgguuucuauaaaaaucaagauagcgccaucccaguguacacagggugaagcauaaacuguugaucggcuucuggaugccuugcagaaaaguguagugcucacauucugagcacucauccuuggguuacuuggaaggaguuuccaucuucaucuguagacauggagauguaacaaggccuugggugugauuaucuaauaggagaaaugguguaaaacuuuuggugcagugcaauuuaaauugucacauuaugaaguagauucagauauuugaaagauacagcuauuuauaccuuuucuugaagcacaucagaaagaauucacuuacuggcaauugcacaccagcauuuuuauuuacauagaacauacagucgucuuauaaauaugccagaaauuaucuccauguuucagaacacaucaguguaaaagcacacaaaggaagcuuccccuuucccuguuucuugcuuguuuuccuuuguacaaaguguguagugcuaaacaucuuccauuuaaaauuuauuugaaauguuggauaaaggugcauuucuuuguccuuacaaauucaaaaaggcuacagugguggucaucuuucuuaaaaaauuaagucacugauaccuaauaguuggauaagaggguauuuuuuuaaaguaugcuaacacauuuaggcaguguguacucacugucaagccgguacuguaucaaacugcuuuuaugauuuugagauugcucagugggcaucauaaacuaaagauaacauguucuuguuuuccuugcuaauaguauuucauaagaugccugaccauaaccugaaaagaauuuuaguauuuauaaaacgaauguaucauuuggucagagacaacuagauacaucaaggauuucuacuuagguuucaauuuuuuggguuuuucaagacaagguuucucuguaguucuaguugucuggaaccacgguggccuugaacucagagauccuccacccacgucugccucccaagugcugggauuaaaggcuugcaccaccacugcccagcuaggugagaaaacuuuucaaugcuuaguuuaaaagacgauuuguacaggcaguuuucacaaaauagguuguaaacauuacccuaacccccugaaugaaguccauaagcuuuuagguguauguauguguguguccagauguuuuucuuuaauaaagguccacuaguguuuucauaccauuagucuaauguauucuguuggcguggaacuaaaguagcuauuaccaguggauaaagaguggaauuuuagguuccauuuaacugugagucuuggagcccaauuuaagugccccauuuuaaggguguaucuggauugcaauugcuguauuuguaaauaagagaaauuuagguuaucauuggaucauuuagagacuaauaggacuagccauuguuacuaacaguucccaauaguuguuuuuaaugcaggaagucauuaaauuuucaggcuuuuuuagaaucaaaguauuuuuaauuucuaaugcaccagggcaguguagacucaggagccauuaauuacacagucuguuccuacaucuugaugagucuuuaagaucuuauauauuucuugaaacugcaaaagaguuuuguuuguuuuuuaagacuauaaaaaugaaggauagguggauacauugauuaugugaggaacuugccaggcuccaucuuuuaaagccaggucagucuauauaaauagugcaugcauuauagucaugaaauguccuggagcuuccuuucugaggacuacagcugcagcuuugagacuaagaaaguuacaugggucauaugcacaggcaaacugcuuuguacaacuagaauaucaauugcucuuguaaguucgacugaaacggacagacuugauauacgucauaggaaacuugaaaaaugugaauuaaacaugugauuuguuuuguaacgaauaauauacuuuucagcuuauagccagucuucacacgagcaaauucauacacugcaauacacaaaaguucauaaacuucuacucagguaggcagcagcagguucaagucagcaaaguguggauaucaaacaguucuguucaccaaagaugagucucucggauuucagcaauaauuugacuggcuccuuguaaugccugcauuaaaagauauaaaaacucagguuagaauguuacucugaauuuuguaaaguaauuucucccuuuuucaguguuuaaaaaaagcaguaucucgucugaaauucuaaccuaaucaaauaccagugugugaaggagacagaucagaauguaacuuuaauaucuugcauguauauguguacaucccagggagaaagauugagaacaauuucacaguuaccuucagcauauccgcugcuucuuuucuucguugggccauguccucggauucagucagaaggucaucuaauaaggaugacuuauacagcugcccuaccaguucacucugaagaguaucuuucacaugauuaaccaaaaaaugcauuacugccuuugggacacuguaaagcaaggucaaaucaugaacuuuugguaacauuuauauuuucaaaaauuuagaucagugguucucaaccugugggcugugaugccuuuggaaaucaaaugacccuuucacaggggcuguguauuggauauccuguauauuagauauuuacauuauuauucauaacuagcaacaaaauaauuuuaugguucaugucaccacaacauaaagaacugugauaauggguccaaacaaaguuaagaaccacugauuuagucuuuaacuagaguaugccuuuguaaaguaaugaaguuaaauaacacugaauauuuaauguacuuaguaaaauacucuuuaaguguucauuuaauaaagcaauaagcaaagucaaaauccuugauauuuuagcuucauucaucucacuuaucccauaaacacaacaaugaccauuauucuuaauagcccaaaaugaaauaaaauauucauagcaaugaguagauauacaaaguaugguuauauaauacagcauuguauucaacuguagaaaugaagucaauuguaaaaaggauccaugcuguagcaugaacaaacuuuaaaacacacugacaaguagcuaagauuuaaggccugaucuacaagcuaaaucccauaccuggcaccauugcugggccaagaagcuauggcuagagagaucaaagagaccccagaagagaaccuaccacuuaauggacauagcauuaaaccaauuccuaaugaucuauuauuauacccauagauuauacaucuccuaacccucaucugagaaauuguugguuauagauggugauuaacaaggagauccacaguggccaagaugcagagaauaagacauuguacaacauuucgcccuaaguggagcaccuauaucuccccccaaggauaaaggaccauuacagaagagguguggaugcaaauaaacaauuuuggauacaguagugcagcugcaaauaugaacucagcaguugugacagcaugcacaagacuggugcaagccuaaaccagaccacaagagaggggugagggauacaaagacucaucgccagcagaggagcuaguggcaauucucagcugcugggagagggucagagcauagcugcugagagcucagccaagcucuaguagaaggcuauacacccaggaauaucaagcaacacaaauuggccuugacuggggaaggaaaaaacaaacacaaauuugggugagaaagggcagagaucuaggaagagguccgcgagggagcauaaaaacaaaaaagaucaaaauacaaagaauucucaaauauuucuuaaaaaggggagggacacucacaugugaaggaagccagacaaaaggucacauauuauuguguucccacuaacaugaaaugucugauaggcuaauucaaggcauggcaccuuagaggcaaggcaaauaggaaguuaugacugacagaggguguguuuuacuuugaguaagguaauaaaauguaaccauguagacuacuagaacacaagaauguuuuucagagcacugugggaauugaauccagggcuucauaaauacuaaacuauauuauucuauacuauuccauggaaccacacugcuacccuuuucugauuuuugauuuuguuuugagauggcggaauguguauuugugaucauucugcuugaggcuuaaucuuccuaacuugugacugcagacauaucacuauuccuacauccuuuuauuuuuaauauuuuucagcuaaugcauaauauuuuaaucauuccaugucaacagacuaagucuugcuaucacaguuaacauuaauauuuagaaucaaagauaaucuaaaaauuuuaauguauaauucuuaaaaagacaucacaaacucauccaacaguauuuacauauuaaauaauacuaaccugucuugaauauucuuucugacaauuagaaaauaugauuugauaagucuuucaauaaccucacaaucucgcuguucucgggcagacaguuuucuugcaacuggaacuggcuaaaagagggaaaaauauuacuucuaugcuauuuugaaauggcaacauuuaauauuuaaaaguuaaaaauuuuggugacuucaauuucuucuguuuaaagaaugucugcuacuaacuugguucacuuguagauuuaaacagaauugugguggcuuaccacaucuagcaaauugacagcauggccuuucuguggacuugcuggcauaauuggaauugguuuugauuuuucuucagcaaguaauucuucagcuuuugaaguuuucagcauuccucuccaguugccuguuguugguuccugaccaccgucuccaaucccaccaccugcagaugggaccugaaaacacauuguuccaaaccuauacucuguauauuuaacaacaaaugaaguccauuuucuuugauggcaaucuagaacauacaggugguaccuaucuggaauauauucaaacagauaaugaagucagaaauaaugguggcacuugucugucacuagaaaccugagagauucuguuugaagcugucaguaagccaauagucaauucagguucuauuuaauuacuuuucauuuaguauuacuuucuaaaacuuuaucuuucaccauuccucaaacacuaaauuaaaugcacacacaagaaacagaacuugcccuugguuucaucucaucaaagcaaucuuaaacucuuaaccauugaacuuugaucuuacagugcugugagcuuauggcucuacauauuucuaaacuaguuuacuauaguucugauuaucaaaaaguaaaacuagaccucuuuaauaaaagaaagacuacauccauagaccuaacuauuacauucccaagcuaccuacaaugugcaauguaacauaaguacaacauaaccucccucauaaucuguacccgagaaagagaugcggcgauaguccucggcuagccuuacaaccuuauuuuaugaggccuugauuucuaagagaaaaaacaacaacaacaaaaaaacccugccugauuaauauagugggaaaaacaacacaucaacauuuaagaauguuuucagauccuuuuuaaggucuuauaaauguaauagaagauuaaaucauauaaauguaauggaagagucuaugguacuuguaagaaaaaugaguuugggaaaucauucaaauuugaaaaaucugucaaaaugucaaaaaagguaaguuaugucuuuauauagauguuacugauaaucauauuuuuaguguuuguuaaauacacauaaauuaugauaaaugaaaucauaaggaaagugagccauaaaugaaauaaaacuuaugcagugauugguauggcucucugaagaccacaacugaaagauaggagaugucuguaaagaucagaguaugagaaacuuacaucuggaaaguaaguauuguaagaaauaggucuguauauccuacacaugguuuccugugaaaacuauuaccaagccuuaaauucucaauuuccauguuuugacucugcuuaagcuuugaaagcacaugugagaguuacugcauuagagucauuacagacacugacgacggacacauagacacauagaaagcacuggagagcugaguccuuuacagaggaaaugucccaaagcaccauuuccauuccugaaaucuuugguuuuuugagacagguuuuucuauguggcucuagcuguccuggaacucacucuguagacuaggcuggccucaaacucagaacucuaucugccucuucuacauacccagcuccaucucugaagucuuuacgaagaggacccugaaagcuaaucuuuaaaguaacagcaguaggagaggcuauuguuaguaguuaagacagugcuaaagcuagacuaaugccaccuuacaagauaaaaggaacauuaagaccauaacacagacaacaaacaauggaggccacuguacaaacagguucugaugaacuugaauguuuuaguaagaaccaaaggcaccaacauuuccaucugaagcaagagacucacauuuuuaguuucucuucuguuguccugaauuaacuguuaaaagauauguuaaaacaugcaauuuaacaagcaaaauuuaaauagcaauggcuugaaaauuuaaaguagacaacuuucucuuagaauuauuuuucuguugaucuucuauauagcaagcagagcaugucagcaauacuuugauauuuauagacuucgcuauagaauuuaaaaauuuggauuaggcuaauagucuaacacaguaucccauaucaauauuguuuuauucaguguacugucuccacacuaggcaugcaggcuuagauuaggaaucagaacagaccuugccaucagccucagcagaagcagcaggggggggcuccugggaggcaggugccaaagcacuuggaacuuuagaagacuaaagguaaaaaugcaggggggaaaaaaaaaucaaggaugccaaaaaugcauuuggaaacauuuuauagacaaaauuuccucucucuaaugagacaguaaagugauguaaaccagaagcaaccauggagcuguguguucugucuuaccuccuauaccacugucacuguuagcuuuucugcagaugaacaaguaagaaaacccaaaucccacagcgacugcugcugcuuuuuuugggguggggguggggguugaggggguggggguggaaggucacuuccuaucuuuucugacaaggaacccaagguaagagguacaacagcuguugaaaguuacugccaaaauuuaaaugacauauauaguugccuucucuuugucuuucaaaugcccuuaugacaaagucauugcugaccaaauaagaaucuuaaaaaagaaauuugacacuuaaaagccaccuuucuuuuuaaauuauucaaagcuuuuaaaacuuauguacaccccuuaaaguauuaaagacaggaagaaaaauacauucuuacagagaaauaaacccaagugaggcugaccuuuggguguggggaauauaccauaaaaacauuuguauuauuuaccuugucccgugauccagcugaaggcagcucucuugcuagccuguuucuucuuuguuccuauaaaauguuaccaagcuucccugauuaucagaauauugagauguuccucuuaguuaaaaaguauggaguuaacuuacacauuuagcauauuaauauugggacuuaugccauaauugauuauauuuuaaaaaucugaaaccuaaugcuucccuauguuuguuuucugcccaaacacaucugcuaagggauauacuacagcaucaguaacaaccguucccuuuaccagggacucccaaaugaagggcaguagauaaacaucucuaacucaggagguuaagaaacauggacuguuuccacaucaacauggaacacagacuuucagaauaccaugaagaaucugaagcacacaccucauagaaaauccacacccuuaaaugucacucagacuacaaaacaaaaacccucauaacuuaaaugucuauuugaaaaaagguuuauccuuuuaaagacuauugucuucuggugauagcacugauaacuaagagacuguucuguaagcuguuuaacagacugauaaauuacucguuauauuaucaaaugguuacaaaacuauagacaucauguacugagcaccuacaauauccagguaccauagcaagugauauagacaaauaaagauacagguaauaagccucuuacagguauuuggaaaauuuaaacuugaggugguagaacagcauauaucaaaauuguuccucaaaugaaaacauuucaugaaaacucaagcuuacaaagaucuauaguuaacaaaguuucaagaacaguuucuuauagaacuuuuacagcaaaaagucaacuauuuccauuuucuuggguugucaagugauagaaugauagaugacagagaagcccccacucucacuguuaggagucccugagcuacucagucauaacgaauaugcagaggaccuaugucagacuccuauagggucuuccuuugccuacuuaugggacccuuuucauccugcugggaugacucauuucagccuuggugcgaugguaugugccuagucuuauuguagcuugcuauaccauguaugguucaugucccucuuuucugaagguagguaaaggggagagagggaaggugggggaagcaacuggggagaggggaggagaaacugcaguuaagauguaauauaggagaauuaaaaaaauucauaaaauaaaacuuuuagguaaaaaguuaaagauagaaaaaaaucaacaugcagauuuuaauacuguauucauucuauaaguuauacagagguucuauaguuaggguucuauaaaacccuaacacacuugucauacaugacccuguuaguuaaaccaaaacugcuccaagcaaaauauucauuuacgucaaagaacccuuaaaccaaggaaguguaugugccuacuuuucaaauuauucuuauuuuacuuuauguguauggguauucugacugcauguaugucugcauaccacaugcauguuggugccuauggaggccagaagaaggugccagauccccuggaccugguguuacagaugguugugagcugccgcaugaguucugggaauugaacccagguccucugaaagaacagcuagugcucucaacuucuuagcuaucucgcuaguguagccuauauggaccuccacuuaacacaucacgccuaauucgcuuuuugaguguuaaagaaaggggugggcacuuuacugugaagaaccuacacuuuuccaaauuaugaaguuagguaauucuuugaauguuuccuucaucgcuugcagagccaagaaacaaauaaaacaaaacauucucaauuaaaagcauucacuugguuuuauauacuucaauccaaagaacuauaauaguuacugaaaaggaacaagaacauucuuuaacauuaaaauaaauccucuuugauuaauaaguagaaaguaaaaauaauugucccaggugacucugagaucuaaaauuaacagaacaauguaaugaauuuaccauauuuccuaggcauacaaccagcaguaauaugccacaucucuuguacaaacuuacucgcaccugauccaacucucugaaaaaugaugcccuacucaccucuauauuauuguucauuagcccacaggcaucagcaaagucgggguguuuuguguugauauacgcuagcucaauugccacuaaguuaugcaccuauaaaaaacaaaauaagguuaaugugaaaaaaaaaauaugacaggcuaaccuaacccugagaagucuauauaugaaaaauuuauuauacagacaauauugcaaaaguauaagaaacauuuucauacacuugaugacuauacuccaaauaacauuuuaugcucaaugauaauuaacucuaauuuauuuaccuuccagaguuaaaauuguacuaugaagaaagaaaacaugacauuaagauagcuuuaaaguaauuucuuauuacugggaaaaauuauguaccuguguaauuuuaaguuccaaaccuucaauaagcaacuuuguuauucaaauuucagacgauacauuauagcaaaguuuauguuccauuuuaaaauaaauaguucauaaguaggcauaaguaagaaugcuaauucuauucaaacaauaaacguauuuaagccugagguaguuaggaauaacuuagccuuaaccaugaaacagacagauaaaaucaauggggcuaaaagucuaaugagacagcauugaaaagggaacaugaagacuucuauuuucagucuucuacacaauuccuaaggcuuagagagaaugaacuuaaaucuuuaucuuuaaaacaauuaaugcuuauucauuauccauaaguagucucacuuguguuuucauacauguuuuaauuauacucaccacugcccuucuuguccccccugcugaccccguucucuucccaccuagcagucccacuucucucccaugucuuuagugaccugauccccuugaguuucaucugucuguaaaggcugcuuacaaauauacuggugaggguaagggauuguuuacaggaccauggccacccuuaaugucuuuuuaucuucuagucuuuaaauguuucuggucacagcuuuucuccaaaacugacuccccuacugccaacucugaacaaaagaaaaguuaucuaaguauuacuuaucaaguaccaaaugaacacaaugugagcuacuuguuagcccaguagcuguuugauggccauguuaaauuaacaagguacauguaaaaauauggaggucauacaagaggaaccaaggcucucucucucauggcugcccuguacugucucaaguuucagaauaccacuuaacggugcggagcuggugacagggaguuucagugauucagugaugcugguggguaugaggugaggcucaggcuucugacucuaacaguaaucccugcgacccaagugaccacucagcagccacucaccaagacuuccaaggauacuauucauggacuucagaagggaggcucaaaugcauuuuuaguugccagaaggaaaagugcuauccacuugggggcauaagcauaauuucaauuucagcauuuuuauagggaugggaguggacagcuacagcucacuauaggaacugcuaucauuaggauauagaacaagcaaaaugugaaagaggccaaauuaccccaugugcuuuagaauaaaagcaaacuugcugcaaaggucugguuagugaguccagagacaaaggauuucccacaaaaaucaauggcagcacagaacuucuagaagcagcuacucaagaaagucaacaauauuauguacucacgaaaacuaacggcaauucaaacaagaccaaagcucaccauuucauuugucacgggcaaccuuuuacgaagaagacaggucacuacuucaacuauggcaucgugaaguuuagggaaccguaacaauuccugaauguaauaaagaaguuaaaaauguuagucugucuaacuggaaaugaaacaaucacuaaaguacugaauuagauuuggaucuuacauuuaagaauggcauuucaaaucagugucagguaaggaagcuaaugauguuacuuuuagcucauuuccucccauucuaugaggacuuucuggugagcccugucauucacaauaccugugugcuguaauugcuacaaugcugaaugauccucugcaucuccucauggaccagcuccacacaccguaggcugggcucuucuagacgcuuaaucugacguuugaccaguaacucaaaugaaacuucaggcacaaauaaagcaggacgggggcccugaaaacacaaaacuuagcugcuucuuauuauagcuauguacaauuucaggucuuccaaaggauucaaaaaagaaucccauuuuuguucuuuuuccuaaaaaauauuucaaguaugagaacaaaauaaacuguacauauauuuaaaauaugcuuaagcaacugaagcucuaaucuucuguuguuggauauacucacaguagcauuucugauggcagucaggaugucaauaguguuaaggccaccuaguggguccacagauucuaagguucgcccgaaagucucauggaaaauauaacaaauccuagcaccaccgcaucuggaaaauauauauaggaauaugcauuacuauaaagaaaacgagcuacaaguuacaucuuuuuuuaagcuuuaagguuguuucacuuucugacaaagucuuauaaaaaacucaacggcuguauuaacuuauauaucaacaaaaaugaaugaggguuucucucuuaauauauauacacuugaaguauguuguaaauauguuacauuucuuucaaaauuugugauuuuuuucccuuuagagcugaguaguauuuauuccacuuauauauaaauguuuauacauuguacauuuaucuguuguuagcuaagcagguugaucccaacuccuuagugaauaaagcaacaguaaacauggaguacaguuaucuuucugguaggucaggaaguccucugaguauaggcccagaaggagcugggucacaugcaagcucauuuucacaauggauuuauuaauuugcaccuuccaugaacagugaauaaggaauccuaucuuucuaacauucuaucaaauuuguugaugaacaccacucugacuggggugagguaguaucucaaaacacuuuuuaaaauaauuauuggucaucugugugguuuuguuaaaacuauuccauuuauuugccuacuuguugauuaggauuuuauauccuugguauuuaguuguugcaauucauuauaaauucuggcauuagcaucuuuucuaaaguauagcuaguaacauuuuuuuguuuuguuuuguuuucccuauucuauaggcuguuugcucugcuaauaguuucuucuauuuucauguaguccccauauguugauaauugggacuagguucuguguuuugguauucuauucagaaaguucuugccuaucccaaugucuugaaggggaaucuuuauguuuuccucuagaaguuucagugguguuugauccauuuugaauuuauuuuuuguauaggugaaaaauucugaauucauccugcuuguggacauccaguuuugccagcacuauuguugaacaggcuuuuuucaaaugaauguuuuugccacugucaaaaauuaaccaggcauaguguucucauuuuaauucuggguccucuacucuauucuauugcucuaucugucagauuuuuaugccaguaccagacugucuuuaucacucuagcucuacaguauaauuugagguuggcauguggccuuuuguggguucguaaaaauucuuguauuuacaaacccaucaaguaugacaucaaauuuugauagauauuccauuaaaucugugaauuaaucuugguuucauggccauucucauaacauuaauuuugucaauccaggagcaagauuuccccuuuuaagugccuugaaguucuuuuuugaugaauauuuauuuauuuuugaauuauuugaauaggauauuucuccuacuuucuuuuuuugagaguacauuguugauauauauuaaguauuuuuuauguugauuuuguaccacguaccuuuaugguguuuauugggaaaucugucaguguaaaaacaaucuguaaaaagugacuugaauauagguacacuacaauaaaacauauagccugucacuuaaauuuuauauaauuuccaaaugucaugaaauacuaaauuuuuuauuuaaaaacuuuauauuuauaauauauaaauaucauuuuuagucugccuaguuauagagggaggaagaaaaaaacagcaggaugagaacaaaagaaaacagacaccuagcaagguaaacaacaaauccuguggcuccacguccagcagcaucuaggcuuaugauggaaucaugcgaguuccaagcaagggucuugggcgaccccacauucuagcucugcuacccacaguauacaaacucuuucuuaagccugcagcuuguuaaauggccaacagucuuggcauuucaaauauucagggcuccacugcagcuugaguuucaccuucguagccucacuuacuaacuuauuaauuauucagugccugcuuguagagaaccaguccugucaguuuggccugggaggcuuuucagcauuagcauaagccccuauuagccugugcacacuuguauccauuauuccuauaaaaccaguaccacacagaugacacaugcuuucauucugaugcauauacgcugggagaaagauuugagggacuucucuguguauuuguugacaacuucauaugucucuauccuuaaaucuaaaguguuucuguuuguuuguuuguuuuuuacugaguauauggacagaaaagagagggagagaaagggagggugggggaaauagaauguuuagggucauguauuuuuuauauacuacuggcaguaaguuguuugugacauccugauuugaagaaaugaugucaagauauauagcaccugauaaaauauaggcauuuaucugccuuauagcagauguguaauguguaaguuaaagcagaacagcaggaauaaucucugguuggcuaaaauaaugauaauuuuguuuuuauguuuuguuuuuauuuaucugcauuuccacuaccaauuauauacuaugugugcuggucaugcccagaccuccauguaaaggucuccaguacugguucaacaaugauaaauguagacacuaacuugauuucuagagcuaaaaugacuucuuuuuuuucgagucauaucuuccccucugucuuaagucucuacugcuguaauaaacaccaugaccagaagcauuuuggggaggaaaggguuauuuucccuuauaucuuacagucccuaauaaagcgaucacgggaaggacucaagacaggaauaggggcaagaggucauggaggaguaugcuuuauugguuugcuuaaccuguguuuuuacagaacuuaaaaccacuauccaaaaugggcuaggcauucccacauuaauccaaucagucaaucaaucagucaaucaagcaaucaagaaaaugccugacaaacuuguguauagccaacccuaugggugcauugucucaaauuaagaguugcuuuucccaaaagguagagaccuugugucagguagauauaaaacuaaccaacauacuugccuuaccaaaucccaccuauggccaacccaagagagaggccugucaaucacaggccuguuuuucaaacugagcucucacuggcuauaccuaacaauggccaacuuuaggacaaaagaaaacuucaaucuucccacccuccuuccucuaaaaucuguaagaauggacugacugccauguggaccugaacucuccuuggagccccuguuccccaagcagcagucuucccuauuugucuaugguguuaaaacuugaaaucucuucuaauaaaucucauaaaaaggauaauuuauuacaauguccucauuagccuuaaacucaaaacuuuuuaaugugcauuaaggaaguaacuaggccggguaugcaccucagucacagaguacuugccuaagcaacccaugccccaauuaguuuaagcaugauuauucuuuugcugguuuggacaugacuguuuggguagguugggacuuggccuggcugaggaaggaugucgcugggggcaggcugugaaguuuuaaagcuacacuccacuguaguuuacucccaacuugcugcucuagugucaugccugcuugcugccuccccacuguaauggugauggacuccuagucccuugggaaccaucaggccaaacaaaacuacuuccuaauauaaguugcaaguugccuugcucuggguggucuauuacaacaauagaaaaaucacuaauacaaguuuaagggugaaaagcuggugagauagcuuaguauuacagaguaacaagaagcuaucuuggacuuugcccugauagacuuggaaacuagagcagaacaguaacaguaguagcuaggucuauggcaauaguacuagagcuacugacauucaguauagagcagugacgcucaaccuucccaaugcugugacccuuuaauacaauucuuuucuuuucuuuuuuuuuuuugaaaacaagacuuuuuuauuauauauuuucuucauuuacauuucacaugcuauauccccaaggucuccuauacccuccuuccgcccugcuccccaauccacccauucccacuuccuggcccuggcauuccccuguacugggguauaugaucuucgcaagaccaagggccucuccuaccauugauggcuaacuaggccaucuucugcuauauauaugcaacuagagacacagcucuggggguacuggcuaguucacauuguuguuccuccuauaggguuacagaccccuuuagcuccuuggguacuuucucuagcuccuucauuaggggcccuguguuccauccaauagaugacugugagcauccacuucuguauuugccaggaacuggcauagccucacaagagacagcuaucucgggguccugucagcaaaaucuugcuggcauaugcaauagugucuggguuuggugguuguauaugggauggauccccagguggggcagucucuagaugguccuuccuuugaauauuagcccagaaacuaagaauacccaagauacaauuugcaaaacacauguguagauacuuaguuccuucuuagacuggggaacaaaauaccauggaaggaguuacagagacaaaguuuggaccuuuaacacaauucuucauguuguguucacccacaacuauaguuauuuuuguugcuacuuuguaauuguaauuuugcuacuauuaugaaucaaaauaaaaauauguguuuucugauugucuuaggugacucuaugaaagucagucaacccccaaagggucaugacucauagauuaagaaacaugcuguagagaaauugggagauucucaccggggauuccagaaauuauucccucccccagcugcaggucaucuugggagaugagagacuaguaaaggaagugaaacggugacugaagguagggcauguaaugcagaauccaugagacugcaugggguaggacaaggcaucaagauagcuauuaugagguuacccacacuucuguagcuaacuuugcaugugcucuguaaacaagcucaauacauucauuaggcucaucaagucggacuccggugacauccgucaccgauagacaucuggggugauuagcuguucguuugccccucgcuagcucccuaggcuugaauaggccugacaacccaagcucaaucccucaaucucacaagguggcaggagaaagucaacuucugauaguugucuuuugaccgccacaugucugcugugucgggggugaaggggagaggaaagagguggggaagggagaagugaaggggguagggugaauuuuacuuuaaaaauuaaagaaaaaaacaaaaaaccaaaacaaaccaaacaaacaaacacuucaaaggcagacauuaugcauagccuuaaaauucuagcuauguaggaagcugagacaggaggaucaugaguuugaggacagccugagaaacugggaagggagauucuuuaaaaaaaaaaaaaaaaguugcuuuuuaaaaaaccuguaacuuuaccauguuuuuacacaauuuauaaacauaugacacaauacuccuccuaucauuucuacaaauuuauauuccuguuuuauggacaauaaaucacagaugaucuaagucauuucaaagauucuuauaauccaagcaaccaaaucuuuacaaaaacuucuuacuuacagcucagaaguuucaauguacuuugcgguuccuucaaucguguuacaauacucuguggcaaauuugguaauaagcuggaguaaaguagcacuuuuaucauccaccgguucaccauagcuauuuagaagagacugauacugagcagcuaagacauuuauucuuguuuucagcucugguaaacaaucucugauaugaugcauaaguaaccugaaaguuuagaaaagcaggguuguagcauaaaauuagguauucugauacuuuuaaacaagccaauuaaaaauguguaaaaaagggcaaaucuucuaguacucagaucuucaacauguccgaggacuugguggcugguuaccagaaagacgagaaagagcaaaggauugggauguucaaucccagaugacuugcucaccaauggcuagugaaguauggaucacaucuguaugaggaagcggccauaacucaaguaaaaaguucauggaaguaaaaagguuguguagcaaggcaugcccagaaagagcauaaagcccagcucaugugucagcauuccauagaccuuaccuuagcuaucucuccuaacugcuuuaccuguacccuuuauaauaaauaaccuuuuauuauacaugagcaaacauaaaugaguauccccugaagccuaucaccuaucaccagggaagcacauucauaacuucugcugucacuugacaucugaaguacaaggaaaaauccuauaacaaacugaggccucgugaugaugacucuauguaaauagugucagaagugaguuagaggacaucuaguuacaaucuagcaaagaauuacacuguacggcauaugggggaaacucagaaguacucuguucaucugaguaacuguaauaagaaaacacauuuuuagcuccuccaccauagcacaacaagaagaaauacagcaaucuuaaauuacagguccuuagucuaaaaaccuuacacaaaagcugugcuggucaauucuuuucacgaauaccuuuagccuaccaagccuaguggcugcuagaaaaccacagguaaaacaaauaacgcacauuguuuuugugucacaguaaaguaagccaugcgguccaaucuaccuguaauuuugguuuaguuacaacagguacuuaguauaguauaaauaaacucaucucauuaagacccaacuucauuuuccuuuaacuuacaggauaagagauaaugguuuucacuuuacuccuuauauaaaaggaaggcuuuuaguuccuacagcauuaguagauauucagaacuguagguauggaacucauguuauuucuaucaugaauaaaugugauagcugaaccacaccaugugauaacugaaaaauuuaacuaaauuuaugaaaccuaaaguguuuggaagucaucuaauaucucaguaaaguucaaaauccugugaauuuuucuuaacugcucagucaagguacugugguagcaauugcccugcugacaucaguccccaaaacuuccugcacuugacaccggcauugaugcuguccagucagcuugcuacuguucuuauggcucacauaaaacagaugcauauuuugauuucauuagauaacacuucagcaagccagaaauagacggcuaugaacugcagagaugagcagacuccgcaagggccugacuccaggcacugagucacugccgcugcucuguaagccugcggacaguuaaaggauucugcugguguuguuugcauuuuggagguugugaaggaagaccccauaaguaaauuuagcccuaucuggaacuuaggucaacuuuaaaugaacuggaaaucuccacuccagaggauccgggcuucaacaaaauauaaacuccuuuugaugggguuccuaaagauuucugcuauuacuacuugauuguaaacacuacugaaaauguuuuauuugaacaaauuuucuuugaguauuaaauaguaauuugggaaaugaguuugaauugaaaaaaaaaacccacuucccaauuaagaauauuauuugaauacucacuccauacuacaugauuuaauaucaaacaucccaauaaaaacagacauuugcuucacaggaacccagaaguaaggcuggagggaacaguaugaaaagauaugaaacaaaacaggaacagucuaggacaacuauuggcaaaacaaaaacauuucaucuucaaaaagugaaaauguuaccuauucaggguccuagcaagauacuuuguuccauuucuguuggccagagauggguacuucuuuugaagaaaagcauacucaucacggauugaaucaguuacacucuucuuauuguuaauauccaguuggcuucuaugguugaaaaauaacaaacuuguucaacuagggucugcucugaugagcagcugcaucagaugaugucuccugacuucuaacacggcguuuacuuacuccgcagcagacaccaucauuacacuuuauacaaggcacugaugucucaaugaacucacccaaggaaggcacagacaaccuagauuugaacuguaugacugaacuuaaaagaugaagaguaucagcuucauuguuacuauuaaccauaagcuaaagcaguauccuuaaguaaauuuuagauugauauacaaaugcaaguauaucuuaaucugcuuuauuuuauccaugggcaggugauugauuucuaccaaaaauuaaaguuagcugaaaguguaauuaucuacaaauauaguaugcaguaguauauauagcacaugcuugccugaaaagaaaauagauagguuuucuuuaaauguggaaaggaauguauggaggaacauauagagagaauuggaauggaccuuauauaucacuuaauaaaauauuuuaguuuuuaaaugaccugagggccaaagauguuauuacaagugauuuaaagucuauuauauccagaccauguagaaacuagaauuagaacuuggucucuugacaacuaguuaguuuccuuaccauagagaaucucugaccuaagagaaacuaucacuguuccacacuagcccugccacccugugagaauuccaacaauacuguugcaaacugcaacaagagauacucaacagcaguugguuuguuucuguucuauaguuuuuaaugccagcaaguuuuaggauguaucuuuaaaguuuccaaguuacauucuggcaauuacacaguauuacuaaugauaugggguuaaaauaaucauuaaaauuccacuaccuuuaaauuuuauugauuaggcacaaauuagauaauacuuauuuucuuuacccaaugcccuuauacagaauuuaaauagcaggcaagaaucugcaaaagcuaauuauuaaaucaucucuuguuuuuuuacugauuaccuuagaaacaauuuuuauuagaaaacucagagaggaagaauaauuuuuaaaaagggccuuggaagugacuccauguaaaagcacuuguugccgugccugauacccaaguuuaaaccucaaaacccaaaugggagaaagagaaaacuggguccugcuaauuguccucugaccuccacauacagguucauacuuuaaaaaucaaaacuaccaccaccaccaccaccaccaaagcccacaaaacuauuucagagagauauuaugaacuucaucucuuuacagugcacugaccucugcagcaauauaagcauuagaacaggagggaaacacaggauaguaucacauuucagacugauuuucaaaaauuuagacuugcuuuaaaaugagaaugcuaugauucuuauccuauucauuaaaaaaaaagauuuuauuuuuauuuauguguauaugugugcaucugcauguuuauaugagcacauguaugcuggcgguauccuuggaggacaaagagggugauggaucccuugaaaccaaaguuuuaagugguugugaguuacucaauaugggugugcugggaaucaaacucugguccucuguaagaguaacaaguguucuuaaccacagaaccaauucuccagccccuuuauuccauuuaaauugcuaaccuguuaacuacuccaauuauuccaagcuugacuggaauaacccuucccaucaauacauccauggcaucaguacccgcauccaugagaucaaguuuagugauuacagcuagaguucugcgcccugguaaauaugaaaaggaaggggaagagagauccauuaaaaaaccagcauuaaguuuaguaaagguuuucaucuauaguucuacuuaacauauugccucuuuuaccauuuuguuaaauauuuuccuacccuuugccucccauacuuuaaaauaaauuuaaauauggcauacaauuuuaaaacuuguuugcaugaguaauuuuuaaaaauaacuuuuaaaaaugauguguauaugaguguguauauguuugugcaugcggggguugggagguggggcacaagaggguggugggggguccucuggaguuagaguuauagacagacacuugugagcugacugauguaggugcugggaaccaaacucugguccucuggaagauuagcaagugcucuuaaccacagaaucaacucucuagcuccguaauuucuuauuauuucuuaggucaacauuucuacccauuuuauguuuauauguguggcucuacauguuuguacaugcacacaugugcuggugauauccuuggaggacacaugaggguguggaaucucuuggagccauaguuauuuacuauggagaaucuugcuccugcccaaucccuuugguggugcuggggaagaaaccuuagggacuuaggcaagcuuaaauaacuacuguauuaaugaacuacacccccagauucuaauuugguucuuucuaacaaguacauaccacuuuacuacauaacagcacuauuacccagcaauguccuuuugcuaagcaaccaaacccauauuccaguccuccuuuuguaagucuuagaauguuaugugaaaggaugucacugaugucuuucauucaccgugacucaucggagugcuguccacauuguagacauugaaguagacguuagcaaucacuguucaacagugcucuuuauuacauggguguacuaauuuggcuauucagucccgauuugagaaauauuugaguuguuuuuaguuuggggagacuaugaauaaauucaacauagauguuaguauacaaaaggguauuuuaaaaaauucauuuauucauuuauuuuggggguggaaggaaucaaaggggcagaucacuuucaggagggaguuuuuucucuccuuucagaucaucagacuuagcaaaucacuugcuuaacaaucaaccugcuaaaccaaaacucugccaagcccuagauucuuuaaacaguaugucucugaguggacaacagccugagcuaaccucagcguguaacccucuugccucagccuccucgauuguugguauugcauggcucaccaggcuccagacaaguuuucaaaugaaaauguaaaaugcaauugcugacuggaguuguuuguucuucuuccccaaaguaaaugcagcacuccacaucaauacaugcaacaauuccagcugcucugcaggcaugaccucaaguagacuguuuccuaguuauggauaucuuucuuuuguucccaaucuacaaaucauuauuuauagucauuucacauuaucuuauccccauuaagaaguuacuucuaaauugcaccuaauugcuuuuguguguaugugcuaugcauguguauuuacauugaguccauacaugggauaucuuccuaaauuaccuuccauccuauuuuuugagacagggucucucacugaaguucgaaaucaccuauuggcuaaacuagcugaacaguaagcuccaagggucuguccuucuacuucugcuucgggcacugggacugcuaagguguuccguugugccugccuucuagggaugugaaccuggguccucacucuugcauuggaaacacauuugcaauucauaucucucuagccccaguuuuaaauauuugauauuauauauuaauauugauugaaaugauuuaccuguaauguacugccauuuugguuguuagaucaucuacacaacaaguuccaggccaaccaggguacauaguaggauauugucuuaaaacaacacaacagaaaacaaaaaacaaaccaccucccaccccccaaaagauuacuagaucaaauguaucuccaucuuauugcaugauuauuuuauguauguauguauguauguauguauguaugcauguauguauguauuuagagacaggguuucagauauggcuagccacaaacucacuguagcugaagaugaccuuuuccgguucguaccucccacauccuaggauuacagguaugcacuaccauaccugacuaauuaugaaaguuuuaauuauacuuguacagcuucuaucaaauuuuuauuugaaauuaauuuucaaagcagaaaagaaccuguaacacagaugcugguccuccaagaauuuaggugacaaaacaguuuccuuaugggucaauuacccacucacuuauaaagcuagcauuucauacaggcucagcgacaccucuaauaucccaaguaucaucugaaucacaaucuggguaaagaaugauuuauaaagagaugccuuaaaagacucucuucuauacugagcuugucuaguguuuuuuguuuuuguuuuaaaucuucagaaaguagauucaauuauuuccuguaugauaauaaucuauacaauuaugaguuauuuauucuuaaauguuggcaauucaaaaguugaaauuucauuuacauaguaauuuaauguuaaaauuauaacuggguaguuacugaaaauauauaucuuaugggguaguguuuuuuaccuauccuuuauagcaaucaaguaacuauuuuccaucuuaauugcuauuaaauuuauuagaaaaguaagaaagcauuuuuaagcucucuacuaacuggauacacuccuuucaauaaaauucuuuucuugaggaaagauuuaccauuguaaaucaacauccauuaaauauaaacaucugcccuuaccaucuggaucuaccucucuggaaaucuugagugcuucugauguugccauaucuguauuugcagcagugacggcgaggauaauggaauugggauuacugaugaaccgaagaauaaguucucugaucugaagcucgauguccuugggcugaucgccuacagguaccuagaccaaaggugaacuauaaucaaaaucaaaucagccuuuuccaugcauuucauucauagaauacaaguauuucuguacuuaaaauagcuaaaauaaauuaauaaugugcuauagagaugucugggcaaagccuuaagaugucacuuccaaauaucagaaauucacuauagcauaaaucaugucaacaacggcugagaaucaacugcauccagaugagcugcccuaguaauacgaagcacacgcaaaccauaaacaaguaaguaauaggcacacacagguccaucauccaaguggcagacagagcacagagcacagaguacagcagagcagagcagaggcugcggaaugaugcuuuucaauuccugcuuuaaaugauguuuaaaacagaauaauugggaccuacccucaauuagauaaugauuuuuaggugacugagcagaaauuaaagacaaaagaaauagacauggauaucuggggaaagaacauuccauacggagugaauaacaaggguagacacccagaacagaagaaauuaaagaugaauaauacuuaaacugcgugugguggccuguaaucccaggaccuaggagaguagaaggagggaguucacagucauucaccacuacagacaguuaaaggccauccugagauguuuaacuauacaaacuaaugaagugagaggacaagacagcaguagauaguaauaagaacuuaaauuuguacucuucauaaagagguaacugggaagucacugaugagacuuuaagccaagaaaugacaaucuaauuuucauuuuaauagaauaguauaguuaccaaaaguaaaaaacaagagagaccuauuauuuauuuuguaacuuuaauuauguaauccaagucaaauaacaagagcuacuacuucuaucauaaauauacugagaggugauagaauucuggauauauuauaaaaauaaggaaagcccagaggauuugaugaaaggaaagcagauagaaaguaaagaaguuucaaugaugacuguaagguuuuggcugaucaccuagaaaaguggaauugucauacauucagauagggaagauaacagaaggagcaaacauagguaacggacaggaauuugguaguagacacaguaaagcugugaugcuuauucaaacauuuaaauguguaugccaaguggauagcuggacauguaucuggaaauaauuuaaauguucacauauucaaauucaugcgcugauaauacuaucaaccuaauuagauuguguuaugaguaccuaaaguggacaagagguccaaaaaaaugaacucugauuaaagacuuuggugagaugagaagaaaccagcaaaggacacugaaaagggguagccagcaagauuacagaugaaacuguagaugcaauacucugggagccacgguaaagaaaguauuuuaaggagaaagaaggcaucaaccauauaaaaugaucugauaauaacauuaacugugaaaucaacuccuuauucucauuaggucaaugcuaaacggaaaacaaaacacaguccuuuaaacagaaacucaaacaacagcuauuccuuacuuuggucauucccgguaaauccacaagugucagguugacaacguugggcgagaaaaccuugagauggauuggcucagggcuuacccccuaaaaacaguuucaaauauauuauaaucauuuugaaugucaaagaauuaugaaaugcuagaguaagcuacauucaaguacauagacuuuagaugccuuaaaauauuuauuaaacuacgguccuaaaaucuuucaauaauaaaaguuuaaugaaucacaugaaugagaaggcagcaagucaaauaacgaguaggauuaccauccuauacaaccucauaccauuagugucuaaaauuuuucucccuauaucauuucacuuuuuuauauguauaugccaauuuaaaaaaaaaagaguuuaacagauuaaguacuuaaaaauaaugcauuuuucauuuauccaaaauuaugauguuucugaacugaugguguuaaacugagagaguaauauauaagaagcuauucccauuaauuuggucaaagauaucugaacaucaaguggcaaaauuguacauacauaguugaguuugcccaggcaauauaucucaacuuucagauccccaagaugaaaagccucccugauauaaucuaguuauagucccaucacauuccagguauagaugguguagacacuuagggaagugugauggcaacagcaguaacuccaaggugccagcugagaguuugacaaucugcaaagcacuauaacugaaaggauaaauauuuucaacuggcacacaguguuaacacugcugcaaaaugucuuucugucaggaaguaacuacuucaucacacuaccuggcaacaaauauauauugaauauuaucacuaagcucaagguugcuugugagaguuauuguuccuccagguaacauagaauagcaaauauaaaaaauauaaauauaaaaagaaaacaguaauuacaauaaaaggcauaagaaggauuuaaaugaggcugauuuugucauuaaaaguauccuagacacuugguuuaaauucucacauucuuagaaaauauguggcuguaaacaagcacuauguaacuaaguucacaaaauauaaaugaaauauuuuauauguauaaaaguuuuaagguguguguguguaugugugugugcacacguauguuugugucaaauaauccgcguuaacuguugacuuggcagaaacuagaaucacuugggaaaagggcaugccuguaggggugguccuuaucacucuugaacuagaaagacucaucugaauugugagugcuauauauguagaaaaagacaguuaaaaauuaguauguauucaugcauucaauauucucuucugauucugaacaugugagcagcugcuucaaguuucuguugcugugacuucccugccacgauggacuguaaaugggaaaacaccuuccuucccccuugcuuuuguuaggguauuuaucacagcaauagacaagaaacuguguuuugcuggagaucuaguucaugccuuuccacuaaacagccuagcacugaccuaugucccuagccucuggugucuacgaaacuauuucacuguguagcucaagcugcccuugaacucacaucugucugccucuacuaccccaauucugggaauucagauauaaaccaccacaacuuacaccaagagagauaauuaaucaccuaaauuuuuauaagucuguggaauacuccauuuguuguuguuguuuguuaucugaaacagggucucucuuuaaaauauauauagcuuuagaauauauauagcucaguguagcccuggcuguccuggaacucucuguagacccaggauggcugcaaacucacagagauucaccugccucugccucccaagugcuggaacuaaagguguggccacuacugccuggcaugaauaucaggaggcagaggcagguggauuugugaguucgaggucagccuggucuacagagugaguuccaggacagccagggcuacacagggaaaccugucucgaaaaaccaaaaaaaaaaaaaaaaaaaaagauucagauuaugaaguuacaagccaaccuugguaccacaaaacuguaauuucuagcuacucaggaaguaucccaaguucaagacuagccuggguaauuucaugagacacugucucaaaauaauaucgaaaaaccaauauauauauuauuauuauuauuaaagcuuuagaauauauaucacuuaguggaagaacacuuagcuagcauguaccaggccccacauucaccaucaguacuagagggaaggggagaguauaacuuuguaauauacuuauauauuauuauauuauauauuaauauauauaggaaauguucagcaauauauuuacuuuuuaaaaaguguuccagguuuggaauaaugccuaccuuauuauuuccugaaauucuuucaguuucauuuucaauuucuugucgaauuucaucaaaaucuguguaaagcuaaaaauuuuugaaacaaaaaagaaucauauucuaaauaagaucagacauucuuaagggguggaggccacauuuaaagaauauauaaggauuuacugcagaaaaauuaguccacauuucucacauacacauacauuuuugcaagauuuguuucaaaguugccugaugucaccauauuuaaaaaucuccaaaugaggcaggaucaagucuaguuaaacuacugugguuagaagcauuacugagaaaaguucuuuuauagggaacaagaaacacacucccgguaagaaacuauucucuacuaucuuugcaaaauguuauuuucuaugcuauuccauuauauucuuuagugauuaccuuguuuuuggugugaagaaauuuaccccauucuucugcuucaacuccuagagaaagaaagacucauuucuuaaagacuggaaauuagguuuuauaaucaggaacuuaaaaagauaacgcagaaaacuuuuuauuacuacaaguuaacaaaugucuuaauuuuaggaucugcuaaauacacauucacauuuuuaaagcacgacacagacgacaaaggcaggacuaacuucaagaagaguugccugcaagcucucccagaaucugaaaucuauuuuuuuacaaauaaauuguucauuuccuauuugugauuauaauaauuucuucauacaucuuauauaugaaagcaauuuaugcaaugaaaaauuuuaaagaacuagaaaaaaauuaaaacuccauuggauaaugcaaaaaaaaauauggcaaauguguacauaacauuaaaguuaaaaauacaugcaauauaugaaugaaaaagcuaauuuuuccauuuuugaaaaucauuguccuuuauuuguuuuuuuguugccuacauauagagcucucagugacaggguaguagcuggcuuggaaugcagacugccaaugugauuuuucccaaggucaaaucuauauuuucucauggaauuauagaacagaaaugaaugcaaaauuaaugaaaauagaacuauauaugugugugaggaacugacacucggcuaguuugcagucacagucugcuccugacaucuuacccaagcacugcuauuccgccuucaccaaauucagaagcuuaaguaucugaaugauuuaaaauauuuaaugcauaaaagucaccugaaacaaaaguaacauuuucacauacauauuuauuuaguaaaagguauaugguucuuuguuagaacaaagguauauaaaaccagauccuuuuugcaaauaaaauguucaccuacuugaagcuuagaaccuucuuccaaaaaggaccuuugaaagaccagauuaaucuaggugacagaacucacagagguacuacuacauacaaaagggguauuuuaacuuaguuggccauauaaaaguuucaguaucuucaguuauguuuuuguaaaaauuaaauucuaccaccaaaaaggcuugcauguuaaugcaaugccaaaacacuaacaagaaccaccaaaaccugcaaccaauguaaagaggcaaauaaaaauggaaacggugcacgcagccuguacggguacauaagcacacaugcaggcauaauaaaaaagggagggcuaaaaacaaauggauaaaggaaaccuuuggaaaggugucuugaguuuuuccauguggcagggucuguaguuaaagagaaauagcacaaaguaauuuuagugcuuaucccuaagacuuaaaacuuuuaaaacacucaaguguguagaaacacuauuacacuucaaaugugcauaagcacuuaauuacucaaaacuuauuagaauuguaagaacaaauauauuuauuguauuaauaaucugcacauugugugugaugcuucaacuuuuuaggaauuucaguaaauaaauuuucauuuuacucuaauaauguuugccugagauauuugaaagccuauugugggaaaagauaaacugucugguuuucaaaagccuaggaaauaugauaauuaagcacauccuuugaaacucagaauuaguaagcaaaugcuauuuguuaaaugcaauuaguaagcaaaugccuauuugcuaaaaaugacuguucauaaggauauuuucuuugaaauauaaauugcauuuagcaaaacaccacagaacuucaaaugcaugaacucaauccaacaggaaucuaagaucacaauucuuguauuuccuauuauauacauuaaacacaaaauacuucagccaacuuucacagaccucaguuuaaaauuacacuuuguuucauuuuacaaugugcuguucuuaacucauuauuaguaacugggccucacuuacauaaaaaaccccaaggagcuuuuauaauaagguuuuauagccaagaugaaacugaauuccuuuaugcaagagaugcacuuacauguauaaaggaaaaaaacaauacugacuccuggaggcaaacugacaaaauaaagaguaguugugguaacucaggcccauagaaauaguggaauaguuuguucuuaauuccaaagugaaguuccuacaaaggccaccggacugaaucugagaggcuguaccccucauaaauguaaacucaugaaaguaaauaaauaaaaguagaacuguuaaaaaacuaaaaagacccauauacaaaaaaguuugggguuguuguauacuuuuuaauggcuuuuauuuguuaugcuuucuucaaaacuuuucuuugaaacuauuuucucucacuguucauguuuuuuaaauccaaacugaauguuaaucuguuuuaauuaguucuugauuugcacaaugucagaaugacuugauaagccuaaagugcuuauguagagaagcagguggcuuugaugagaaguaaggagccagcaagguagcucaagaggaggggcugcuaccuagccugaugucccgagugccagccccaggacccacaugguaggagauaaccaauucgccaaaguuggccucugacuggaauauaccuaccauagcacacgcauaccauauccacacauaaaauagaaauguuaagaaauaaaaacaaaaacaaaaccuuuagaaaaaggaagccaaagaauuaugguagaauaagaaugaaauuuaauauucaaauuugcaucuauuuuguacucaaaauuagguauaucacuuuuaaaugggagcacaauagauauuuuucuuuauaggcaaagacacauauauguaugcacaaauguauguaaacacacacauacauagcagggccuaaguucuggaauaaucuauaugcugguaaaaaugugcaguuuuacugaccugcuccccacaucaacaaaacaugcugggcauauaagcaaggugauaccaaggaaccagcaugucuauacccuuucuuuacaagcaacaauuuguuuaaggaaacaucacaguucugauagggauacugcccuuucgaaauggcugaggaaaaaaaagaccuaaagcccucaguuucuccaagucuugguuuaagguacuagguaauguguuugauguaacugugaggacaaaagccugaaaguuguauucugauauuugaggcuaagcaacagguugccaagaaugauuacagucaggguucaaacuuuuauaagccaacuuugucacaaaauagaauaaaacaaaaagaacgucaauaauaaauguuaaaauauaaauaacuaguaugucaagaaaauaccuaguaauuaaaggguuccuauauagcugaucgucuguuauaaaauauuacuuacuaauaccuacaaacucaugaacuuucuucagguauuuuggagucccuguuuuaaagucauaguagaugcucaugacaaguuucuccaccuacuuuaaaaugaaaucagagucaacaccaccaauaucuuccaugaugaauggggaaaaaaaauuagcugugauacuaucaccccaccucaagucaaaagauaaucaagacaaaacuacacugaaaacaaauccuugcagguaagaacagcuauagcgaucgcuauagacacucucugaaagucggaguaguuuuacagaauguuaggagacagagucuaagucagacauugaacugaacaggauacugaauggauuacucucucacacuccaaaacucacuauuaugauuaauauaggacaaaauauguaucauaaacaauuuaaaauuucucaauaaagaacauuucuuaaaauaauuuuaguuuuaaaagauucagcuauauaaaucuaugaauauacucauacucuggccuuacuauucauaucuauuuuaaaaaaaaaaacccaguuuagguaguauaaacagaacauggcaaaagggaggaccuuuaaaaguacaaauaguguaugauagagaggugagccuuuacuuuuaaaaauaaaucucuuccuauaacuggacauuagccgcauauguuuguagucagguaaucgggaggaaaagagaggaggcucucaaguaugaggucauugguagcucuccgguaguucugaagccagucugagcuaccucaccucacgcgaccaagugaucuuucucuaaguaacagcuuuucucuuagacuaaagccguguguaauccaaaugagcgagcacagagcaaguacaagaagcagcuuccacuguacucagcacuccaagccaguacaaauucuuuuguguguuuuggggguuucucugugcaggcguagcuguccuagaacucacucuguagaccagccuggccucaaacucagcgaccauccaccugccucugccucccaaguguucacauuaaauauugauaccaauccgaaagauuucugauuuugcuauagcuauuauuucccaauucaccaaucaacuuuuuacuuugaaauucauaucuugaaaauagaaaaaaaaaaggaguaacauuuuaaaauaauucuuacuccagcucugaaauuuaccauuuucuucuccuguuguuuuucuuuuaucuucuggugaaacguggacuagcugcagaaugagaggucuccgggugaccacaccaguuccucugggaagaaggucccugcccacuaggcuuuccagcacugagcucuucccacugcucugaaaagagaucagacaagagcaaagaagugacuucucuacacagacuacacgagcaaagcagcauacaaacaagcuaaauaacuuggagaaaagcccacacuuaauuaaaauacauaaaaagcagucccuuuccccaaauuguuuuacguuuuugauacucucuugagagucuuaaaacuugcaucauauagguacguagauauuucauuuaaauggggcauuacuaacuuuauuuuuaaugcagucaagagguuauuuaauaauauaucuccugguuaguuuuugucaacuugccauaaaccagagaugucugggaagaggaaccuuaaaggagaaaauacuuuaaucugauugccuguaggcaacucuguuggccauuuucuagauuaauuacugauggggagagccaagcucaguagcuuguuuaagaaggcaguccgaguggcacaaccacauccacgagucaugaagccagugcagcugugaccguuccaguagcacugagccaaaugcugccaucgcugucucugucucuugcuuugggguuuuggucuccgcauucuuggggacuuucugcacuaugauucacucuaugucuuuccccaagaaaguugucugagucuuuuuaggaaaguccuaaacuuacugucccuucugcuuuuagggaaauaacuucaucuagcccuauuugaaagucuuccuuaugcuuuggagaguaugauaagcacuaaaaugcuugaaauuuguuucugaggccaugacuccagaaaucuugggguauccacccucaagcaagcucaaauaguauagcuggaacaggcuaagcauagagauaguugacaaaacccagcuggccaggagaauagguuacagauucauggccucccuuuacaauaugcuuagagcacucuaaaaauguaguuuaaagacaggggaucauacagaguauagcccuggaggaacagaacucaguaaauaagauggacugacuaaaauaacuucuacuuuacaucguagaugaugaaacaauauaguaagggaguuauccauaaaaagauccuuucuguuugucuggagugcuuucaaacuacaaacauugccagccuaaacacagacugucauauaauaaauguauuugcuuuggaggagacauucuuuagauucuuugaauugggguuauagugcugauaauaauaagaucuauucuauuuguacuuucuaguugugacugaacuuguaacuccagacauguaaugaaaaaaaucaaacauacguccagagacaaauucuauacuucuuggauaaucacgagucugucugugcucugugaaaccuggauaaauaaagaagcaaccugaaugccagucagucagagcagcaagaagucacugcgccuuacucacuccucccucaccaacuccuuaucugcuuccagauuuacuuaguagccagccuguaguucuuucuauagguuuggggccucaugggccuuccacaauccaacuuaggauauucauugauguccuuguucagcucucauaucugaguggucauguuggugagacuuuauggauacaguuucugccauuacuaggagacacaucucacagaagucccagauccuaucucuuacaaucucuuuguuccuauucccaaggccuuaggugugggaguguuuuguagauguauccauugggaaugggcuccacaacuccguuuauccguugguuguaguuuucuguaguggucuccaucugcugcaaaaacgacuucccuugaugcuaggugaauacuacccuuaucucuagguauaaggagaacugguuauggugcugauagggauuaugcuggauuaguaaauuaguggugguagauucuccuccagugacuacaaucucacuagcacugauuagguagcuaguuuuucaguaccagggauguaucccacuuguugagugagucuuaaguucaauuacagagccaguaguuacacaacuggguagaacugcugguggccccucacguuauugcauuuuuuucauucucagauaaauagugaauagcaugauuccuuguggcuuuuucugacauccauauuguuauuuuaccuccaaccuucuguauugaccucccuuccacucccuaaggcaccccuauuuucccauuuccaccgucaaaucacuuguaccacuuccuuccccuuuacccuccuccaccuaccuuuguauuuacuucacccccccaccccaagaagccuccucccauucccuuauggcuuuaucauuguuauggcuauuuuaccaucuucuauauuuaccuccuucccccugccuaagaaaucccccucuccccauugccaugauaugaauacuuuuacccugauauccccuucucuacugaucuccaccccgcccuccccuacugcaacaaugguccuguuuuacuuuccuauuuucuguaguaaaggcuauguuauucauaucugaagauuuagagcuagccuuugaagagagagagaauaugugucauuuauauuucuaggguuaccucacucaaagaaaaaauuccauaauguauacguaccucauuuccauuaccuauuccucaguuguuggcaucucugucaaauauuauguggcugaaguuauguuaaguuaugacguuguuauaaagcuauguuuucgacuuuguuccauugguguacauauacuacauuguuuuacuucuaugguucuauaauacaucucaaaaccuagaauuguaaaaucucucuaacauuguaggggguuguuuuuguuuggauuuuuuaacuuaguugcucaaaauuguuuuagcucucuugggucuuugguuguuccuaugaauuuuaagguaauuuuauauauuucugcuaagaaugagauggggauuuugauugagauuacacugaaucuuguagcagaauuucccccacuuaauuuaaauauuaguacaacaagaagccugugauuggacagggaaaaggaagguggagcuaagaguuucagagauagagacagggacaggaagggagaaggaggacgagagaagauggauagagaagaggaugagccuuauccauguggcuucauauagccacagguagcuaugaacaccauaaaaggauagaauaauugggauaacuugccuaaucuaggugugcagcuuguaucauuaucaauuggcucugaauuuauugugugggcgucuucugaauugagaauuuauugauauauaaaacugacugauaauuauaagauucuugaguuuugauuuacuguguuagagagauuugugacagcuagccgcagggguuagauggcuaggaaaauacaagcagcucugagacaggcaaaccagagcugagaagacucugccuggggcuagccauggagcuggcaagaccgagaccacuggggcagagaguagccggcgcuagagugggaugguguauuuauuucauauuucccacaauagaaucuguaaauagcuuuggguagaaugguuauuuuuacaguguuaauucuagcaugccaugaacauaggaugccuuuccaucuucuaguauuuauauuugugucuucaguggcuuaaaaguuuucauuguagggucccuuuacuucuuugcuuguguuuaccccuagauauuuuauuuucuuugagguuacugugcucaugaucuccuucuuaguauguuugcugcugguguacagauagaaaagcuaugaagggugauucucuauccugccacguugcugaguuuuugguuucuacaaguuuuuugguacaauuuuuugggauauccaauuuauaguaugugucaucugcaaauagaaauaguuugacuucuuuuucuacuuguauuccuucaauuucuuucucuugccuuauugcucaccuaauauuuuagggacaguacugaaaagggauagacauaguggccaucccugucuuguuacugacacuguggaauugcuuuaagcuuuucuucauugaggaagauguuggcuguaguuuuuuucauauauaacuuuuauuguguuuccucuaguccuauauucuccaagacuuauaaugaaggcauguuggauuuugucaaucuuuggaaaaugaucaugugauuuuugucuuuuaguccacuugcaugacuuauuacuuuaacuugcaagcacugcacuauuucuacauuucagagauaaagccaacuuggucacugucuuaguuaggguucuacugcugugaacagacaccaugaccaaggcaagucuuauaaggacaauauuuaauuagggcuggcuuacagguucagagguucaguccauuaucaucaaggcagguucauggcagcauccaggcaggaauggugcaggaggagcugagaguucuacaucuccaucugaagacugccagcaguacggguauuaaagcccauacccacaaggucacaccuacuccaacaaggccacaccucccaacagugccauucccuaggccaaguacauacaaaccaucacagucacgguauacacucuuugugauguaggucuacauccuguuugcaauuauuuuuuuuuauguacuuuuagucuaugguucuuaggaauauuggucugcaguuuucucuuacuacugaaucuuuaugugguuugguuauuaguauuuggguauuagagugauacgaucuucauagaagaaauccaggagugcuccuugugucuacuguuuuaaacaguuuaagaaauaaacuauuggcuguaacaauauuugaaagucugguagaauucuacugugaaugcauucagcccugccccccucuuuuuuuuuuuuccuuuuuccaaaaaauaaaaaauaaaagaugugacuuaugccuuuaaucccauuucucaggaggcagaggcacacagaucuuugagaguuugaggccagccugggauacagagugaguuccaggacagccaaagcuauacaaagagaaacacugucuggugggaaaaagcugggaagcuuaauaauauuucaaucucuucaauuguuuuggguuguuggcacucuggauuaaucugggugaucucaauaaauuuagaaaaucguuccuuccauuuagauuuuccacuucauggaguacaaaguuuuaaaaauauuucuauacaauauucugaauuucuuuggugucucuuauaauguuucccuguucauuucuaacucuguuaauuccauuuguucuuguuuuuuuuccaacuuuuugacuuguauaacuaggccauuuauucauguucuuucugauuccuuaauguaggugcuuagagcuacacacuucccucacaggacucaguuagaccuauccacuucccuuacaggacugcuuucaguaugucucaggguuuuuguuuuguacuguuuucauuuaguuccagaaagugaacugcuguuucagcaagaugccugccugcugccagacuuuucugcuaugauagugauggauucguauccaucuguaacugaaaaccaaaauaaacuguuccuucuguacguuuuaauuguagcaacagaaaaguaauacaaaagcugaauaaaaugccauugcagguaacacauaucacauauccuuuaaccacugagcaaaaaggaagguguaaguaugucuguaguauacugacuuacuucaggcauaugaccaggaucagaagacucucuccugagaacuaucuccauaaagucagcauuaauaccuuccuaagggcaauacccccauugaaccuacaaacucccacuaccucuuuaagauucaaccaccuccaaaccacacuggggaccaaagucaaaccauaacacuucuacuugaagaaauaugacauggaggaaauugucaauuaacauuucccaagagcuccacauguucaauacuguuccuuucagucaacauuuguugcuguauacugauaaucuaaugcuaguuagagucuuuccuuuuaccuccucaccccucuauucagaauuuucuauuaguuuuguuuuaguuugauuucauaaacuuaacuauauaguuuuuaaaauuuuuuauugauugagggaggagacaaguaggguaggaucaguccuuagcaacugcuacauuccuugaaguggucaaauaaucuucucuucgugcuuccucugguggcaugaaugugcaacucacucucuucuugaucaacuugagugccugauuauucuuggagauucugagcugcaacauggugcaaagacacaccucucugauauaaauucauuaucacuuucuuugcuuuuguguccuacaugugugugucuauugguuuggaugaaaauggccuccauagacucagggaguggcacuguuggaagguguggccuuauuagaagaagugugucauggggcuuugugguuucagaagcucaaaccaagcccaguggcacucuuucuuccugcuauucuucuugcugccugccuauugggaugaagaacucuuagcuaccuaccucuccaguaccaugacugccugcaugcagccauaguucccggaauggcagagguuuaaugaacuaaaccuuugaauugaaagccagcuuuaguuaaauguuuuccuuuuuaagauuugcuguggucaugaugaugucucugcacaguaaugaaauuaaguccaauuguuauaugauccuccuaaaauuugaaauuggaagcccucagacuguauuuagagucaggacuucuaauccuucccaaacaguuccacuaacugagguccaagcaaucauauaugagccuaugagagccauucucauucaagccagcacagguguuacaaguuuugucucagaguagggagucaacaccuuaaagugaaaggaugaaagagguuacuccaaucaaugauaccaggaagcaagcaggcacugccauacuaauaauggacaaaacagacuuuaaacaaaaauuagucagagaagaugaaaggcauuucauucugaucaagggaacaacuaaccuagacuugcaauucuaaacauuuaugcaccaaaccagguacauccaguuucaaaaagcauacuacuggaauuaaagacaagauuaaaaucggccaucuaacaguaaaugacuucaauacugcacuucauuucuccaaaagcagguugucuggacaaaaacaaaaaacaaaaagcaaacaaaacuaaaaaaacuaagaacaccgggauaaagugauaucauacaucagaggaaccacuacaggcuauuccauccaaaugcugaaguacauucuacucagccagccauggaaacuuuucucaaaacagaucacauucugaaacaaaaaaacaaaacaaaacaaaacaaaaaaccaaaucuuaagaaacagacaaaaacugaaguacuucauguauccuaucugacuauauuggucaggguuaacagaacuaauuauuuacacacgcacauacauguaugaaauuuauuagauuggcuuacaugcuauauccuggguaguuuaacaaugacugucuaggaauggaaaagacaagaacccuauagcuguuaaauucacaggccuggaugacucaguaguccuagacucuggcacggaagucuuugaaggauuccuggacagcaguuggaucuucagucuauauuggaauucugaaaguauguucuaauagcagcaaaagaaugccucauuagcaagauaaauaaacuugccagcaagacugagagcaagcaggcaaaaggcaaauuucuuccaugcccuuuuauguggguccaacagaugugguccauacuuauugucuucuuuagcguuagucuuccuguuugaaauaaucuauuaagaaaaucgcccccaucugugaucaauuugauuucagauuuagucaaguuaacagccaaaauuauccuuaauagagacuauaacacaauaaaaguaagaacaggaaacaucucuaauaaguacacaaacuccuaaagauuaggcaacucauuaauaaauuaugaaugggucaaagaagaacuuaagaaagaaagaaaauuugaaaacaagugcccaaaacucucugggacacaucaaaugcagcccuaauagggaaauuuacgccucuauugcuagcauuaaaggaccagaaagaguacaaauaagggacuuuaugauaaaauucaaaaauuuggaaaaaauaaaaaacaugaacagaccaagcccaggagacagcaaguaauaauuaaauaaaguagauauuaaugaaacagaaacaaauaauacaauacaaagaauaaaucgaagagcugguucuaugacaagauacgucauaucaacacucuguuguccaacuaaccaaaaguaacagaggaccagaaucaacagaauaaaaaaaugaacaagaaacauuguaacagacacaaaagaaauccagaguauuagaagggauuacuuuaaaaaccuguauuccuuuagucuggaaaaccuaaaagaaauggaaggauuucuaaauugauccaaaccaccaaagcuaaaccaagagaucaaccacuuaaaccaaccuugaacaaaugagacaaaaaugguaaaacaagcaagcuaacaaacaacaaaagccaggcacuaagucuagaugaauucuaccagacuuuuaaagaucaauagcaaacccuucuaaaauuauuaaaagcaaacaaauaaauaaaggaaggaagaaaaaaaagaaagagaaguacuucuaaaucaauaauaaaaccaguaucauucuaauaccaaagaaagaaaacuacaggccaauaucccugauaaacgucaauucagaaaucuugaauaaaauacugccaaacuaaagacaagcauucaaaaaaacaaaaacaaaacaaaaaaucguccaacaugaccauguuggcuuuauccagggauauagggauaguuuaacacauucaagacaauaauuuaguaaauaaaauaaauaaaccuaaagacaaaaaucacaugaucaucccaguagauaaagaaagggcuuugacaaaauccaacaugccuucaugaucaaagugcuagaggaagacuggagggagggaacauaacauaauaaagacuauagaugacaaacccauaggcaacauuuauccuaaauggggggaaaucaaaggaaucacacugaaaucaguaacuacacagugcugcccaccauccccacucccuuucaauauuccuuaaaacaccaguuggagcaaugaggcaagggaaagaaauuagaaauuaucccuaucugcagaugauacaccauacuuaagagccaaaaauuacaccagaaaaugacaggauauagaaucaacuuacaaaaaaacuaaccacuugucuauauaggaagaauaaauauaauaugaccuauucccauaguauagacacauucccacucacaauagccuagaagaaaaaaaaaaucuaaggagaaauaaccagggagguaaaaaacaaaacaaaacaaaacaaaaaaacccuauacagcaaaaacuuuaaaccuuuaaagagacugaagacacuauaaaauagaaagcgucccauguucaugcuauauaguuuacauagaauuaauauuguaaaaaugaccacuauacaaaaaaaguuuacagauucaaugcaaucacaaucaaauuucuaucuuauucuccacagaaauagaaaaaaauuucuaaaaucuauacagaaucaugcaauaccccagacagccaaagcuauugcaguuucuagaguaauugccauuccagauuauaagauauacuauagagccuuaguaaaguaauggcacaaaaagagauacauagaccaacagaacaaagaaaacaaaaacaggaggacaugugacuacagccaccuucugauauuugacaaagaugccaaaaacaugcagugaagaaaagauagcaucuucaagaaauagugcuaagaaaacuggaaguccacauguagaaaaacaaaaugaggaucauaucugucuaucaccuugcacaaaaaucuaacugcaaauggaucaaagaccuaaauguaaaaucugaaacccugagacugcuagaagaaaacgugggcaguuccuuacaggauauagguagagaaaaugaguuucugaauaggauuccauuugucuaagaauuaaaacuagcaagugggaccucauaaaacuaaaaagcuucuguagaacaacugaagagaaaauucauaggaugggagagaaucuugccagcuauauugcugagggaaacuuaauauacagaagauauaaagaacugaaaaaaaaaaaaaaaaaaccucaagggucaaaaaaacucauucaaauaauggacaauaguuucucaaaagaaucuauucuucuguucucaaaagaauaagucaaaauggcuaagaaauguugauuuaagugaauuaaauuaaauuuuagauaguaagaucaucaaagcugaguuucaaaggccuuccuucuucccuccauuacuccucuacuggcuaacacuguuguguguaagaaagcccaucuugauuuuaaucucuuuaaucugauucacuauaucccugauucuuuuacugguuaaaauguacuuggaaaucucuuaagaguauaagguuucugcucuaaagcuagaucacaauucuugauuguuaugaaagaaaauuaacuaagucaucuuuucucauuuuauuuacaaaaaauaguucuuauuauaaaagucccaaugaagagauacuucagcaguuaagagaacuuguugcucuugcaaaggaccuaaguucaguucccagcauguucauggcaguucacaaccauuuguauggcaaguuccagaagaucaguugccuucuucuggcuuccaaaggaauuaacaggcauuugauacauauacauauacauaaacacaggcaaauauucauaaaguaaaaauuaacuuaaaaacuaaauaucucguuacaaugaauaauaugcaucacugaaaaucuucuauaagaucgcaggaacaaaauaccaaaacaaacaaaaaaccaaauaguacacuugauaauuuggucuucgggcacagccaacaucaaguguuaaugcuggauuaugcagacaugacuguccgaaaacuaucuaugccaacccagcaaauggccccaaaauaauuccuacugcuuuaaauauuuaaaggccaauaauaauaauaaacuacaggaugguuugaaguauauggauauccucuaauuuauuucuucuuauaauauuuauacacuuucuguaguuaagauguagccauacaacccauggaaaacagagaaaucacccaucaccucagaagaaaagaauauuaacaaaugggagcaccuaaaaguauguuuauaaaggggcuggggagauggcuuggagguuaagagcaaaggcugcucuuuuagaggaccugguuuccagcacccacauggcaucucacaaucauuuguaacuccaguuucggggaucauauacuuucuucuaaccagcaccagggaaaacacucacaucauaaaaauuaaaaaaaaaaaaaauucugggcaugguaguuuuucagucaagggagcugaagcagggggagugcuaugaguuucagccaauucagguaacaagguaaauucuuagccagcuugaaguacagaguagggcucaucucaaaaacaauucucgccagguguaguggcacacgccuuuaaucccugcacucgggagguugaggcaggcggauuucugaguucgaggccagccuggccaaagugaguuccaggacagccagggcuauacagagaaacccugucucgacgccccccccccaaaaaaaaacaaaaacaaaaacaaaacaaaacaauucuccccaggaggauagaggcacugaauggucuuccagaagucaauucccagcaaccacaugguggcaugguggcucacaaccauccauaaugggaucugaugcccucuuuuggugugucugaagacagcgacggcguacucacaaacauuaaaacaaacaaaaccaacaaaaaacgcccuccuccccuaaaguucuguugcuccucuucaguucaaagcaggcauuuuuuuaaaaaaugaaacucacauaucucugcuauucuagauaucuauucaacauucuuucauacaaaauuuggacuuaucgccaauaccccacauaaggccugagaaccuuauaccaaauuugggucacaguaacaaaauuacaaacaccaaagucauggugcuccuuccuaacuuuaggccuccaacuacacccgggauuuucuuuuaaucuuauuuuuacuuuguaauagcuccgugggccaccgacucaccacuagcuugcugccugucugcucacagcaacuccugaguccgucgcguccucagcggccggaaggaagcgacagccgcccacacgcccgcccgcgcgucccccgagugcccuugggccaagccgcgccgggcuguaggcugcagggccacucagucccgcugagcgcccgggagcagagcggagcgccgagcugccggccuccuccuggcgacaccugcaggccugcggccgagccaggccucgcaaucgcggccucaucuuaccugcguucccacuacgacgaucugaggcagcuggaugauguccgcacccacuguguugaagacguccugcagcuuauugaugaccgggaucagcgccuccaugacccccgaaacacuggacccccaacccagcaggccacugcaaugaauggggacucgacccacagcccgcuugcuuccucuucuccuccgcccuuuccucgggagcccgcacccauugggccgggccagcacccagcccgcucccggcaggccacgcgccacgacag

SEQ ID NO: 8119 - RNA, 9979 nt, Mus musculus
aggaggacgagagaagauggauagagaagaggaugagccuuauccauguggcuucauauagccacagguagcuaugaacaccauaaaaggauagaauaauugggauaacuugccuaaucuaggugugcagcuuguaucauuaucaauuggcucugaauuuauugugugggcgucuucugaauugagaauuuauugauauauaaaacugacugauaauuauaagauucuugaguuuugauuuacuguguuagagagauuugugacagcuagccgcagggguuagauggcuaggaaaauacaagcagcucugagacaggcaaaccagagcugagaagacucugccuggggcuagccauggagcuggcaagaccgagaccacuggggcagagaguagccggcgcuagagugggaugguguauuuauuucauauuucccacaauagaaucuguaaauagcuuuggguagaaugguuauuuuuacaguguuaauucuagcaugccaugaacauaggaugccuuuccaucuucuaguauuuauauuugugucuucaguggcuuaaaaguuuucauuguagggucccuuuacuucuuugcuuguguuuaccccuagauauuuuauuuucuuugagguuacugugcucaugaucuccuucuuaguauguuugcugcugguguacagauagaaaagcuaugaagggugauucucuauccugccacguugcugaguuuuugguuucuacaaguuuuuugguacaauuuuuugggauauccaauuuauaguaugugucaucugcaaauagaaauaguuugacuucuuuuucuacuuguauuccuucaauuucuuucucuugccuuauugcucaccuaauauuuuagggacaguacugaaaagggauagacauaguggccaucccugucuuguuacugacacuguggaauugcuuuaagcuuuucuucauugaggaagauguuggcuguaguuuuuuucauauauaacuuuuauuguguuuccucuaguccuauauucuccaagacuuauaaugaaggcauguuggauuuugucaaucuuuggaaaaugaucaugugauuuuugucuuuuaguccacuugcaugacuuauuacuuuaacuugcaagcacugcacuauuucuacauuucagagauaaagccaacuuggucacugucuuaguuaggguucuacugcugugaacagacaccaugaccaaggcaagucuuauaaggacaauauuuaauuagggcuggcuuacagguucagagguucaguccauuaucaucaaggcagguucauggcagcauccaggcaggaauggugcaggaggagcugagaguucuacaucuccaucugaagacugccagcaguacggguauuaaagcccauacccacaaggucacaccuacuccaacaaggccacaccucccaacagugccauucccuaggccaaguacauacaaaccaucacagucacgguauacacucuuugugauguaggucuacauccuguuugcaauuauuuuuuuuuauguacuuuuagucuaugguucuuaggaauauuggucugcaguuuucucuuacuacugaaucuuuaugugguuugguuauuaguauuuggguauuagagugauacgaucuucauagaagaaauccaggagugcuccuugugucuacuguuuuaaacaguuuaagaaauaaacuauuggcuguaacaauauuugaaagucugguagaauucuacugugaaugcauucagcccugccccccucuuuuuuuuuuuuccuuuuuccaaaaaauaaaaaauaaaagaugugacuuaugccuuuaaucccauuucucaggaggcagaggcacacagaucuuugagaguuugaggccagccugggauacagagugaguuccaggacagccaaagcuauacaaagagaaacacugucuggugggaaaaagcugggaagcuuaauaauauuucaaucucuucaauuguuuuggguuguuggcacucuggauuaaucugggugaucucaauaaauuuagaaaaucguuccuuccauuuagauuuuccacuucauggaguacaaaguuuuaaaaauauuucuauacaauauucugaauuucuuuggugucucuuauaauguuucccuguucauuucuaacucuguuaauuccauuuguucuuguuuuuuuuccaacuuuuugacuuguauaacuaggccauuuauucauguucuuucugauuccuuaauguaggugcuuagagcuacacacuucccucacaggacucaguuagaccuauccacuucccuuacaggacugcuuucaguaugucucaggguuuuuguuuuguacuguuuucauuuaguuccagaaagugaacugcuguuucagcaagaugccugccugcugccagacuuuucugcuaugauagugauggauucguauccaucuguaacugaaaaccaaaauaaacuguuccuucuguacguuuuaauuguagcaacagaaaaguaauacaaaagcugaauaaaaugccauugcagguaacacauaucacauauccuuuaaccacugagcaaaaaggaagguguaaguaugucuguaguauacugacuuacuucaggcauaugaccaggaucagaagacucucuccugagaacuaucuccauaaagucagcauuaauaccuuccuaagggcaauacccccauugaaccuacaaacucccacuaccucuuuaagauucaaccaccuccaaaccacacuggggaccaaagucaaaccauaacacuucuacuugaagaaauaugacauggaggaaauugucaauuaacauuucccaagagcuccacauguucaauacuguuccuuucagucaacauuuguugcuguauacugauaaucuaaugcuaguuagagucuuuccuuuuaccuccucaccccucuauucagaauuuucuauuaguuuuguuuuaguuugauuucauaaacuuaacuauauaguuuuuaaaauuuuuuauugauugagggaggagacaaguaggguaggaucaguccuuagcaacugcuacauuccuugaaguggucaaauaaucuucucuucgugcuuccucugguggcaugaaugugcaacucacucucuucuugaucaacuugagugccugauuauucuuggagauucugagcugcaacauggugcaaagacacaccucucugauauaaauucauuaucacuuucuuugcuuuuguguccuacaugugugugucuauugguuuggaugaaaauggccuccauagacucagggaguggcacuguuggaagguguggccuuauuagaagaagugugucauggggcuuugugguuucagaagcucaaaccaagcccaguggcacucuuucuuccugcuauucuucuugcugccugccuauugggaugaagaacucuuagcuaccuaccucuccaguaccaugacugccugcaugcagccauaguucccggaauggcagagguuuaaugaacuaaaccuuugaauugaaagccagcuuuaguuaaauguuuuccuuuuuaagauuugcuguggucaugaugaugucucugcacaguaaugaaauuaaguccaauuguuauaugauccuccuaaaauuugaaauuggaagcccucagacuguauuuagagucaggacuucuaauccuucccaaacaguuccacuaacugagguccaagcaaucauauaugagccuaugagagccauucucauucaagccagcacagguguuacaaguuuugucucagaguagggagucaacaccuuaaagugaaaggaugaaagagguuacuccaaucaaugauaccaggaagcaagcaggcacugccauacuaauaauggacaaaacagacuuuaaacaaaaauuagucagagaagaugaaaggcauuucauucugaucaagggaacaacuaaccuagacuugcaauucuaaacauuuaugcaccaaaccagguacauccaguuucaaaaagcauacuacuggaauuaaagacaagauuaaaaucggccaucuaacaguaaaugacuucaauacugcacuucauuucuccaaaagcagguugucuggacaaaaacaaaaaacaaaaagcaaacaaaacuaaaaaaacuaagaacaccgggauaaagugauaucauacaucagaggaaccacuacaggcuauuccauccaaaugcugaaguacauucuacucagccagccauggaaacuuuucucaaaacagaucacauucugaaacaaaaaaacaaaacaaaacaaaacaaaaaaccaaaucuuaagaaacagacaaaaacugaaguacuucauguauccuaucugacuauauuggucaggguuaacagaacuaauuauuuacacacgcacauacauguaugaaauuuauuagauuggcuuacaugcuauauccuggguaguuuaacaaugacugucuaggaauggaaaagacaagaacccuauagcuguuaaauucacaggccuggaugacucaguaguccuagacucuggcacggaagucuuugaaggauuccuggacagcaguuggaucuucagucuauauuggaauucugaaaguauguucuaauagcagcaaaagaaugccucauuagcaagauaaauaaacuugccagcaagacugagagcaagcaggcaaaaggcaaauuucuuccaugcccuuuuauguggguccaacagaugugguccauacuuauugucuucuuuagcguuagucuuccuguuugaaauaaucuauuaagaaaaucgcccccaucugugaucaauuugauuucagauuuagucaaguuaacagccaaaauuauccuuaauagagacuauaacacaauaaaaguaagaacaggaaacaucucuaauaaguacacaaacuccuaaagauuaggcaacucauuaauaaauuaugaaugggucaaagaagaacuuaagaaagaaagaaaauuugaaaacaagugcccaaaacucucugggacacaucaaaugcagcccuaauagggaaauuuacgccucuauugcuagcauuaaaggaccagaaagaguacaaauaagggacuuuaugauaaaauucaaaaauuuggaaaaaauaaaaaacaugaacagaccaagcccaggagacagcaaguaauaauuaaauaaaguagauauuaaugaaacagaaacaaauaauacaauacaaagaauaaaucgaagagcugguucuaugacaagauacgucauaucaacacucuguuguccaacuaaccaaaaguaacagaggaccagaaucaacagaauaaaaaaaugaacaagaaacauuguaacagacacaaaagaaauccagaguauuagaagggauuacuuuaaaaaccuguauuccuuuagucuggaaaaccuaaaagaaauggaaggauuucuaaauugauccaaaccaccaaagcuaaaccaagagaucaaccacuuaaaccaaccuugaacaaaugagacaaaaaugguaaaacaagcaagcuaacaaacaacaaaagccaggcacuaagucuagaugaauucuaccagacuuuuaaagaucaauagcaaacccuucuaaaauuauuaaaagcaaacaaauaaauaaaggaaggaagaaaaaaaagaaagagaaguacuucuaaaucaauaauaaaaccaguaucauucuaauaccaaagaaagaaaacuacaggccaauaucccugauaaacgucaauucagaaaucuugaauaaaauacugccaaacuaaagacaagcauucaaaaaaacaaaaacaaaacaaaaaaucguccaacaugaccauguuggcuuuauccagggauauagggauaguuuaacacauucaagacaauaauuuaguaaauaaaauaaauaaaccuaaagacaaaaaucacaugaucaucccaguagauaaagaaagggcuuugacaaaauccaacaugccuucaugaucaaagugcuagaggaagacuggagggagggaacauaacauaauaaagacuauagaugacaaacccauaggcaacauuuauccuaaauggggggaaaucaaaggaaucacacugaaaucaguaacuacacagugcugcccaccauccccacucccuuucaauauuccuuaaaacaccaguuggagcaaugaggcaagggaaagaaauuagaaauuaucccuaucugcagaugauacaccauacuuaagagccaaaaauuacaccagaaaaugacaggauauagaaucaacuuacaaaaaaacuaaccacuugucuauauaggaagaauaaauauaauaugaccuauucccauaguauagacacauucccacucacaauagccuagaagaaaaaaaaaaucuaaggagaaauaaccagggagguaaaaaacaaaacaaaacaaaacaaaaaaacccuauacagcaaaaacuuuaaaccuuuaaagagacugaagacacuauaaaauagaaagcgucccauguucaugcuauauaguuuacauagaauuaauauuguaaaaaugaccacuauacaaaaaaaguuuacagauucaaugcaaucacaaucaaauuucuaucuuauucuccacagaaauagaaaaaaauuucuaaaaucuauacagaaucaugcaauaccccagacagccaaagcuauugcaguuucuagaguaauugccauuccagauuauaagauauacuauagagccuuaguaaaguaauggcacaaaaagagauacauagaccaacagaacaaagaaaacaaaaacaggaggacaugugacuacagccaccuucugauauuugacaaagaugccaaaaacaugcagugaagaaaagauagcaucuucaagaaauagugcuaagaaaacuggaaguccacauguagaaaaacaaaaugaggaucauaucugucuaucaccuugcacaaaaaucuaacugcaaauggaucaaagaccuaaauguaaaaucugaaacccugagacugcuagaagaaaacgugggcaguuccuuacaggauauagguagagaaaaugaguuucugaauaggauuccauuugucuaagaauuaaaacuagcaagugggaccucauaaaacuaaaaagcuucuguagaacaacugaagagaaaauucauaggaugggagagaaucuugccagcuauauugcugagggaaacuuaauauacagaagauauaaagaacugaaaaaaaaaaaaaaaaaaccucaagggucaaaaaaacucauucaaauaauggacaauaguuucucaaaagaaucuauucuucuguucucaaaagaauaagucaaaauggcuaagaaauguugauuuaagugaauuaaauuaaauuuuagauaguaagaucaucaaagcugaguuucaaaggccuuccuucuucccuccauuacuccucuacuggcuaacacuguuguguguaagaaagcccaucuugauuuuaaucucuuuaaucugauucacuauaucccugauucuuuuacugguuaaaauguacuuggaaaucucuuaagaguauaagguuucugcucuaaagcuagaucacaauucuugauuguuaugaaagaaaauuaacuaagucaucuuuucucauuuuauuuacaaaaaauaguucuuauuauaaaagucccaaugaagagauacuucagcaguuaagagaacuuguugcucuugcaaaggaccuaaguucaguucccagcauguucauggcaguucacaaccauuuguauggcaaguuccagaagaucaguugccuucuucuggcuuccaaaggaauuaacaggcauuugauacauauacauauacauaaacacaggcaaauauucauaaaguaaaaauuaacuuaaaaacuaaauaucucguuacaaugaauaauaugcaucacugaaaaucuucuauaagaucgcaggaacaaaauaccaaaacaaacaaaaaaccaaauaguacacuugauaauuuggucuucgggcacagccaacaucaaguguuaaugcuggauuaugcagacaugacuguccgaaaacuaucuaugccaacccagcaaauggccccaaaauaauuccuacugcuuuaaauauuuaaaggccaauaauaauaauaaacuacaggaugguuugaaguauauggauauccucuaauuuauuucuucuuauaauauuuauacacuuucuguaguuaagauguagccauacaacccauggaaaacagagaaaucacccaucaccucagaagaaaagaauauuaacaaaugggagcaccuaaaaguauguuuauaaaggggcuggggagauggcuuggagguuaagagcaaaggcugcucuuuuagaggaccugguuuccagcacccacauggcaucucacaaucauuuguaacuccaguuucggggaucauauacuuucuucuaaccagcaccagggaaaacacucacaucauaaaaauuaaaaaaaaaaaaaauucugggcaugguaguuuuucagucaagggagcugaagcagggggagugcuaugaguuucagccaauucagguaacaagguaaauucuuagccagcuugaaguacagaguagggcucaucucaaaaacaauucucgccagguguaguggcacacgccuuuaaucccugcacucgggagguugaggcaggcggauuucugaguucgaggccagccuggccaaagugaguuccaggacagccagggcuauacagagaaacccugucucgacgccccccccccaaaaaaaaacaaaaacaaaaacaaaacaaaacaauucuccccaggaggauagaggcacugaauggucuuccagaagucaauucccagcaaccacaugguggcaugguggcucacaaccauccauaaugggaucugaugcccucuuuuggugugucugaagacagcgacggcguacucacaaacauuaaaacaaacaaaaccaacaaaaaacgcccuccuccccuaaaguucuguugcuccucuucaguucaaagcaggcauuuuuuuaaaaaaugaaacucacauaucucugcuauucuagauaucuauucaacauucuuucauacaaaauuuggacuuaucgccaauaccccacauaaggccugagaaccuuauaccaaauuugggucacaguaacaaaauuacaaacaccaaagucauggugcuccuuccuaacuuuaggccuccaacuacacccgggauuuucuuuuaaucuuauuuuuacuuuguaauagcuccgugggccaccgacucaccacuagcuugcugccugucugcucacagcaacuccugaguccgucgcguccucagcggccggaaggaagcgacagccgcccacacgcccgcccgcgcgucccccgagugcccuugggccaagccgcgccgggcuguaggcugcagggccacucagucccgcugagcgcccgggagcagagcggagcgccgagcugccggccuccuccuggcgacaccugcaggccugcggccgagccaggccucgcaaucgcggccucaucuuaccugcguucccacuacgacgaucugaggcagcuggaugauguccgcacccacuguguugaagacguccugcagcuuauugaugaccgggaucagcgccuccaugacccccgaaacacuggacccccaacccagcaggccacugcaaugaauggggacucgacccacagcccgcuugcuuccucuucuccuccgcccuuuccucgggagcccgcacccauugggccgggccagcacccagcccgcucccggcaggccacgcgccacgacagaggugggcgcgcaaaggcugccgggagauguaguucaggcugaguggaacgcgaaggccuauucuagaagguuucagguaucgaccugaacugggcggguaaggaagcugagaccgugaaucugagucuacuauagucaaaaugcuag

SEQ ID NO: 8120 - RNA, 9979 nt, Mus musculus
cuagcauuuugacuauaguagacucagauucacggucucagcuuccuuacccgcccaguucaggucgauaccugaaaccuucuagaauaggccuucgcguuccacucagccugaacuacaucucccggcagccuuugcgcgcccaccucugucguggcgcguggccugccgggagcgggcugggugcuggcccggcccaaugggugcgggcucccgaggaaagggcggaggagaagaggaagcaagcgggcugugggucgaguccccauucauugcaguggccugcuggguuggggguccaguguuucgggggucauggaggcgcugaucccggucaucaauaagcugcaggacgucuucaacacagugggugcggacaucauccagcugccucagaucgucguagugggaacgcagguaagaugaggccgcgauugcgaggccuggcucggccgcaggccugcaggugucgccaggaggaggccggcagcucggcgcuccgcucugcucccgggcgcucagcgggacugaguggcccugcagccuacagcccggcgcggcuuggcccaagggcacucgggggacgcgcgggcgggcgugugggcggcugucgcuuccuuccggccgcugaggacgcgacggacucaggaguugcugugagcagacaggcagcaagcuaguggugagucgguggcccacggagcuauuacaaaguaaaaauaagauuaaaagaaaaucccggguguaguuggaggccuaaaguuaggaaggagcaccaugacuuugguguuuguaauuuuguuacugugacccaaauuugguauaagguucucaggccuuaugugggguauuggcgauaaguccaaauuuuguaugaaagaauguugaauagauaucuagaauagcagagauaugugaguuucauuuuuuaaaaaaaugccugcuuugaacugaagaggagcaacagaacuuuaggggaggagggcguuuuuuguugguuuuguuuguuuuaauguuugugaguacgccgucgcugucuucagacacaccaaaagagggcaucagaucccauuauggaugguugugagccaccaugccaccaugugguugcugggaauugacuucuggaagaccauucagugccucuauccuccuggggagaauuguuuuguuuuguuuuuguuuuuguuuuuuuuuggggggggggcgucgagacaggguuucucuguauagcccuggcuguccuggaacucacuuuggccaggcuggccucgaacucagaaauccgccugccucaaccucccgagugcagggauuaaaggcgugugccacuacaccuggcgagaauuguuuuugagaugagcccuacucuguacuucaagcuggcuaagaauuuaccuuguuaccugaauuggcugaaacucauagcacucccccugcuucagcucccuugacugaaaaacuaccaugcccagaauuuuuuuuuuuuuuaauuuuuaugaugugaguguuuucccuggugcugguuagaagaaaguauaugauccccgaaacuggaguuacaaaugauugugagaugccaugugggugcuggaaaccagguccucuaaaagagcagccuuugcucuuaaccuccaagccaucuccccagccccuuuauaaacauacuuuuaggugcucccauuuguuaauauucuuuucuucugaggugaugggugauuucucuguuuuccauggguuguauggcuacaucuuaacuacagaaaguguauaaauauuauaagaagaaauaaauuagaggauauccauauacuucaaaccauccuguaguuuauuauuauuauuggccuuuaaauauuuaaagcaguaggaauuauuuuggggccauuugcuggguuggcauagauaguuuucggacagucaugucugcauaauccagcauuaacacuugauguuggcugugcccgaagaccaaauuaucaaguguacuauuugguuuuuuguuuguuuugguauuuuguuccugcgaucuuauagaagauuuucagugaugcauauuauucauuguaacgagauauuuaguuuuuaaguuaauuuuuacuuuaugaauauuugccuguguuuauguauauguauauguaucaaaugccuguuaauuccuuuggaagccagaagaaggcaacugaucuucuggaacuugccauacaaaugguugugaacugccaugaacaugcugggaacugaacuuagguccuuugcaagagcaacaaguucucuuaacugcugaaguaucucuucauugggacuuuuauaauaagaacuauuuuuuguaaauaaaaugagaaaagaugacuuaguuaauuuucuuucauaacaaucaagaauugugaucuagcuuuagagcagaaaccuuauacucuuaagagauuuccaaguacauuuuaaccaguaaaagaaucagggauauagugaaucagauuaaagagauuaaaaucaagaugggcuuucuuacacacaacaguguuagccaguagaggaguaauggagggaagaaggaaggccuuugaaacucagcuuugaugaucuuacuaucuaaaauuuaauuuaauucacuuaaaucaacauuucuuagccauuuugacuuauucuuuugagaacagaagaauagauucuuuugagaaacuauuguccauuauuugaaugaguuuuuuugacccuugagguuuuuuuuuuuuuuuuuucaguucuuuauaucuucuguauauuaaguuucccucagcaauauagcuggcaagauucucucccauccuaugaauuuucucuucaguuguucuacagaagcuuuuuaguuuuaugaggucccacuugcuaguuuuaauucuuagacaaauggaauccuauucagaaacucauuuucucuaccuauauccuguaaggaacugcccacguuuucuucuagcagucucaggguuucagauuuuacauuuaggucuuugauccauuugcaguuagauuuuugugcaaggugauagacagauaugauccucauuuuguuuuucuacauguggacuuccaguuuucuuagcacuauuucuugaagaugcuaucuuuucuucacugcauguuuuuggcaucuuugucaaauaucagaagguggcuguagucacauguccuccuguuuuuguuuucuuuguucuguuggucuauguaucucuuuuugugccauuacuuuacuaaggcucuauaguauaucuuauaaucuggaauggcaauuacucuagaaacugcaauagcuuuggcugucugggguauugcaugauucuguauagauuuuagaaauuuuuuucuauuucuguggagaauaagauagaaauuugauugugauugcauugaaucuguaaacuuuuuuuguauaguggucauuuuuacaauauuaauucuauguaaacuauauagcaugaacaugggacgcuuucuauuuuauagugucuucagucucuuuaaagguuuaaaguuuuugcuguauaggguuuuuuuguuuuguuuuguuuuguuuuuuaccucccugguuauuucuccuuagauuuuuuuuuucuucuaggcuauugugagugggaaugugucuauacuaugggaauaggucauauuauauuuauucuuccuauauagacaagugguuaguuuuuuuguaaguugauucuauauccugucauuuucugguguaauuuuuggcucuuaaguaugguguaucaucugcagauagggauaauuucuaauuucuuucccuugccucauugcuccaacugguguuuuaaggaauauugaaagggaguggggauggugggcagcacuguguaguuacugauuucagugugauuccuuugauuuccccccauuuaggauaaauguugccuauggguuugucaucuauagucuuuauuauguuauguucccucccuccagucuuccucuagcacuuugaucaugaaggcauguuggauuuugucaaagcccuuucuuuaucuacugggaugaucaugugauuuuugucuuuagguuuauuuauuuuauuuacuaaauuauugucuugaauguguuaaacuaucccuauaucccuggauaaagccaacauggucauguuggacgauuuuuuguuuuguuuuuguuuuuuugaaugcuugucuuuaguuuggcaguauuuuauucaagauuucugaauugacguuuaucagggauauuggccuguaguuuucuuucuuugguauuagaaugauacugguuuuauuauugauuuagaaguacuucucuuucuuuuuuuucuuccuuccuuuauuuauuuguuugcuuuuaauaauuuuagaaggguuugcuauugaucuuuaaaagucugguagaauucaucuagacuuagugccuggcuuuuguuguuuguuagcuugcuuguuuuaccauuuuugucucauuuguucaagguugguuuaagugguugaucucuugguuuagcuuuggugguuuggaucaauuuagaaauccuuccauuucuuuuagguuuuccagacuaaaggaauacagguuuuuaaaguaaucccuucuaauacucuggauuucuuuugugucuguuacaauguuucuuguucauuuuuuuauucuguugauucugguccucuguuacuuuugguuaguuggacaacagaguguugauaugacguaucuugucauagaaccagcucuucgauuuauucuuuguauuguauuauuuguuucuguuucauuaauaucuacuuuauuuaauuauuacuugcugucuccugggcuuggucuguucauguuuuuuauuuuuuccaaauuuuugaauuuuaucauaaagucccuuauuuguacucuuucugguccuuuaaugcuagcaauagaggcguaaauuucccuauuagggcugcauuugaugugucccagagaguuuugggcacuuguuuucaaauuuucuuucuuucuuaaguucuucuuugacccauucauaauuuauuaaugaguugccuaaucuuuaggaguuuguguacuuauuagagauguuuccuguucuuacuuuuauuguguuauagucucuauuaaggauaauuuuggcuguuaacuugacuaaaucugaaaucaaauugaucacagaugggggcgauuuucuuaauagauuauuucaaacaggaagacuaacgcuaaagaagacaauaaguauggaccacaucuguuggacccacauaaaagggcauggaagaaauuugccuuuugccugcuugcucucagucuugcuggcaaguuuauuuaucuugcuaaugaggcauucuuuugcugcuauuagaacauacuuucagaauuccaauauagacugaagauccaacugcuguccaggaauccuucaaagacuuccgugccagagucuaggacuacugagucauccaggccugugaauuuaacagcuauaggguucuugucuuuuccauuccuagacagucauuguuaaacuacccaggauauagcauguaagccaaucuaauaaauuucauacauguaugugcguguguaaauaauuaguucuguuaacccugaccaauauagucagauaggauacaugaaguacuucaguuuuugucuguuucuuaagauuugguuuuuuguuuuguuuuguuuuguuuuuuuguuucagaaugugaucuguuuugagaaaaguuuccauggcuggcugaguagaauguacuucagcauuuggauggaauagccuguagugguuccucugauguaugauaucacuuuaucccgguguucuuaguuuuuuuaguuuuguuugcuuuuuguuuuuuguuuuuguccagacaaccugcuuuuggagaaaugaagugcaguauugaagucauuuacuguuagauggccgauuuuaaucuugucuuuaauuccaguaguaugcuuuuugaaacuggauguaccugguuuggugcauaaauguuuagaauugcaagucuagguuaguuguucccuugaucagaaugaaaugccuuucaucuucucugacuaauuuuuguuuaaagucuguuuuguccauuauuaguauggcagugccugcuugcuuccugguaucauugauuggaguaaccucuuucauccuuucacuuuaagguguugacucccuacucugagacaaaacuuguaacaccugugcuggcuugaaugagaauggcucucauaggcucauauaugauugcuuggaccucaguuaguggaacuguuugggaaggauuagaaguccugacucuaaauacagucugagggcuuccaauuucaaauuuuaggaggaucauauaacaauuggacuuaauuucauuacugugcagagacaucaucaugaccacagcaaaucuuaaaaaggaaaacauuuaacuaaagcuggcuuucaauucaaagguuuaguucauuaaaccucugccauuccgggaacuauggcugcaugcaggcagucaugguacuggagagguagguagcuaagaguucuucaucccaauaggcaggcagcaagaagaauagcaggaagaaagagugccacugggcuugguuugagcuucugaaaccacaaagccccaugacacacuucuucuaauaaggccacaccuuccaacagugccacucccugagucuauggaggccauuuucauccaaaccaauagacacacacauguaggacacaaaagcaaagaaagugauaaugaauuuauaucagagaggugugucuuugcaccauguugcagcucagaaucuccaagaauaaucaggcacucaaguugaucaagaagagagugaguugcacauucaugccaccagaggaagcacgaagagaagauuauuugaccacuucaaggaauguagcaguugcuaaggacugauccuacccuacuugucuccucccucaaucaauaaaaaauuuuaaaaacuauauaguuaaguuuaugaaaucaaacuaaaacaaaacuaauagaaaauucugaauagaggggugaggagguaaaaggaaagacucuaacuagcauuagauuaucaguauacagcaacaaauguugacugaaaggaacaguauugaacauguggagcucuugggaaauguuaauugacaauuuccuccaugucauauuucuucaaguagaaguguuaugguuugacuuugguccccagugugguuuggaggugguugaaucuuaaagagguagugggaguuuguagguucaauggggguauugcccuuaggaagguauuaaugcugacuuuauggagauaguucucaggagagagucuucugauccuggucauaugccugaaguaagucaguauacuacagacauacuuacaccuuccuuuuugcucagugguuaaaggauaugugauauguguuaccugcaauggcauuuuauucagcuuuuguauuacuuuucuguugcuacaauuaaaacguacagaaggaacaguuuauuuugguuuucaguuacagauggauacgaauccaucacuaucauagcagaaaagucuggcagcaggcaggcaucuugcugaaacagcaguucacuuucuggaacuaaaugaaaacaguacaaaacaaaaacccugagacauacugaaagcaguccuguaagggaaguggauaggucuaacugaguccugugagggaaguguguagcucuaagcaccuacauuaaggaaucagaaagaacaugaauaaauggccuaguuauacaagucaaaaaguuggaaaaaaaacaagaacaaauggaauuaacagaguuagaaaugaacagggaaacauuauaagagacaccaaagaaauucagaauauuguauagaaauauuuuuaaaacuuuguacuccaugaaguggaaaaucuaaauggaaggaacgauuuucuaaauuuauugagaucacccagauuaauccagagugccaacaacccaaaacaauugaagagauugaaauauuauuaagcuucccagcuuuuucccaccagacaguguuucucuuuguauagcuuuggcuguccuggaacucacucuguaucccaggcuggccucaaacucucaaagaucugugugccucugccuccugagaaaugggauuaaaggcauaagucacaucuuuuauuuuuuauuuuuuggaaaaaggaaaaaaaaaaaagaggggggcagggcugaaugcauucacaguagaauucuaccagacuuucaaauauuguuacagccaauaguuuauuucuuaaacuguuuaaaacaguagacacaaggagcacuccuggauuucuucuaugaagaucguaucacucuaauacccaaauacuaauaaccaaaccacauaaagauucaguaguaagagaaaacugcagaccaauauuccuaagaaccauagacuaaaaguacauaaaaaaaaauaauugcaaacaggauguagaccuacaucacaaagaguguauaccgugacugugaugguuuguauguacuuggccuagggaauggcacuguugggagguguggccuuguuggaguaggugugaccuuguggguaugggcuuuaauacccguacugcuggcagucuucagauggagauguagaacucucagcuccuccugcaccauuccugccuggaugcugccaugaaccugccuugaugauaauggacugaaccucugaaccuguaagccagcccuaauuaaauauuguccuuauaagacuugccuuggucauggugucuguucacagcaguagaacccuaacuaagacagugaccaaguuggcuuuaucucugaaauguagaaauagugcagugcuugcaaguuaaaguaauaagucaugcaaguggacuaaaagacaaaaaucacaugaucauuuuccaaagauugacaaaauccaacaugccuucauuauaagucuuggagaauauaggacuagaggaaacacaauaaaaguuauauaugaaaaaaacuacagccaacaucuuccucaaugaagaaaagcuuaaagcaauuccacagugucaguaacaagacagggauggccacuaugucuaucccuuuucaguacugucccuaaaauauuaggugagcaauaaggcaagagaaagaaauugaaggaauacaaguagaaaaagaagucaaacuauuucuauuugcagaugacacauacuauaaauuggauaucccaaaaaauuguaccaaaaaacuuguagaaaccaaaaacucagcaacguggcaggauagagaaucacccuucauagcuuuucuaucuguacaccagcagcaaacauacuaagaaggagaucaugagcacaguaaccucaaagaaaauaaaauaucuagggguaaacacaagcaaagaaguaaagggacccuacaaugaaaacuuuuaagccacugaagacacaaauauaaauacuagaagauggaaaggcauccuauguucauggcaugcuagaauuaacacuguaaaaauaaccauucuacccaaagcuauuuacagauucuauugugggaaauaugaaauaaauacaccaucccacucuagcgccggcuacucucugccccaguggucucggucuugccagcuccauggcuagccccaggcagagucuucucagcucugguuugccugucucagagcugcuuguauuuuccuagccaucuaaccccugcggcuagcugucacaaaucucucuaacacaguaaaucaaaacucaagaaucuuauaauuaucagucaguuuuauauaucaauaaauucucaauucagaagacgcccacacaauaaauucagagccaauugauaaugauacaagcugcacaccuagauuaggcaaguuaucccaauuauucuauccuuuuaugguguucauagcuaccuguggcuauaugaagccacauggauaaggcucauccucuucucuauccaucuucucucguccuccu

SEQ ID NO: 8121 - RNA, 22253 nt, Mus musculus
gggacgccacagacggacagagccggaagugaguucgugaguggccaccggggaaagcacagccggagcgagaggcgcagcggcacggcgggugagcagugggaugcuggcugcucgaggaagcggaagacgcuggcuuuccccaggcauuuccggaaugguagcagcgcuccgacccgggcgggggcgugggggaggguccugcccuggcgcggcuuuuucgccauccagcccucgccguggggccucugggcggcgguggagccgcguuuagugggcaguggucgcuuuuccaacgagcuccccgcggccccgaggugagacguuucccccuaguugaggguagggaaaccggcucagggaaguugugcugcccacagaggcucaggccugcgguuugcguucuuauccgaagguuccacucgcugccucccggagccugcucugucuggagacccaggcuguucucggacuugaucucugcagauuaggagaaaacuuggguaaaccaaugagcuagagucgagggccagcuaguuaugcauagggaagaacggaugaccucucuuaaccuauuuggaacccggccuuugggaacaggacugugaaaagccaggacgacuuggauuugauagccagagaaaggggggaauuuucaccguucgccaaggucccuugucgcuagucugaauuguuaugcacugcgauuuauucuggcuuuuuaaacuaggaugaugagauggcucagcgcucuuacaaccaagguuccgaccccgggaacucacguuguaaaaagagagagcugaaucccacaauuugucuucugaccugugaccggcagcaugugcgugcccauacauauccacacacaaaauaacuguuuauuuguuuguuuaacuuuaacuccuauuuuauagcaauguugguagacagagcugcagcauacuagauacaaagaaggaguuaagagacaggcuuauuuuccuggaucuguaggugauuaaaagucacugaaguguuaaauucuuagauuucccaugcuuugcugaccccuuuuggggcuccucaaguuaaauccacuacuacauaauacaaaaagaaaccuccauauuuacagugcuuuccaagggacacugauuagugagguguggcaaagaaugggcagguugucuugcuauucucucuuugcaauccacaccuaaauagcccuuugcuuaccuaacuccagaauaggacaaacuauagugucagagccuuggcagaaaagacuugguauaucauguagguuuauguuaaggagucuuauuuaagugaucauauauaaaaauuuuggcuagacauuuugguguacuccugaauucccagcacucaggaguugaagauaggaagaucaaggccguaguggcuauauaguuaagaggccagccuuggccacacaagacgcugucuuugcccaauacacacacauacacacacacacacacacagcaaaagcuuaagugaauaguguuguuucagagucacaaagugugagugugguguguaggugaugcuuauaagccaucaaguccagguuuucucauugguuuucacuuugaaauggaagaugagccuuaauuagggaagucuugacauuaaucacaguuacaaaagcucucuagaguagaaucuggucuagguaaagggaaauguuccugucaaggcccuggauugucuaguucuguaccuuaaaagaagaaaaaaaaaauguuuuaaacagcuuauugcuauguaacugaguauagccuaaaacucaagcuuccccugccgcauccagccucgugaaagaugcaguuacagguguaugccagcauacuuggcauuagaaaucuuuuuucuuccuuugaaauagugauagagcauuacaaaguccccuugugcugaagugcuaaaacuacuuacuuguuuugagucaaagcugaagauaaauguauauucaaaguggacggcagcugcauagccuggcaaguggacggcagcugagagcgaguugugccuuucuauuacugaccuuuaccuggauaugugacagaguccggcuaaggcagcgugucugugucugaagggacuugucagucuagucaauaauuuggaucuuagguuguagaagagaagaagagauacaaaauucccaaaacuuggaaaccagagagaaagaaugccuagaaauagaaguguuugcuggcaguaacguuagguguugcugcuguugcuacugcugcugcuguuuuuaaugugaugaggucucacuguguagcccugacuguccuggaacucacuguauagaccaggcugccuucaaacucaugcuaagagaucuacuugccuccuaccaaacccaacauaaaguaaguuuuugguuugguuugguuugguuuugauuuuaaugauauauaagcauauuauuaguuuuacagguaaaacuguugucauguauucagagauucauucaauuguguuugcucaccaucuacuacuucccauuagagugagaaaaaaaagucccugcugucacauagcuagcuuauuuuucaggagcuauaagguaagaacccgauaggagucuauaucaggcuuaguaaguacuacagggcaauauagcaaaaacauucuuagaggcaacaggauagagcacagguucuagagcaaacagguucagggucaaauccauguccuacaacuccagcucuagugugacccauguucccauuauagaacaauaugaugacagugucuccaucccaaccacaguggcaggacugucccaacaccuaguacuuucuuuggaagagacaggaacuuuaaaaaccuucauagaauaaucuguuuccaguuuuccuuucuggccucugacuccucuaucugauagaaccaaaacuuccccagaauggacaucagaggcuaugacaauucccagucauuucuuuucauugcuccagcaaacaagcauugcacacuagguaccaaagaaacagcaauaaccuagauaagccauggauagacaggccugcggugccaagugugguucucagggggaguuaggucaggaagucagaggcaagacaguuuuugaaaauacuuggcucuugugugaaauuuuauauuuagggaaaacauucaaguuuuuacuuggggcaauuuuuauucuuuuauggccccagagcaaggacuguaacagcccagguucaccuccauacaugauaaggaguaacagaaacccuuuuagugaaggaauuuucauugacaucuucauuguuucuaaacagugcucuuugcugacuacuagguuguuucugaucuuuacuuugaaugauaaugcugaugacaauuccccagcaauguuuucucacggcugucucaucugguccuuccaucacaguccugucugccucacagggcucacuguccacgugaacagucucacuagcacuuaucauuuguuucugugcuugcuucucaguaaaccuacagcuuaccauuucugcuagauuagcuagccagcuugcacugugaucagccucuccacuuucccagugcugggauucuaagcccaugcuaccacaucuugcucuucauguugguccuaaggaucaaacuuguguccauaugcuugcacgacaagcacaucacucacugagucgucucauuaggaagcagaugucucacgucaccuuuacccagaagguugaccuugucugaacaaaagucuucggguuuuaaaauauauacaauaguguauuuauaaauauuaaugcagcuagacaugguggccuaggacuauaauuuugucacuuugagagacugagacaagaggauugccaccaguucaaggucaaccuaaaauacagaguaaaacucuuguuacaaaacaguaauguuguaugucuguggaucaaaaagaaagggagacuggagguaugguugguguuaggauacuugccuggcaugcauggagcccuggguucaacccccaacacaacaacaacaaaaaaaaggaacguggggcuggagagaugggcccagguucaauauguaucacccauguggugguugacaacagucuguaacuuuauuuccagggaaucagcacccucuucugggcuccacaugcaaauauucaggggaaacauacauauaaaacauauauauauauaacagauauauauauauauuauauauauguuauuauaaagaaaaaauacaucuuuuuuuuucuguuuuauuuuguuugaugugguuuugguugguaggguguuugugcuuauuauugucuuuuguccuccccugccagcagguuucaaaugauauauccugcccagaaagcuacaucaggggccaacagugguccagauaugaaguuugcauguccucuugcaagguauaacuggccauagcacaauguaaugugaguuaguuaagacagacaccuggacaagggguauggguaugggagagaggcuugacaccaguacacagcguuagagcucugagguugggugcagcuccaugcuagagcuuggcuucuauauccagcaccagaaagaagagggggucaccaaacaguauuuuucagggugguagaacaaucagggagcacaggcagagccuccaaaugaauucauucuuccuuucucucuuucuuucuuuccuuuuugggguggaguggggagggguuguuugagauagaaucucaaguaguccaggcuggcccugaguucccuaguaugacuuuaaacuguugauucucuuaccucuacauuucaagugcccaaauaggguuguuuuguuuuguuuugcuuugcuuuuagguuuugguucuuuugcuuguuggguuuuuuuuaacaucuuuuacuagaaaaaaauuuuuucauauauuauauuuugaucauguuuuccccucccugaauuccucucuacaucucuacccacccaacuuuguauuccuuuuuuuuucuuuuaaaacacacacacauacauacauacaaccauacaaaugaaaaucaaaguaaaaaagcaaaauaucaguaaaacauaaaauguccaaacauagcaaaaugagacaaaaagacuacaaagguacucuuggaucauuuuggauuggccaacuacugggcauagugcaugcccugagguguaguuaauguauacauugagacucuguuauagaaaauuaauuuuuccuuugcaaguuaauaucaauugcagauagcuucuugguuagggaugggagcucuuauccacgucuuucucucagugcugggaccucaucuggcugaaaccuguguaaaccuugugcaugcugccacagucccugcaaguucacaugugcauuaguugaagucauccauuaccucuggcucuuaaaauauuuuuucuuccucuuccacauaaccccagaucccugaggagagggguuuaauaaagacauuccauuuagaucugaaucucuuacucucugcacauuguccaauuaugaguuaguuccuaucugcuacaaaaagaaacuuggaugacagucaagcaaggugcugauuuuuggguauagaagaaugccauuaggagucauuuuacugcuguguuccuauagcagagcaauggcauuuggcuuugcuguaggccugugaacugucuaguaucagguucucagcugccuuagcagugucaaggauggcuuccaucucauggagugagccuuaaaucuuaucagaaagugguugguuacuccuauaacauucauaccacuauugcaccaauaugauuuguaagugucuguugucaguugcauggauuauagcuaagauacugaugcuuucuccucugguagcauacagaauacucugcaauaccaugaaugcuagucaguaggggugaaaccucuaguucagcaccagcucaccuuuuccauguuugacgccauauagaaguguucucuaaaguaauaggaccuuaacuuuggauuguggagagcaaccaauagccuugacaacagucugagauguguggggguguccauggugccucuuuggccugcucaacaagcuguuacucauuccuggcacuggagguuugaaaacuugguuaguugggauacugucagagccuauuaucugguaacucaugucucugaguguuaguugucccuccccacauuccuucuuguauccccuucccuacuuaaucccucaauccuaguuuccucuuugucucuccauaacacuguucuauuuucccuucuaagagaugauuucacaggcagguaucccaacagcuaguccaggggcuuggguccacacacccugccccaaccuaugaguccaggucuguaggucccagcauguuuuagucauagucaaagucauagucacugcugcuucucuccauagagccagacucccacugccugaacaauuggucagugcuuacuuagcauucugguggcccuggguuccaucuccaucaccaaccuaaggaagaaaaguacauuccuuguccuuaucauaauaauggguuuccucgugacauuuucauacgugaauauaacguacuuuuuuuugggggggggggggggucaagacaguuucucuguauagcccuggcuguccuggaacucacucuguagaccaggcuggccucgaacucagaaauuugccugccucugccucccaagugcugggauuaaaggcgugcgccaccacgcccggcgaauauaauguacuuuuuauacucaucacugacugccuuuuucggcccuauucucugugauugccuuccucuuccuaacuguugcccucugccuucugagugcguaacccagugaguuccguuagguuauuuacaggauccuggauacuucagcaguagcuacaccacugaagaaaacguuuuuuccuuuccucagcaaucguuaaccacacuuagcuacgugcugccuggacgaaggcacuccauaagcacaucacaccucccucuaguccgugccuucucugucccucuucacagaguucucugagcauuggagagaugauauaaauguacugucuuuucuuccccuuaggagucagcauuggcagucguguugagcuacagaggagacauuucuaagcuuuuuuauugcugcuguucugggucugggugcaacggucugugggcccugacagccaggagcaagaaugaagaccgugcucaugguagcagaaaagccaucccuggcacaguccauugccaaaauccucucccgagguaggaaaaacaaacacuaggcuguuugauugcuuucaucuauaagcagagucuuuugugcuuuuuugaucauuucuuuuucugguggguucagcugggauuggcagguuucaggaagcaccuuauuagcaagucuccugugacaugcuauguccacauguggaagucccagggcugaagccuccaggaaaaguaaugauguacaaagugcagucauugucagcaugcugggcuuaguuuuugcaccacuagauacucacuacuaucugcugggcccuggaugugguuacaguuacauucccuacaucucaugucacucacaaguggccagugaccucagagccaggaagguaguggaagauuugcccaucaggauccacucugcuacugaggugguacauggagggagggcccucuaaauagaaagaguacuuggaugcugaguggcuauccagcaauggcagacauccacuuugaccuccuuuuaccagcucuuggaggaggaagagccccuaguuaggcugagaauacacacuccaaagguccagggggauccagaaggcaucaucucacuuccaagugccaagaguguucagcugaggaaccauaguguaagauauaauaaccuuaaaaucuaaauaaauaaagguagaauucaaauugaaaauagaaauggagugagaccugaagagucuccgccucuaguucccaggaaguaugggacuggugugaauuucugugaaacuuucauagaugcuuccaucccucagcaccauuaagccacccaguacccacuuaucugcagugggagcuaagggauguuaccagugaccacucuggagaaggagaacucguguccccugacaguuagcauguaggcucagggacccacaggguuauaagucagccucacaguugucugugugguuugccucccuaggaaacauguccucacacaaagggcugaauggggcauguucagugcacaaguacacaggaaccuuugcuggccaaccuguccacuucaagaugacgucugucugcggucaugugaugacacuggauuuucuggguaagaugaccacucuccuccugucucuguccuauugaaaggaacaccguacagcacuacccaggguccaguuagacccuguucccaacagaucaggaagugguuaacagcuggguaaguuacccguccccaucucugcaugauacacccuauccuauuccuaguugugacagcugcagaggccaagccuuugugaaguguggcucagugucuuuggauacgguuuacagggaaguacaacaagugggauaagguggauccugcagagcucuucagccaagcuccaacagagaaaaaggaagcuaaccccaagcugaacauggucaaguuccugcagguaagggagcaucuacaagcccaccgaggagcccaucuuauuaaaaaaacaaacaaaaaccaaaaaacuggaaacgucuaauccuucccuuccugaguaauguaauguaagcugcuaccaugugguuaaagcccuuggaagcuaucuuugguuauccaaaccagcccagucaauauugccuaaguuauaauuugaaaaauaggucuuaggugcuaacuggucugauauaacauccuugacggcucauggugagauuaccggcaccagggaggcagaggcagaugaaccccugugaguucaaagccagcuuggucuacacagacagacccugucucacucaauaagaaaaaaacaaaaaucugagaaaguguuucaagaaauacuuguuuacaaaaaacaaaacaaaacagaacaaaacacuggaaaauaaagauaaguuuaaaggaaaaacaguaaaaccacaugauccaaaacaagcacuguuaauacugaacuguuucauuucacucuugaugcuuaugucauacggagaggaggagggccagugagaguagaugagggcgagagaaaaugauggggucgaauguacuagaaguauauuauguacauguuugaaaauguaaaaaguaaggccucucccucaggaaauuaaggagcacacacuguauuuugugacuauauaauaaaaguaaaaauccuuauccuagggguuagauggcucaguggguaagagcacuugcugcacaaacauaagauccugaguuuggaucuuagcacccauggucagugcuguggagggcagagacaggaggaucgcuggggcuugcuggcuaaccacguacuucaagguucggugagaaaccuugucuuaaguggacaagacagagacugguagaacaagguaccccacaguguccucugacucugccccacuuaugcaccugcuugcccugcacaugcuccacaccacacgcagaagcauagacagacuguaaauacaauuuucugaucuaacaguuugauaguucugaaccaaaaccuuuucugagucugagacagccucgcuguagacugcuucuugcucagcuccucguacuggaagcccaguaccugguuccaucuccuguccccaaaggggaaugucauaggguugauugucagugugugcuuuguggcagguggagggcagaggcugugacuauguugugcuguggcuggacugugacaaggaaggggagaauauuugcuuugaggugaguguggagaccacucugguuuucuuuagaccuuuuccccaccuucccaaucagaguuugucacacuauuccuaagguuaacauaagggaguauagggcucaaaaaaacaucucccaaccccuugauuucagaaaaucuguggcuacuuuaaaugcauagaccuagagguggagaaacgccucauugguuaagagcacuuguucuuacaaaggacacagguuucacaaccaucuguaacuuccaagguaucugaugcccuccucugaggucaccaagcaugcacauugggcacauacagacagacagaacacucauacacauaacaugaaauaaaugaaucuuuuuuuaaaaaugcauaaacuagggcccacaagaugggucugcacaugaaggugcuccccacuaagucugacacccugaguuuaauccccagggccccacaugguaggaggaugcaaacucaugagagccucagaaagcuguccucugaccucuaacucacaugcacaccacacacagaccaguuagugguagucagaguaguaauuuuuuuaagcaccauucugggugggugcaaguuucagaauuuucaauguuuggcuuggcuccaugccuguuguagauuuucaguuacuauaguuuaucuccucagcaauguacuaauauguaugaguauuuugccuauauguauguauuuuacuguguacaugccugguacccucacaggucaaaaaagggcaucagauuucccagaccuggaguuacacauaauuuuaaaccugaguccuuugcaagagcaacaggugcucuuaaccacugagccaucucucuagccccuggucuuaucucccacuuucaugugucuucugcccuguccauccuagggaguccugccugcagggagacugguggagguuucccaaaugaccucuaaugacacuuuaaugcuacuggcuaugccugcugguccugccacucacugccuguuguacuguagcuccauacaggucaccucuauauccuuauaccccagcccuaaccugcgacuugucacacuuaagugcaugagauggcuguaguaagacaggaauuuaaggcgcccagaauucucauucaucucucuuagaaaacucaacucauacugucccuucucagauaccuucuucucuccuuucucugcuccaucugacaggagcguucucuuagaaggccuuugccucugguacuagaaacaauaacaguugauaaggucacugcuuucccauaauguugccacugcaugcccuagcuucucugcuccucccccauauagccuuagugagucucaguuccaggaccuucuauaccuagcucccacccccauacagagccuacucuaaccuuuccauucuuagucauuuuaucuuuuccuuugucuguucuccgaucauguaaaaauucuacccauccauccaagcacucccuacucccagaaaagggaagggauuugggaccaaaaaguccuuugugugcuggauacagcauugacugguuaguucaggugaaagugcacgagaagggaaaagguagcagccuugaggcaacacuaagaggaagugggcugaggaaugggugcauaucuggaagggagugcaacaagcaagguacccagguugcaagggauuucuggggaggcuaagaugucuagaagggaaagagauauaggagggccuaguaggggugggaaaaggcuaacccugaaaggcccgaucagcacuggggguaaagagugaaaggcagagacgaggaauuaaccacagccaguauucuuccucccagguccuugaugccguucugccugucaugaauaaugcccacaauggugagaagacaguguuucgugccagguucagcuccaucacugauacagacaucuguaaugccaugacccgccugagcgagccagaccacaaugaggcacucucaguggaugcccgccaggagcuagaccugcgcaucggcugugcauucacuaggugcuguucccugccacaugcacauacucucccuuuagccagggcccgaagagccugcauaaguuaccagagaugccauuuauauauuuaucagaugcacaucacauaggacacaacuuuuuuuuuuuuuaagauuuauuuauuuuauguauaugauuauacuauagcugguuguaagccuucauacagcuuucauucguaguugcuuggaauugaauuuuaggaccucugcucacuccagucaaccccgcucgcucagucccugcucacucuggcccaaagauuuauuuauuauuauaaauaaguacacuguagcugacuucagacacacaagaagagagcgucagaucucauuacagaugguugugagccaccaugugguuacugggaauugaacucaggaccuucagaagagcagucaguguucuuaacugcugaggcaucucaccagcccaggacaacuuccuaagcagauuauuuguaugcacucguguccugggggacaguauucaugggacacacucuguccucacuccauccugugcacauguauaguucuucuuucaugacuucauacucugucacuguugcugucuucaaagugaggugugaccucucaguauuuaaucccaaauccacaaccuagguuuacauggguuugucuagaauuaauuauucauucauuuuucugucuuucucaacccuuuagguuucaaacaaaguauuuccagggaaaauauggcgauuuagacagcucucucaucuccuuugggccaugucagacuccuacccugggauucuguguagaaagacaugauaaaauccaguccuucaagccagagaccuacugggugcuucaggccaagguucucgucccuucuguauuccuguucuauuguugugggcuuaggguguggacuucuugagaguuuuccuuaucaccaugugcacuuuguuggccccgugcuaagaacacaagugugaguuagaauaucaacaguuguagguccuggugcccaggagguagagucaccagcuuuuuugggucagugaagcugggcugcaccuggacacaaugaauuuggauaaauaagagugaguuccuucuuggggugaaggugaggucagcuagugucuucaguggggaaguccaacacaggguuaagucugugcuuucaaaccuuacuggucuuuagggcuuuuuuacauaaaaaccuaaagcacaacagguuuaaaacgaaguucagcguuccucugguugccuccaaggcugaggacugugugggcaugggcagguacuguggguauguagaccuugauaagcagggauagagugagaagcacagcuucagguauuucguaagggcccacccucagugucugcucuggagugagaagagucagguaucgucucuggauccacagcucagcaguuaugagauguuacagcuaggccauuucguuuguggaccaaacccagcguccucugucugucucaguuuucuucucugcagugugcuugccuuuugucuucccuacagguucauacagauaaagaggagucacuccuucuggacugggaccguguuagaguuuucgacugggagauugcacagauguuuuuaaacaugacaaaguuagaaaaagaagcuuggguaugcuuucuauguccacaucugucucaucuguccuagaugggcuugccuuagaaucagugaccuugagccaugccuuucugccuuuuaugaaauucagauggcuucuuggacaaaugaaugguucuucacacauucauuguuaauaugcagugcagcaucugugaagcacuaccucaugcuagccacaucugagccacugccaggccauuuccacugucucuuccaacagucaugugcagggucuccuuuggcaggacuccauuucauacaaauguuucuuuucuguaauauccaaagcuaccaacugcagaggaaccuguguguacacugguaaacuugccugaguucauacggcuaggauaaaggucuaagagcacacagucaacuuucacaccucaguggugauguuuccuacucagggcuucuccacaucagaggggcuccugcuuggugcuuaggaagauggucagcuuagcaaaggcuggcugcacaggauagaagcaggucuacaccugucacagccaaaauccuacacugugacagcuaaccaucacugagccucuuccuggccuucagucacaucuauuugcaguuuucaaaccuugcuuuggugccauuuugcucaggcucugcugacuuagaugugaggcuguuucacauuguuaacucugaugucagcacccacuccaagagacccuaaccucccgugucacauguacaaauauccucagugucugcacccguauuuguaggccuagaauccagaauguguugcccugaucagucuuuguaaguuugguaaaggaagagacuagcuggucuauuugcgcuauguuugcaauaggcaaaacaaagagucaacuucucccugaguaugcuaacucacagcgggaggggagcucaccugaccagcacagccuauagguaaagucaaaugacuacuauuggggaauugugggauuucccauagagaucauaccuugcagccucccuuaaaaaauugaaaagugugaauucaaggccagccugcucuacagagugaguuccaggacagccaggacugcacugcacagauagcccugucucgaaaaaacaaaaaacaaaaaacaaaaaaaaggaaagcuuuacaaugcuaguggcccagugggcagcacucacagagccaccagcagccauuucccucacacagcacaggccacccugggacguggccucuguugacuucggugggauuuacaucccuuccucgguucuuuuccaguccuccacauuuucuguuuccuucaagaaaaacagaggaugcgugugcucucugcccaccccucacuuuuccuaauccuaaauguucagcucaaucaucagacugcuggagaaagugaauuucaggaggacagcccgugaaucaauucagaccuuuguccaacaucucaccuccauuauguuuaucuugccaacuaucacucucgguccugcccccagguggaggcuacaagcaggaaagaaaaagccaagcagagaccacuugcucugaacacuguggagauguugcguguggccagcucagcucuggguauguagaaacaccucucuaaaguacccccaaagacaucuugagacugguacagggcagggccaauacuguaacccacaccaagcccuucucaugcugugaugcuugaagcuuagguggaggucuugagucucauguaaguuuucuuuaaauccuagaauaggauuccucuaagcacugcucccuuagcuaucacaagagauagucugaaaaacuagugaucuuugaaagcuguauccuaaaacauuauccucacagagcuagcugauccuugacauaacauugccaucaaaugauuaauagccaagucccaacucacagguuagagagcaagagaauaagcucuugcacuguagaguccuaaugggcucagcuacccaaaggucuaguugcugcucuguggccagaguucagacugucaucagugcugcuaugaguacuauaaagugguaacguggagcaaugagcaguguuucccacugggcccacuucaccagauacaggaccucaguuuuagacaggcuguauucuagaugcccauccagccaguacuucugagccuuggcaguaaccacuaagagucaucugggggcggggguggggggguuaaacaggaaugcccaagccuaggggugagccuagccaacuuccagaccucuuagccuccuauuuuugacagguaugggaccacagcacgccaugcaaauagcugagagauuauacacacagggcuauaucagcuacccacggacagaaaccacccacuaucccgagaacuuugaccugaagggcucuuugcgacagcaggccaaucacccauacugggcagacucggugagcagaaugggcacugaacaacccgucagcuguggucccuagacaggcuuuggccaaacccaaaacugauggaagccaucagccugacuugacuccgcuuugccuccccuuccucagguaaagcaguuguuagcggaaggcaucaaccgcccucggaaaggucaugaugcuggugaccauccuccaaucacaccuaugaagucggcuacagaggcugaauuagguacugagugcuccucuucccgacauccucaagcuuccgaggucugaggugaagcugcuguaggcacauggcugcaauggacaaggucaggcccauuaucaguacagaugcuccugagccugccucugauuuagugaaacccacaucaccaagccucuaagacagaagugaagugguugcagcuaguuggggaaugagguagaguagcagagcucagaggcggucuguaugugcuaccuuagguguuccagaaggccuauagagaagggagagccaugccaauggaaucaggaacugcugcagaucugagugugaagcaagacuccuacauauagaugugccuaaagaacaguccccuagaaccacuuugugaaggggccaccuaggcacuagaggcagcuuccauaacuauuuucuuccuccuugcaggcuuugaggccagggauagggcuuaaugguauggcauuugccuggcaugugcuuaacguccuaaauucaaucccuggcaucauacauauauauacauccuugauacccacgcagagggccuguugcugguccagggcaccugguuacacugagcuuuuauaggaggugacgcauggagacucuacgaguauaucaccagacacuucauugccacagugagccaugacugcaaguaucuccagagcacuaucuccuucaggaucgggccugaacacuuuacaugcaugggaaaaacaguuauuucuccagguacaguggcagaccacgggagucccuuucuucucaucuauacagacacugagaucucuggaugggaagcccaaguggggaccucaaauggcagugguaucucucuaggcuucacagagaucaugccuuggcagagcgugccccuggaagagagucugcccacgugccagaagggugauaccuucacugugggugaagugaagaugcuagagaagcagacgagcccaccggacuaucugacugaggcugagcucaucacucucauggagaagcaugguaucggugaguacccaaaucuggggucuccauucccagggccuuggccaagaggugaugauaauaaaacuuccuaugauuuauauauaccuggcucagcaugagguaacagaugggccaauguauaacccauggacccaggccucauuguguagagccgucuacaaagcccuaccaucaggccugaccugguuuuccauaugaagagugucauacagccuugugcaccaugagacagcuacacacugacaaguacccaccagacucaagguuaauccaggauucuaaaggacuccugggccagaucagcugccuccccaaaacagaaagcuaugaggccugcccuagaauucuggucugggccugcuucuccccagggccuagguaccuaaagugaauccugacaguagccauggccuguggcugaggucccauuugaugaagcuuuucacacuugugacuuguaguagcuuguguacuguucuggaccuagugaccaauaugcucuucaauuugggacagugaacagaguuugugugugaccucugaacaggagagugagggcagugcugcugaucaagguccauggggcaguaucaaaaaaaaaaggcuuuacuaccugggcauaagcucaaggccagccugggcucugaagugagacucucccuuuaaauauauauaucugacuauagcagccauaccggaacucuuguaugugcaaacugccaugauccaggccaauuccuuggcaaugagcuguggaaccucugaagguuccuuaacccccaaugccaguaucuuccccuguaaacccugcccagguacccacagaaagcuaagugucccucugccagcacuacaagugugcaugcaugcagggcugaguuccuuuucacaccucugacaucacacagcagaugcaucaccuuucacuuuuccuucucugccaagcugcaucccuggagugagaagcaugccuuggguauuguaaggggccuuagagaaugggagaugguaggagagaggaaauguaaaaccaacuugguucuacaguagcuuuaugagcuuucucugguagaagcuggauccugauaccuagagggcacacaaaccacaguuucuggacaaaaaaaggccaacuugcauuuacugguuucaagagaugcccucugaccuaacagaguccucucugggccucugucuuuuaacuauaaaauuaaaacaccaaugaaggcugucuuuagguucacaggugugccccagcacaaugcagagacagcccugcucuaucuugggaaucuuucugcaacauggcuucuggcagccauauaggaaauagcagucuggaccuaaugagcaaaauaagcuucagguuguggcacuguacuccuugggugucagguggaaggaacuagagugcauaguccagagcaucuucuugggacaggcugaggaauacccagagccaugcugugccuuccagggacugaugccaguaucccugugcacaucaacaauaucugccagcgcaacuauguuacuguggagaguggccgccgacucaagcccaccaaccuuggcauaguucuggugcaugguuacuacaagauuggugagucugucuacccacugccuacgaccugcugggcuuuccggcuccuuccucugcuguagcucugcugccuccugcaguggccccaugcuuuucaugcauuuccccaauccccacugcagagaugcuaugggacucaggaauuugauggaugaacacauaaagguaaaacagaggcuucuucuacaauccaaaccuuggguucuucacuaagauacccaccaacucugcccacuaaagugccuaguguucuaugggagauggagaaguacagcauagaccuggccauucugcaaaagauuucuacacacuuuccugauggaaaguucaggaaaagucugguggcaguaggagcugcccuuggugccuuccaacucuguggacaagcagcccaggcagacugggucagagcuagguugagcaggacagcaguucuugccugccuagugggguggcaagguccugguugcccacagcagcaugcacccacuugcucauagaugcagagcugguacuccccaccauccgaagcgcaguggagaagcagcugaaucuuauugcccagggcaaagcugacuaccaccaaguucugggccauacccuggauaucuucaagagaaaguuccacuacuucguugauucuauugcugguaagaccugccucuuccuugccccucaucagcuauuccaacaagacagagccaccugaggcccauuccagaucugggcccugagccucuaugagucacagcagugaugccaucccaauagcuguugccagagcagguuaauuaauauccacaucaggaauauacagagcugaugagcagggcugcagcucuguacucuaucacugacagaaacacagucacacuuggauccuugaccaugugugguggccucuuugucuaguucacccaguuuuaccaagcccaggagagacaugacccugugcugugcuuacucucaggcauggacgaguugauggagguuuccuuuucaccccuggcugccacuggcaagccccucucacgcugugggaagugccaucgauuuaugaaguacauccagguauguggagguugaaagacugucacuauaucuagccaaaacauuccuguucagauaucaccuuaagccucugcuuugucauuagucuagcagaaauaauguucauugucacacggagugaugaaaaggccugaaucagcaccaguaacaacacaaaccaucaggcuguauacacauugucuauucacucuggccaacagucacucucuuacucucauaauuauuauuaaaaugcuggggcuccuuuacauuuacagugugugugugugcgcgcgcgugcaugugugugugugugcacgcgcacgaccgugcgagcaugcgugcgaguagagguuaaaggacacuuuguaggagucagcucucucuccuuccaucguagggguucuagggauuaaacucaggcuuuagcagcagcuccuuuaccugaugaaccauuccccggccucaugcugggguuuaagacucuggcuuugugagggaagaagaaauggggaaguaugguaccugggcucauaccagcgguugagguauuugccuggcacugaauucuguauucuguguaccuguuagguguuuagcauuaccuauucuguguuuugaaggaaaggacagcagucaagaaagucagacccaacaccccucauauuccuucuaauugcccccaucccauaggccaagccaagucgccugcacugcucccacugugaugagaccuacacccucccccagaaugguaccaucaagcucuacaaggagcugcggugcccauuggaugacuuugaacugguccugugguccucaggcucccggggcaagagcuacccacuaugucccuacugcuauaaccacccacccuuccgagacaugaagaaaggugaguguggcauguggguguccucagguucauacuuagcauacuccagugagguccuuuacccaucuaucacuaccuguguacacugguagugagucagggacccuaagaaauacuugugccauugcucaggcuguagccaaccuaucuggucuggguaugccuggguccuaauugagcaaacagcuugcucacuuaggaucugggcaggaggcaagaugugccccucgggggcuaggcuaagugagaggcaggcaaccccagauaaggacaccugacaaaccaagcccccuggguucucagcacugcuuuuugucuuacuuuacacccuuugcugggaaacagaaagcauguauccaggcuaagcagugcaugccaagccuggaaccagagaggcucacugccagcacauguacccgcucccagguaguaccaucccuaccucagacgaggagccggcuccuuuguuaccugaggcauuaauuaggaauccucagugucucaguucacauacuuacuaccaagauaaugaggcucucuucccgccccccaccccaagugucuuacagugcacaaugcagcaagcaaguaacaggugagcugagagcaaccuggaagagccauuaauaaguuacagaagcaaacgaggguuugggagucagcuggaguccuuggauugagaacugcacauuuuuagauaagcagaggaacccaguccagugaacaagauaucccaaaagcagguuaagagugagugccacguuguucuagaauaggaauucagcagucuggcauugaaagcagccagaguugagggagccagggcaugcuuaggucacuggccuccucuccuuucaggcaugggcugcaaugagugcacacaccccaccugccagcacucacugaguaugcugggcauuggccagugcguggaaugcgagaauggaguccuuguucuggaccccacuucuggucccaaguggaagguggccugcaauacaugcaaugugguggcacacugcuuugaaaaugcccaccgaguacggguaucugcugacaccugcaacaccugcgaggcugccuugcucgauguagacuucaacaaggccaagucuccccuuccuggcaaugagacacagcacacaggcugcaucuucugugaccccgucuuccaggagcugguggagcuuaagcaugcagccuccugccaccccaugcaccgaggugggccuggaaggaggcagggucgugggcggggccggggccggagaccuccaggaaagcccaacccuaggcggccaaaagacaagaugucagcucuggcugcuuacuuuguaugacaaccuaucuuuuccccacuccagacacaucgugguuaucuuugagccacugaaaccauuaaaaugcuuuuuauuuuguauucucuggaacaaag

SEQ ID NO: 8122 - RNA, 2434 nt, Mus musculus
ucuuuuuuuuuuuuuuaauuaaagaaaucagcuaugaaaauucagccaaaugcccuuccgaacaggcacacagacaagagcacauagucuagcuuugaggaucucccacuagacaugaagacaggcucugggguugagauguauuccagaagcauuugaggccccaagaauagugaccccgucugcccagagacuuggggcaucaguuuuaagcaggauuccuaagguucagagcccuguggagagacacaugucaucagcucacugucuucacugcuuaucuuagcuacagcagacuugccuuucucccagacuccucucuuguuuggucucuugucccguuuuucagugcuaccugcccaaggccccagcaggagacugacauuucuucucucccaacagcugucagcaugagguaaaguucuucccacccuucugugcucuuaguuaucuuccgugacuccagaacagucccuucccucugugggaccuuaccuuccuauucccuacuugaccuacucuucuggagcugggccucccagccuucacuccaucuguggcucuuucuccugccucccauguucucacagcucuccaggucuccagagcuccgcugagccuguggaaacagaaccuggcuuccucuuaggcucagugguggggcuaccgcuccuccucaauccaacugcucagauccaguuugagucucuguccuucccuugccccacucucacucuugaucagcucccaacauuguucugcucuguccuuuuuuaacaccaagguucccugcccagcucuuaggccuggccuggccucucuagaccguugucaccagcauucacaauccagccuauccucaaagacaucuaagaacucaaucugacacugucacauaucucuucaaaaacaaaccagagucccuucugcccacugccuggauacccguagcccccuucuccacaaaccgagcagcucagagacuaugggucuucugucagaagacgucacugggauguucaccauccaagaaccauuuccugggguugucaucccaaagcacacagagcagacaccuuaaugaucaccaucauucucucaggacagaugccaaauggaggugaaagugcccucaggcugagccccccuggugcucuucagauaagcaugugcauuccucagcuuguagguucaccccuccgucccuguccugcaccuacauggcugcccucauguaucuaugucuguguuuacaccuuucacaagccagucguacugaagcaggcauccauccuacuccagccauaaucucaucuuucuuagugcuauccacaguaaaccaacuuacaagagcucccaucugagacaguaaccucagcauauaaaaugggggauacaguucagcacuuaacaugcccugcucccagggguuaccagcuugagcaucagggauccaagcuucaaggauaccuuuccaacacaucccagcaaaugccgugccccugguguuguguaaauauccauuccgggucccugaagacagagaucaccugcuugugaugacaccaagaggaagguaugagccaucaucuccaucuucaagguggaggaugccaggagcugcuccagccccgccucucacaucuucuuccuaggaacgcucccccaucguuugcuguggcugugacccacgaggcaauuucccagcugcugcagacagaccuuucugaauuuaagagguugccugaacaagaggaggaggaggaagaggaggaagaagagaaagcccucgugaccuguaaguuccacucauauggcucugggauuguuuaacaagugacaaacucagauugacacuaaaggucagugccagcgugccaucaggacagcaguguuggaguucagcaagagcacgauguggcauagaaaaccugcaauggacugagcagcacgugggucaaaggcggccagugagacgguggcccaccuuugugcugucuugauggugcuucagagcacauagaaaugaguggugccuguccugccuuacacacgagaagugcaagguguugguucacagccacacagccaaccucaccuguacucacugucccccuuggcuaacacgaggcccuuagcagaguggcacauccaccucggggagggggcaacuguugucuagguccccugccuugacuuaccuuaguugggaucauuagaugucagugaucccaaucaugaggugacgaagauggacauuucguguccacuggcuacagccaucagugaguugagcccuacagugguacaccaaaccaaaggaacccaggaacagaacggggagcaaacgccaagaggccccaagaccacuugacagagcguuuguuuauaaaauccaggcucuuuuucugcaugacucucuuuccuccuauuu

SEQ ID NO: 8123 - RNA, 2434 nt, Mus musculus
aaauaggaggaaagagagucaugcagaaaaagagccuggauuuuauaaacaaacgcucugucaaguggucuuggggccucuuggcguuugcuccccguucuguuccuggguuccuuugguuugguguaccacuguagggcucaacucacugauggcuguagccaguggacacgaaauguccaucuucgucaccucaugauugggaucacugacaucuaaugaucccaacuaagguaagucaaggcaggggaccuagacaacaguugcccccuccccgagguggaugugccacucugcuaagggccucguguuagccaagggggacagugaguacaggugagguuggcuguguggcugugaaccaacaccuugcacuucucguguguaaggcaggacaggcaccacucauuucuaugugcucugaagcaccaucaagacagcacaaaggugggccaccgucucacuggccgccuuugacccacgugcugcucaguccauugcagguuuucuaugccacaucgugcucuugcugaacuccaacacugcuguccugauggcacgcuggcacugaccuuuagugucaaucugaguuugucacuuguuaaacaaucccagagccauaugaguggaacuuacaggucacgagggcuuucucuucuuccuccucuuccuccuccuccucuuguucaggcaaccucuuaaauucagaaaggucugucugcagcagcugggaaauugccucgugggucacagccacagcaaacgaugggggagcguuccuaggaagaagaugugagaggcggggcuggagcagcuccuggcauccuccaccuugaagauggagaugauggcucauaccuuccucuuggugucaucacaagcaggugaucucugucuucagggacccggaauggauauuuacacaacaccaggggcacggcauuugcugggauguguuggaaagguauccuugaagcuuggaucccugaugcucaagcugguaaccccugggagcagggcauguuaagugcugaacuguaucccccauuuuauaugcugagguuacugucucagaugggagcucuuguaaguugguuuacuguggauagcacuaagaaagaugagauuauggcuggaguaggauggaugccugcuucaguacgacuggcuugugaaagguguaaacacagacauagauacaugagggcagccauguaggugcaggacagggacggaggggugaaccuacaagcugaggaaugcacaugcuuaucugaagagcaccaggggggcucagccugagggcacuuucaccuccauuuggcaucuguccugagagaaugauggugaucauuaaggugucugcucugugugcuuugggaugacaaccccaggaaaugguucuuggauggugaacaucccagugacgucuucugacagaagacccauagucucugagcugcucgguuuguggagaagggggcuacggguauccaggcagugggcagaagggacucugguuuguuuuugaagagauaugugacagugucagauugaguucuuagaugucuuugaggauaggcuggauugugaaugcuggugacaacggucuagagaggccaggccaggccuaagagcugggcagggaaccuugguguuaaaaaaggacagagcagaacaauguugggagcugaucaagagugagaguggggcaagggaaggacagagacucaaacuggaucugagcaguuggauugaggaggagcgguagccccaccacugagccuaagaggaagccagguucuguuuccacaggcucagcggagcucuggagaccuggagagcugugagaacaugggaggcaggagaaagagccacagauggagugaaggcugggaggcccagcuccagaagaguaggucaaguagggaauaggaagguaaggucccacagagggaagggacuguucuggagucacggaagauaacuaagagcacagaagggugggaagaacuuuaccucaugcugacagcuguugggagagaagaaaugucagucuccugcuggggccuugggcagguagcacugaaaaacgggacaagagaccaaacaagagaggagucugggagaaaggcaagucugcuguagcuaagauaagcagugaagacagugagcugaugacaugugucucuccacagggcucugaaccuuaggaauccugcuuaaaacugaugccccaagucucugggcagacggggucacuauucuuggggccucaaaugcuucuggaauacaucucaaccccagagccugucuucaugucuagugggagauccucaaagcuagacuaugugcucuugucugugugccuguucggaagggcauuuggcugaauuuucauagcugauuucuuuaauuaaaaaaaaaaaaaaga

SEQ ID NO: 8124 - RNA, 1972 nt, Mus musculus
gcuguguuccucuuagcccuuccccagcacccccagacuggccaucccauugcuguuagacuauauuuuaugggaugcaacauaaccugcugcuguugggucuggggcaguggggacaggguuuccggggcugcagaguggcagaaccaggcaagaggcaaauagagucuguuuuuuuuuuuuuuuaauuuguccuuucacaauuucacucauguacacaaugcauacccuccuacaacccacccucucacaucucccuacaaccuauaaaccauuccucuccccuacaaauaucuuuucgcugacuagugggcugaugccuacccuguccccagcacucccugcccccaggggacacagcugcccacuaggcaacaagcccagaagaagauagugccagcaugcaaaucuggggguuucugaucaggcccugccccugcugcccacgcauccaucugucuuccccuccccacacccacacaacuccuccagagccccuggcagaaccuccuuaaguauaugcugccuugcuguuccugaugagucgacucguguaucugaaucuccagauggugguuugcauucccccuguccuccaacugcauguagcuugacacacucacucagagccaccagaugggagugggggaggcaagaaggacaagugaggugugacggguagauggguguaguggaggcaauucauccaaaggacugagcuaccaggauagagcaggguauguguuagacucuaccaggagggaaacaagcuaaagcuaauagaaagagugggggccauggugugcuggggagaggaggggagaggcguuauguccaucaaacaagaguuuccuccugaggaagggaaccugaaaaccaggucucccaggcugggucuagaauguagcagagccagaaaaagaggcagaaauccugauuagcaagcuguuaucugauuugaccacagaucuccacacuggaguccuacaucucagccuuauuaacuugucugggaccuggaugggcucuaagcuaaucaaagauaggucaaagaggacuucagaugggccccagcacuugggaggccaaaaaagagagcugcuuagccugggcuauauugggagaccuugucucaaaaaaaucaaaacaagaggcuagggagauagcucccuugguaaaguguuugccuugccuagggauugaguucagacccuagaagcuauguuuuuaaaaagccagacuugaugguguauggggacucagacaggaggaauucuuggggcccuucagcuacccagcuauauuacaauucucugggagaauagaagcaaugguuggauauauauuaaaaagagacuuacuagacuaauguauaacaugcaaucuagguaguucaacaauggcuaugucacgccaaaaauggucaagaaucugguaguuugucauccgaggguugguaggcugacagcuaccagucuucagucugcauuagaagucuuaaaaagcuuguucugauaucagugaguucagcaguugcagcaacagaacagaugaguuugccagcaagaaugaaggcagacaggcaaaaagcaagcuuccuucuuuuaucucccuucuaaguuuccauccacauuuaguaugagucuuacuuuuuuuuugggggggggggguguugagacaggguuucucuguguagcccuggcuguccuggaacucacucuguagaccaggcuggccucaaauucagaaauccgccugccuccgccucccaagugcugggauuaaaggugugugccaccccugccuggcccauuuuaaauaauauaaccaagaacucccuuaaagaaggauggugguacacaccuuuaaucccaucacuuuggaggcagaagcugauagaucucugugaguucaggccagccucagcuacacagcaaguuccaggccaggaagagcuacauagacucugucu

SEQ ID NO: 8125 - RNA, 19463 nt, Mus musculus
ggagacugggugauacugccuguguuuuguggguaggaaaucuaaucugggguuccauaauucaaguccacgcagaccuggaggcucuuggauggcgacuuggagaguggagaaaggguggucaguauggagagagggaagaagcuugcgcucuagggacccagcugcagagguccuccugccugcagccugaggcgcaaaccuguggaaaaucucgguccuuuggccuuccaggacccuaccuccccaccggccccgcgaccugccgguucgccuggguuccucgucaggccagcccaccggacuccuggcgagcuccacccggacacguuccagcccagucccccgagcgcagcggggcgcggguggacgcguggggcagggcgaggggcggggagcguggaggggcggagcggcgggaacgcgagggcggggcucggacacugauugggcaucgccacguuccgaggccguuuauggcggcugggcugggcuacggguccaaaacaaagggcaggcggcccgcgaggcggcggcaggaggaugccucgcgcccggagugggcgccaacggccggagcgcgucccgggucacaccgggaccgccugaaaaccgagcucgcgccgaccgagccugggccggaugggcgcagcggaccgcggagcggccgugaguacgggcgggccucagggguucucugcggagaccugaggaucuccggcuccgggaggcggggaagcaccuguugggcgcgggcgggccgggcgggagugcggaggaugcguugacuuuuuguucugauguuccgaacuguugguauuugggucauuagaagacaacgcaaaaucccggucuuucuuucuuucuuuuuucuucgcccccccccccccauuguuuuuuccccuaccuuaaaaaauggggaaagaaauaaauacagaagauaccuccaauaaaagaauauuaugggguggcauuuucaaguugccuguacaauaauaacuaaagggaauuguccucauuguuuaccacuuguggcucuaggcuuuaucaauguaaauugcuaacaguagcaacuaaauaagauauucucuacucaauaacugcacaaauggucaucuucgaucguguacugagcuccaggauagaaagccggcagaauucuguuuuggauagauaauagacguugaaaacaucauuuuucagcccaaggucuuucuaauucaguugccuuauaaguauccacaauguauucaccuuaacuaauguaucuugucaaagaauugaccauacuccuccucgcuccgcugaaguuccaagaccaggcucaccuccucuggggaacuucuccaggccccucugaguaagccacccucacccaucacccagggcccuuuaccucugcuguguucugguagauguguuaacaaauguuugcugaguacccgucucccucuccccuaggggcugguccagugggugucugugugcauguguauggugggguacaaauaaauaaacacacacacacauguauauucaccgugugugugccugguaucuagagaagccagaagagggcaucggauccccuagagccgaaguuauggauccuccacaagagcagcaggugcuaaaggaugucagcccaucucuccagccauacugugggcucuuaaaaaagucaggggugcuguauuugaagaguuuugcuaccaggaucccuaggucuauguguuccuagccaagggacuaugugguuagcaugucuucuuagggauuagaccaaaaucuugacuuaccacagauauauagcagcccaggggcuggcccauaugaaacacuaaaaauacauacauacauacagacagacagacagacaguugaaucaaugccaguaaucaaucugaauagaagucuuuucuuuuccuguuuuuuuuuuuguuuguuuguuuuuguuuuuuuuuuuacuuaugcauuuucggcaagugcucuaccacaaccacagcuccaacuuuauaaauaaacuuaauuuuauaaaagagcuggggguguggcugggugguagggcucagcaugugugaggcccuuggucucccccccacuagacacgcaaaucagaaguucccccucagcucuggcggacccagcucagccacccuucauugcugggguacaccuggucacacugaguaccucaggggaucuguucuuaaaucccagguuguccuugcauucuaaagaaccgaaguuguuuguuuggcacucuguguuagcacagaugcucugaugucguucuucagucccacaagcacaggcacggauggaggcgacagggcuggauagucuuaaugcaucuuucuugauggagcguugagaaaugcugcaccaaaaguuuaaaauauaaagaagcagcuuauuuguaguaugugaaaccuaaucuucucaugcuaggcucgugggaugaaaguuuuagcugaggguuuggguacaggaagagagcugagcauacaggggaagccacuauguuguggaacccggaaugagaucgguugugcccccaggagagacccucuuauuacagcucagugccuggaucccacacaccguaccuggagugaaaacacuugacuguuggacuauaguuauccagcaugugaguaaauaaagcugucuugccaggccagggaugguggcacacaccuuccagcccagcacacgggaaugagagccagggaccucaguuaaccaggccuggugucaggaggaugggaagugaagaucauucuuggcuguagauggaguuuuaggccacauaagaaagaccccuaaaagcagcaaaacagaggucuggagaaauagcuuagugauuaagagcacauauaggggcuggagagauggcucagcgguuaaaaacacuggcugaucuuccagagguccugaguucaauucccagcaaccacaugguggcucacaaccaucuguaaugggauccaauacccucuucuggugugucugaagacagugacaguguacucauauacauaaaauaaauaauuuuuuuucgagacaggguuucucuguauagcccuggcuguccuggaacgcacuuuguagaccaggcugaccuugaacucagaaauccgccugccucugccucccggguuuuacuggggauuaaaggugugugccaccacacccggcaauaaaauaaaucuuuaaaaaaaaaaaaagcgcauauugcucuuguagaggacccaaguuugauuccuagcaccugcaugagguggcucauagccaccuguaacuccaguuccaggggaucggccaccccugacuuagaacuccugagcaugagcacccauaccugugcacauaauucaaagaaaaacuuaaaaauuggcagcuguguuuucucaucuucagcugucuucacagccagucugcuauucaaggaaaccaggcagcuuucugcuggcaugucucucgggcccaaagcugugcagaagccagaaagaacaugcuguaguaucucugauugcauacacaucaucaguagccuuuauugugcuugagcuugguagaauucgauaggagaugagggauugaacacugaguguggaggugccagaucccgugaggguccugagagagcaggagguggcagaccauggcaggcacgggcacgucguugucuugaguccacuguccagguuacuguccccgaagugugggagaaaggaucucauuccgugauccaaguagggaguuauagauacgaggaaagaaggaugugucaccaaagccagcuagcgcuacacuguggcugugugaauccuuccagaucuuuccaugcuugugagcguacgugcagugcaucugaguagucaguuucaaugcuuggaaucaaaagauaaaggugcagggccaggaggaugccugagcagugagaggaccuguggccaaccuuagaaagcugagcuugaucacugagccucgaacaguggaaggaaccaguuucacgggcacucgugugcaugugcgcacacacacacacacacacacacacacacacacacacacgccccaggaaaaucaggccugcagaaggaagccacauuuccucauugcagccuuaagaccccaucuuggcaguaucucugauuuaugaaggcauuugcagacucucaaacuugaaguguuuucuaauuuuuuaaaagauuuguuuauuuuauguguaugagugcucuguaugugccagaagagggcaucaggucccauuacagaugacugugagccaccaugugguugcugggaauugaacucuggaccucuggaagggaagccagugcucuuaacugcugagccaucucuccagccccuuuaauuuuuaugagggaauacugugacugcuuucauccaauuguuuugcaaauguaaacuccugugcagcaacauacagccaggaauguucuagaugaaauuuuccuaaccugcaagagguuucacuauguuacccaugcuggcuucaaauucugaggcucagucagucuuccaaguaacagauaaaauuacagaguggcccaagcucaccugcuuguuaguggagguauuagagccaguuaaagcugucuguggagaaggcuggugcuuugauggguauggaacaggcaguaucacacuguuagucccaagaauugggaggcagagcaagcccuguccacauaggacguuccaggccagcacauagcuucacagugagccccuaacaggaagggagguguggcuggcuagagggcaccauggcgccaugcuuuaccauauggcuucauuuuguuccucugucucugucucaucuuccagugugauaaucacaccauauggacaugagccuggcccauagacucuuaaaauaauuguauguguuuauuuuaggugagaaacuucuggaacacaguauauugguuugcuaaggagaaggaaaaaaaaccaaacaccaaugucugucugcuuggagguggaucuccuccacacuacaggaaggacgccagcauccuuccuguaggugugguucaucugacuagugcuugcuucccugagacuucacagugguuccuaauggcuucuuagacuuugcaguuguuuuccauuugcauggcuucuaguggagagccccugucagcugacucacagcgccaugccuucagggguggcugcugucagagcugcugcugcugggccaaaagugagaacugugaggugaccuggagucuguaugaggccagcgcuguccuggcagggguaaaagggaauccagagagcagccuaggcccaguaggagcugcucuggggacugugacacacaggcagacuguuaggucaggagugauagagacaacgugaucauuaaagagaagcagacaggcaucuccagaagcagaauuguucguucagucggaauagccuaagggcugcagucuguaugcacuuaugugugcgugguuuauaggugaagaggagcuuugcaggugggagagcccaucugcaggugaguccccugcagacuggaagugguacacaccagugggcucaauguggagucuccugaucauagacuucugccaagucagcuuucuuguccagaauauuugggucauuaacccuucacagacuucucagguaaggaugccuugagagcaggucacauagugaaggucucugucauaauuugcuuucuauugcugugauaaauaaauauaacacuaugaccaaagccagccuggggaggaaugggcauguuucaucuuccacuuccaggucauacuccaucauggagggaaguugaggcacaaaccuggaggcaggaacuacugaagaagguugcucacuggcuuucucacuuucuggcuuaugcucagcuaccuuuuguuuauuucugguuuuguguguguguguguguguggguguuuugccuacacauguguguauugccuauggaggccagaagagggcgucagauucccaggaacugaaaguuacagacaguugugagcugccaugugggugcugggaauugaaaccugguccucugagagccaagugacuuuuaaccacugaggcaucucuccaguucucucacauaccucagaccuuaccugccuagggauagugcugcccacuaugggcugggcccucccacuucacaggcaagacaguuuuucacagacauggccauagaccugucugaucuggacaacaguucaaaugagaauuccagauguccaaauuuaaaacaaacugacaaugaaacugacagucucagaauaaggugacuguguaguagaaacuggauguggcugaaguuagaguuucacagugcucauggcugacuggguccauaagcacagcacucacuagacccgaguuccuuacuucucaggguacuggugugauucagccauucaagaauuugcagccucuuaaaguugugaaugcgugccuguuugcuuggaaaaauauuuuuaauuuugugugucuuuuuuuaaagauuuauuuauuauuauauguaaguauacuguagcugucuuuagacacaucagaagaggacaugguugguuccauccaucucaucaugaaugguugugaaccaccaugugguugcugggauuugaacucaggaucuuuggaagagcagucagugcucuuaauugcugagccaucuguccagccugagugagugaguguguguguguauauuuagcuuuauaagcaccauuuuugcacaguacccacagaggccagaagagggcaucagaucuccuggaacuagaguuaugcccagcgugaugugggucauggaaacuaaacccuggcccucuucaggagcagcaagucuucuuagucagugcugucucuccagcccucugcuugaaauguuucauucauaaccuggacccaagcuaaucagucagcaagaacaccuuuuauccaucuaggugagcguccuuccugaaccccagaagucccagacacuugaaaggacagucagugugcugaaagcugacuaaacagcaaaacuggugucucuuuuuuuuuuuuuuaagagcuagagagauggcucagcuuaauuaaaauuuagacucaacaacacacacacacucauuuaaauacuuuauuugguugucuuuuuuagaacuuccccacuggaggguuaguccaaagaugugauauaucauaguuuuaagcuggaaguugacuuuugagauauuaaaguaucucuuuuucucuuuuucauuuacuuuuuuuaaaugugacuacucugucugcauguacaucugcaugccagaagagggcaucagcucccacuauagcagguugcuaggaacugaacucaggaccucuggaagaacaaucauuuaacugcugagucauuucuccaacuccauuuacuuugaucuuuaaaaaaaaaaaggauuaucuugugugugucuguguguuuuagaguuuuacugccaugaacagacaccauaaccaaggcaacucuuaaaaagacaacauuuagcuggggcuggcuuaaagguucagagauucaguccauuaucaucaaggugggagcauggcagcauccagacaggcauggcgcaggaggaacugagaguucuacaucuucauccaaaggcugcuagcagaauacugacuuccaggggguuagguaaggagcuuaaagcccacacccacagugacacgccuacuccaacaaggccacaccuccuaauagugccacucccuggaccaagcauauacaaaccaucgcaaugcuaauauucuuuugauguacuuagaaaucuuggaucucagaggccagccugggcaacagagugagacccugucuggaaaaaaaaaaagccucugugaccagguccugccugcuuauaacgcacaaggcccugcaaaauaaagugaaaagaugagauuuguuagaucuguaacuuuuaggccuacuccuuuucaaaauaucugcagcagagcucccagagugccugcugcugcuguguaaagcagggccugucugauuugcuugcagguugcacuggcguucccuugccccaguguguggacagcaccacacgcccuccagaccagcaacggcucuugcauauacuuuccaguguuuuugucagagaguccgacagagcccuagcuccuccagagcuggcccagaaccgagugacgagagcccagcagacauggugaaaaugaccaaguccaaaacuuuccaagcuuaucugccacacugucaccgaacuuacagcugcauccacugcagagcccaucuggccaaucacgaugagcuuaucuccaaggcaagugaucuggacucaaaccugauaaaaagaaggcuggcguacguacaugcgccuuuacuccgaccaguugggaggcagaggcaaucucugugaauucuaggcuagccugggaauacauagggauacauacccugccucaaaaaaaaaaaaaaaaaaaguaaggcaguggccagcagcacugguugggaacuauagggcuuugucaacuuagugacaacugcuguuugccaagaucugucaccuaauucaguugucagagucaggcaccgugcccagcacgccgagcgcguggugcuuuguggggagggagggguacacagaaaucugagaaaaggguuuuaugucagcucuuaaaaauugcaugaagaacagaugugugcuaggaaaugagugauuugaaaccuacccauggcaagaugaaagaggccacaaauaauucuuaaaaauacauagacugccacgagcuaucaaaccucgcuccugagcuggggguggugaggguggcuuucagugauauuccuguaagaagguacaaugagcucaauaaagaaaaauuuugccgggcggugguggcgcacaccuuuaauccuagcacuugggaggcagaggcaggcggauuucugaguucgaggccagccuggucuacagagugaguuccaggacagccagggcuacacagagaaacccugucucgaaaaaccaaaaaaaaaaaaaaaaaaaaacaaaaaacaaaaaaaauugucuuaugguuucagagauuuccaugaguggccacgugugccccccaccaccccuccccgguguaggaaaguguggcagagagcagaaagcaaaaaaggaagagaucagaguccuaguagccuuggagguuuucuuaguaaacuaauuuccuuccacuggccucugccuccuaagguucucucagcucccaguacuggcacugccgggacccagucuccggcaugcgggccuuuggagagcguucaggacccaaagcacagcaccagccauggcaacuguccucuucugaguugucuuccugcuuaggccaguaagccucaguacacacaccucggaaguagaucccagcacacuggacgcuagagccaccuccaugagagcucaccagucucugguccauauuugucacuuaacaaggagugcucuggucugaggaagcccuucccuuuaaaaaccauggucuugauacgccgccauugcuggccuugaacucagagaucaccugccucugucucaagaguccugggcuuggaggugugcaccaguaugucucacacaucugugauguuaacucacaguuccugucaccucaggugacucaugcuaccacagaguaacuaggucuccugcaucaucucuucccagcugccccugugaaaaaccuaagagcuugcacaauguacaagcagaggaagaauucaacgcugaugggggugcagagucuagacaugaguaucaggaaaaccgaacauaaaggggguggagagauggcucagcgguuagagcacuggcugcucguccagaggaccuggguucaauucccagcaaccacauggcagcucacagcugucuacugcaauuccagaggagcagacacaaacuacaaagucacuuuaggggauauuccuuuuaaagcugaaaacuuguuuguuaguuuuagacaggauuucucuguguagcuaucacccugaacacucucugaagaccaggcuggucucaaauucaaggauccaccugccucugccccucugcccuucugccccugccuccuaaaugggauuaaagacauucaucacuauacccagcugaaaaugaaacuuuaaaaucaauauuaucaauggcagagcacuuguggagcgcucggcaucgcgauccgccuuaucuccugagacuaggccucucacugagcccugagcgcucagaaccagcuggacuuucuggucagcaaaccccaggcagucgcuguccccagcagucaccugcccagcacugagguuacagguuuaugcaaccaugauuagcuuuuacuuuuuuuuuaaaaaaauauuuauuuauuuaucauauguaaguacacuguagcugucuucagacacuccagaagagggcgccagaucucauuauggaugguugugagccaucaugugguugccggaaauugaacucaggaccuucggaagagcagucagugcucuuaaccgcugagccaucucuccagcccuagcuuuuacuuuuaaagguuaugugaugaguguuuugccuggugccagcugaggccagaaaagggcacugagucccugcaggacugaaguuacagaugguagugagccauguggugcuggaaaucgggcucucuacaaggccauuuucaguuuuucugagacagggacuaguuauguaacccugauuuaccuagaacucauaauaggaacuuaagguggcccccacuggagcuccaagauacuggaaauauagacguggauguucagcucaggcuaggguuuucguuuuguuuuaaugucaguaaaaaugugaagaaaugggggcuggagagauggcuuagugguuaagagcacugacugcucuuacagauaguccugaauucaaaucccagcaaccacauggguuggcucauaacuaucagauacccucuuacggugugucugaagagagcuacaguguaacucacauacauaaaauaaauauuuauuuuuaaaaagugaagaaacuugggcuggagagauggcucagcgguuaagagcaccgacugcucuucugaagguccuaaguucaaaucccagcaaccacaugguggcucacaaccauccguaaugaggucugacccccuuuucuggagugucugaagacagcuacaguguacuuacauauaauaaguaaaucuuuagugaagaaacuucaccuugucuaauucuugaagauagugagccaucagaauuagguuagaaggugucauagggggcgagagagcucagcagcccugagugcucagugcuuacucugcagagggccugcguuggguuccagcagcaacaagauggcucacacccuccuuuaacuccaguucugugggauccaauaccucuucugagagaugaaaagagucugaggagucacuuaagccuacagagccuacuguuuaaggcugauucaccacguuuuacucuuuuaacuguuuuccaaguucaagcauuuuccguacuccagccuuuugacuagcuggggcugaaggugugccccagggccagcucugcuuugcugugaacuugugcacaugauugcaaaauggcaaugaugaaguuuagaugcagaauugugacugggaauggugcuuuuauaaccugucccagcagaagcccaauccacacggcaucagcaauugcacuuguggggugacagguggccugagccaagugaccgcaccugugccuccagcaucccagaaagcugagcugccaagugcuuugcgccccugcuaacacugccuccucccuuucuuugcaguccuuucagggaagccaggggcgagccuaccucuucaacucugugugaguacaugcugucacuagugugucuggcucugucccucugccugcucaguuaaugagggcugaaacguguaucugagccaucccagucagcaccaugaucagcugggaagaaccuagccuccugcaucuguguuucugaugcagucauugugccugagagucuagccuccaguccugacacuuuaggauucccuuggugggcuggcucuguaguagagugcuugcucagcauguugaggcccuagguuugauuccaagcccuauaaagaaaaaacuauuuccuucuugcuaaaguggggggugggagagccgaaaagccugugaugauauggacaacucuguccugguguuacuuaugaugugggggaggggaggggcacugggcagggagaccuccagcacagccacucugugucuucacagggugaaugugggcuguggccccgcugaggagagaguccuucuaaccgggcugcaugcaguggccgacaucuacugugagaacugcaagaccacacucggguggaaauacgugagugccugggcaugggagggaugguguccuuaaaauucugugggugcucagaggggaaagcuuucuagaacacauaaaguccugaguuguguccccagagcugaauaaaacugguuguggagcaaggcacaguguugagugagcaaaagcaccugccaccaagcuggaugcacaugggagggagagaaccgguucuugccaguuuuccauuaaaagcaccacagaacacaaauguguaaacacacaauuuaaaacaaaacaaaacaaaaaaaggggcaggcauuuaagagguggaggcauauggaucagaaguuucugggguacaagauccugucucagaacaaagacugcaaguuccuguuguuuccuuggaacagggcagagcacaccuuguccaccacgacacucuucaggcacaaaggucaaugcaguccugggcucucccagagcucugugcucagaccuuggccugccugucuccagcuucucuccauacauaaauugauugacaucucaaagaugacaaguuugccacucuugucuuugccuuauuucuaguccuggaguuugaggaccccucuacuacaaagacuagaccgugugccacccacucuugucuccugagagccacuccagccgcugugguucugaggacuuguguuuggggaagcccuucuauuucugccucugccucagcugaucuacuggaagccacuuggcucccucaugauagugcaucccgacugacagccagaggccuguuuugugccuuuuucuuuuugcauguguuugugaugugcacacuuggaagcuggcuggugucagguguuuccugaauaucugcuuaauuugcuaaggcagucucuuccgaaauccagggcucacugcugcuuguuuuaaguuagucaucuugauucagggaucuccugccugcuucccagauucggauuccaggcagcugcggcaucugaccugcucuuacguggguuuuaggaaacccaacuguaguccucgugcuguguggacaacacuuuaccuccugagccauauucccagccucccuuugaacucuggauucucaugguucaggguagcauccucuucuuuccuugaauuugugaccaucuggucuuccaaacuccucaugaacugcaaaggaccagacaaccccacaaagcauuagguucugggaagcccagcccuucaacugauuggccauguugucccucuucuguccucccugcagucacugcagcacgcugcucaccauuuucaccccaggggacuugccuguaucuaacagccaggccucauccccugacaaaugugucuggggugcaucuccacaggcuucaugcuauagcacgcuaagggagccuucguggucaaacucucauaaguggucugcugugggcugggaagaugacacagucaguaaagugcuugcuaugcaagcaagaggaugaguccagaccacugucacacauguaaagagccaaguguggcagcguauguucauaacccuaguggugaggaagcagaaauagaucacugggucagaguaagucuagcugagucaguaaacccuaggcucaaugaaaaacugugucucaaaauaaaguggagaggggaauggaaagauggcuccgagaucccagguucgauucccagcacccacaucagguaggcagcucacacgguuccagugucuucuggccuccaugagaacugcacaugcgugaugcacagacauaugcaaaagagacauacacggauacgcccauacacauaaaacaaaguggaauaaaauggccagcggguuggcucagcaggggaagcacuugcugaugugugauguccugcauccuaucugcagacccacaaugaaagaagauuccaaaaggcugugcuuugaccuccacacaugugcacacggcugccccuccagaauaauaacuaauaaaacauuaagagaaacauguagggcugucaaaacaccaccucaaacucuuggccugugcgcgcacgcgugcacacacaacacacacaacuucaccuguguuccaccaccuguauuacucugaaacauccacauacaucaccuagugaaguguuuguggugcugagaagggaucccagggccacaggcacaccauacaguacacacugagcuacagccccagccccagaaacagaacugaguuaaccuuguuccugaguguaaugacccagucgucaucccccuguacugcccagugcacagcucagagauaaugacuguaguaaagcagggaaguaaacauguguccugaaaccucucuacuuuuccccucaaggaacaugccuuugagagcagucagaaauacaaggaaggaaaauuuauuauugaacuugcccacaugaucaaagacaacggcugguaaagugaagcgguccacuccuguuugaauccuauuuuaugaaagcugaguguacagaagaccuagcuucuuggugacaaugcuucuugaacuuaaccucacaggccagcccagucucaacacuugaaggugucucucuaggcuauccacuugguaaggugcccauuugaaucccugucguguacaaugcguuuuuggaagucugaguucuuuuucuaacaucuuaaguucuagagaaagaauugaccagcuggugacucaccugccuagugaauacuuucuuuuacccuacgccugcaaugccuggcuguguucucaccaagcccaagucccuaaaagcagagaagcaaggucuccucacaagcaaaggcauaguuaccagaaguaaagcaugucuccaaaaacugaaaccagccacugguaacauggaagagaagcuaggaagcaagcauucaguguacaucuuaagcaaauagggagguuccugauguagaaggcgagugacuuacugguggcugaacgcucugucccagggcuacccaagucugccacugagcugacucccuuggugcugcggcagcacagcggcucagaauguagggcuggucccugccacagagcaacaggcuggguuucacuuuauacccuggauguacuugaaauaguuaugcauacagaggccagagccaguacgggaaacugcaaaacaugagaguuuuccaagguaaaggaagaguuagcuuaguaugggagcuaccuuuucugccuggaaucaccucaugaccugacaagggaggaucugggccaucccccaagcccaggcucucagauuuuaagucacaacacaucauacucuauaaggaguggccaauuugcagagaggauggaggccagaaccauucccagauaaguuucauuguuuuguacccuccccagggcagaagggcaggcaguaggccugugaaggcugagagcccuugagcugcaaaggcagcauuacaggaaagcgcuuagcaccggcugcucuagagcugccugggugugguagucaaaaagcaguuucuaucuagaccuuugggcuccagccccagaccugcuaaacccacauccucuggccagcacaggcacucgcuacuccucuucacuucaaaaccuacauuuuggugccauuucuuugcccaagauuggaaggcugguaauacaggaaaugccugcgcaaugcugguccuagcccaagcugcuuuuuccccagcuacuuccaguuucccucuagacuaaggcuggcaaagcaaagugacucuaccaguaagguaagugcugaaacucagcacaagcagccgugugaccuuggcaaggcucagggccauccuuaucuaggaaugaacacuggucaacagucugcucaaacuggacaugcccgccuggcuaguuuuuaauacuuuucagagugggaacuugguggcugaggcaugggcggcuuuccccagugggaaggcggcaagggagacagacccgaguacguccuuauagaugccucaguaaagcugaagagucuuggagaagucuucuguauauacuaagauuauauuuagacuuuaugcucugggcaugcuaucugccccucaacugagcacucuguauuaucuuuugugagagcucugacuggaacguuuuugcuaguacucuauaugacuuaccuguauuggggaguaauggauauaaacaaaccauuuaucaagguuuuuuuggauuuugcguuggccuucugugaaauauaaaccaaaagaacugaccaugagcuggcuucaggguaagugaugcaagaccacaaccaggcaugcugguaaaccacugaaugucucaccuccuuacauuuguaaacagcaccauucugugacuauuuuaaagagguuuccucagaacagugggaggugauaccaggucaugaacgccacuuugcuuuagaaaugugguuuauuuccuuguugucuuguuacuguauacauaguauuuuuauaccuuaaugcuuauucuugauggcaucugucagguauuugaagagaucagaaaugagauuuuuuuuccccucaaaaguccuuuauuuucugaugagcucaucaggcaguuuucaaaauccaagugucuuuacugucuaaaacacuaccauuuaagcuauagacaaccgacccauggaaaugcaagcccugguggucuguccucugugcuggaggacaggagaggacacagcugccugcccuggggacaggugucggcugcugagcaaggcugacugcagugcuguggaacccacagggaguucaccaagaacagcaggaccagcaagcucgagcaaacagagcgccuuggccucccugucuccuagccaaagcugucagcccucuguggcgugucugugggagguauaaaauaaagcuccugucgucacacagcaagguucccaggguggggguggaggugggggcggcggcgagccacguucguuccugcagcauccacuaggagcaaaggaucagggucucagagcccgcugagaaccgagggcuucugggguccugaugcuucugacaccaccuuguaguagcuugugaguggccugagaagagugugagaacacaguuaggcaccagcagccucuguccaugcagggcucccugcugcugcucugcccuguuuaaauuuuucuuuuucuuuuuuuaagacaaggucucauaaccugccucuuuuguuucuuguuuuuacuuuagaggacaggaucuugcugugcggccuuaacgauccuccugccuccacuguaucuagccccacauugccuauagccagaggagucaacagagggguauaggaaggcaggcugaagggcaaugcagucuggcaugugaauugccaucccaggcagguggcuauaguguaccgggcuggggaagugucaagaacagccaugggugaacagcagucaucccugagaucaugcaacagcagcuggaaguggagagggagggcaguagagcaaggcagacucccagaaauacagaaggccuaugguuuuaacaucagaaauauaaacagguacuagcuacaccccagaaccaagaacuucggagauuuuguggauucaagguuuaggguaaaaggucaagccuaaguuacaauguaguguggcauucucuaaggacagugcuuagugacagagaacauagugacugacacgacacugcccacacuugagaaucagcuguggaaagguucccagggagcaaagcacugugacgagcagguggcugugagugauuuggacacgugggccccccgaggccuuuucagcugauacccugacaacuguccuagaaucaaaagucaaaagcuaggcaugguggugacugccuuuaauccuacuugggaagguagaggcaggugaaucucagaguucaaagccaacuuagucuuacauaguaacuucuaggacagccaaggguaaugcagacagacugucucaaaacaugaguaggugacuggucaggagaagucagaaggaagccaccucuuuguaaggaccuuuggcucucauaagagcacauacuaacugggcucagcaggucaccaucacggaugcagaaagguaggcgacagaguagacaggacaauaaacacgcuugucccaagcaagggaguacaagugcuuuguggaaguggugucaaaguaagaccauaagaccccaucacaauagccugggaguagaagcuccugccucacgauccagacuagguagggucugagugaggaccauuuccaaucuccuuaucuaaauuucucugagaucggcucccuauauagccaggguuggucuugguauucugaauguugggacuacaggagccccuugaaaaucuccauuuuuaacaggacacauagguggcagcacuggccaagaaauguguugagugugcacacagccauccugaggcagagaccacggcaccagaugaggguggggaugccaggagucccaggggcucaaacuggacccaggucuuaggcaacagguuuauuggcucauagcccaaacugauggcaagggcagaaagcucagggacagccccagaagcccacagcccugcaucccuaccaggaucccugaggccagccugcugcuaccaggagcugaaguccccaaagccccgacugggccuuuucuuggccguggggguggcagugcuggucgaugguucuuccucugcugaucguuuccugagacgugaagaaaaauacugcaguugccacaaaagagccaggagccuaugcuugcgagucccuugagaaacuauccacagauagccuucccuucagaagccccccuccacagugcugcucccacacagcccagccaguaaggcauccuugccugcaccaggccuuaucaagccccucagucuuagucuccagucuggccugugcugcucuugcuggcuugguaaucaugaagcacuaugaggcuacgggagaugcugcccaucagucacacucacguggccgcagggu

SEQ ID NO: 8126 - RNA, 1466 nt, Mus musculus
ggccaaucaguugaagggcugggcuucccagaaccuaaugcuuugugggguugucugguccuuugcaguucaugaggaguuuggaagaccagauggucacaaauucaaggaaagaagaggaugcuacccugaaccaugagaauccagaguucaaagggaggcugggaauauggcucaggagguaaaguguuguccacacagcacgaggacuacaguuggguuuccuaaaacccacguaagagcaggucagaugccgcagcugccuggaauccgaaucugggaagcaggcaggagaucccugaaucaagaugacuaacuuaaaacaagcagcagugagcccuggauuucggaagagacugccuuagcaaauuaagcagauauucaggaaacaccugacaccagccagcuuccaagugugcacaucacaaacacaugcaaaaagaaaaaggcacaaaacaggccucuggcugucagucgggaugcacuaucaugagggagccaaguggcuuccaguagaucagcugaggcagaggcagaaauagaagggcuuccccaaacacaaguccucagaaccacagcggcuggaguggcucucaggagacaagaguggguggcacacggucuagucuuuguaguagagggguccucaaacuccaggacuagaaauaaggcaaagacaagaguggcaaacuugucaucuuugagaugucaaucaauuuauguauggagagaagcuggagacaggcaggccaaggucugagcacagagcucugggagagcccaggacugcauugaccuuugugccugaagagugucgugguggacaaggugugcucugcccuguuccaaggaaacaacaggaacuugcagucuuuguucugagacaggaucuuguaccccagaaacuucugauccauaugccuccaccucuuaaaugccugccccuuuuuuuguuuuguuuuguuuuaaauuguguguuuacacauuuguguucuguggugcuuuuaauggaaaacuggcaagaaccgguucucucccucccaugugcauccagcuugguggcaggugcuuuugcucacucaacacugugccuugcuccacaaccaguuuuauucagcucuggggacacaacucaggacuuuauguguucuagaaagcuuuccccucugagcacccacagaauuuuaaggacaccaucccucccaugcccaggcacucacguauuuccacccgaguguggucuugcaguucucacaguagaugucggccacugcaugcagcccgguuagaaggacucucuccucagcggggccacagcccacauucacccugugaagacacagaguggcugugcuggaggucucccugcccagugccccuccccucccccacaucauaaguaacaccaggacagaguuguccauaucaucacaggcuuuucggcucucccaccccccacuuuagca

SEQ ID NO: 8127 - RNA, 11807 nt, Mus musculus
uguaggcgcaagccaaugaggcuggcgcugugccuugaggcccggggcucggcccucgggacugucagaugguuaaagauggagccgagggagagagggcgccacgaggugcugaggugcgggguuguccagauaugacggggccgccgccuaccuggaucuuccacuaagcuucaccuugucccccuggugagaacaagaggugucuguccacgugaguaacuggucugggauagggugugcggugaggccagggaaacuccagaugccaggaagcccuaguucugcucuucuaggcaggagaaucuguuaggauagagugcagaacucauacugggggaauggaccaaggaccggaucucggacuccaagggccucacgugcaaggagugaaguaucccucuuauucuaguucuggucugaaacaggguacaaguagucccacugugcuccccucugcaacugagcgcaggccucucuccuuuguguuugagcccccucgggugcucgcccuucagcucccuccuuggaguaccucaccagaaucagaagccuguuagagaaaguuugaguucccugaaguuaauaaguccagaggacugcauccgggcuggaaucccgucuguucuccgagcuuggauagaugucccacccacccauggugguugaauuuccagcgcagcccugcgugcagcgagggcgauggauuuccugcuggcugcgggugcucugacuagguugcacuacugugcugugagaagcagugcaaugguauugucaaagcaucugggaccagccucgaagaccaccucaccuacuguuccuucuuucuucccuuuccaggccuggccccucaggccugcaggccguacccucccccugcucauuuuacucucuucuccauggaaacuugagauuguagccaggcccgugucucuggggucagagggcauccuuugcucaggccgaggcuccgcccaggugggcaugcguucuaggucuaagaucccacuccagccaccccaacuccccaugccccgccccaccccgugagacugacaggcuuguuggacacucuuucccuguugcacuacugugggccucugggaagcagugcaaugaugaaagggcaucugucgggccagcuaaggagccugaggaacaaaagggucagugcuuggaucauagucuuagauagagauagcuaucucuagcuaaaaggauaagguggaugcugagaaccauauuccaaggcuggaaccaguacaaaggggagaccccagauuuggaaaggcuccagucucaagcucuuagcccccuccccccagguuaagauaggggagucugcugcagggggcgcggcggugagugaaugguagguagcucaugccuuaaaucucagcacuuggaaggcaaaggcagguggaucacccagaucuagggcauccuggucuacauagugaguuuuaggacagccagggauacacagagaaaccguguuuugagaaaaaccaaauuaacuaauuaauuaauuaaucaauuaaaaaagaaagaaagauuggugagcccaugucuggaggcugaugcaggaagauugucucaguuuugaagcugucugaagaaucaaaacaaaacuaggaacuccaggaccuuguggagagaaacagauguucaccucuuuguauggaaaagguuuguauaccuugcuuagccuugacugccucgggaagaacuggacucagccuuuccugagauaaccacaccuuggguucacaccuugaggcucagaagaaguguccugccugggccagauggauggacuuggaacaagaagccugcagaguaggccugccagccaugucugcuugcuccuuuacaaagaggguaugugcugaguaggagaggcauggaggugucugguaugucugcuuuccagacagggcuggagcucauuuuuauuuauuuauuuauuuauuuauuuauuuaauuuauaugagugcacuguagcugucuucagacacaccagaagaggccaucggaucccauuacagaugguugugagccaccaugugguugcugggauuugaacucaggaccccuggaagaacagugcucuuaaccacugagccaucucuccagcccuggagcugaauuuuuaaggaugcccgauccuuagugugcuugcagaguuaccuuuagcggcaagacccaauggcccaugccuuugaaugcagcacagggaaggcauggguagguagaucucugugaguucaaggacaaccuggucuacccugcacguuccagaagagcuauauuuacaugguaaagcccuguuucaaugcacccaccccucuuuuacaaacaaacaaaaaccuaguaggagguggucaggccugccuccuugagaggaggcccaggcuuccagauucccuuuugggaauagauugagaaaaucagccuuaauaguacucuagcuccacaaguccuggcacccauggggacugcucugauacauaaugagucucaggccugacggagggcuuugauggggaagaagcaaccacacuccuuuguggcuaggguagacgugugucagcagcuguugccacagcagauccauccugaggugcuaggaauccuaacaugugcauaucuuacauaucuuacaugugcauaucuuacauaucuuacauguacauaucaggggaggucugggccgcaaaggauuuagguuggcuaagucacuucugugaauuugaauuggcucaggguguagaacacuugccuauuaugcacaagguccuggguuuaaucccuagcacuccagaggggaggggagggagaggaagguagcggagguaggugugaggagaggccacaggaggacaucaagacauagagcaaguaaguggucaugggugcaggcaugcagucucuaaucccauuguuugggaggcagaguuccagccuggucuacaguggauuccaauauagcuagaauuacauaggagaccuugucucaaaaaacaagcaaaagaaguggucaggacaugaucuggagagggauguguguaaugcuuccgaguagguaggaaacucagagggugcaaaagccagagcuaaagcccuuuggggggcagaaggaaguccuuuuggauauuaucuuagugaacuggaaaguagauucaauuaccagggcggucugguagggcagaguauggagggaacugcaaacugggagagggcugggugcuuugaaacggaaaggaccacggcucagaaggaggucaaaauccaggagcucaaaauccagaagguaccugggugccuuuggcggucacagugagggguggagcagugggggcggggugggguggggagcacaccaaugcgcaugccuagagaagugagcauuguuacgcguacuggugcuggacccgcccccugucucugugggcauucauucccugggguagaccgggagggggguggguagucuggggaucuggagucugcacugcggcuguagggagagaguggguacgcccugcaguccucaucccgaugguuucccaucaccuuucucaguccuggcccucgggagggucucccugccccaggagcccugccccgacggucguucuacccacagguagcaucgacccaccaccagcaguccauuuccaauggaaguccuggaugaguucgacaacgaauucccccugagugugaccuucugccagcucauuuccgaggaugacuucgagaggcaagcagcgaccuacacagagcgugcacugcgacgacucuuccgcaccuuggaucgcaacccagcacuggcggagagagucgugcggaagggcaagcagacugaguucgagcagcgcgggcuccucugcagccucugggugcgagcugcgggcagcgggcagcagaaguccacuaacucccuaaacuagggaggaucuuugagggugggacuuuggcugagggaugaauggggagguuaucuauuggcuggggcagccaaaggggucuuuccgaagccaagaauaccaagccugaggaaggagcaggcaagcgacucuuuucuggcuucccgccuuuucuccuccguauugcaggcgaaguuugucugcgcugugcagggggaucuaaaccagugcaaugacaugggugccauagagaugcaucggcgccuggagcagcugaagaggcgcauacaucgugugcaucuguauucccagggugaggcucaauuucugaaggugcaaacccuugggacucuuagcccagcucaucugcucccccucugccucccaucacauuacagugucuaucaagcuuagauuggugaaaucuuaggugcacucccugcccuggauuugccucucuuggaucagauuuaaugaagagcgauaaugugggccugggacagaaagggaggaaggaagaaacaccuccuaacaagauuagcuaauuuagagaaugacaacugagggugggggaggggucguagacacauuuaaucucagccuuaggauauuugucuuaauuaacacaauuuaucuacuuauauauuugagacagggucuuauucugaaguccuacuugccucaaaaucugccugccucuuugccuucauauagugcugggagucuugugugugugucccauguguuuguuuaagugccuguggaagccagaacauggcauuggcuucucuacagcuguauuuauaggugcuuauuagccaucugacaugcaugcugagaucugaacccaggucuucuuuaagaacaaugagugcucauaacaacugagcuauccuucuagcucuucuauuacguugacuuuguauguacauguacaagcacacucacuuucuguucugcauauguggauggcugaggacagauugcagaagacucagcucuaccacaacucagguuaucaggcuggguggcaagcuccuuuaccugcugagccaucuagucagcccuuauugcuugauaaggccuuguaugucccaggcugaccuuaaacuuguagcugagauuagcuuugaacuucugauccuccugccucuaucuccugaguuuggggauuacaggcaugcaacaccacauccaucgaaugaacucuuccagugggcuggugaggugugcuuuaacacccacugugcuccgcagacucagcaguccuuaagaccuaagagcacaguagguccuggcucagggucgagccagacguuuggcuacuuuguggguuccccucccuuccauccuucagcccucuuucacccuuuaucuagauaagagagagugaaaggacacaggcaagggagcauuguuauuguuagauacugcugauuaggggcauggaguuccuugaggcaagcuugaucuucaccaucaggauauccaguuucuuauuucuucuuuguguaugacuacuuaaaccacgaccaauagcaaccaaccagaaacccaccaacaguccaucccaacucuuggggccaggauuuauauauccucugaagaauacucaaaaugccaaacgucacacaguggcaaaaacuaucaacagcuggaaaaaugcuagagcaugagacaaauccuagucagcugcuguggacaaucugaagcagccccauagcucacauggauugaaacgaaagcacauuccuauuuccauguuuuguuuguuuguuuguuuguuuguuuguuuuaaugaaaccaaaaugcccaggcaucacuuucuuugaacccaccuuugcaagaccucucuguggauuuucuuauagaagcguaucauuuuccaccaugccccugugccucugaggcuggguguagguugagggcucacugucuggugccugaauacuccuucugguguuggcuaacucaggcuuccacaguccuugacugggaagccacagguuaccuuacagggccugauuuacucaccacuugcuuccaaauucuaucuaaaguuagacaucuuggcauggauuuugccugcuuuuauguagacgagaucuggcuugcucugccuguaagagacaaaaaggggaguggggcugauagaaggcuccauugguagaauucuugccuagcccacaugaaacccugaguuugauccuaagcaccacuuaaacuguuugcauacagccagacagugguggcacacaccuuuaaucccagcacuugggaggcaaaggcaggcagauuucugaguucgaggccagccuggucuacagagugaguuccaggacagccagggcuacacagagaaacccugucucgaaaaagagacaaaauaacaacaaaaauaaccuuuugcauacauauaaucccagcaauuuggagacuggaggcagaaaggucacagauuuaagaugcuccacagaugcaguuaaaggcuggcuaggauauguaagaccuauggaagggaagguggauacagagaaugauggagacagaggaagaaagagauugauuuuugaacccuuucuccaagauaccugggugacuacugagauaauagauaaugccugcuggcaccugucauugaugggccugggucccaggauuuuccuuuaucuggaaagauauuaugaaacccuuguguuauuccauuuggacccuacugcccaaggugucaguacucaccaaaggauuugaugcagaugccaagaagaggaggaggaggccaaaaccaaagaaaccagauccuaucuuucgagaucagucaaccuccgcaugccugccaccagcucucuuaccaccaccgcugcugccgccaccaccacaaccugucaccaccguggccucuguaguggcugcaucacccucugucuacacuaugccccgggucuuuggcccuuucccuccacugucuggcaagccggucaguaggaacaugcucuacucgaggcaguccugggagggaggacagcuucuuuuucccuguccaagggccacaguggaggugggaaguacaaagcuccuguccucugugagccagcaauccggguagacuugggaugucccuaagaauaaggaaaaccauagacuuugcucacaucuguaucccacuccugccucucaggcugucaucccugcucugccugugucugcagagcucccccuuugccccacccccccucuccagaagcucuccccuucccugucaccuugccucaggauuaggacuuccucaguucccagccaccaucucucuaucccugaaaucaauucuugcuuccuguguaaggacugcuuuucugcauggaacaguuuucacucugcccugagacuuccuuuguuucuuguagauggagaaacuggauauuucaaguucugaagugaaacuaaacuggaguggucuuucaucaacgucaaagagguacaagggauuuacucaucuugaaggaaacaaaaagcaguugggggccagguuugauguuuugucccagccucuuaauucuuaguuuuggguggugauuacauucuauucagagggagagucuggacuccugggccuguguuacagaaagcauacugaagccgugaauggguccaaagccaacauccuguuucuucccuaucuuacagccacaugguugaucugacccccuugguucucaaucccggaggcuuccauuucucauauuuggcaggaagcagugcacacaagcuccauuguccuggcuuucccuggugaguaucuguaccuuuccgacacugauccugugggcucucuuccaguuccacagucucugccucucgaaggcacuguaauaguaugcucacggaaagaagagacucugucauauuccuuucauuccuagaaccucacauguaaucaguguuugcagugguagaagacaucagugauuggccaacccagcccaacagaaaggagacaacuaaggggcugccuuggaaucgucauauugcaaagcaggguuuaccaaauguggauuuuuuuuuucccgagacaggguuucucugaguaguccuggcuguccuggaacuaacucuguagaucagguuggccucgaacucagaaauccgccagccucugccucccaaguccaaauguggauucuuuuuuuuuuuuuuuuuuucuuuuaagauuuauuuuauuuaugaguacacugucucugucuucagacaccccagaagagggcaucagaucccauuacagauggcugugggccaccaugugguugcuaggaaaugaacucaggaccucuggaagagcagucagugcucuuaaccacugagccaucuaaccagccccccaaauguggauucuuaaaacucacuuguagagauagagauguagcuuaugaucacagcacuugggagguggaggcagaagaaucugaaauucaaggucaucucugcuuaucuagucauggugaggcuagccucagcagcaugggacccugucucaagagggaaacacagaugauggugacaucuguguaaccagucuacagaaagugaaacaagagagaaaggaggagaagaggggugaggguaagggaugggggagaggcagagaggcagguauggcuauuuuauaaaucauuucuucacaaagggagaaaaucauugcagaucauuaguacaggcuuuacuuucaaauggcuggaaaaaaucgcucaucacucuguuguuaggaaaaucaauagagcacaguucuauuaauuuaugaacucaggagcugcaguucagcaagaacauggucagggcuuggaggcuugcagaguucacugugguagcugaucauagcuuaucaugugccugcugguacuauccuccugcgucaaccuccuuaauaauggagcuacagguguaccccuggcugucauaguccuugcuccaagauggaugaacaaaauuaucuguacucauuuuguagaauauuauuaaccauacuacaaugcauggacaaacuguaagugaaaugucugcuacacaaggaaaaauacuaagcagugguggcacaugccuuuaauccauccuggcacucgggacucagugaguucaaggccagccuggucuauagagcaagucuaggacagucagaaacccugucuggguggcagggguggggugaggguggggggugggguguuccggggaagagaaagaaaaagaaaaauacuauacagcauauggacuagguuaguucagagagaugaggaguuauuguuuaugguugcagaauuuuugaguuuugagugauauucuaaggagucaugguguuuuguauguaaugcacacaaaauuguauguugaaaaugguucaagggcucugguguguguacucaugugcuaggcaugcaugggucccagcauuuuuuguuuguuuguuuuauaauuuuaucuucuuauuuucuaaauauuuauuuauuauauauuaaguacacuggucagacagaccagaagagggcaucagaucucauuacagaugguugggagccaccaugugguugcugggauuugaacucaggaccucuggaagagcagucaaugcucuuaaccgcugagccaucucuccagcccgggucccagcauucuaagagagaugguuaaacaugugaggacuuagaaugcaguuuaauacuuaguacucaugaaagcuagugucuuaggguuugacugcugugaacagauaccauggacaaggugaggcaacucuuauaaagacaacauuuaauuggggcuggcuuacagguucagaaguucaguccauuaucaucaaggcaggagcauggcagcauccaggcaggcauggugcaggaggagcugagaguucuacuucuuuaucugaaggaugcuagcagaauacucacuuccaggcagcaagggugagggucuugaagcccacacccacagugacacacccacuccaacagggccacaccucccaauacugccacuuccugggcugagcauauacaaaccauuacggcuagggucguggcacaaauuuguuaucucagugcugggggcagagacaagaagacccuggagcuugcuggccaugucuauuugaaccagaaagcucaagaccaagugagagacccaaaacauaagacagcaaaugaaaaaguacaauggugguguacgccuuugauucccuugggacgaagaagcaggcauaucacugagucugagaccagcaugucuacagagucaguuccaugauagccacauacuugcaguugggcaaaaagguaaauuugcucagugggugagccugcugaccagaguccagugcucuucugcagguacauagccuggccuacauagcaguaaagagacccacaucuuaaacaagauauaauggcaagaaacaacaccuaaagauuauucuauggcuuccacacacucagcagugacauguacaugacugcacccccaccuaaauaugcacccccaagccccccagagcuaggagagcugaugugcacuuacaguucguuuuucuggagcugggaaggaaacauugcuugagccuagcaguuugaggccagccugagcaacacagauagauaauguguuuuuaaaaaagaaaaacagaaaaguaugacagcucaaaccuguauucuauuuccaacacucgggaggcugaugauacagguggaucucugaguucaaagcuagccugagcuacagagggaagacuuuguuuaaaaaauagaucaaaguaaugccagguguggugguacccacuuuuaaucccaguccugggcugacacaggaguaucugugaguuuauugcuaaucuggucucuaagacaggcaaggcugcauagagagacaugucucaaaagggaagucauugaaguuugcagcauucuucgcugccauucucagcacccaucuacuuucuguccuuauaaauugcuuauucuggccucaaaauauggccuuuugugucuguuugauuucauuuaggguaauuuuucaaaguccaugcauccugcaguuaguccuuuacuccuuuuaaugguuaccugauauuccugcaucacugucuuuucugugagugugguauguuugcacacaugugugugcaggacacagagcugggagucggugucuuucucuagcuucaccuuuuucuuucuuuuuuuuuuuuuuaaacuugguuuuucaagacaggguuucucuguguagcccuggcuguccuggaacucacucuguagaccaggcugguuucaaacucagaaauccaccugccucugccucucaagugcugggguuaaaggcgugcgccaccacugccuggccacuuuucacucuuaacaggcaucaggacaagccucuuugcuuugcacuguguuccucugucacucacaggcacuaagaucuguuuccagccuuuuacuauuguaagcagugcuauaauguaaacccugaacagguuccaugggagagguuucuagaagucaugucuugggagacagccugcagccuaugacugugugucugacagcccugugagcaaguaugguacaucaugagcauguguuggccaucucucaugcaggacgccagccuguagccgacccuccaacacggaugagacgccaucuccuguugugaaaaccuccaucuucacuccgccuguacugcucaaguuccaaccugugcccagacccaaugaugauucagagaaugacucuggcagcgcagaguccacuccugccaaggagagccaguaaucucuucccaacagaccaugccccaggacugaauaaaguucauccugguguugag

SEQ ID NO: 8128 - RNA, 16083 nt, Mus musculus
uguagaagaaaacauuuauugagccuuguaguucuagaggguaagucgggcagccggcaggcagagaggguguuggagcagcagcugagagcuuagaucugauccacaagcacagggcagagagagugagagagaacuaggaauggcaugggcuuaauggaaacuccaaacccuuccucagugacacagcuucuccaacaaggccacacuucuaauccuuccccaacaguuccaccauaccaaccauucaaacaugugcuauuagggaccacugucauucaaacuaucauaccucuaaaaaaguaggcuguaaaauauuuucaugacauugauuucaaaccauuucacaguuuacugagcaucuuugcuagaaauccugguugguuguuggauuaccuuuuugauagagggcuuuagaugauguaucauuuguaucguugguauuaaugaacaauuaaagcagcccuggcuuagccauaguuaugugaagucugguauguucauuuucccccuccuuuucuuuuaggacaacccuccauaugauaagggagccuucagaauugaaaucaacuuuccagcagaguauccauucaaaccacccaagaucacauuuaaaacaaagaucuaccacccuaacaucgaugagaaggggcaggucugucugccagucauuagugcugaaaacuggaagccagccaccaagacugaccaaggugagaggcaugcaccuuucuucucccugccuuagauagagcucuuuucuggaaauacugcuuugagauggaagcuugaagguucucuuuaauccccucucagacagaguugagaaaacuacuacuguagcaacucgaguguguguagaagugcugcugagaccucacaguccugugaggcugucucaucucaguuggcguguugacugugcagaggcccagacccucgaaggcacaaaacgaugugauggugccugauagggagagugaggguggugcuagaugcauauaguggucaucgccuagagucagcccagcagaaaggcgaggauuguagcuccauuagaagguuuagguucaagacaagauaugucagauuuggguagcauuucugugaaagcacacagcuagcuacagugucuguaacuuguuagaaguagguguggcuguguguguccgagcuuucagucagggaccuugccuggagagaagugcuucugcacagggcaggccccuggcacuggccacaguugaggcuccugagaagggaggacauggaggcucccagucccugggaugcacaugcuucaccaucuccuaggccuccuuuaucuucauugcugcauaugcagcccaauacugcuguuucaggcugggggugcuccccacucuccaaagagccaaauagguuggggcaguuuucuauucuuuugcaaaauauacuuauuggcuauauaagaauuucaugcagcguggugguggcacacaccuuuaauacuagcuagccucgucuaaagagugaguuuuaggaagccaggacuacaaagagaaauguuaccuuuaaaaguuugggguuuuguuuuguuuuguuuucauuucagguauaguguuagaauuacuuuuuuugugaugugggaaagcguacggcuucuuccuagaaaacgaauuacuugucuuuguagcauggcuuugauucugauaucuuggucaauaauagcacuugaugccauauuuuccuauuucuguuaaccuguggcuguauuauaaccaccguuugcauagaugguucacuggauguuguuccugagaaccuggguucguuccucagaacccauacauuagaguucugugacucuaguuccaggagaucuaauguccucuucuggucuccaaggguaccaacuaggcuugcacagacauacaugcagguacaaugcuaauacauuuaaaaguuaguucauuaauuaauuaauuaaagauaaggugaaacuagcuuaaaguagcaguuuuuugcuguuucuguauuggcugucucaaacaggacugggcacucuuggggcuauucagguacuguuauugugggguaaauuguccuacuugucaucaucacauguguggcaguuggugcuggcuagguacuugacucucuuugugcugcuuauucuccaugaauaggauuggacuugauagcaauggaggggcucuaggaugaaagcagaagcaacagguuacuuacaacucaguguagugcuaacacuguuuucauguccuuucuggauccucuuggucaaacaaauaaguccuuagucaggguacucagguugguagaggugggugcauacuuaggcagaggaggggccccuggcaccaaguucccuuacugucucucuguguuugccugaauguauauuugugcaccguguacaugcaaugcuggggagcucagauggcaucaaaucucuugugaaaugccacaugagugcuaaggaacucagguccucuagagagccaucucucuagccccugccucucuacauacuuaguguggguucuguggcacuauuguggccauacgauaggugcuuuuguguucagcauugguguuugucugguuuuguuuccuggcugcugugcagcagucaucauccuauaucaccuucccuuuucaugccuugcaauucugcauuuccuaaagcugugaagugagcaugacacuuguucuucauagcaucugcuuguggguuucuucugccuguguccuuaggaacguuuucauugaugacuccuuucagauaaugucauggugcuugugguguguagguggauguuucaccuucauguauguguguaugugcuugcccagugucuagggagcccaaaagaggguguuaauuucccugaaacugagcuacucacaguuguaagcugugugagcugccgguguucuuaaccacugagccauccaucucugcuuuggcacaaagucauguuuaauuaaacagguauggaaaauaaaaaugauaagauuagcagcugaugagauggcucaacagagaacugaaauuuaauucccagcacacauuugguggcuagcaaccaucuuuaacuacaguugcaggugauucaauaaccucuguagcauccacgaacacuguaauacacccagggcucagacaaaacacccauacagguaaaauaaaaauagauaaaucuuaaagaaaugguguugacaauaaaguuaaaaugucuuagaauaggagcuggagagagagcucagcaguuguugaguucaguucccaggcuccacguugagugggcuaauagccacgugugauuccagcuccaggggaucugauacccucuucugaccucugugcauucuaacaugaagacacacacacccaugcacacauacacaugaaugugcaugcaauaaccuaggcauaauggaguggaguaagcaaugugaaaaaaugcuccugugauccagcaggucaacuuuuaguugaaugugcgccccaaaaaugaaagcauggauucacacaaacauuuuaaaaauuacauucuuuugugugugugugugugugugugugagagagagagagagagagagagagagagagagagagagagagagagcaagcaagcaagcaagcauugaaggucagaggacaguuugagggacuacucaguucuuuccuucucccaugugaauaccagggaucaagcuuagguugugaagcuuggaggcgagagcuuuuaucuagcagggaucccucuggcuggccuaaaacacuagcauucauguucauugcaguucuucucauacuaggcaugagagagaagcaacucaaaucaauggauguacauaaugugguaccuaguguccuuucuguuucuguaacagagccacuaugaccaaaagcagcacggggaggagaguuaauuucagcuuacaucaugaaaggcaagucaggugugggggcgcacaucuuuaauccuagcacccuagaggcagaagcagguggaucucuggguuugaggacagccaggacuacacaaagaaaccaucucaaaaaauaaaaagaacugaaguagagacagcaaaauggugguguuuauuuuauugucuugcuccuuguggcuugcucaguuugcuguuugucuuauacaccccaguagcaccaucuaucuguccggguggcacugccuacaaugagcugagcccucccgcaucaaguauuagucaagggaaugcucuguagacuugccuacaggccagcagaaaguggucccucuucccagacgaccauggccuuaacuuacaucagugugaccaaagacaacaguggucuuuccauacagugacauacuguuaagccauaaaaaaaguaugagccggcgugguggcgcaugccuuuaaucccagcacucgggaggcagaggcaggcggauuuuugaguuugaggccagccuggucuacaaagugaguuccaggacagccaggcgauacagagaaacccugucugggggaugggggggggggggaugaaguaugaauauaugguagaagauauauacaccugauaaauaggaugcuauaugaaauaauuacucucauaaaaacaacaugauaaugugauucuguacacagcucauggauuguggauauguagcccaaguuggccuugaacuauggacccuugucucucucucucuuuuuuuuuuccgagacaggguuucucuguauaucccuggcuguccuggaacucacucuguagaccaagcuggccucgaacucagaaauccaccugcuucugccuccggagugcugggauuaaaggcaugcgccaccacgcccggcuuugucuuauguuuuuaagugauguaauuucaguggugaugcuagcacaucuacuuagagcuuaugaauuugggaaucuguguaccuuguaacuucucaaucaguacagcacuucugugauaaguccugucccuauaguuccucugagcuggggucauuguuaacagacagaugcagcuucauaauaugcuucccuucccccacccccacccaaugauuagaaguguccugaguagaguguaucauacaagaguaggaaccugccaccacuaacugccuagagagguggcccuauguauagacaaguauaaaagugacuaggccuacucucugcagagcacuggagaaugagacugacuggagccaggagguccagauacugucuagaagauggucugugcuacccuuguuuucauuuugaaugagugaauguauuaaguauauagcaagccagaguaaaagaguaaauagugcugggugugcuggcacacaccuuuagucccagaccucgggggcagaggcaggggaacucugugauuucaagaguagccaggcuuacuuaguaaguuccaggccagccaugcuacauagugagacucuuucagaagaugaggaaugagggcucuagguaguguggcacccacaugagugagguagggcuccuuuaaagguggccaguuggagucuaccgagggaagcccaggcagagcagucucuucaggugagaauuccauauacaaacaaauugcacauagaaagaacuucagcacaacagaaacuaacauaucagcugcaguucccgguuaggcuuucuuucgaugacugagcuuccagcuuuccaccucuuucccacugcaggcauuucuguauggugagauaaaguagaaacuuauuguugggaaugacucaccuucugucuucaaggcacagcuguguuuucucuuaggcuuucuuguuguucucuacuugcugucacugcauugggagcauaguguucguccucagauaagggaccuuggaggguaccugaugucaucaugcuugguucugaaauuggagggacaggcagccucucuuccaaagccagcuucucagugagacaaaacagcacaugacaguucaccaguaaaaugugugucccaccaaggugaggcugggaucugucagccgcuaacuaagcuguaaucugucucuccugauuacagaaguugaguucugguggucagaauuuugaauacacagaaggccacuuugucuuuaaaacacauuugugggcaugagacauaguucacuugguacagagccagccagaaugugcuguguauggagucacccugacuucauagaaacaaauauaguggcauugggcuguaacccaaaacucagaagggucaggaauucaagaaauugugauuucuaacuacaaaucagaaaaagggagcgagcuggguuugagucaguguagggagaaguuucaguuucucucucuccugagauuaguagcaucuugccugugcuauuugaguccauuuuaaccccaaugccuuaucuuucucuucgcaguaauccagucccucauagcacuggugaaugacccccagccugagcacccacuccgggcugaccuagcugaagaauacucuaaggaccguaaaaaauucuguaagaaugcugaagaguuuacaaagaaauauggggaaaagcgaccuguggacuaaaaucugccaugagugauuccagcaaguuugagcagagaccccgagcagugcauucagacaccccgcaaagcaggacucuguggaaauugacacgugccaccaacuggcguccgcuuguggcaguuacuaacuuucuacaguuuucuuaaucaaaaguggucuagguaaccuguaaagaaggauuaaaaaauucagauguucuaguucugcuugcuuuguuuuaaaaaucacugcuuuagucuacuucaaaagaauggcauuucuuuucuugcccaaauuuacucaaaguugcaguuagcccagaagguuuaaagaaaaagguuguugugguuucuucccccuuccccucuccccacuuuucgauucccacuuccacagaccaaggccccagcuccccacagagguggccgcagcacugacaacguuuccugugccaacacugccuguggguaaugaguagcucacgcaccccauuccagcuuagugaugucuuuaaaaaauuauaaaacaguaucaaugcccugucccaaaggaacauccaugcaaacaaagagaagccgucuuuacguaaaauuuuagcaaaggguuuccacaauaauaauagacccgacagacagacccccauggucccuaucuguagucagacugugcuggcugggucucugcagggaaccuguuauagcagguuuguggugaccuuggagggagggucugccagcagagaauacagugcgcuugugugauggacuucucacagucagcagcccuuccugaagcugugguagaccuggucaucacagaccaaaaaaaaaaaaaaaggccagaauauucuuuugaaauuucaagcuucucuaccaccaagcucugauaggaugugccaaggagagcucccacuccugagcacagcaggccaccacugccacccuccucacggcuuacccucagcggggucagccacgauggcucugccucucucagagcagcugcugggacagcccaggaacaggguggcuuuucccucccucuggacuccaaaccuuuccaguccggcuccacuugaagcucacucaauauccuuucaguguguuuuauauuguuuugauugccuuuuuuuuguagaaauaaaauuugagcuuagaauuuaucaucaaaugaacucugucaagauuugaauguuaaaugucuuuucaagggaagugggacggacuguccuugacgcaguagugacacccugaggaagcugauggccugacugcccauguucaccaacucacuucugcuacuaggggucuaauccuguggagaagauugccucaagaaaccuugcuuucugcuuuaaccuuaguucuauaacuuccgggcuaccuaggcuuacagacuugggagacagcucuggguuuugccuauaaaagaaguaagacauguccucucaggcaguguaacacuauuuaguuuuccaaguguuuggcuccugugaugcauaaaugaacuaugcuuuaguucaaguuaugcauggggcagguuucuggagacuuccauaugcccaggauggucagagcccugggccuguguuucuacaucugucucuucauuggcagaaaagugacaauggauuuuauuucacucauauucagauuuguaauaaaaugccaaacucugucagaauugucgaagcaaaccaccauuuuguucauguugcuuuucugaaucuagagauaguccagcugucucauugcuuagcucuaccugccuguuacccgucacugcucucugcucacuaugggaggguacucuuaugccagcagccccucucagggacucucagccccauuguugacaaccauggccugcccugccuuggagucaguggugucccucugggcuugcaugccuuguccuguccagcccugcccugagcaggcuuugagcaagguggcagggagaccuguggagcagccacccacgccugacccaagcuggcucaggaauccacaucccccugguuccuugaagugcccgggucucguccugcucuucccacaauggcagagaauaggcuuucuaagaugcugugaccccauucuguccuuaauaaaaauguucucagacauuagauuggguguauggguuucuuuggggauggccauugcugggggguggggagcggcuauuuggagacuagagaguagugacugggccucuaaucuuuccuccacuucucagccucuaaaagagguguacaggugguucugucugccagguagaaguagauaggggagucaacacugggaaaaucucaagagaccccauggcuaucaaggagacuggccccuuguuacuuccauccuuguagcuccaagaaaguaugaacuuaauuuagcaaaguugagaagaacaagucaagaagagaggauugaucaaggucucagaacgcaagauuauauaucuuaggccuuuuccuugaauccuagucauuaucuggagacucucugagguucccagagagcuacugcuaaggcacuacagcaugcauuaaccucaguugggcacaggccugugacaugugggcaccagauggaauugaggguaccuucuuaguuguaucugccgaucuuguaggaauacauccuagaaugucauguuaccuuugccuccaaacauuccuggggcacugcuggguuugaacuuccaaucauacuccuucauucacucucccuccccagcauguuucucaagggagugcauaguucauaagucccauauccccuuuauccuuaccuuuuacucccaaggcuccuguggccaaagacccaugguucccccacugcugaguaagcagcuuguaaggcacucaacuuuuauuuggugugucguuuucucuagcccuacgagauguguccccacacaacaugcugugcagucuaguugagggagaagucaaguuuggcuuuuccugcccugcucauguccagugugagcaaacaguacuaccccuuuacucucaguacuacuacagagaauaaggcugaggaagagauugacugcaacagggugcccagcccaggcuaugccuggugaauggcguuuccuggaugacuacacaguucaguucuucagacagcaauccugggaaaacagaguacagaccacauacccagugcuaugcccaaggugcagggaaggaagcuuucaggggaccuuccuuuuccuccaguguggccuagaucacacugauuuuccguuuguaagcugggcaguaucccagcagaacagaacucggcaaagccuucugagcacuccgcuguagucacacuccaagagcugucucuagaaacaugaggaagugaauagaaaacuuggucacagacauugcagaguugaaccugcccaggccaagguccaggaagguuauaauagacuggagccuaucaagggaaugaaggcaagagaggaggagccauuccuucugaaagccacaaagucuuaccaggccauuaccaggccaaaugagagagagcuuccuuuccucccagcccccagcugcaggauggauguaagucaugucaaguucaaagccccgcucuacaacucccacuucuaagucuagugggggccugggacauguaagggcuggagguguaguuuaguugauaggaagccuugggcuuaauccuaaaaccauguuaccugggacugacgggcagugcacacuugcaaucccagcauuugagaaguggaggcagaaagaccugaaguucagugucaucauuggcaauaugaguaucaaagacagcccagcugucuugccuagcaugcgugugugaaacuauagacucaguccccacuaccaaaaggaggaucauguuuuccauccucagaaacagugugaggugugcucuucccuucuacucccuacugcccacagagcauccauacgucaucagacaucgcuagaauccuaguuuaucaugucagcagaagacuacuuuccuggggaaauguaacacuccuuuuuccaucuguccccugaaauggcuuacauauaacagauuacuuuuuucccaagacaacuaaaacgacuucuauagcauguauauaaagucuguguggguuuguggcacccagaugaggacaacuuuuagaaguugauucuuaccuuccaccagaaucccagggaucaaacucaaggauuuuuacccaacugagcccaucuugcugccccuccccccagauaaccucuuuuuaaaucaaaauuaugguuaucaugugccuccccagagcacccuaaugaaucuugucccccucccuuaagaaagagaagggccgggcaugguggcgcacgccuuugaucccagcacuugggaggcagagaggcaggcggauuucugaguucuaggccagccuggucuacagagugaguuccaggauagccagggcuauacagagaaacccugucuugaaaaaaaaaaaaaagaaagaaagagaaagaaagaaagaaagaaagaaagaaagaaagaaagaaagaaagaaagaaagagaaagaaagaaaaaagaauggggguggagagauggcucagcgauuaaaaaacacugacugcucuuccagaggcccugaguucaauucccagcaaccgcauggugcucaaaaccaucuauaaugggaucggauguccucuucuggugugucugaagacagauacaguguacucaucauauaaauaaagacauuuaaaaauucauuuauuuauuaucuguaaguacacucuagcugucuucagacacuccagaagagggugucagaucuuguuauggauguuugugagcugugguugcugggguuugaacucaggaccuucagaagagcugucagugcucuuaacugcugagccaucucaccagccacggaauacauuuuuguuuguauguuuguuuaagaaaagaauguagucauggcuagggcacaguggugugugcuugcagucucaacaagucgguggugguggacaaccccuugagccuaggauucgaaggcuagucugagcaaugugguaagauacuauccaucucaaaaagaaaacacgugccaugguacgcauauuacucccccaacacaaacaaguguauguaauauuuuucuaaaaaaggauuuaaaacauauaagcaugugcagaauuggaauguaaagauguuuuuguaugucuuggucugagccucuaaggaguucucugugcccacucuuauuucucugaaggauaccuggacacuuuauaaaccagccaaaucugaaagacauuauuuuauuaacacaccagccucuucccauugcucuuaaacaagugguuguaacuacaacacgaacuggcaccaaauaaucgcucagcuguccuuacguccagaugucacagacugggccucccugcagccagguaaggcugcccaaggucggccuacuacucacuacucagccuagaggaccuggaaacaggauuuaguggcuuuucacucuaggaagucagacccugcuccaaggccugacugaacuggaacuuuagccuuggccuuccuccauaguuuuaggcaguuuguagcuggccuucggugucugagugaggaaggcuccaggaaagguuccagaguugccucacaaggggaccccuuccccaggccuuuuggaauccaggucaucaauggcgcagagcugcacaccauuuugggccagccaagcccgcaaagugggugcugugagaacgugcagcucaugcagccgcucccaagaacaagagaacgcaucugggcccucaccgcagcccccugcuggaggcacacugggguauccgggaugugccaucagcucggcagucagggcguggccagcagggauaucuuccagggcccgcgccagugaccccaagacucggugagcugacauaugccggccacaagugcucaggcccacaaaggcaucgguccaccugugagugccaggauaucagagguguugccucaaggaccggucgggauaggcagaggguggagcaggacaguaggucaacuccuaacuuuuuuuuuuuuuuugguugagaaaaaccaaccaaaacugggaucuuuggggacguggcaggguuggauguaguugggaaggcugaugcucaccgcaggccguggcgagagaaggggccaauugcggcccgggcaucgcgcuccaccgugcaggcgaaggcgcgcgcuggcgcuucgagccacgcgcagcugcccacgccacguucugccggcagccgugugaagcggaccccguacgccugcagcgccucggcgaacaccugacacacgccugcuuggaggggugggcgcagaggggagucuccaucgaccucccaucaacccaggaaagaagccccaccccccgcccugggaguaucaagccgcguaccuggaagcacaugcacgugcuggugaccguccacgugcgugggggaccugcccagcaacucccggaagcggcugaguugagcuucuaguuccucccgcaccugaagggaggggcacagauacuaugagcuucgggaagcagccacaaaacuaggagcuccgucuggugccacgaugcgacugcuccagccuuugaacuagagaguauacccagcauccgcuuuugacccaacgacuuccaugauacccucugggcugagauuugaagaucaagaugaguauuccccugcagccacgucuccgcaccuggggcaaagcaacgucuccagccgcuaaagccucccgaaaucccaucuugccgagaaagaagccuucggggcugaggagcgacgaggcguuguggcgggccgggcccaccggacggcccucagacagguuggcgugaagacccgugggaaugcugugccuacgggcagagcgcgagagcgaucaccggcugccaccaagugggagccccuaaaccagccggguccuguaggggaccgcccucaccugcgggccagcucggccgcacucucugcggcugugccguuaaccagcagugacacgcuggucacaguuccugccaggaaggccucuacgaugcccucaucgcgccgcgggcaauaaccaaagucaucagcggugacaaccagccgcacgcggggaaaagccauggcugccaaacccuggcuggagagcagagggaauagguuggagcauccagaccccgcccucgaacgcugccgaggccccaccccgacgcacacgccuaaaugcggcugcaagccgccauuguucucgccaccuagaggucucugaauguccugcuaacgcucugcaaauuuuauuuuuuuguucguguguguguguguguguguguguguguguguguguuuauguauauauacauauguauguauauacguguauacacguguguguguauauauaguauauauauacauacauaaauacacacacacacauauauguguuuauacuuauguauauauacauguauauauacauauguauguauauacguguauacacguguguguguauauauaguauauauauauacauacauaaauacacacacauauauauguguguuuauacuuauguauauauacauguauauauacauauguauguauauauguguauacacguguguguauauauauaguauauauaaacacacacauauauauguauauacguguauacacguguauauauauauauauguauauauauauacauacauaaauacacacacgcauaugugugugugugugcgcgugugugcaugcgcgccugguuuugauccacaaugugaacgcauacugguaaccgaacuucaguccuuugcaagaacuguaagcuuuccuaaccacugaguucucuagcucauuuuuuuauuuuugaacuguaauuuuuuuuaaugucgaaaaggagaaauauauucaagagaaauuccccuugcucuucucaguguuuaucauuacuaaguuucugggcaguauauuguccuuccauuauuuucucugagaaaaaaaccagccaccuaccuuucuccaucacucaaugaugaugccaaguuauuucauucuuguaaugcugcucuucuuuguuucagucuguuccucacugauucucccaaggggaggcuuuuucuuagcaaaagcucuaaacaacaagaaaacuggcagauuuacucaagaaagcacuaguucacuuucaccuugagcuuaaggcaaugcuuacauccgucaccucacuuuuggacuuuguccaguaagcuuccuuauccaugacuuaccuauaaucaccauggugacaugguaauguggcugucuugauacuguuuugaaacagucuuauguauaccaggcugaccucacuauucauucagcugaggcuagccuugaacgucugauccuagagcuuccaccuguccagugcuggagcuacagguaugugcuaccacgccugguuuuuguggcacaggaaauuaaaccaaagacuucaugcauguuaggcaagcauucugccaacugagaagcauucauuauaggaugucuguuucuugauucaagcccaugauauugguaauuuacuacuguuuuacagcuaagagaccugaagguucaugagagagauggggcaggaacccuucccuacaaguugaagccugaccugcucugggcuccucaauccugaugccugcgugacaggcagaagggagagaacuugauuguaacaguaccuggugacguuucauaaggguuggaggccucgaagaacccuucagccaaguucuuggcauaaacacugcugugucugaucauagugacuguugaaccaucgggugucauucagccacuggggcccucugagaaacugcuuuuggaaaggccagaggcccugaggccauggaacgcugagaaccacagauugggaggagaaaacucuacagcaccuacuguaucaggaaugggguuauuagggauuagggcuaacugcuuugauucuugcccuaaagaagugaagcuguuagacaaggaagaaaaaaauguggcaggggaggauggacuugcuguggguauguuggcaaugacaggcuuccuaggauugaagggaggaaggaaaacuguagaggugaguuuauauggcgcuuccauauaguguaaacuguguuguaauacucacuuguggaaggguccucagcuccauuaugaggagcugguguugaggggcuaagucauauuaguaagaaaaagcaggggcaggaacuaggcuguucagaaaaccaggacucuucacuugaaaaggaagaugcggccuaguccacacugcauugaugagggaaagggauccuuaagaggaagccaacggagugggagguccaggaaugagcugaggaagguguuuaaaucacaaauugaggcuaucgcuuccgcccugagaauuagagaaacaagacccagauucagacgucuuggcugaauauaaccauccccaagaacua

SEQ ID NO: 8129 - RNA, 50637 nt, Mus musculus
gagucuggggucuugguggccuagcccaccauucccccacuggugucaagugauuuucccuuagggagucuauuaauuuuagauagaaagggcaucaaaagaccaaagcaaaaauccuuucuaaugggcacauggauguuacucauggaguacagguacuuucagaacuugaggguggaagcuggaggaucaggaguuuaaggucaucuuuaguuauauagugaauuuugaggccaccuuaggcuacaugaggccuuaucuacaucucaucucccaaccuccaacacuucuccacuuguaaaagcacugagugaguguaggguuugccuucuggcaguuucuuucuuccucucuggauauuucagccauuacuaggaucauacuauguagcuaggcuggcuagaaucuauauucugcuugccucugccucccucugcaggaauuaaaggcacaauccacuuaucuucggcugcccugcacugucuuauucaugguauuucuucagugagccuuccugagaagcagauccuguaguucuuguguguaggaggcuguaugugaauguuagugugggcgugcacacacaugcauguggagaccugagguccacagaauucuuuccuuguuuguacuuuacagguuuucuccuugaaucugaggcucaccaucaauucaguuaggcagguuagaaaaagaacuucagagaucuaacuguaacuuaccuccccuagugcuaaugaccaugcuugcuucuguguggguucuugggaacccaaauucagguccuucuugaucaggcaggcacuuuaccgauuguauuacguguucaguaacagaauaacuuucucaucucccaguuuugauuucuucacaauguuuaguagugccugaaauaaucuugauuauucuauuauuuuguguacacacuauuuauagugcaccuacuaugugucaagcacuguauguacuugccauaggauuggaggcgccauaaaguaaggaucuuuaacuguccaggucacucgagucuacacaggauucuauagcccugggaccugcacacaguaggcacauuucucuauuccgcgcucuucccgguuagccccucccccgcuccaggaagugaggggguucuagccgccuggccuaccgcgaugcauuuugggaaagcagcagcaccagauccaagauggcggccagcaggaggcugaugaagguaaaagccauucucuggcgcuggccaggcggggggcggcguccccgggccgggaccccuacggcgggccgcgguuccuuggggcgacgccguucuucaucccucauugcguggccccgcugugccgcgugcggagagaucuaacggggccgccuaggccgcagccugggcgggagcgcaaggccgcgcugagagccgccgcugccggcccuucggaucagccugggcaguucucgagcccccuccuccuggagcgaagccgggcccuccgucgcagcggccgcgguccgggucgaggacgccguugaugugugggccgggccuggaggccccaagcugggcgcccucggggaagaaagccggagccccggcugggaguacgcgccgcggagccgcccgguccugggccgcggucgccguucucugagccccauuccgccagcccacagcuccgggaccgggaggcugcgaggcccgagacgggaaaggaaggaggagggcaggcggccaaaguuaggucaguuaguugguggucuuuugaaauuguguuggguccacgcaaacugucgccuugugacugcagagucacacagccgacaaguuccaacucuaggaaggcguggggucgucucccugcguagcuagguucucuuuucuauccaccucuuagucauccgcaucuccuuucccugaugaaggguggggguugguuucugucguugaaaucaaaaccugccaaaguuuacgaaaauaacuugguauacgcacuuuguaucuugaauguaugggagugucacuucacuaauuggcuccuuuggugaagcauacaauauaggugcucaguuggaguuuuucacgaguagaucugcggacauccucuaaagauaacccgccaguguuugagugcuaccugguagugcggccgagcucucgccggaccggaaauaaaaaaggucgcaggagcuggcucuugagaccaaauuuguauuugguugauggagucacuggaaacaaaagaaagccauuugcucacugaaaccuagagagaacauuugauaaaacuagaguggaagugggcacaaaacaauugugaucaaacccccuuaucuguucugcgggugacacuccaucauuuaccuacaggaaaggaaugcuaaucacuuccguguucaaaccccaaaaguugucgucccuucagccuuguggguuucaguuuaggaagauuucgugacugcaugcuguuuucuuguaauuugaugacaugaauucaucugccuuuucucagguccccuucucuauccuuuuccaugguuacccuucuugggcuccagaguucuuuucucuaaagcaaguauuuaguccuuuccuucugguuaaaauccucucugguuuuguccuuagaaauucugacuuuaaacauuuguaaguacauuucucucugugucugucugucugucugucugucugugugugugugugaggggcacauugugucacagcguucauguggcggucagaggauaacuuguuuguucucuuuuuccaccacggguccaguguggcucgaacucugguggguaagcuuaccugugagcuaucuuucagccuaauccuaacuucuuacuuggccugagagaccuuucuuggaaagcagccucccagucucaccuccaacuuaggaguuucuagaugcucuugcaccuuauugcaccagcuaccauuuucccaauuuuuauugugugcuucauauucaugaccaugaucaauauucucuucgaguuagauacuacuauuccuguucuguagaagagagcagagaacgcaaagauucuuuggccucugccccacaaaggagaagauaauguaugauuuaacuccgcuccaugugagucuaaaacagagccucaugaugguacucacucugcagucucccuuugcauguucugucugcucagccugagaaaaguuaucuucucuucuagaggauucccuucccuuccugaggaauccuuggggucaacaccucugccuccgacucugaacucuuccccacucccagcacaguucuuuacauuucucuuuguaacagucagauuucugcccuaugcuagguaggcuuuguguuucuaaagggcagggguuggcuuuuuauuuuuuuuaaagacaggguugcucuguguagcuuuugguguucuggaacucacucuguagaccaggcuggccgugaacugaagccaucugccugcuucugccucacuggugcugggaucaaaagcaugugccacccccaaccaguauccccccccccccccuuuuuuuuugagacauggucuuccucgguaucccaggcugacuuaaaauucaaagugauucuccugccucagucuccugacugcuagaauuacaggaaugacucaccaggaucagcugacauaauuucauccugguaucccccuagccuuguugaucuagaugucagacaucuaggagggaaaucacaguuuuaaaauuguuuuuuauaaaauuugagcucaggaaaaaguuuaaguacauaagaauucaagcuuauuuuacuuaaguucuuuuuuguuuucaacacucaaaauuagucuauugucaucuaauuuuugcauaugaggcaguuuguguuuagauagauugcaagaguuuuaauuuuauuuuuguuuuuguuuuguuuuuuguuuuuucgagacaggguuucucuguauagcccuggcuguccuggagcucacuuuguagaccaggcuggccucgaacucagaaauccgccugccucugacucccgagugcugggauuaaaggcgugugccaccacgcccggcuaagaauuuuaauuuuaaagauuuauuuauuuauuauauguaaguacacuguagcugucuucagacacaccagaagagggcgucagaucucguuacggaugguugugagccaccaugugguugcugggauuugaacuccggaccuuuggaagagcaguuggguguucuuacccacugagccaucucaccagccccagaauuuuaauuuuaaaugaguuaugugguuugguguugucugcaugugugucuguaugagggugucauauccccuggaacuagaguuacagacaauugugagccaccaugggguugcuggaaauugaaccuggguccucuggaagaguucccagugcucuuaaccacugagccaucuccagccuagauuggcaggguucugaggaguaguagaccguggugaggugagaugaugcacugaagccccuggcuccaaguguggaaaccuacauucuuugucacuuugucagauugucucuguagaagaguguguguguguauugguuuuuugagacaggguguauguguguguauauauauauauauuuguuuguuuuuguuuuuugagacaggguuucucuguauagcccuggcuguccuggaacucacuuuguagaccaggcuggccuugaacucagaaaucccucugccucccaagugcugggauuaaaggcaugcgucaccacgccccgcugauauauuuuuaagguuguggaucuagauagauucuuucaguucagguaggaaacucuguuuauguauugauggucauuggcuuugagaguuuaaacuugguuagauaacugcagagcaaaaauuaaaaaacuaacugggcauggcaguacaccuguuaucccagcacuugagagagagagagcuagagacaaaaaucaagaauucaaggcugcauaaugaauuugaagccaguuugggcuccaugagcucuuguaacaaacaaacaaacaaacaaacacuacugguugaucaacaguauuccaguacuuuauaaaggaauuuccuguggugaaaaauggaaaguuuuauuguguuuguuguuuuuauuauuauuguuuuuuuuuuuuuuuuuuuuuuuuaaagauuuauuuauuauauguaaguacacuguagcugucuucagacacuccagaagagggagucaguucucguuacggaugguugugagccaccaugugguugcugggauuugaacuccggaccuucggaagagcagucgggugcucuuacccacugagccaucucaccagccccuuuauuauuauuguuauuauuaucaaguauauuuuggcuuuucugaaacagggucuuacuauguaguucuggcuguccuggaacucacuauauagaccagacuauccucaaauucacagccaucuaucuaucugccugccucugaguccuaagugcugggaauaaaggugcgcaccuggcuugugucauuaguguuuugccugggugauugucucugaaucaugugccagugauucccuggugccaguggaagccaaaagucccagggacuggaguuguagacaguuguuguugagccaccauguggguacagggaauugaauccuugaagacuagcuaauacucuuaaacaaugaaccauuucuuuaguccuuuagauauuucuuuauaaugguggauuguuaacagauaguauaauacaacaauaauaaaaagcacaguuuacauauuuauauuuacauuuuuaccuauauauaaauaugguugagaaguuauuuuuaggaaaaacuaaugugaagaagcuuaaauuuuuauuuuuucuuagauuuauuuacauuaugcauaugaguauuuuggauacauguaugucugcauaugccuguuugcgugcuacccuuagaugucagagcggguguugcuggguaugauggcacuugacuuuaaucccaguacucuggaggcagaagcagguggaucucuguuguucaaagccagccuggucugccaagcaagugccagcucauccaggacuauagagacacugucuuagaaagaagaaaagaaagaaaaagaaagaaaaacaccuccuggaacuggaaugaacaaguguuaauucuugagccaucucuccagaggggaguuuugagaaaguuuuaaacuuaaaaaacauuagcaaaaaagauuuaaaauguuagaaaagcauuaaauacauuuuaauuugcaaagcagcuaauucagcauugaaggcacaccuagauuguuaccaucacuucagucaagaauagggaaauagcuacaaagcccaaaacaaaagcuguaaaaauugauugggcuaaucguuuguuugcagccucacaucuccccuagggcccucccauuaaguagcuucccacaggggcuuuucucauggaauuuuguggacuuacaggcaggaaagguaacauuuuguuaguuuuuaugguauaauaguagaugcaaggaacugagauuuguagcauuuuuagaguacuuuuuguuguuguuguuguuuuucugagacaggguuucucuguauuucccuggcuguccuggaacucacuuuguagaccaggcuggccucugaacucagaaauccacuugccucugccucccaagugcugggauuaaaggcaugcgccaccacacucagcuuuuagagugcuuuugaaguaguguucauuccaaacuccacauugguguaccuccucagucuauaagcauguaucaggacacaggaguuauucaauaacagcucauuccuuggaauuuauuguacugagcaguaaacuauuuugcucuugaauauaggauucuauccucccagcuugguaauuaacuauagaacagugacaggucugguaauugucuuaagggguguggggagagcuaggugugaugauguuuuuauguagggauuaaagagcuugaggcaggaagaucacugggagcugggauuuccaggcuaacuuccaacuuagugugugugagacuccaguucaaaaaaagaaaggaggugaggagugagggaagggcugacuugcuugcuggcuuccuuucuuccucuuuuguuuuuccuucccuccuccacccucccaagacugauuacuguauguaucucuggcuguccuggcacucacuuuguagaccaggcugaccucaaacuccgugaccugccugcuucugccuccuaagcacuggaauuacaggugcccaccaccgcccagcacugcccaaccuguaggaaguuuuuuacaugauagacgucauaagccaucuuaaauggcuugaauccauuuugggaauggauuuugggauguuuuguuuuguuuuuuugagacaggguuucuguguagcccuagcuguccuggaacucacucuguagaccagguuggccuugaacucagaaauccaccagccucugucucccaagugcugggauuaaaggcgugcgccacuacacccggcagauuuugggauuuuuaaaaaauauauuuauuuauuuauuauauguaaguacacuguagcugucuucagacacuccagaaaagagcaucagauuucauuacagaugguugugagccaccaugugguugcugggauuugaacucaggaccuuuggaagagcaguuggugaucuuaaccacugagccaucucaccagcccaaggauuuugggauuuuuaaauugagaaaaguaauuuguuuuuuauucgugguguaugaugcaugguauguuugaaaaguggcgcacacuuguagaaaucagagaacaaguuuugggaguugguucuccuauuuuggguuugaggaucaaacuuaggucaggcuuaaugguaaacagguguccuguugagucaucuugucagccuuuuuugaugcuggggauugaacaugaaugcuuacauguuacauugauuuauaacccuuccuaucuuaccacauuugcauuuuaaaaauaauguauuccuuuuuauuuuguguguauuaauguauguauaucuguaugaggaugcuacacauaguucgagcugcuacgugggugcugggaauugaacccagguccucuggaagagcagucagugcccuuaacugaugagccuucucuccagccccugcguuugcaauuuuuauccuaagauuauguauuucaguaaauugagacuaauuaagccauuuuagugauacuggugugugugugucccaugugucugaauacccagggugcaugauagguaaguauucuaccacuaaacuauaugcccacucccauccucccuuuugguuauuuuauuuauuaaaauuuucgggaccggguuucucucuguaguccuggcuguucuggaacucauucuguagccuaugcuagccuugaacucagugauccaccugccucuuccuccugagugcugggauuaaagguauguaccaccaguguaccaccguacgggcaugcuuuucagcugcagucugugaucguuggcuguuucucuuuucaccaagaauucugguuaggcuugagcagcaugcccuuuaucugcugagucaucuuucucuggcagucuggauuuuuuuaaaagauuuaccuaguuuauuauguacauggguguuucaccugaaucugugucugugcaccaucuauguagcacccgcagaagucagaagaaagucauccccaagaacuagagucacaggcaacuguuaagccaucuuguguucuggaaaucaaauucugguccccuggaagagcagccagugcugauguuguuguuuuguuugcuuguuuguuuuguuuuuuuggguuuuuucgagacaagguuucucuguguagcccugguuguccuggaacucaggcuggccucgagcucagaaauccaccugccucugccucccaagugcugggauuaaaggugugcgccaccaccgcccggcagugugcugauguuguuaacugcugagccaucaucucuuuagcuccaacucuggguuucuugguugguguccccacaccuauuacccccaccccgugcagcaucagggaucuauguaccgagagccuugcagugcuaucacugagcucuauuucccuuuuuugauguauaaggaauccaacccagggccuuaagcaugcuaggcaagcacuuucccagugagccauacauuucacuaugauguguuuuuaucuucucuguaucagagugacuucuuguccuuugagaaugugcuuaagggguaccuaauuugggcccugaugaaagaguuaugaaaaugguaugcaucuaguucucagaaauuccaucuguccauuggguacccaauuucuugccaacucagugguagcaugcccuguagggaaagacacccuagcccccaacacugaggaguagguggcuuauggccaaggccuuuaauaguugaauaaaauuucaguaguugaagagaaauccugugggacugaauauuuuucuucuagcuaucacuggccuguuuagaauauagaccagugaagcugaauccuccuucucccacagugguucugggcaguaguucugagaacugccccaaagaagcuccagaaacuuuuaucagcuuccuaaccugaccacacacuucugauauuguauuguccccuccuuagauuuuaguuaggccagcccaguaggugcuuuccagcagcccugaggaacuggccuggguuggcuggauagcaugggugggcccuccauuccuguggggagagucuuggccaaauuuuccaucuagccucuggaagagauguuacaggugaugcagauggacuuauugacagguagcagagcuaccucauagccuauagguuucauuugcaaaccuagaaguacugggagggggugggugggaggauaaagagagacugagacucuucuuuaucauacuagugagggcuacacuaaaccacuuagugauugagagccuaaguuuucaauuuugcgucuugugcuugucacauuuuagccaagugguccugaguaaguuaacgucugccuuaagguacuccaucuguguguagauucaguguauuaagauaaguuaagccaggcaugguggcgcacgccuuuaaucccagcacuugggaggcagaggcagccggauuucugaguucuaggccaaccuggucuacagagugaguuccaggacagccagggcuauacagaaaaacccugucuuuuuuuuuuaauuuauauauauauauauauauauauacacacacacacacacacacacacacacacacacacacacacacacauauauauaaaaaagcagaguaccugucauguacuaggauauuacagauaucguuaauaaaagugaaacuacacugggcauugugguguacuguggucucacuguagaggucagguuggcuucaaaucacagaaauugccugccucugccucucaagugcugggaaaaauacggugugcacuaccauacccagcuguuugcuucucaaaacuggaagagaucucugaacuaaaguaugccucaguuucucucuuauccuguguaugaguauaccuuuuuugcuuuuguguauguuugcagugaauguguguguguugauggugcacaccuggguguguguguagagagagcacaccagagcugaaaacugcacccuguucuucugcaaaagcaacaagcgcucucucucucucucucucucucucucucucucucucucucucucucucucucucucucucucucucucucucucucucuccaggguuucucuguauaguucuggcuguccuggaacucacucuguagaccaagcuggccccgaacucagaaauuagccugccucugccucccaagugcugggauuaaagcauuuaaaaacaaaaaacaaaaaaccaccaccacaacaaaaaaacguuuugggaguaaccccauuugugccagacaagaaucugagcuauacccuaguucuuguggucauuuuggcaguucuaggucuguauuguugauguuguccuucauuauuuuaccagaguuugcuuucuaccuuagcaugggucagcauuaguuuuuuuuuauuuuuuuuuauuuuuuuuuauuuuuuucgagacaggguuucucuguauagcucuggcuguccugggacucacucuguggaccaggcuggccucgaacucagaaauccaccugccucugccucccaagugcugggauuaaagacaugcgccaccacugccaggccagcaguaauuuugauaacuaacuuacccagcaggcgcccauuuaacaaaagcagacacuauugucaaagccagcacuuauugguaggaucuguuuauuucugcauggggacacugccugacucuugucacuagugggggaagacaguauaacucagaaagcuaauagccucugagcucuuugaaagguguuaacuucuuguuucaugacaguaguucuugugaaccugcccuccccucucuagcacuccacuacagaccuacucuucuagcucuuaccaugugugacaggcaguuccugguuucuaggucuguugugggcacaguugagauggugucuuaguccuugcgcucucucaguuaaguuggguugcuggacucuggagucuauacuguaauguaggucaauaaugucaggcacacccuuguucagaugaagacaaacacauuccaggagcuaggccuaugaaaagcugccugccuguggaucuagggcccugacugggcuugcccagggguuauguaggcagcauuuuccuuuaagcauauguuguagcugucuucaguuacagucucuuagacugaagugaagcugagcaguaugcugugauagaguagcagggaccuacauuauauguugauuugugcuuuuaauuaauuuguuuuguuucuuugacaccuuguggguauccucauacuuacaaagaagguaaugacauggccucaaaaauuugugauaauaguuguguuauguuaguuguaauaauaauuaugugugagcuuaauccauggaagaugccaugugggcaugagucauucucucccauuugcugagaauuaauugaaacgagagcauucugaaggauuauauuuaaauuugcaguaucuguaaucacauuaaaauuguaauuucauugucaagcaguuucauuguauaagcuuggaaagcugucuaauauuaaauuagaaauuuucauuuuguuuuauuaguauuuauuuauuaacuuauuuugucuguccuggaagucacuauuuguguagacuagccuuaaacccagcuauccaccucugguuaaaggcaugcaccaccaugccucuuuuuuuuuuuuuuuuuuuuuuuuuuuuuuuuugagacaagguuucucuguguucccuggcuguccugggacucacucuguagaccaggcuggccucgaacucagaaauucgccugccucugccuugaaagugcuaggaucaaaaggcaugcaccaccacugccuggcuuauuuuuguuuuaaauuguauguuuguguguugguaugugcaugugaauacagugccuucugaggucagaagagggcagcagagucuguggagcugcaguuucagggaguuaucugucuaccauaggugcugggaauggguccucccucuguugagcaguaugugcuuuuaacuguugagccaucuuuccucaccacuuuuguuuuauuuguugagaaaagcuaucaguaugagcccuugguuggccuggacuucacagagauuuucaggcauguggcaccccacuccuggcaaagucacucauuuugauagccacacaaaaucagggaggugcuuuuuuuuauucuguuaauguccuaccaguuguguauguggugugugaacuuuucuuacauaucuaauuccaucugauagguuuuguuuuagcagauaagaggagcuuaaaacaaaacaaaacacugacuagcaguggaaggcuagggacauugcuacccuuuguuuguuucuuuguuucugugucuugagacaggauuucucuguagccuuggcugaccuggaacucacauuguagaccaggcuggccuccaacuaauggagauucaccugucucugccucucaguuuugagauuaaagccaugugucaccaccgccuggcaccaucacauauaaugugugugugugugugugugugugugugugugugugugugugugugauaugugauacacacacacaugcuuuuuaaaaaacauuugcauuuauuuauuugcuauuggggagggaggagacagaugugucugccugagugcauguggaagucagagugcgacuuguacaaguuggucuucuccuuucaucuugaaggucuuggagauuugaacucagguugucagguuuaaauugucaggcuugacggcaagcuccuuuaccuauugagccaucucaccaaucuucuauuuguguguuugguuacucuaccuauuuauuuauuuuuaauauuuauuuuauguauaugaguacacuguagcugucuccagacacaccagaggagagcaucagaucccauuacagauggucgugaaccaccaugugguugcugggaauugaacuaaggaccucuggaagagcaguugguacucguuacugcugagccaucucucuagcccugguuuuugguuuuuuuuuuuuuuuuuuuuuuuggcuuuuugagacaggguuucucuguagcccuggcuguccuggaagucacuuuguagaccaggcuggccuugaacucagaaauccgccugucucugccucccaagucugggaucaaaggcaugugccaccaccucguggccccagcccuguuuuuuugagauagaguaucacuguggccaggcuggccuugaacuuauuccugccucuacuucccuaguaaugacaagcucauuucuauaaauauuggcaugugcaaauguuauucaaaacaagcuaauaagggcuggagauggcucagugguuaagagcagugacugcucuuccugagguccugaguucaauucccagcaaccacauggugguucacaaccaucuauaaugagaucugaugcccucuuccaguguguacaguuacaauguacuuacauacaacaauaacuaaaucuuuaaaaaaauaacaaaacaagcuaauaagccuuucuagaauauuguauaagaaguagaagcaccgggggcuggugagauggcucaguggauaagagcacccgacugcucuuccgaagguccagaguucaaaucccagcaacuacaugguggcucacaaccauccguaaugagaucugacucccucuucuggagugucugaagacagcuacaguguacuuacaaauaaucaauaaauaaaucuuaaaaaagaaaaaagaaguagaagcaccuauuugucccaccuauuuaguuuucuuuuuauuucuuggguucuuuucuuugagacagacagcacuggcuguccuggaccuuacuguguaaauaggcugggauuaaaaaugugcaccauugugcccaacuucauuuuucuaauuauuauguguguacaugcagacauauguacaucuguauaacugacugugugagugugugagagacagacagacagacagacacagacagacagaaccacacaacugaacaacuuuggggaguugauucuuccuucugucuguaugugguuuucugguauugaacucaggucaucauguuugggugguaagugccuuuaccugccaagccaucuugcuggcucauauucuauccauuucuaaugaaagugcccacugcucuauguagcugugauaacuguagaagggcuuuccuggccuggccuggccuugguccaguucugaaccugcucuaugagaauucugugauuugggcuucucugagauuugcuuucuuucuauagaguggcacauuugugccugccuugcucucaaucugggguguaagucucugaucacaucuuaugugcuguauaucgucaacagugugaggagugucgucaugacuggccaucucuacccugucugccuuuuccuuggcauguguuucuaauuguuauugaaaucuuggaugaucuucugaacugaugccguugauagauaaauaugguuuuaaugagauuuuaaccagaaccaugccuuauguuucaguucauuucagaaagcuuuguguuaauaacuauaaacacccucaguuuccucugucacauuauagacaguaaaaaaaucuacauuguuguauuuuagauuuuuaagaaacaggauacgccgggcaugguggugcaggccuuuuaauuccaguacucaggaggcagaggcagguggauuucugcguucaaggccagccuggucuacagagugaguuucaggacagccagggcuacacagagaaacccugucuugaaaaaccaaaaaagaaaaacaauuuaaagaaaucuuuauauauguuuguuucguuuuuuuuuuuuuuuccucuuuuugcuuucugagacaggaugucucuguguggcccuggcuguccugcaagucucauguaaaccagucuggucucaaagucagagagucaccugccucugccuucccaagugcugggauuaaagacauuugcuaucacuccuacccccaucucugacuggagagaugcccauuggaccucuuucaguggaccugacuugauuuucagugacugcacaagguggguuucaacugcuugugugaguuccaacuccaggggagcacaaugccucugguguucacggccacucacauacccauuaaaaaguuaggacuugcuuugcauuggugucacacagcuuuaauuccaacgccugggaggcaaaggcaggcagauaucugugaguucaaggucagccggguagacugagcaagucugaacacaggacagccaaggcuacacacacagagaaucccugucucaaaaaaccaaccuuaaugcugaagaacauaggcagggauuagguauucuuuuuuuuuuuucuuuuuuuuuuuuaaagauuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacuaagccaucucaccagcccugggauuagguauucuuauuuuguugccuaugacaaucuucagaguacggggacuugcugcugccacagaaugagcuguugcugaaagugugugugcagagcuugggagaagguucagcaguugagagcacuggcugcucuugcagggaaccugaguuaauuuccaagccaaggugcucacacuugucuguuagcuucaaacuguucuggggguucaguggucuuuucugggcucaagcaugaacauggcauucaaaccuagauacaggccgaacacauguagaguaagggaaucuuuucaguguaugggccaguguguuggcacagccaguaggagcuguugccugaccugaguuugacccccaaguuugacuccccaugguggagagagaaaacucccuaaggccaucuggucuuuauauauaugaauucacaguaaguaaauaaauguaauuguauuuauugcuauauuuaaaaaaguuuuuauuauaaggcugggucugguugguagaguacuuuucuagcaugcacauaacacuugguuugaucccagcaccacauaaaccuggguaugugauaaaccucuaauagucauaggucaggaggcaggagcaucagaaguucaaggucaucuucaggcuacauagugaagucagucagccugugaccuccuuccucuaugguuucucuguaucccuggcugugcaggaauucauuuucaaggcuggcccugaacucacagaucugcucuccucugccucccaagugcugggacuaaauaaagguggacaacaccaugcaaggcacagucccauuguuuuuuaauuuuuacauuuuuauuauauaugugcaugauguaucuguuuggaugugugugugucaugucaugcuauggaggccagagaacaacucuguagagucacuucuuuccucuuuacuuggguuccagaaaucaaacaaggugccagaggcuugugaaguagaugucuugccggccuaguaguuugguuuucugagacaggguuuguagucccaucugcauaggaauucaccauguagaccucugcuucuugaguccuagugguuuuuucuucacauauuuauucaguguguuuaugcuccugugcuuuugcacuucuguggaaggcagaagacuugcaggagucgcuucuccuuccauuguuuacuuccuaaagacugaacucucauugucaggcuugugcagagagugccucgucccaucauuuaaaacauuaacuucuuauuucuguguauaugccugccugagcuuauguguacugcauaugugagggaguuugaggaggccaauaagggugucagcuccccuggggcuggaguuuauauagggaugaugaacugccugaugggggugcugggaaccaaacccaguuccucuggagcagcaaauguuuuucuuuuuuuuuuuucuuuuucuuuuguuuuguuuuguuuuguuuuuauuuuuguuuuucgagacaggguuucucuguguaucccuggcuguccuggaacucacucuguagaccaggcuggccucgaacucagaaguccgccugccucugccucccgaguguugggguuaaaggccuguucugcuacaugugaugcagcaaauguucuuaacuguugagucaucuuuccaaccucucauuuuaaacaaguacuauauuuauugcuauuguguguaugaaacagagggagagcuggcagggcacaguggcuccagagagaagaaaguguggguguggggcucuggagccccuguauguguguggaggccaguggacaccuuucagaggcuguuuuuguccuuugaucguguggguuccagucguuggacuccggucaccaggcuugugcaguaagugcucgaaucgguuggccauccugcugaccugacccuacaguucuuuuucuuucuuucuccuuucuuccuuuaaaaaaaaaagucggggcuggugagauggcucaguggguaagagcacugacugcucuuccgaagguccagaguucaaaucccagcaaccacaugguggcucauaaccauccguaacaagaucugacgcccucuucuggugugucugaagacagcuacaguguacuuacauauaauaauaaauaaaucuuuaaaaaaaaaagucaggggcuggcgagauggcucagugguuaagagcacugacugcucuucugaagguccugaguucaaaucccagcuaccacaugguggcucaaaccaucuguaacgagaacugacccccucuucuggagugucugaagacagcuacaguauacuuacauauaauaaaauaaauaaaucuuuauaucuuuaaaaaaaaaucaggccgggugugguggugcacgccuuuaaucccagcacuuggaaggcagaggcaggcggauuucugaguucaaggccagccuggucuacagagugaguuccaggacagucauggcuacacaaagaaacccugucucaaaaaacaaacaaacaaacaaacaaaaaucagacuagaccugaugucaaaugccuuuaaccccaggcagaggcagguggaucucuguguuccaggccagccugaucuacagaguaaguucuaggacagccagggcuaauacagagaaauccugucuugacaucccccuccuucuccccuccccauaccccccuucccccaaaaccagguuucuccauguagcuuuucuguccuggaacucacuguguagaccagacuagucuugaacucacagagauccacuugccucugcuuccugagcgcugggacuaaagauguggccaccacuguccccuccugcccccuuucagaaaaauuucugaguuucuuugaucucagacuugcaguagaaaugacuauucugguugcuuccaugugccaagcucagugggaauacauguguuagucacaguucucuaaggaagaggacugauagaaugaauauauaucuauauauuaauaaagaauuuauuagaguggcuuacaggcuguggucgguguaguccaauaacagcugucgccaagauccaagagacugaaugucucagcaguuccagucuggugcugauguuucagggaagccuagagagcugccaguuggcagucuguuggaaucccaaaaaaguagguucaaacgacagccaagggcugggucaggacagaugaacuugccagugagagugggggcaaguagacagaaaacaaaagcucccuuccaugaccuuuugugggggcuuucaccagauggaguggcccagaguuagaguggguuuucugaccucagguaaucugguuuuaagguaggucuuccaauggugcaaccaagaaaaacaggugugccuggcuguuuggaguuuaguaaguuacagauagucauauugacaaucgagauuagccauugcagaagauuuugccuuuuuaaagagcaugcuucuagccaggugugguaauauaugccuuuacaccuuuagucccagcacugaugaggcggagguagguguucucugcaaguuugaggcuaauauuguagauuugugcuacuugguagcacaacagucaagucuccaugauagauaggacacaauuuccuacccccauuaaacaaaaacagcaacaacaacaaaacugggggugggggcacugugucaaaauacagauguauauaucugaguuggaugguucugucugaaaacaaaauacauggcuggccacgcaagguagucuccuguuuucccuaaucgguuaaggacuuggggaaagugguuccugggaggccagcucucugauucugccacacuuugucucccacacucuguacuuagccuuccuguuggccuguguguauccaauuuucuuuuacgggagagagaggcuaaaauugagaaauggauauuuccccuuaggaaguaggacgaagggguggucuuagucagugugcuauugcuguggugaaacacaugaccaaggcaacuuaaaaaggaagcaagggcuagucuauuaucaucaugguggggaguaugacagcaggcagguaggcaggcaggcaggcaggcaggcaggcaggcaggcaggcagacagacagagacaggcauggugcuggggaaguagcucagagcucacaucugauccacagguuccaagcagagagacagacacuggugugggcuuuugaccccagugacacuuucaacaagagcacaaauccuccaaggagaccauacuuccuaaucuuucccaaauaaaaccaucaacagggauuaagcauucagacacaugagccuguggcagccauucucauucaaacuaucucaggcaauaauuuagugguagagugcuugcauugccuagcucaucugagcccugguguggagagaaagagagagagacuugauaugguguuccaggcuugcuucagauuuacaaugauucucuugccugggccuuuagcuaggaauacaguguacagcagcaguacaccugaugaggccuuggguauaucuuuagcacuacccaaaacaaacuaaaacaaaaaccccagagaagcggaaaagaauauguuuuuuuccggcuuucuuccaaagcucugagcagcuggaaucaaagagggaucugaucugcucuuccccuguguacuugucgccuuccagcagaaggguaaaggguuggcugguucugcuuucucuuggcucauaucuugguugucagcauugcaccaucagcuuugaacagcugaccccagguugcuuuuggcauugagcagaacugaaauaaaccuuuugaggaaguauguuuuguaaguucaugucauucuugguuaagucuuucagacuugauucucaaagagaugggcuacuucuguguuuucuuuuguuuuaaaauuaauuuguaugugcccgugugugcauuuguaugugcucaugcuauaguguggaaguuagaggacaguuagccggaggcucuucucucuuuccacccuguguaucauggggagugaauucagacugccuaauuucaauggcaaguaccuuuagccucugaacugucucaccagcuuuucuaaguugacuccuuuccuucauuacuuguaauaaagccuuuggacuuuacccucugcauuuacuuggauuucuugaaauucuuucccaauucaucauuaucaggaucaucucaguuuuaggggcacugccaucucucagaucuuuagauagaaccucugaaugagcacuguagauuuucaguuuuccuuagugaagguggaggcaguuguugcccucagagccaucuugggcaaugcaggaacuuuagcauccuggucauucuagugccagugguucccagcuaggucuacagaggcuauuaauuucaguaggguguagccacgaugucuggcaucucuuuuauaugugagacucagaauacugagaugcauaauccuguucuggauccuguuguugcccuauugagaaaugcuuuuuuuuuuaauguuuuuaguaaauacuuauuuauuauuauacauaaguacacuguaguugucuucagacgcaccagaagagcgcaucagaucucauggguggugugagccaccaucugguugcugggaauugaacucaggaccuuuggaagagcagucagugcucuuaccugcugagucagcccugaaaugcucuucuauuaggcuacccaguccucucugcaggugacaguucucucacuucaucuuuuuuuuuuuuuuuuuuuuaaaguaaauuuuuuuuuuaaagauuuauuuauuuauuauauguaaguacacuguagcuguccucagacacuccagucagaucucguuauggauaguugugagccaccaugugguugcugggauuugaacuccugaccuucggaagagcagucgggugcucuuacccacugagccaucucaccagcccucacuucaucuuuuuuguuuuuguuuuugagacaggguuucucuguguagcccuggcuguccuagagcucacucacucuguagaucaggcuggccuucaacucacaaagaucugccuucacuucuuuuguuuuuuuuaauuauuaauuuuuaaaaaauauuuuauuuauuuauuauauguaaguacacuguagcugucuucagacacuccagaagagggcgucagaucucguuacaaaugguugugagccgccaugugguugcugggauuugaacuccagaccuucggaagagcagucgggugcucuuacccacugagccaucucaccagcccuuacuucuuuuuauaaucaguucuuuguugauuaaaauugugcaaaaaaaguugucuuuccuucuugggaaaccuuaaccugacagcaaagagaguuuagucacucuacuuuagauuuccugagccaucagcucagcacucacugggugacgcccuuccuucuguggucagaaggcuuggggcuuuuguaucuacuugauaaucuuagcacugagaaauacccuuccauagguuccauagguuuuccuuuucccaagacagaguaucauguacuccauacuagcuuugagacucccuguguauccuaggaugacuuugaauuuacuuuaaaaaaaauacuuuuauggguauuugaucuaaguguauguuuguguaccuagcgguccaggagguguugguugaccugggguuguaguuagaggugguugugauuuacccucuuuguguaggaauugaacucagggcuuuguacaugcuaggcaagcauucugugaacuaagcuagucucagagaacacuauaugccuuuuauuuacuuauuguuuuuguaguucuggaauugaaugcugugaggccuugugcggccagccagccacucaccccacugcuaagcuucuacaacccagucuaaagucucuaaacaauguugagguuuuuuucuuuuugcccuguuaaacugaaguccagauuuccccaucuuuguaauucucuugaaauuugccugauguuuauacuguucauauuguuaauacagagcucugaagcuacaaagugugcucucuacacaggauauuuuaauuuuucuuuuauaaacauuaaauauuuucuuuguuguuguuucuuucuuaguuaucuuuuuguuguuguugaugaugaugaugauggugauggugguggugcugagaugggguuucucucuguguaguccuggcuguccugguacucacucuguauagcgggcugucaauaaacgcugagaucugugcuucugucuccacagugcugagacuaaagacauucaccaucaucacgccuggcugucuuuuuugguugucuuaauuucaaauuucuuuuuuuuuuuuuuuuugagacaggguuucucuguauagcccuggcuguccuggaacucacuccguagaccagacuggccuugaacucagaaauccgccugccucugccuccugagugcugggaucaaaggcaugcgcuaccaugcccugccggaguauuuucuuugaagaauagugguuaaugaagugggaaaccuuccccuucuugaguguguccauauuucauagugcccagacaauugaugaguucugaaugucagccgaagaccaagaugucaguuggcagguuagacacucagcuuucuugaugcuuucuuuguagaucagucagguugucacauuuucuuguccccugguauauauagaucaggggccuaugggauuauuaggccuuucuuagaaguggauugguuaagcauggcaauacccuuucccuucuugugucgcuuuccaguauuaaagccccccaagugaugguggccacaccuuuaaucccagcacagauguagagacaggcacaucucugaauuugaggccagcuugcucuauagaaaaaguuccaggacagcuaaggcuacauagugagacucugccucucaaaacaaaacaaaacaaaacaaaaauacaacaacaaaaagcucuauccauacuugcuggacuagaauuuccagaguugguccagguugcuuaugguaagcaccugagguugauaaacaggcagcacucugugagacacccauuucauacauuccuucagcguaucuuccuccuugggccauucugaguuaggccucaggaaaauuacccuuucaugcuuuccuagcccuacugugccuuacaaacuguugugccauuauagaauauguggugcaaaggaucuuuugguuuuggugacauaggagccaguaagguggccuuugccaucaugaacuguggcugcauaaggagaggacuuuccugucuuagaggucaugugaucugggacagagaagauguagcuugguaaauaggauaaggcuaauguuuauguuguagguuagaaggcaucuuggguguauaaggaggccaucaucugauugguggugaggccugauugagguagugguggggaguggcaggacagaaacuuggaggaugugaccauguauaugugggcaugagucaugguacauucuggguggcuuggguuaagaugccuucuguauguucauugguguuggggaaguguugggaaacauggggcugauacacaguggaaaaucaagugacagacaagguaaagacaucuuacacuggauucugaaacaguccuaguuuggacauuugcuacguuguugaugagaacccucuuaguuucagaucuuguuaugauguaguuuucagcuccuugacuuaccaugcuguugauagcugaagaaacugaggcucaguacugcuuucuuguuuccauccucaucccagacuggcugguugugcucuuugccugugcccauccugggguggaguccugaaauuucaacuuaaaaguguuaggaaggaaagguuuguggguauccauuugccuuucuuugucuucuagacccaggcucauucauuuuauuuuuuuaaaagauuuauuuauuuauuuauuuauuuauuuauuuauuuauuuauuuauuuauuauauguaaguacauuguagcugucuucagacacaccagaagagggagucagaucucauuagggaugguugugagccaccaugugguugcugggauuugaacucaggaccuucggaagaucucauuagggaugguugugagccaccaugugguugcugggauuugaacucaggaccuucggaagagcagucgggggugcucuuaccugcugagccaucucaccagccccggcucauucauuuuuaucucaauuuccugugcauagauagugcuggaaguaguuagcucuguagaucccuguugcauguuuaccccuguggacccuguggaguugcugggggacagcugcuuuuuuguuuauuuucaauuaccucccccccaccccagucucacccugcagcccuagcuggccuugaacccauaucuguguuauucucccggguauugggauuacaagugugagcuaccacaccuggcucugcugaggguauuuaaacagauaguaugaccagcccaaagaggagguguuauauuuauagaagcaugguuccccucauugugucaaguggguugcuugagauugggacuuguuuuggucuggggcaggcaggggucuuagaggcaaugacaccgcagaugggacccccugccuccacgcuuccuuaccugaugcaguguauucugguccucaugcaaauguugucauuggugaugcuguuaccugguuuaauuugagggcgucaggagggaucugaauauguggugcuuucccugauuugacacccuuuaugcuuuguuaaucaacaggagcuugaagagauccgcaaauguggaaugaaaaacuuccguaacauccagguugaugaagcuaauuuauugacuuggcaagggcuuauuguuccugugaguauugaacacuuccacuucuuauuagauaauucuuucagguggugugcugcuacugcuggccauaucucuguguuccucaguaaguuccuagucugggcagaccauagaugggcagaagugggcaguggcuacagggugauaagcaggguagcauauggccuugugcucuugaguaaaauccuggcuuuacauugggguuuuaaaauuguagaucuguaguuauuuacaaaggaaaaggagugugagucugcuccuuuuguugcccaucccccuagcuuuugaaugacuugcccuguuuauaagguugagacuccugucugucugcuuugguagagagcuggcuucccauguagaccuugguuggcuuuccccauggacuuugaucugugacuaaccuuguagacacccgugcuuuaucugugccacacugcacugacugccccuguguccuucccuccacugggcuuccagaagcuucucuccagugucugcccacaguggcccugcguccuucagggacaccuuccaacaggcucagcuccuccuaagaagacugguuuguucuagcacucucuugauuuugugucuuucccuccaucuucucugguccccucuccuucuggagacuugagcuguacuugacuucagcaugcacuucuuguuucucccacuccaaaucguucgguccuuucaguugucacauagcugacacuuguuugccuccugaagcuuugacccuuugccaggguccuagucuugaagccuguaaucaguuuucauacuuucuggcuugcuacuaauuucuugacacugcuuuuacccuguuuuaucucuggggacccuucuaacauccaaguugcuugcuauaugugaaagauuucuacccaucucccucccccugccuucucucuagagguggacuauuuguccaauguauagccucacuuggacauuggagaauugcagucaccuuaaccuauagcguugaccuacaucgauaagcucuccuacuuucuuucuuccauacucauuaucuuucuuuucucauuugcccaucugagccucagguucuuucccuguaucugacucgccuuucauugguacuuagaauuguaccagugguaaagagucugcauucuuguaucaaggaagaaugcagcuuuccuuuauucuugauucugguuauaacauuagacagcaaacacugguuuagaucauuuuaaaucugggaucuucuagucuagauuuagaaauaaauccucugagguguuuuucuuguuguuguuguuguugguuuuuggguuuuuuuuuuuuuuuuuuuguuaguuugguugguuuuuuuuuuuguuuguuuguuuguuugaaagugguugggcucagcacacagggaggguggcugggaagcccuuagcuacuagaggcuggccuguaucuauagcucuagccuguaugacuugucagaguaaguaggagagccagagccaucugauccaucucucuguccaauuucuaauugagauuguauauuacuaaaaugucaauggcugauccaugguucucuggaaaauuggaggaaugaaugaacugguuuuaaaugguaaggcugggguagugucaucaugucgggucacugucaucaaauugcuuccagcucacaccaaggccucugaguucaugcuggcugaaccuaugacauaguggucagagggcucguuaugguacagauugccucgucaaauuccagugugcuuugacgaucugaaaguuaucuaggcuccaaagauuugccuucauuugaagcagcugcacucugggggcaacugugucaggggcugcucaaaucuuaucauugccccauuucccugcuaugaucauugugcaggauuuuucuucuuuccucaggauagcuacuauaugugauucuuuugcaucacagggaauaagccagcaugggaaucuucuauuuaaguucaccugaagucuacccacuuagagugaaaguagacuuagccaauaaaaucauggcaauucagucuguguucuagccuacucuucuguuuuauaggaagauacuguuccuuaguccuuaagccuggcugaagcauucaaggggcugagugacagacacucuuauagacggugcaucagugccaugcaucucagguucacuuaucuauuuguuguugcacuggggacuuaacuuagaacuuuguggauguaaaugcucucuaucacuaaguucguugcccuaucccuuuaauauuuuuaucuuacgaguguuuuuccuacauguaugucuguuuacaguguucaugccuacuguccucagaggccagaagagggcauuggauucccucagaacuuacuuaguuucccugugggugcugaaaaccaaaccuagaucuucuguaagaauaauaagugcucuuaacuuuugagccaucucuccagccucaccauuaaauuaacuuuaauuaauuaaugaauuuugagacagagucucuacauaguccuggcugcccuggaauuauauagaccaggcugaccucaaacucacauagauccagcugcuucugccuccacagugcugggauuaaaagcauguaccaugacccaccauuacugagccguguguguguguguguguguguguguguguguguguauguauguguguguguguguguauguauguguguguguguauguauguauguguguguguguauguauguauguauguauguaauguguguauggucucucggucucucucauguagcccaaacuagcugaagaugaccuuaaacuccugauccuccuguuuguaucuuugcugggcagguguguagauaccacuuuugguucccuuuugacuguggcaggguuuuacuuuguagcugagacuggcuuugaauucagagccguucuccagcuucagccucuuaguguuagaauggcagauaaaagacaccauucacauuuauuaaaaugcuuaaauuuuuauuuuuuuauuuacuuaacuuauuuuugguuuuuuuggauaggguuucucuguauaguccuggcuuucccggaacucacuauguggaccagacuggcuucaaacucacagagaaccaucugccucugaguucugggauuaguuugcauuggucaccacugccuuuuaagaagagggagguugugguggguaagucaugguggcauuugccuuaaucucggcauuuaggaggcagagacagccagacucuuaagaguuuuaggccauccagauuuacauagugaguccuaggacagcuguggauacauauuaacaacuugucuuaaacaaaaaaauccaaaaccagcaaaaauuaaaauuaaaaaaaaaaaaucaguugaauauaugugagucagcuuacuagcuagccugccuucucuuccuucuuuccuuacuccaguggggucuuauguguuccaggcugaccuugaacuugcuauauaauugaguauggccuugaauuccuguuuuucugccuucagcucuugagggcagucuucuuugguacugaagaucaagcccagagcaucaugcuaggcacacauucugcuaacugaauucgaucucuuaacuccaugaagauuuguuucugggcuuucuauuguuuuaagaagcuguuuuaugagugugcucaauugugagugguguugagaggacagcuuucugauaucuguccccacuuucuaccuuguuucauaaaggcucuuuuuguuguuuugccuuuugggcuaaauacugcagagccucuggugauuguuuugucugcaccuucuaucucuguguaggaaggcugcauuacagaccccauuguauggcagcugauuuccuuguggguucuggagauuugaacccaggucuucacacaguuaacacuucuuuacuuacugagcugucucuuuagcagaggguucuuaacuuuauucuguuaauacugguuagucaauuuacucuagugcuacauuguuguuguuguuguuguuguuuucucacaggguuucucuguguagcccuggaaacucagaaauccgccugccucugccucccaagugcugggauuaaaggcauguaccaccacucccaguuuacauuguuuugauugucacuuaugagaaacauucguuucauuuuuguucuucuuucuuuuuugacacugggucuucuggguaccccaggcuggucuagaguguaccaugugugucccaaacuggccuuuuuucucggccuuccaaaugcuaagauuucaggugugagcuaccccagucaguuuauaguaaguuuugaaaugagaaaauggaacucuuccaacucuagucuuuuacaguuagaguuauuuaccacuugguuuggguaaaggucccugggaaugcugugcaggaauguuuuucacuuugcuaaacaaagcauuguugagauuuugauauagauuguauuuaaucacguauggaaguauucucaucuuauaguagaguuguugucuuauuuuuguuuguuuucaagacaggguuucucuuuguacccuuagcgguccugaaacuuacucugaguacuaggcuggccucaaacucagagauccaccuguuucugacuccugagauuaaagguaugugccaucauuaccugggcuuuuuguuuuguuuuguuuuuuuaugacugggucucuauguaggcuugccucuccugaagcuugauguaaacucuuugcucauaacuucucaaaguguuccuuuuugaucauuuugcuacuaguuuuauucucuuuuugcuuugccuuuucuccuaacaggcuaucagguucauuaaaguggcuguaguuguuuugugugguauuugcauuuguagcaucacucuuugauggauguuuucauuuguucaucucaguuuauucuccugccucuccuuuucaguagcucacuggacaaccucuuucccucccuuucuuucucuuuccucuuuucucuuucuuuuccucuuucccucuuuuuuccuucccuugugguguucuggucucaacccagggucuuaauaugcugguuccugccacugagcucuaggccaucucguucugcuguucauuucuccuuguauuucuguguggccagaaaaguuacuuaguaugguuuugauccucauaacuguauuacaucuuuguguuuuuuaauauugggcuuuuucuggagaauguugcauaugugcuugaacaguaagugcugccuucagcuccuucuagguguuguuugugguuaguagaguuguuuaagugcucuuugauuuuuuuuucuuccuuuucuguuuuguuguugcuuugucuuauagcucauuugacccccugucuccaccuccugaccauaaaaaugucaucuuuucuaguguuuuuagaaguagggaguugaaggcuccaacauauuagaucuuuuuggauuuucagggcaggguuucucuauguaguccuagcugucaggagcccucucuguagaccaggcuggcuucaagcugagagaucagauuggccugccuuagccucccaaguacugugauuaaaggaaaggcaugcaccaccauugcccagcucauuuuaaaacacuuuuuuugagcauauuuuacuuuucuuuuuucuucucuucucuuuuuuuuucuuuucuccuccucuccucuccuccccuccccuccccucccccuccccuccccuccccuccucuucucuuuuuuuuuuuuuuuuuuuucugagacaggguuucucugugaagcccuggcuguccuagaacucacucuguagaccaggcuggccuugaacucagaaaucugccugccucugccuuccaagugcugggauuaaagguaugcaccuccacugcccagcagaucuauuucuuuuuuaauuuugccaacuuuuauugacaaauuuuguguuuuggugcuuuaucauuuuuuauggucuuuucuuuuugucuuuauguauguguauaugugagguauguuuuuauuguauuuuauuuacucuuucauguguaccugucauuuuguacuuauggggguuaggggaguuggaucucuccuauuguguuuucuucucuaugucuguaucucauguuuuaaaugagaauauagguuuuucugguaguaaagaguguuauuugauaaauauggggguugaaucuuggacaauagaaggaaugugugcccuuucagcuugucugggcagugucugucaugcucugugugucuugggaggaaugccaaaugccuuaggcuuuacauuuaauuuaauuagaaacaguauuuggucugagucugcccuuugugcuuuuaugagauaauagagaaagucuucagacuaagaaaguaauguucuguuaugaacauauugaaggucagugguucauaugagcauugucccauuuaaaagcuuuuuuccauuuguaacaaaaucugaaaacuugcugauguucuuaggacauuuggauauccaggauagauacuacuuuuguuuaugacagggucuuacuuuuaccuaguuaagauacacgguguuagagcauucugugucagggagcuagagacuuguccugacuuuauuucuaggaucagugauagauucagagaaggaaagaccagagguagaauggagucuggggauacuugaaggggugccauguagaaagaauaggagcucgguguggugacguaugauuuaaaucucuaccagagggagucagcucugaguuagaagccagguagcuauagcaagaccuaccacuacaccccccaaaaagauaagaagaccauagauaauuuggugucggaugaugaaaagcuuccucuuggauuuaacuguaguaaaauggcuuuuuggcuuggggauuggugccgagaaaugaagaaccugagauguuuuacccuuuuccugccguuucauuuggacacucaucccacaugagaccucagacaguacugguuauagcuggcaguugaaacacugcauuuccuugauugccuuugauucaagguuccacaggagacauaaaccuggcuacuugcaaguacuguacauuacaguaaagcagagagaaccugaguagggauuuuaggcugaucauucagcuacugucuugcuugucagacuugcagaugcauauaaugauagcauuugccugugagaguuguucuauugagauaucaauacuugauguauugagauaggacagaaaaccaucagaauuuuagugaaguuauauagaaauguuguuguuguuguuugggggcggggggguaauauugguguuuugccugccuggaugucugugugaggauguuggauccgcuagaacuggaguuacaaauuguugugagcugucauguggguacuggauucacuuacaguuucagagauuuaguccauuguuguuaaggcaggaagcauggcagcaugcaggcagauauuacggugcuagagaaauagagagauugacauauggaucuagagccacaggcagcaaaaagagagccagacacugggcugggccugacuugguuauuucacaaccaccuguacugaacuccaggaagucugacaccuucuucuagccuugguggguacucauacacccaauauguaugaguacaguaagagugcacuguagcuguacagaugguugugagccuucaugugguuguugggaauucaauuuuaggaccucugcucacuccagccaaccccgcucacucuggcccaaagauuucuuuauuauuauaaauaaguacacuguaguugucuucagacgcacagaagaggguguuagaucucauuaccagugguugugagccaccaugugguugcugagauuugaacucaggaccuuuggaagagcaguugcugcucuuaccugcugagccauuuugccaaaccccagacacauacacuugaaaaaaguuaacaaaugugugugcguaugcaugugaaauauccaaggaauaaauuccuaaaaauugucuaaaagacuuuuuuuccuugguccccuuuucugcugcuuucucacaggacaaguuuagcucuagaaugucaaguguuuacuuuuggcucuuuaagccugugguaguuaaucuucauugugaacuugacuggauuuugaaucaccugaggguguggggggggaggggagaacacuagcacacauuuccgugaggacuaagcuagaugaccgaggcugacuuggaugauggcaucgugagcuggauggagugggacaagaaagcugagggcaguauucuccucacaccugcuuccucuuugcugucgugugaguuguucugcuguuucuguccuaugauagacugaucucccugucacugagagcuaaaggacacaaguugugucucauuuuguugcagggaugagaauuguaacuacccagcagacaguuuuaauuuuacucacuuucacaaaaaaaaaaacaacuuggucaagcugggcaugguugcaacuccuuugaucucgauacuagggcaagguaggcuguauuuucugucccccuggucugugauuugcacauaccacagccauuuuuuugucuacuuaagugucuuaguuaggauuuuauuacugugaagagacaccaugaccacaguaacucuuauaaaggacaacguuuaauuaggacuggcuuacaguuuuagagguucaguccauuaucauagcagcaagcaugccagcauacaggcagacauggugcuagagaaggagcugagaguucuacaucuggaucagcgggcaacagggagagagaggggaggggagagagaagagaagaggagagagggagggaaacugggcccucuuccuccccuccauaugaauauaccuaauagugccacucccuggugaccaagcauucaaacauucaaaucuaugagcuuauggggccauuucuauucaaauaaccacaacaaggaaagaaacucaagguaguuaggugagcuugucuaugagugcucaguaaggcuaaccuuuacucucauagcaaaagagucucuuuuuuccuugugucugguacagggagcuuuacaaauuuaguuucucacugucaugaccuuugcucacaggaacauguggccccucucagccuuccagcuucuugaaaacagcauaagcagcaugaacagaagauugaucagcccuagauguugagugaagagauuuagcagcccuuaccagccagcaguuuauaggaacaagcuauauuuacauggcuaaagcaacauaagcaguaguuuuggucagcuguacccucacuucaucucuaccuuaccacguucauucucuccuaaaaaccaaaaggaguacagcaaagagcaaagaguuagcugccucgauuggagcaguucagaguacagacaggacaagcuuuuuuuuuuuuuuuuuuuuuuuuuuuuuaaauuggucuagaaaacuauguguuccuuaaagaaggaauugaaggauugauaagauguggcuuagcagguaaaggcuccuggaaccaagccuacaucauaauggaaggagaaaaugcauuccugaccuccacaugcacagacacacagaugauaaacaggcaaaaaagcauaauuuauaauuauuuuuaaaagguagaauggagaagguuugcugggaugaauuuugaaugcgagagagugugaaagacagaaagcagagaccuguuuuucuagcagugcgggguugcuucuauacaugggcauacuugacuuuccuugaauauagcucuggcuaguuaguauuuauccacauucccaaccaaccugccuggcagugucuuuguguguauucaguaccuugauuuaggguacaacagcagcuucuuggucaacugcuuguucacauccucccagcaugcccuguguuguucccuccaaccugacacccuagucuuuagcccucugcuaagaggccuuucccuucuuuugcgcagccuacuccucuuaucuuccugaggacaucauucaguuccuugguugggguuagaguauaggaaucuggagacuggaugcauaucaguuucaacugccaguggguacaucuguuugcuggagaguuucuauuuagacccaggguauauggagguaggaugaaguaugggaucugccaugguccuccugggcaucuuaaaaaccaggaagcccagauauaagaacaguacaauguugggggacucuucaguucuggagauggguaggguggaagucccaaagaguucauucuuggagacccaccagggcaugguucuuacucaugucaaccaaccaaugaccagucagucuccuuuaaguuccaccauuguuuuaggguuuuauugcugugaauacacaccaugagcaaggcaagucuuacaaaggacagcauauauuuggggcugguuuagagguucaguccauuaucaucaagguaggaguaugguggcaucuaggcaggcacgguguuggcagagcugagaguucuacaucuuuaccugaaggcugcuaguggaagacugacuuccacacagcuaggaugagggucuuaaaacccagacccacagugacacaccuacuccaacagggccacaccuucuaaaauagugccacuuccuggacugagcauauacaaaccaucacauuccacucccuggcccccauagacuuguucaaacacacgagucuacagguggccauaucuugccauagcauaauaaaaaguacauuuaguucaacuuccaaaguccucauaguauauagcagucucaagaauguuaaaaagucuaaagucuuuucugagauccauccaaucacuuaacuguaauccccaaagcaagacaggaaaccagcugggcaaauuccaaacucugcaucuccaugucugaugucaaagcagucuucaggucuccaacuccuuuuucaucuauguuuacugcaacaaacuucuuuuccugggcugguuccacucccuguuagcagcuuuccucagcagauaccucacagcucugguaucuugaacaucuugggaucuccaaggcaacuucaauguuaccauuucuuguuucaaugucugggauucacaaagaucuucugggguccuccaaagggaugacuccuacuuaguuauuucucuagcucugcucucuguagcacucuaaguuuagguugauccacuccacugcugcugcuguucuuggugaucauccuaugguacugggaucuccaauauacugggaccuuccaaugcaacuaggcuucaccaguagccucucaaggguucucuucgugguucuaaaccucaacuucuuugcacgaucccuucaguccugggccaucagcugcaauugaggcugcaccuucaccaaugcucuuccauggcaucucacacugcugcuugcuggggcugaaacuugcccccaaccccuuauucuauuaccagcuuuuuguuuucugccucccugcucuguagauugaccuugaacugagagaucuucauggcucugucuccugggauuaaagguguauaccaccauaccuggaacuaaauuuagcuggguaggaucuugcccccaaaucucuuaauguguuaucugcuagaauauaggauucaguuccauuuuacuuccuggugccccuuuaauacuugaaccauauauuuuauauuuuuccuuucuaagcuuguuauacuuguccaaaacacucugcaugagauuuaaccagagaacaacgucucugaugggcacuucugagacuuccuuugucaaugcaauuaaucugagucucuuuaccuuagccucaggcagacucuucagacaaggacuaaaauuagccacauucuucaccaaaauaccacauaaacagucucugggccacauauugaaauucuccacugaaaccucuugaaccaggucuacacaguucaaaucacucucagcaacaaagucuuccauauuccaauuaggauggcccaucaaaccccacuuaaagcauuccaugacuuuccaaaucaaaaguccucaaauccacauucuuccaaacaaaaucauggugaggccuaucacagcacuaccccacuccugguagcaacuucugucuugguuaggguuuuacugcugugaagagacaccuugaccaaggcaagucuuacaaaggacagcauauauuuggggcuugcuuguagguucagagauucaguccauuagcaucaagguaggaacaugguggcauuuaggcaggcauggugcaggcagagcugagaguuauauaucuucaucugaaggcugcuaguggaagauugacuuccacacagccaggaggagggucuuaaagcccauacccacagugacacaccuacuccaacagggccacaccuucuaauagugcuacucccuggacugagcauaugcaauccaucacagucauugagagaauaucaguuucaaaaccuaccaucacuugguauguucuguacuggguuauuuacucuuguaguucuguucacagcuuuaaaaaaaaaaaaaagacaaaauacuucuaaaaguaaaacuugucuggugaagaacucugagaauuuuguagcaacaaaauggaaccacugggaauagcagaacauacugggaaacagggagccaguuaugauguuggauaagaacuuugcaccaaaauuagucuugaggaagugaggguaaguaucugaguguaucucgccaccaucaacacaauuccccuaaaaauaagguaaacccaugaagcuuuagcacugugugggaaucuuuuuauaguuucuccuccagucugcaaauuaaaggcccagaaguauaaaauuuugacuaguagcccccugagauaguugagugaguuaaauguauguacugcuugaugacugacugagcuccaucccugcugugagaggugggaugaggugggguugccacugugcuccuggauguuuuacaaaccagagaggccagauauaaaggaaagcaguagagauuagggauugcuuaguucuggaggggaggaaggaggaggaaaggccaaagaguucauuuuuggggacccugagacugucacaggguaagaggagagaauugacuugaucagguucucugcugaucuauguaugcauaugguggcagaugcuggcacacgcacaauauaaaaaguuaccucuagccaggcagugguggugcacgccuuuaaucccagcagaggcagguggauuucugaguucaaggccagccuggucuacagagugaguuccaggacagccagggcuauacagagaaacccugucucaaaaaaccaaaaaccaaaaaaaaaaaaaaaaguuaccucuaggaggaaaagaagaaaaaaccaaauguaaauuaggaauaacuacaaaauguugacucacaaauggagauguacaggcaaagcuuggugcugugcaccuguacuuccaggcacuuggaaggcuagggcuggaagaauacuugagccuaguaguuuaggagcauucugggccugggccuucucuuuuaaaaaugagacagguaagguaguggugacagcaacuaagacuagacauggugguguauaccuauaauugcagagcucaggaaaaagaggaauauuacaaguucaaagcuagcuucaucuacagagaggggagggggcaaaaaaaaaguccuggugagauguuucaguggguaagggugcuuccuaccaaggcugaugacaugacuuuauuucccuggaacucacagguggaagaagagaacucacagggcacacgugugcacauguagguccucugcuccacaugugugcccacacauaaacacccacacaauguuacaaaaaacuaaagagagaaauauacagaugacaaacaauauugagagaaucuugaaacaauagugagaugcugcuccacaucucuuaguauggugacaguaaaauauauuggcagcuuuaaaugcuggcaagacugaagcaacagucauugccagagcuguagauggaacauuugucuuagucaguguuucuauuccuacacagauaucaugaccaagaagcaaguuggggaggaaaggguuuauucggcuuacucuuccacauugcuauucaucacuaaaggaagucaggacuguaacucaagcaggucaggaagcaggugcugaugcagaagccauggagggauguuacuuauugggaaaaugguuuacugcacacauccaggaguucacaaccaucuauaacucuagcucucucucucucucucucucucucucucucucucucucucuuucucucuguggguguguguguguguuucugucucuuucucugucucucucucucacacacacucacacacuaaaucuuuaaaaauguaccuuccacaauuucauguucaaacugguggcacaguuuggaggcuguggaacuuuuaggagguggggccuggcuaguggaagucacuaggagugugcuuuguggguuuuaaucugggccucccucugcuuucuguuucuuuauuuacaugagaacuauccgcaaaauaagccuuuuuaaguuguuuugggauuuagucccagugaagaagaaaauauaacuuuauauaaaaccaaacauacucuugcaacaugagccaacaaugguucucuuugcucuuuuuuagucuggacagaaaccuacccagagaguucuauagcaggguuauuuaugauuaccaagaugucaagacaaauaucauuuagcacuaaaaacgugagcuaauugcauauuauggaagaagccacucaaaaaccuauuauccauauuuauucagacuacuguaaaaaaaaaaaaguauugucaaagguguggccuuuaagcaacagaaacauuucuccuaguaccagauagaagcugagaaauauuuguucaagccauugacagauacaguguuugauaguucucagguuuuugguuagagaaaaggauauuucagcccucaguaucucuucuguaagggauccacguccugauggcguugaugaguagggguauauaugcucagguggggguggguguugaugcuagggacugaaccugguuuuuuggauguguucugccacugagcuacacuuuuagccgugaugauuuaguuuuguuguuuuaaauuuuauuuauuauuauaguaugugugugagagagggaggaaaugggggaauauuugcuacagcacacagaauucuguggagucaguuuucucuuccugcccuaugguucugaggcucuaauucagguugucagguuuguguugcaaguacuuuuacccacugagacagugcugacacuuuuaauggaugcauuuggggaggacauacacauugagaucauagcagcucuacaauacaugacucaaauucuaaguauaacuaugcaaaaccuauaacauguguaacuuccagugauaaaccuauuaugaacugugcaauguagguucauggaugguaacauuucaccuucuuaauguagaauguugauagugagggaauauuaggccucugaguuuuuuucaguacuuucagcuuuacuaaaaucuacucuaaaaaagauagaaauagucuaccugucucauuuacauuucugcugccaugaagagaaacugagcaaggcaguuuauguagaagaaaacauuuauugagccuuguaguucuagaggguaagucgggcagccggcaggcagagaggguguuggagcagcagcugagagcuuagaucugauccacaagcacagggcagagagagugagagagaacuaggaauggcaugggcuuaauggaaacuccaaacccuuccucagugacacagcuucuccaacaaggccacacuucuaauccuuccccaacaguuccaccauaccaaccauucaaacaugugcuauuagggaccacugucauucaaacuaucauaccucuaaaaaaguaggcuguaaaauauuuucaugacauugauuucaaaccauuucacaguuuacugagcaucuuugcuagaaauccugguugguuguuggauuaccuuuuugauagagggcuuuagaugauguaucauuuguaucguugguauuaaugaacaauuaaagcagcccuggcuuagccauaguuaugugaagucugguauguucauuuucccccuccuuuucuuuuaggacaacccuccauaugauaagggagccuucagaauugaaaucaacuuuccagcagaguauccauucaaaccacccaagaucacauuuaaaacaaagaucuaccacccuaacaucgaugagaaggggcaggucugucugccagucauuagugcugaaaacuggaagccagccaccaagacugaccaaggugagaggcaugcaccuuucuucucccugccuuagauagagcucuuuucuggaaauacugcuuugagauggaagcuugaagguucucuuuaauccccucucagacagaguugagaaaacuacuacuguagcaacucgaguguguguagaagugcugcugagaccucacaguccugugaggcugucucaucucaguuggcguguugacugugcagaggcccagacccucgaaggcacaaaacgaugugauggugccugauagggagagugaggguggugcuagaugcauauaguggucaucgccuagagucagcccagcagaaaggcgaggauuguagcuccauuagaagguuuagguucaagacaagauaugucagauuuggguagcauuucugugaaagcacacagcuagcuacagugucuguaacuuguuagaaguagguguggcuguguguguccgagcuuucagucagggaccuugccuggagagaagugcuucugcacagggcaggccccuggcacuggccacaguugaggcuccugagaagggaggacauggaggcucccagucccugggaugcacaugcuucaccaucuccuaggccuccuuuaucuucauugcugcauaugcagcccaauacugcuguuucaggcugggggugcuccccacucuccaaagagccaaauagguuggggcaguuuucuauucuuuugcaaaauauacuuauuggcuauauaagaauuucaugcagcguggugguggcacacaccuuuaauacuagcuagccucgucuaaagagugaguuuuaggaagccaggacuacaaagagaaauguuaccuuuaaaaguuugggguuuuguuuuguuuuguuuucauuucagguauaguguuagaauuacuuuuuuugugaugugggaaagcguacggcuucuuccuagaaaacgaauuacuugucuuuguagcauggcuuugauucugauaucuuggucaauaauagcacuugaugccauauuuuccuauuucuguuaaccuguggcuguauuauaaccaccguuugcauagaugguucacuggauguuguuccugagaaccuggguucguuccucagaacccauacauuagaguucugugacucuaguuccaggagaucuaauguccucuucuggucuccaaggguaccaacuaggcuugcacagacauacaugcagguacaaugcuaauacauuuaaaaguuaguucauuaauuaauuaauuaaagauaaggugaaacuagcuuaaaguagcaguuuuuugcuguuucuguauuggcugucucaaacaggacugggcacucuuggggcuauucagguacuguuauugugggguaaauuguccuacuugucaucaucacauguguggcaguuggugcuggcuagguacuugacucucuuugugcugcuuauucuccaugaauaggauuggacuugauagcaauggaggggcucuaggaugaaagcagaagcaacagguuacuuacaacucaguguagugcuaacacuguuuucauguccuuucuggauccucuuggucaaacaaauaaguccuuagucaggguacucagguugguagaggugggugcauacuuaggcagaggaggggccccuggcaccaaguucccuuacugucucucuguguuugccugaauguauauuugugcaccguguacaugcaaugcuggggagcucagauggcaucaaaucucuugugaaaugccacaugagugcuaaggaacucagguccucuagagagccaucucucuagccccugccucucuacauacuuaguguggguucuguggcacuauuguggccauacgauaggugcuuuuguguucagcauugguguuugucugguuuuguuuccuggcugcugugcagcagucaucauccuauaucaccuucccuuuucaugccuugcaauucugcauuuccuaaagcugugaagugagcaugacacuuguucuucauagcaucugcuuguggguuucuucugccuguguccuuaggaacguuuucauugaugacuccuuucagauaaugucauggugcuugugguguguagguggauguuucaccuucauguauguguguaugugcuugcccagugucuagggagcccaaaagaggguguuaauuucccugaaacugagcuacucacaguuguaagcugugugagcugccgguguucuuaaccacugagccauccaucucugcuuuggcacaaagucauguuuaauuaaacagguauggaaaauaaaaaugauaagauuagcagcugaugagauggcucaacagagaacugaaauuuaauucccagcacacauuugguggcuagcaaccaucuuuaacuacaguugcaggugauucaauaaccucuguagcauccacgaacacuguaauacacccagggcucagacaaaacacccauacagguaaaauaaaaauagauaaaucuuaaagaaaugguguugacaauaaaguuaaaaugucuuagaauaggagcuggagagagagcucagcaguuguugaguucaguucccaggcuccacguugagugggcuaauagccacgugugauuccagcuccaggggaucugauacccucuucugaccucugugcauucuaacaugaagacacacacacccaugcacacauacacaugaaugugcaugcaauaaccuaggcauaauggaguggaguaagcaaugugaaaaaaugcuccugugauccagcaggucaacuuuuaguugaaugugcgccccaaaaaugaaagcauggauucacacaaacauuuuaaaaauuacauucuuuugugugugugugugugugugugugagagagagagagagagagagagagagagagagagagagagagagagcaagcaagcaagcaagcauugaaggucagaggacaguuugagggacuacucaguucuuuccuucucccaugugaauaccagggaucaagcuuagguugugaagcuuggaggcgagagcuuuuaucuagcagggaucccucuggcuggccuaaaacacuagcauucauguucauugcaguucuucucauacuaggcaugagagagaagcaacucaaaucaauggauguacauaaugugguaccuaguguccuuucuguuucuguaacagagccacuaugaccaaaagcagcacggggaggagaguuaauuucagcuuacaucaugaaaggcaagucaggugugggggcgcacaucuuuaauccuagcacccuagaggcagaagcagguggaucucuggguuugaggacagccaggacuacacaaagaaaccaucucaaaaaauaaaaagaacugaaguagagacagcaaaauggugguguuuauuuuauugucuugcuccuuguggcuugcucaguuugcuguuugucuuauacaccccaguagcaccaucuaucuguccggguggcacugccuacaaugagcugagcccucccgcaucaaguauuagucaagggaaugcucuguagacuugccuacaggccagcagaaaguggucccucuucccagacgaccauggccuuaacuuacaucagugugaccaaagacaacaguggucuuuccauacagugacauacuguuaagccauaaaaaaaguaugagccggcgugguggcgcaugccuuuaaucccagcacucgggaggcagaggcaggcggauuuuugaguuugaggccagccuggucuacaaagugaguuccaggacagccaggcgauacagagaaacccugucugggggaugggggggggggggaugaaguaugaauauaugguagaagauauauacaccugauaaauaggaugcuauaugaaauaauuacucucauaaaaacaacaugauaaugugauucuguacacagcucauggauuguggauauguagcccaaguuggccuugaacuauggacccuugucucucucucucuuuuuuuuuuccgagacaggguuucucuguauaucccuggcuguccuggaacucacucuguagaccaagcuggccucgaacucagaaauccaccugcuucugccuccggagugcugggauuaaaggcaugcgccaccacgcccggcuuugucuuauguuuuuaagugauguaauuucaguggugaugcuagcacaucuacuuagagcuuaugaauuugggaaucuguguaccuuguaacuucucaaucaguacagcacuucugugauaaguccugucccuauaguuccucugagcuggggucauuguuaacagacagaugcagcuucauaauaugcuucccuucccccacccccacccaaugauuagaaguguccugaguagaguguaucauacaagaguaggaaccugccaccacuaacugccuagagagguggcccuauguauagacaaguauaaaagugacuaggccuacucucugcagagcacuggagaaugagacugacuggagccaggagguccagauacugucuagaagauggucugugcuacccuuguuuucauuuugaaugagugaauguauuaaguauauagcaagccagaguaaaagaguaaauagugcugggugugcuggcacacaccuuuagucccagaccucgggggcagaggcaggggaacucugugauuucaagaguagccaggcuuacuuaguaaguuccaggccagccaugcuacauagugagacucuuucagaagaugaggaaugagggcucuagguaguguggcacccacaugagugagguagggcuccuuuaaagguggccaguuggagucuaccgagggaagcccaggcagagcagucucuucaggugagaauuccauauacaaacaaauugcacauagaaagaacuucagcacaacagaaacuaacauaucagcugcaguucccgguuaggcuuucuuucgaugacugagcuuccagcuuuccaccucuuucccacugcaggcauuucuguauggugagauaaaguagaaacuuauuguugggaaugacucaccuucugucuucaaggcacagcuguguuuucucuuaggcuuucuuguuguucucuacuugcugucacugcauugggagcauaguguucguccucagauaagggaccuuggaggguaccugaugucaucaugcuugguucugaaauuggagggacaggcagccucucuuccaaagccagcuucucagugagacaaaacagcacaugacaguucaccaguaaaaugugugucccaccaaggugaggcugggaucugucagccgcuaacuaagcuguaaucugucucuccugauuacagaaguugaguucugguggucagaauuuugaauacacagaaggccacuuugucuuuaaaacacauuugugggcaugagacauaguucacuugguacagagccagccagaaugugcuguguauggagucacccugacuucauagaaacaaauauaguggcauugggcuguaacccaaaacucagaagggucaggaauucaagaaauugugauuucuaacuacaaaucagaaaaagggagcgagcuggguuugagucaguguagggagaaguuucaguuucucucucuccugagauuaguagcaucuugccugugcuauuugaguccauuuuaaccccaaugccuuaucuuucucuucgcaguaauccagucccucauagcacuggugaaugacccccagccugagcacccacuccgggcugaccuagcugaagaauacucuaaggaccguaaaaaauucuguaagaaugcugaagaguuuacaaagaaauauggggaaaagcgaccuguggacuaaaaucugccaugagugauuccagcaaguuugagcagagaccccgagcagugcauucagacaccccgcaaagcaggacucuguggaaauugacacgugccaccaacuggcguccgcuuguggcaguuacuaacuuucuacaguuuucuuaaucaaaaguggucuagguaaccuguaaagaaggauuaaaaaauucagauguucuaguucugcuugcuuuguuuuaaaaaucacugcuuuagucuacuucaaaagaauggcauuucuuuucuugcccaaauuuacucaaaguugcaguuagcccagaagguuuaaagaaaaagguuguugugguuucuucccccuuccccucuccccacuuuucgauucccacuuccacagaccaaggccccagcuccccacagagguggccgcagcacugacaacguuuccugugccaacacugccuguggguaaugaguagcucacgcaccccauuccagcuuagugaugucuuuaaaaaauuauaaaacaguaucaaugcccugucccaaaggaacauccaugcaaacaaagagaagccgucuuuacguaaaauuuuagcaaaggguuuccacaauaauaauagacccgacagacagacccccauggucccuaucuguagucagacugugcuggcugggucucugcagggaaccuguuauagcagguuuguggugaccuuggagggagggucugccagcagagaauacagugcgcuugugugauggacuucucacagucagcagcccuuccugaagcugugguagaccuggucaucacagaccaaaaaaaaaaaaaaaggccagaauauucuuuugaaauuucaagcuucucuaccaccaagcucugauaggaugugccaaggagagcucccacuccugagcacagcaggccaccacugccacccuccucacggcuuacccucagcggggucagccacgauggcucugccucucucagagcagcugcugggacagcccaggaacaggguggcuuuucccucccucuggacuccaaaccuuuccaguccggcuccacuugaagcucacucaauauccuuucaguguguuuuauauuguuuugauugccuuuuuuuuguagaaauaaaauuugagcuuagaauuuaucaucaaaugaacucugucaagauuugaauguuaaaugucuuuucaagggaagugggacggacuguccuugacgcaguagugacacccugaggaagcugauggccugacugcccauguucaccaacucacuucugcuacuaggggucuaauccuguggagaagauugccucaagaaaccuugcuuucugcuuuaaccuuaguucuauaacuuccgggcuaccuaggcuuacagacuugggagacagcucuggguuuugccuauaaaagaaguaagacauguccucucaggcaguguaacacuauuuaguuuuccaaguguuuggcuccugugaugcauaaaugaacuaugcuuuaguucaaguuaugcauggggcagguuucuggagacuuccauaugcccaggauggucagagcccugggccuguguuucuacaucugucucuucauuggcagaaaagugacaauggauuuuauuucacucauauucagauuuguaauaaaaugccaaacucugucagaauugucgaagcaaaccaccauuuuguucauguugcuuuucugaaucuagagauaguccagcugucucauugcuuagcucuaccugccuguuacccgucacugcucucugcucacuaugggaggguacucuuaugccagcagccccucucagggacucucagccccauuguugacaaccauggccugcccugccuuggagucaguggugucccucugggcuugcaugccuuguccuguccagcccugcccugagcaggcuuugagcaagguggcagggagaccuguggagcagccacccacgccugacccaagcuggcucaggaauccacaucccccugguuccuugaagugcccgggucucguccugcucuucccacaauggcagagaauaggcuuucuaagaugcugugaccccauucuguccuuaauaaaaauguucucagacauuag

SEQ ID NO: 8130 - RNA, 82860 nt, Mus musculus
ccucucucucucucucucucucucucuuuguuuuuuguuuuuuguuuuuuuuguuuugguuuguuuuuuugagacaggguuucucuguguagcccugguuguccuggaacucacucuguagacugggcuggccuggaacucaaaauccccccgccucugccucccacgugcugcgauuaaaaguaugugcaaccaaugcccagccacccucccguuccuacauucuuucugucuccucauccucagugauuccuggcucuugauagaggggagauuuuauuuugguccacaguuuaaggauauagucuaccgugggaggaaggcuugguggcuggaacacaaggagacuucuuacaaucgcaccuguagcuagaaggcagagggaggugaguacucagcucuacuuuccuuuauucaguccaggacuccaucccaggggaggggauggugccaccuacauucuuucugguucuucucaccuccauuacacuucucuacagacucucucaaagacaauuccaggggggcgucuccuggguuuuucuaaagucugucaaauugacaguuaagauuuaaccuuaggggccuggagaaauggcucagugguuaagagcacugauuacuuguccuaagugcaauucccagcaaccacaugguggcucacgaccaucuguaaugagaucuggugcccucuucuggagugucugaagacagagauaguguucucauauacauuaaauaaauacuauauuuaagaaaaaagauuuaaccuuagacagcaguucacuacacugagaucuaugcuccccucgggagccacugaggaagaggacacagaaagaauguuagaugggaaggugggaaggaguggugggaaaugcugacuuccagacgugcuaugcccagugugcccaugaucuuagaguaucuuggccacuugcacacaaucugcacaaaucaagccagccaaugauaaccaugagaguuguuaggagcucacuguuacuggagggaccauucuucucuggggguguccccacagguaaauuguguaggcauaauguuauugugcgcuuuaugaaacuuuauuguguguaugccugcauccugucaauaagaggcugauuggcuaauaaugaguugaggcaagacuagaaggugagacaucugauagagagaggaauucugggaaaauaggugcaggagauuugccccagacacacaaaaagacaguuuuauaugaaacugaagaccaaguaaccagccauauggcaugagauagaauacaauaaaugaauaauuaagauacgggcugguugaagaacagagccaaugcuacuggccuaagcauuuguucauauacagaagucucagaguuguuauuucugaauggguggaaaacacagguuacaagacugccugugcugcccuggauggcaccacaccaaugcgcauaugauugacacuaauuggacuuaguagguuuuuuguuuuguuuuguuuuguuuuguuuuucuuuuuuuuaaaaaaagauuuauuuauuuauuuauuuauuuauuauguguaaguacacuguagcugucuucagacacaccagaagagggcaucucagaucucauuauggaugguugugagccaccaugugguugcugggaauugaacucaggaccuucugaagagcagucagugcucuuaacggcugagccaucucuccagcccuuuguuuuguuuuuaaggaguggaaauaacauugggugggggaaauucgaguggaucuuuggagaguugaagggaggaacugagggguggaugucaucauauuucacugcauacuuauaugaaauucucagaauauuuuauaaaauaaaaaaagucaaauauuuuuuacuuuuguguauguguguaugccugcauguauguccgugcuugccuaauguccaugaaggucaaaagaaggugucagauccucugggacugggguuacugaccugggagcugccacaugugggaaccuaaccuguguccucuccucagccauuucuccagcuccucacagaauaauuauauauuuauuuuacaaauuuagggaacacugguaguaaugcaaauagacucuuccuuuucccuuguuuuuuaauauuuugauaucaaguuuuaccauuuagccuuggcuauccuggaauuugcuaaguagaccaagcgacuuagagauuauagagaucugccugccucugcauccugagugcugacuccaaagucaaagcccugagccaccauuacuggcuuuuuuguguuuuuuuaagacuagguuccauguagcacaaacuggccacuaccuugcuacauagcugaggguggucuugaaauuauggaagcuccugucuccauccugaauacugaaauuacagauauacaucaguucaccuggcucagcaggcuccauuuucuaguguauaaguguaucucauacgaaauauuguaauacuuauucugucagggcaaguagauauauauaggcaagaguuucagguagcaagauuuuccaagugguagguuuuuccucuacauaucauggauuaaaaauaguagacugggaguuggggagauagauggcucagcaguuaagagcauuggcugcucuuucagaaguccugaguuuaagucccaggaaccaugucauggcucacaaccaucuauaaaggcaucugaugcccucuucugguuuguagguguacaugcagacagagcauguauacauuaaaaaaaaaauuacuugugcucuuccagaggacccugguuugauucccagcacccacaugauggcaaacaaucaccuguaacucuaguucuagaagaccuaacacucuuuucuaucaucugcagguguguguagauauacacagacuaaauauucauacaaacaaacaaacaaacaccauuaaaaaaauaccaggauacuaaagagauggcucaaaaaguuaagcauacauguuagucacucuugcagagguccagggucaguucacaacauccacauggugguucacacacauaacccuauacucagggguccuacacccucuuuugacuuucuugggcaucaggcaucgaggccacauaggggcuaggauuggaguuacagaugguugugagcugccuuguugguacugggaaucaaaccuggguccacuggaaggguauacagugcucuuaacggcugcgugaucccuacagguccagaacagauauauaaaugaacuuuguauuuguuaagacaauuuccuaaguagucaacugguagacaauagaaacuaaacacacacacacacacucaaagaaagaaaaaaaaagaaacuaaacacauacucugcuuucaaaacaaaacauaaagucuuaagucaauuuccuuuuguaaauauuacuaagagcagaguacuguuuuuguuuguuuauuuuguuguuguuuuccugaacauuguucuuguuuuguuuuguuuuguuuuguuuuguuuuguuuuguuuuguugagaaaggguuucucugaguagcccuggcuguccuggaacucacuuuguagaccaggcuggccuugaacucagaaaucagccugccucugccucccaagugcugggauuaaauucgugugccaccacugccaaccggaacauuguucuuaagaagguacugcauauggcaugcacaggucuaacccagaugggggcuccuugaaugagaggauguagacauaugucccaucccuaaccaagcagcuaucucuagcugacaacugcugccaaaggaaaaacaucuuuuucaacagucuugcugggcacacuaaccauacuuaagggcaggaccuaugcccagcaggagacguccaccacaaaaugagauucuuugucuuguaacuuuucuuuuuaacucuacagggauuuugcucauacaguaugcuuuuacauuuaccuucuuuuuuuucuugagcuuuuucuuugacuaauuuuaucugguuuuuuuguuugguuguuuguuucguuuuguuuuguuuguuuguuugucucuuuguuuucaaagggaacaaaaauagaaagagaaggaaagagagagagagagagagagagagagagagagagagagaagaugcauuggguggagaggaucugggaggagaugggggaggaaaaccagauuagaauauauugugcuuaaaaaucgauuuuucacugggcgugguggugcaugccuuuaaucccagcacuugggaggcagaggcaggcggauuucugaguucgaggccaaccuggucuacagagugaguuccaggacagccagggcuacacagagaaacccugucucgagaaagaaagaaagaaagaaagaaagaaagaaagaaagaaagaaagaaagaaagaaagaaagaaagaaagaaaggaaaaaagaaagaaagaaagaaagaaagaaagaaagaaagaaagaaaggaaaaagaagaagaaacaaaaaaaauagauuuuuaauuuuaaaaaguaaaaaaaaaaaaaaaaaaaaaggcucaaaaaggcccuguugcuuugaacacaggaauagcuacugguuuacaucaguaucuucauaucuuaucuucacaucaauauuuccuugaacugaugaauccuauuucauuaauuuacaaaacagauuuuauguuugggugugaguuucugauucucuccuuauucuuggucuaaauccaugaucaagguagacagaauucuucaaguauguucagaugauucaauaguaacaauuaagcagcauauuuaacugaggcaggauaggaagauagagucuguuugaagccuuugccaguugaaaaacaauuaguuccagcacaguuagcaaggacuuggggcccugcucucuccuguugugaaccugcgguuguauaggacucucaccagagacuccauuuaucgggaaaggacaugugcugaacuucuuggcagacacaacugccugcuuuacucuagcagagaacaacuucauacaccucagcuccugagccacccuauaaaucccaucuaacaaaagaaagagaaaagaaggggcuggagagauggcucagcgguuaaaagcacugacuacucuucuagauauccugaguucacuucgcagcaaccacauugcagcucaaaaccaucuguaaugugauccaaugcccucuucuggugugucugaaaacagcuacaguguacucauauaaauaauaauaaaucuuuuaaaagagagagagaaaaaaggaauaauacaguauuccuugcagucuuuuaagauguaacuucagagacauuaaaacgcuaaaauuugucuuagauuuaucuugguuucccaccuacuuugaugaaaauauccugacaaaagcaaucugagggaggaguuuguguuggcucacagauguuauaguuggccaugugagggagcuguggugaaggacugugagguagcuccucccacuucaucugcagucaggaaacagaaagcgauaaaugcacuaagcccaagauuauagcucacagaauugugcuacccacaguuaaggugggccuucccaccucaacucaacuggcuugauagucucucacaggcacgcuagaagcuagccuaaucaacaugauuuccuaagagcugugccuggaagugccucuccuggguaauucuugauccugucaagaugacagucaaaauucacccucacaaugcucacugcuaaggcaauucauucugacucuuucuugaaaagccuauaucacacuuggcuaugucuuauuuucugagauuuucucuuugaggagugcccacccgugcacuggaguguggcuuacuuucuucugagugccucuuuuucuccugauucuugcacucaagaggguuuuuaguccauuuagaggguagaggaugauugugcccccagguggauaaguaaacagcaccaucuacggugaaguagacacugauaaguuacucacugcugggaacagaagaguccauucuauaaaugcaucccggugaaaggagacugcaggggcacgugggaauauuaaagucacauuauacaaaccaacaaaaggguacacuugaacucuauaaagggguggacuuguagcaccaugacagcaucccagggcuacacacggauucgucucacugguaacccaugugugcaccggggcaggguacuccugcuuguuccuggagcuucuauucagucuguccccuucuguugguguugcuccucauaccaccugcuugauaugugaagcauaucaagguugguuugugaacuuauucucuguuuguuuuuugucuagacuggacucugucuuccagcucuccauccccugcuguauguguagcccagaaaucuucgcuccucaacccugacacuccuuagaccuggcuucuuccauucuuugaagaggcugcucagagucugguaucugaucaguaaacucccucucacauuucuuuagcccaugccugaaacauccugaacucuguuguagcugaacuuauauucaucugcaaccacauacauauguguauguauuuuauuggguacugugugaaaugaguacauuuuggccauuaugauuggaacaaaagaagcugcacuaugugugacuagaugaccagaguaggcaaaguguugccauugaaaccacuguaccuuuugaacguuuuauuauuauuauuaauuauuauuuuguuuguuuuguuuuuugagaugggacuucucugugucacaguccuggcugcccuggaacucacuuuguagaccaggcuggucucaaacucacagagaccagauuuucucugccucccaagugcugagauuaaaggugugcaccaccaagguugguuugugaacuuauucuuuguuuguuuuuuguuuuauuggcaacuuagaguguaaaguauuuuauuuuuaaccuucuaaaguuugaaaacaauguagcccaguuuaggugaguuaccaagcuaaauguguuugccuggagcuuaguucugccugacaaggaauuccuaauacccuaggugggugccuguguagcuacaaguggcaaacagccuggacucuacugggaaugguccuuuccccaucccuuugguaggagcuuaacaaacauuaggcguuuuucuugucuuauacggcuaaugugggucugaaugucgccugggaggcaugcaccacgaacaagaagucgucuucauucuucucauaugccuuggagauagucuuacacauacucaccacgcugugccaggucaccacgaggaagaaggcuugacuaucguugagcuguuaccgccuucucuuucuggucaugagcuuacccauguugacgugguuggguugauuuugucauggaccggcagcugccuuuucuguuuauaaugcacuauugaaaucuuuaugggugcaagacaucuuccacucucugugugaagcuuccacgcugugugaaggucucugacuacauggcuuggggaaucuaagauuuggauaaagggggcuggagagauggcacagcaguuaagaacaccuacuuuucuuccaaaaguccugaguucaaaucucagcaacugcaugguggcucacaaccauccauagugagaucugagaugcccucuucugguaugucugaagacagcuauaguguacuuauuuauaauaauaaauaaaucuuugggccggagugagcagggcccaccggagcaaacagagguucuaaauucaauucccagcaaccacaugaaggcucacauccaucuguacagauacaguguacucauauacauaauaaauaaauaaauaaauaaauaaauaaucuuuaaaggaaagaaagaaaggaaggcaggaagaaaggaaggaagaaaaaaaggaaggaagaaaaagaaaggaaggaagaaaggcauguaccaccaugccuggcuuuccuauucuuaaaaaaaaaaaaaaaaagauuuagauaaagaaccugaauuagcuuucuccagcuguacugccaaauuuugccucucaaggacugggauuaaagugguguaccaccaugccugcaucaccaugccuguaucaccaucaccgugccugcaccaccaagcaccaccaugcaccaucaugcaucaccacgccuucaucaccaugcaccacuauguacuaccaugccugcaccaccaugcacuaccaugucuucaucaccauacaccaccaugccugaaccaccaugcuugcaccaccaugcaccaccaugccuccacuaccaugcacuaccaugcaccaccaugucuucagcaccauaccugcaccaccaugcaucaccacgcaccaccaugcuuggugguuuugaauuuucuuuuuaaguuuugucauacucaguuuuuuuuuuuuuuuuuuuuuuuuuuuuuuuuuuuuuucuuuuuuccggagcugaggaccgaacccagggccuugggcuugcuaggcaagcacuuuaccacugagcuaaauccccaacccccauacucaguuuuuuaaagacuuacuuauuuuauguauaugaguauauuguaacugucuucagacacaccagaagagagcaauagaucaaugcucuuaauggcugagccaucucuccagcccccacacucagggguuuuuuuuuuuuuuuagauuuauuuauuuauuuauuucauguauauacuguagcugucuucagauauucuggcacaccaaaacaguacauuggaugugagccaccaugugguugcugggaauugaacacaggaccucuggaagaacagucagugcucuuaaccucugagccaucucuccagcccugacacucaguuuuuaauucauuuguguuuaagacuuuuccaaaggccaaaaguuuuuuuuuuuaaagggugcuuucuucuauaauaauaaacacauguauuuuauuuauuucuuuauuugucuauuuauuuauuuauuuugggguucauuuuggguguuguuuguuuuuguuuguuugagacaaugugucucuacauaggcccugguuguccuggaacucaguauguaaaccaggcugccuugaauucaacagagaucugccugccucugccucccaagugcugggacaaacaaaguucuaaaaugaggccuuacauauuguuggaaaaaaugaagacuuacaaaauugguuaguuaccuuguaaucucuacucuaaacuuaaaucauauaaacauugaaaggugaacucgagacacauaagcccagcaacaauuauccacuuagaccaaaauguccuguauuaagggaugcaccacuaagaagcaaggaauaugaaccacagagaaaacauuaacagaaauaaugcuuuugcuuuccuuuuaaauauggagcuuaaugauucaaugagcagagauccuaaaccuaacauugcuuguuggugaaauacuagcuuuauuuugaugacuguagaauguacauauacuuauguacacuuaacauauguuagaaauuaaaaucucaauauuuaaauaccaaauuuauuuaaaauaccaaaaauauguuauacauuagcaauuaucccaacacuggcaacaaaauauacauagacucuguaugugugucuguguguggugugugugugucuauguguccgcaugugugucucucucugucucuguaucugucucugugucugucuuucugucucuuuuuucugucuuucucucuguuucugccucugucuguguuuccgccucuguaucucugucucucccucugugucucccucucccccucucccccucucccccucuccccuucucccucuuccccucucccccucuccccuuccucucuuccucucucuuucuguggcgcgcaugcguauacaaaagcaagacuucauuucccacaauucuuccuguacuuccggcguggcccaguagcgggaucgcucggcuuccggguucgggccugucgcugugguagaggcggcggcgccggggguggccgguagggacucgggcuacaagaguaggggcuccgggcauggacguuucggggcaggagaccgacuggcguagcgccgccuuucggcagaagcuggucagccaaaugugaguguggccuggggcaaggaccgguggucggaccuuccgggcggggagggugaggccgggcuagacccgcucuugacccuggucagaagcugcgguguccgcugggugccggggacguacaaggguccuccuggagucucucuggccuuucucggcagacagggacugcuggcuaguuuuucuggggaggaacucugcaaacccagcuagugcccuggcuagugagucaucguccugagccgccucgucauuugugugcagauuuuccuuugcuucgauucgcaccgaauauagaaagagaaugaggcagccagagauuuuacacgggugccgcguggcuucuuuuauaaaauaaauaaauaaaacgaaaaccacaucaaugaguuggaggaggcuggaaggaagguaaauuggaagauugauguguuuggguuguaggcaguggaauagaagagugcuccgguuucuuccacaaggugugucaacuuggccaaaggguagcaggaaauagcugugggaacuucgggagugaagggcagggaugcccucugcccacggagcacugcagagugcuuguugcacuuagccauuuuacugaguuuccuaaaguguucagaaaauugccuguggcacagcuuuuccccugaggguugguacugucugucuguaaagaaacaguacagucgugccaaugcucagucauuuuugugggugcuaaagugucaguugaguagacuggagcagccucgaguaggugacagauugagcucuagagagaaaaguaggagggugacaggccaccauucccagcagaugauugugaaagcaucaggauggacggcuguagguggagaguucugggucuuugaagcaaaguagucaaggauacaucaugaggaugagcagaugcuggcaugguuaguguuggguguuuugggcaaacaacuuguacccgugguuuuuuguuuguuuguuuguuuguuuuuuaguuuuucgagacaggguuucucuguguaguccuggcuguccuggaacucagaaaucugccuacuucuaccucccaagcgcugggaucacugcccggcccuuccuccaguguuuuacacguggucugccuugagguggugcagcauuaguguugggaaggccccugagucccuggagaugaauuagggacccaagagaggccaaauaggcaauuuggggaguuuuuuuccuuuggaaggguugguggggguucugucuuuuuuucauuuagaucauauggucucaugaguugauuguagaagacuugguuggcagagaucauaaagaccaguauuaagugcugaacuugaaagaggaagacagauuccagagaaagaggaaugaauauguggacaauuggugacuaacuggauggagggggugggguggggugggguggagugaagcaauggacuaaaucggggaagcaucaguacaguggagggaguggguacugugucaguggcuugguaccgccgcacaauaacccuugcacgguuuugcagacaguucagcaaacaaguguuuuguuucuuaauuguuuuagauuuaauuuauuuauaugaguguuuugcuugccuguauauaagugaaccauguauaucugaugaugucagaggucagaagagcguauaagauucccugggauuggagcuacaggggguuaugaacugcccugugaauucugggaaucgaaccugcuucuucuguaagagcucagugugagugcuucuaaccucugagccaagucuccagcccacaagugcaguauugauguacuugaguuaucucuaagugaagucuugagaaauggucugagcuccagggcaaggauucuuugggaaagcccaguacaguggaucuggaagagcaaguuguuaucacagacaguaggggagagcugcagaaguaucugaggucugagggaagacugaaguauacuggauacacuguaaugccuugugaguccugaggugcuuucuaccucuguaagauacugcacuuguauauuauuuuguuuugcuguaauaacaauuaccaugcacuuagcaucuuaaacaacacagauuuauauuugaucuuuuuuuuuuuuaugucagaggcucauguaagauuugguagguguuaguuucaggguugaaaucaauacgauggcaauauacacauuuuuuaaauuuauuauuuauuuuuuuuauuuuuuugguuuuucgagacaggguuucucuguauagcccuggcuguccuggaacucacucuguagaccaggcuggccuugaacucagaaaucugccugccucugccuccagagugcugggauuaaaggcaugcgccaccacugccugguaauuacauuucuugauggaaccuuuggaacagaaucugcuuucaacuccauucaaguugcuguccaaauucuauuccuuacacuuguaaaacugagguauccucuuuccugccuauuugucaggggccaguuuuuguuccuggagguugauuguaucuugugcuuucuuuguggccuagucuaacauuggcugguuucucugacacucaccaaauucagguagagaacauccugugcacuucccagaucaguuuggaacaauggaacacaaucguuagucuguaucuucaaucacagcuaugcggucauuuuuugagauacagugaaagauagucacagguuccagggacuggggccuguguaucuugguggagggggcaacauuugucuacugcauuugagugagcccccucaaagguugcuuucuaagaguaaagguaucuuaguuugcuuucuguuacugugaaaaacaccaugaccaagagcaacuugaggaggaaaggguuuauuucauguuacacuuuaucacacagcccccaacccccagcaagaaaagccgagucagaaacucaagcaagacuccaggggcuggagagaugauuuaguccauggugaagacugcuuguagcucuuacaaggcaccaggguucgauuccaggcaccugcaaggugacugacucaaaacuguucauuuccaaggguuccacagcccuuguccgauuucugugggcaccaggcauaaacuggugcagucaacauccaugcaggcaaaaccuuuguacuuguaaaaagguaaauaaaaaucagcugccagugccagguggugguggcgcacgccuuuaaucccagcacuugggaggcagaggcaggugaauuucugaaucagaggccagccuggucuacagagugaguuccaggacagccagggcuacacagagaaacccugucucaaaaaacaaaaaacaaacaaacaaacaacaacaacaaaaaaccccaaaaaaaccuaaccacgcuuacuggguguuuucacuucuucgguuugcuuguuuucucucuaggguugacuuugcuggugacuugauuaacuguguugauagagcuuaagaagauuuauaaugggcuaaucuacacaucuuuacuucugacuucuuccaggggugaugcuguuguuuaaauuuggggaugcacuucaaaccauagugauuuauauuacaugaggcauaaagaaaguuuagggcugagagaguagcuuaguagaagaucgcguauguaguccucaugaagcucucaguucagugucaguuguuggggaguggggagcauagcaaaacacugggaagguucugcaaaguuucaguggagaagcaucucucauugaggaaaaagcaaguuugacaauucuuuuuuuuuaauuaauuaauuuauuauauguguguacgcuguagcuaucuucagacacuccagaagagggcaucagauuuuuguuacggaugguugugagccaccaugugguugcugggauuugaacucaggaccuuuggaagagcagucggugcucuuaaccgcugagccauuuuucucaccagccccaaguuugacaauucuaacuggagucuaggcuucuuagccuuuccuauacuacacaaaugagggcaguguguagcccgaugccuucaucaggcaguccacuguccuguacucuggcuuauuguuuuguaguuuccccuguuguccagcgucuccgucuuuccacuuuaacuuaacuuuacuuuacuuuucuuuuuuucuuucuuucucuuucuauuuaucucuuucuuucauuucuuuauuuugauuuuucaagacaggguuucucuguguaucccuggcuguccuggaacucacucuguugaccaggcuggccuugaacucagaaaucugccugccaagugcugggauuaaaggagugugccaccacugcucaccccacuuuaacuuucagaguucuuccuuuguuucuuuguuuuuacuugcuggagguugagagcagggccuuucaugugcucugcauaugcucugcuacugaucuguuccuuuagccccugcugucucuuuaaaacaacucuuacugaguacuuaggauauugagaaaauugugacuaaagauucucuucaccguugucaugagcagaucuucuuuauguaggugucugcuuuggugucaaauacuucagauccuucccugucccuuccucuaaagugggucaccccacuuuauuucagcgcuuuuuaguuucucagggaacuccaguccucugcagcaugaagaguacaggaugcaguauuuuccuggaccuccugauuaaccuuuccuguuacagugaccauuauguguugugaaacccuggaaucuaccccuucucauuggcuuugugaccuugggcacugcugaccuuucuaaucugguccuguaucugugaaaugauacuugucuaguuugucugacaaggaugcugggagggacagugaagagacuucugugccagcuuuguagggucugaggacugggcagaaaacucuuucuugcaggaauaggagauacuauggcuuggguuggugaagguggaaucccuaagcccagguagaggaaugcagugacauuuaaaggaacucagaggaggagaguagguagaaaaagauugauugguucauacugacuuuuaaugaaguaccgguauuuccuggagaaccaugggagaaaccguucuuauagccugcugagcaggguuuuguguggcuugggcuuuccuugagggaguuuuggauuaaugguugcaugucccuggucuucaguaugcauauauucugacuuuuccaggccuaacauugaguagggucacaccaaauacauaagcaguacagaauacaagagcauuaucagucauuucucagcuuuucugugcguauguguaaaccagaaauugauauuguucucaguuucucucuaucauaauuucugagacaagaucucucacuaaauuggagcucacugauucagcugaacaggcugucagcaagccccguuugcaccuucccaggucuggaaugccauacacgugcacauagcuuuguaccucagugcuggauaucaaacucagguccuugagcuuugcagaaaggccuuuaccaacugaaccauccccuagcccauuccauguucuuaauucuguuaaguuauccucuuuccuuccucuaggcaaggacauuaauaaacugaacacuuacugagaacauaaaaacugauagaauaaauauaugcaaaauaaucauaaacuuuaugucaaaggaaaauuuccccugcugacaaauucuaguucugucaucuuacucuuggggcuuuuaucucugguggucuuuaauguagcacacauguaaacaggaaggaguagcugcagcuagggaaaagguagucaauauuuguguccugguaaaguguaagagggccaagcagagcaugcuauggggccaggacagacaggcacuugucguauuuucuuucguuuucucucucucucucucucucucucucucucucucucucuuucucucuuucucucuuucucucucucuaccaaagucucacuauucaugguagcaaaugucuuuaauucuagcacuagggagacagacacagguagaucucugacuuaaaggccagccuggucuacacauugagcuucaggacagccagaacuacauagagagacuaucuugguuaggauuuuacugcugugaagagaaaccaugaccaaggcagcucuuauaaaggacagcauuuacuuggggcuggcuuacagguucagagguucagugcauuaucaucgaggugguaagcauggcagcauccaggcagacagugagcuggagacggagcugagaguuuuacaucuuguucugaaggcauacagaaaacuggcuuccaggcagcuaggaggaaagucaaagccccauaaugacacacuuccuccaacaagaccauaccuucuaauaguguuacucucugggucaaguauauucaaaccaccacagagacccugucucaaaaaagaaaaggaucucauguagcucaggcuagcccugaguguauuggguaauagagguugaccaugaauucaugaucauccugccucaucucccaagugcaugcaccacaccagcuguguugaguucauacauguugucuucaugcaccucuuuuucuuuuccuuuauuuuauucauuaaaaaauuuuuuaaaaauauuuuuggucuugagacaauauagcacugaguagaaggaguuauuuggacuggucuugagaugcuaagguuauaggcaugggcagccagcaugcucagguccaggcauguauuccaguaguuagaugagggagcaggccuaggagaggucauuccucuuugaaguuaguuaucuccauaguaaaaauggaugcuuauuggaucauacuauauuagaggcaaauuaccuuuuaauauuugggagaguaagguuguguucacuucauggaacuggguaaggggaagcucaaaauguagaaguuaggucugguccuauaucucaaccccacgcucccaaaaauaagacucacacucaaacuauauuuacagauaccuuggccauauagcuaugcucuugucugacuagaucauaacuugaaauaaccuauuuauucucaccuacauucugccagguggcugguuaccugugcuuagguaccaugcauaugucucucaucauaucuuccuggcaaaucuccuaugccuggcacuaucucagaauuuuuucugcuuggcagauguuccaucuccuaccuaagcuauaggccaaauuuauuguugacaguucccagauccauacagacagaagguauuaucucuacagccaugugaaguggaaguuuuagagaagagccugcugcuacugagcuuccaauuuauuauuuuagaaagucuccauaggccaagacuaauaccuuuuuuuuuuuuuuuuggugugugcggagcaggucgagagucucaugcagcccagguuggccuugaauuccagaucuuggcuucucugccuugcaaauguugggauuacagucaccacaccuauuuuccugaugaucuuugaccucuugucauaggcugagcccuacaugaacuuuuugcaagugacccacccaccuaguauugcugacauuccuuauuaagcauuccuacuugaggggaucuaagugggaggaguggguggcacccauaccaggcugggcaugcuucacguccugguagaugauggaaaacuugcccaggucaucucuggguugauuuccucuugguugaagaucuugccacuguacacauccaccauccugcccaucgucuugggcagggugaucaugucccucagaagggucuucaccaccuccagcuuccccaugaguggugccuccuucuuggcuuuucucaggugcucaaguagugagugcugauucugcugaaggcugcagguguuguacauguucuacaguugguccagguccacugguggacuuggggaagguccacguuuucugccccacuuuaacugucuuggcagcugcuuguggggagggggggaggaaagcugagaaucuuauauuuauuuucugaccagagaucuuucugcuguugccugauggugaccaaggcugugucuaguugaagauggguauuagccauauugagguuggggacuguggguauguuauuaucuaccugcugggaagaagccauuuaagcauucuuuaggcuaauacuuucaguuagauacacaaggggacauuuuuaaggaauucuaaugaaccuuccaagcuucaaaugggcaacuaaaaucacagagccaagcaggucauuucagagacccaugugucccacuuuuuucuuucuuucuuucuuuuuuuuuuuuugaacucuaccuuuuuuccucaacuguuuugaugucccagauguguuuagugcugucguugccuguagacucaacucuugaggguucacccugcuucaagugccuacacaugcuugcccuaguuuuuccuugacugcugaaagccuaguuuguucuaccuaaaagacccauccuuccuguggcugagcuggguagcucuucuuccaggacagugggccaucugucccugaaagucagugaagagaaggaauuucagaagagauugcuugaaggcuuguuucccacuagucucaacuguguaggguaggaacaacaugaaugcuuauggaauaagcauucguucccaucaaguagaauguuagaaugcacaggauucuugagucugucuaacauacguuuugugagcaccgguuauggcagguugagguguugugguucuggggcuuauuauuggguaguuagcuuggauaaagacagaaguaaccaugaaaauauuggccaaccaacuaaaucagcauuuuauuuucacauaaaauuaaaacagaccauuuuucuagaaucccucuggcaacaagaauaguaaucuuaaauuguucacuuccucauucauuucuuccaaagaaauaauccaaguguguucauacucuggugaaaugaggaugcucacuacugcaucacgggauggagcuuuuuaauuuuuuaaaaagauuuacuuauuuauuauauguaaguacacuguagcuguauucagacacaccagaagagggcaucagauuuuguuauggaugguugugagccaccaugugguugcugggauuugaacucaggaccuucagaagagcagucagcgcucuuaaccacugagccaucucgccagccccacuuuuuaaauuuuuuuaugauuuauuuuuauuuuuaaauugugugugugugugcguguguguaggaaagcacaugaguacacgcacccuuggaagccagaaucuccuggagcugguguuagaggugguugugagcugcuggaaauaggugcuggggaucaaauuuaaauccuuuauaagagcaauaugugugggcuggagagauggugcagugguuaagagcaccaacugcuuuuccagagguccugaguucaauucccaguaaucauaugguggcucacagccaucuguaauggaauccuccucuaguguaucuaaagacagugacaguuuacuuacauaaaaaacaaauaaauaaaucuuuaaaaaaaaaaagcaauaugcucucuuaaccugugagccauguccaacuucuagagugaaaccuuuucccccggcuccccaccccccaagacaggauucuauguguaguccuggcuauccuggaacucacucuguagaucaggcuugcaacuuaucaggauauauauauauuuuuuaaagagcccaauggugguggcacaugccuuuaaucccagcacuagggaggcagaggcagacagaucucugaguuagagggcaucuuggucuacagagugaguuccaggacagcuaagucuaccuggaaacauccugucuugaaaaaaaaaaauccuuccauuguugaauguguuccaccauaccuauugagaaaugugugucagcaauuccaguacuugcugcaauuccaggacuucaaggccagcccuggcuacacaacuacuagguccugucuuuaaaaaagaagauaaucaaggagaguguaaauucauuaugcauuccauagguaaggaaauagacaccuaauccuagagauuaggguuaaaagggcuugcuccaacuaucaauucguuucucuuuuuuucuuuacauuauuuuacuuuuaaagauacuucccaugaugacuaugucucucuuuuuuaaaauuuauuuauuuauuuuuucaaaauacccuccuuagcaggaguaccaagagcuucugaacuucuuaccuccaccugcugaacauaggaauggcauaguggaaguguacugggccaugcuaccaacaaagcugcaccccaaaucuuuuuguuuuucuuuuagagacagggucuuucuguguaucccaggcugcacuuaacauacuccaaggccagucuacugaguccugggauuauaggcaucuacaacugugccugggcuucuauucugcucuuaaaacaucucuucucuucucuucucuucucuucucuucucuucucuucucuucucuucucuucucuucuuucuuucuuucuuucuuucuuucuuucuuucuuucuuugacuacuuaagcagucuuuaaugaaagccaugcacaagaugucucuacuccugcaucuuuucgaucauuucuuccuuguaauugcccuucuccuuuccuacuugucgggacuuggcuuuccucuccaggaucuucuugcuguccuuguccagcuuuagucuggugauaaccauguugcugggguggaugcccacauggacaguugugccauuagccuucucuugauggacucguucaauguagaugacguauuucuuccuguacacuugaaccaccuugccaaucugcaggccuuuguaguguccgugaacaaccugaacuucauuauccuuccgaaugggcauagaccgaacguuauacuuuugucucagcucuuuggaaagaggggaagacgugaucuuccuccgaaugugagagggugcauugacaugccgcuugcgguucuugcuucggucagaagucacgaagggauugaacuucauuuuggcagcugcgauccaccgauggccgcaaaaggaaagagcuuucuuuuucuuuuuuaacauuuuuucuuuucuuuuuuuccagacaggguuuuucucuguacccugaaacucacucuauagaccaggcuggccuugaacucagaauugccugccucugcuucccuggugcugggguuugaggaggaguacaucacaaccagucagcuuuauuuuuauguuauguguaugaguguuuugucuuugugugugugugugugugugugugugcaccaugugcaugcagugcccauggaagccugaagaggguaccagauuccccagcacuggaguuauuguggcuguaugcugcuguguggguacugaguuauuguggcuguaugcugcuguguggguacugaguuacuguggcuguaugcugcuguguggguacugaguuacuguggcuguaugcugcuguguggguacugaguuauuguggcuguaugcugcuguguggguacugaguuauuguggcuguaugcugcuguguggguacugaguuauugcggcugugugcugcuguguggguacugaguuauuguggcuguaugcugcuguguggguacugaguuauuguggcuguaugcugcuguguggguacugaguuauuguggcuguaugcugcuguguggguacugaguuauugcggcugugugcugcuguguggguacugaguuauugcggcugugugcugcuguguggguacugaguuauuguggcugugugcugcuguguggguacuggguuacuguggcugugugcugcuguguggguacugaguuauuguggcugugugcugcuguguggguacuggguuacuguggcugugugcugcuguguggguacugaguuauuguggcugugugcugcuguguggguacuggguuacuguggcugugugcugcuguguggguacugaguuauugcggcugugugcugcuguguggguacugaguuauuguggcugugugcugcuguguggguacuggguuacuguggcugugugcugcuguguggguacugaguuauuguggcugugugcugcuguguggguacuggguuacuguggcugugugcugcuguguggguacugaguuauuguggcugugugcugcuguguggguacugaguuauuguggcugugugcugcuguguggguacuggguuacuguggcugugugcugcuguguggguacugaguuauuguggcugugugcugcuguguggguacugggagccuauuucaagguggauguagugacuuuacuuucugggcuuuguauguaggaagagucagggcuggauuaggauguggccucuagcacauucuccugagcaguuuccuaaguuuacauucucacaacacugucaggaaauuguacuugccuggcauuugcacuugguguuuucaaaguaucuaccuuuauaacaagcaguacuuuuaaaugugagauccucucugggacagugacaguaggacuagacaggaugguuucaggagaaauccuaugaagaaaggagggguuggauuuggugacuguauaccugugcaucuguuagugugguugcauacaugagcaugcagaggaaagaagggaggcacaguguugugguaaauauuauuuggaggauucuaccccaccuuugaucauuuaguucccaaauaaaagacauaaaaccuuuauacuuauaagaagccuuuaagcaccagauuugggccaguaucaaccuucuauguuauuuugucuacuuccuuguaaauaacuuagagauaucauuugccauguuccaccuggguugcuccuacuccaacaugcuggcccucauagugcucacaauccaccuacccuauggugucuucuuccuacuuccccacuguccucucuccuccuccuugucccugccuaagaccccaagccugggaacuuugcccugcccccuuucuucugcccagcccaggccauaagcaucuuuauuaagcaaucagggauaacuuggggggacagaguauacacaacaaaagcugauauaugugaggaucucuucauuuuggagcaaccagaucuuggugugcaggauuuagcauuugaacauauagccacaccagaccaacccacuacaccagaagucaaauauccacccuuauagagaaagccuuacacuguacuuauucugagagaugggugcaagaugaucuggguuuuuggguaucaguaccaguacuuucaaggagaaaugucuaaacaguagcuuggaaaagcacacuucugaaagggguauaggaugggccugcuguaugaguagacccaaugguuuuuuaaaaagcagggugaaugguucagaguuuguccuuggaacucaaauaaagaagaaaggaagaaucaagucuacaaaguuacccucuaaccuccauacugcccauauuucucuuuuucuaucucuguagcccccccccccaaacaaauacacauacacaguaagauuuuguuuuucauuaaaaaagaauaaagacuauuaugaccaaagagggaucacuuaaggugguucuguuugguaagcaauacagauaccuaauuuagagaccagaagagaagggagcaggggccaaggcuuaaccaccucuuagguaccuacuacauauacuaccucagaagcucaucucugcccuuacugaaccuccuccgcuuaguuuccuagagaaggacuguggguugaggggaaucagacuuugacccccuuggccucaaagaacuaacucugugacagcagccucagcccugccucuuucuccuguuuuggucaguauagccagaauuuuggguguagcacuucauuccuuaccagauaacauuauauauaggggauugaaaauuggaaguguuucuguaaucucuuugcccaguuguggucauuauugaauaaggaaacauuuccccuagaccuguaugcuaugucuauuuuguugguagauguauacacacauacuuuucugaguccaguucugagcuguagguuuuucuuccugucugaggcuguuuucucugccucaguuaguucuggcuggucccuguaugcccacagcuuccauucccaagggggcauagaccaugcauagccacuugugugggaagccaacuccaagauggcgccgguuuccgguugccauugucauaaacaacaccacugcacaggcgucaauucgaauuuggcgccaaccccuccugagcgggugcaugcaaauugggugccagcagacugaccaaucccagggggccacggagccuucuccugugcuggggugcauauaagcagggcucccugggcgccugggguccccauagaagcaucgaggcguuccugcaauaaaggcuguugagaagaaucugacugugucguguuguucuugcuggucggacacacuugcuuaaggaaagcaucauuuaauguuuuuuggggaagaguucuucuaugguuguugagcauuucuagaaguggagauaauaggaauuuuuuccuauuuccuuugagagguaacaauguauggccaguguucuuucacaugcauuuucuauucccuucuggacuacuuuaacuuacacccaggaugccaugugauuuuaguugugagugcugaucucuaaagauagggcucccugccccaguaccacaaaaccauguagucagaguguuaugugaguuugcuugaugacaguugagaugugcggaagccccaggcuaacauaaggucaggcaucaaaaggucuuuccagcucuugguucuuuuuuguuuguuuauuuuuguuuguggcugugccucacuacugagacucuggcuguccuggaauguacuauguagaucaugaacucacaggggugugucugccuuccaguguuggaacuaaaggccuacaccaccacuccaguuuucuuauuuagguuaaaccaacagguugaaaauagcugaggcucaugccuuugaggcagcucagaguuugaagggcacaggcucuucuuuagacuaacccucauugaccucagucacuggcauuccugggagcagaaggagaguucaguugagcagcugagagaagugugaagaaaaaaugugcaagucugcucucuucaaguccaaaauguccauuccuguauauagaugaauaaauucugaaauauauuauuuuuguaaaccugggccuggagagaugccucaaguaguugggaguauuuacugaauuuucaaucccagcacccaugcagcaugcuggguauguuacaaacacaacuguagcuccagcucugaauaguugaacacucuuucugaccucuguguguguaaagauguacaccuacacauaugugcucauauacacacgugaaugacugaaucuaaagucaaggaaccugcuaauguuugaaaaccacacguuugcuugcuaauaaaaggaagaagcuguaguauaguuuggcagauguaccucagcuacuaccugugaggucuagaguccagguguuugcuuugguggccaaacaauugcaaucuccuucuaaggugaaaccaccuagauacugagacagugaauuggcugcugcgucauuaggcgcugggcagugaugugggacacuguugcuccaaagagccugaggaggucagaagauuagaugagaaccaggccugugugggaaggacagacagaccucuccaucuggggugaagugacacauuggaacugcagcuagaaggcacuuuucagcuguauauagauguuggccuuaccucccuucaagucccugccaauuucagcuuugugaccugaagaaugcaugguuuguugauagaaaagaagcuucaugucuuuuagcugacauaggaaggguuagaaaugugaaucagcagggaauagagccuugccuagcaugcacaacccuggauuccauccugagcaccacaaagaaaaauaaaucagauuuuccucaacaguggcugcuguucauuugugacucucugugacauauacucuucuuaagaaccaaaagacauuuuagcuuauacucacuacgagcaagcaaauuuccaagguuuugaacuagcuuuaagccuuaagaagcuuuuuauuuuaagauuuacuuuaaauuguguuucaggguguugugugaaggugccugaggccagaagaggcugucagaucuggagcuguaguugcagaugguuguaagccaccgaacacaggugcugggaagaaccuucugagugaacucuucugagagagcaguacaaaguuuucaccucugugccauugcgccagccccaggaguuucuguuucugugccacauuaugugcauuuucucuuuuuaaaaauaauuguuuuaaagucgggcgugguggcgcacgccuuuaaucccuguacucgguaggcagaggcaggcggauuucugaguucgaggccaaccugguuuacagauugaguuccaggacagccagggcuacagagaaacccugucucggaaaaaaaauuguuuuauguauaugaguguuuugucuguguguguguguguguguguguguguguguguaucacauggcacucacuuguggcacauaugguagucagaagagggcaucagaucucuggaacuggguaacuuuagaauugugaaccaccaugugggugcuggaaaaugaaugugguuccucuguaagagcaccaagugccauagagucaucucucuacauccuacccuguguccucugucuuaguuagaauuuccauugcugugaagagacaccaugaccaaggcaacucuuauaaaggacaauauuuaauuggggcucauuagcaucaugguggaaagcauggcaguguccaggcaggcaugguacaggagaagcugagaguucuacaucuucaucugaagacugcuagaagacgacuaguuuccaggcaacuaggaugagggucucauugcccacccucaaagugauacacuuccuccaacaaggccaaaccuacuccaagaccauacccucuaauaguaccacucccugggccgagcauauucaaaccaccacacucccuuuuugaaacuaguucgcacuaugacagaccuagaacugugaagucugucagccucuaccuccugaaugcuauguuuaaaguguaacaccauccccaggcuaggcuagcaucccacccuacuuuuugagacaaggucucauucuauaaaccuggcuggcuggucucaaaguuacuugaucuucuugccuuagcugcuuuauauuacaggugugagcuaucaaaccuugcuaauuuauuauuauuaaugacaguaucucagucucuaguccagguggaccuggaacucacucuguggggcagacaggcuaaaacuccuugaaaucaguugcuagucagagaacugaggugauaagugugagccccacauucaucuuucauuaauuaguguguucccccgacccccacacccgcaaauaaccuuauuuaucauuaucaaaaaucuggauuuuaaacagauucuaagacugguaguuuuaccugucagcucauucaacucccacugcauguaucucuucaccagcagcucugccagaccuuccaccugcaacaguggagcucucucccagaucagacuugcucugcuucaccauuugcuuuuaggcuuucuuuuccaaugaagacacccgaagaggauaaagacuggcaagccuuuuccgucucucccaguuuugggauucaacuuaccacuucuuugaagucaugugucugccccucucaggucaugauuucugucuucuccuagcucugguggaccugugggaaggucuugcauaucugguuauuaacacauuuuuuugguaguaauaccagcauagaagagauagagaaauaaccaucucuucucuuuauagcaacaugagcuucaaucauggucucccuuuuaaaucauggaccacauuuuguccuggguaagauccauugcccugaacauccucaguaaguagcuugauuguucuaaauccaacuuuguugaaauguagaucagcaaggcucacuuuaagcauaugaccuuugagguaaucagaugcaguuuugccuucuugagcccuugugacuacuguuuucuuguuuuuaaugcugaacauugcuggagcugucacgugacaccagcccuucucaaaagggaucagccaaaaucuuccugguucccuuuuuccugccugcuucuuuggccguuaugucagacacucauuuucccuaauugcuauggugcugcucagagccagaaguguggaaguauaacauucuggagacuuuaggugagcaggugucuuagucauuggguuuguuuguuuguuuguuuguuuguuuuguuuuuuaguaaaauuccaacuuuuuugaacaaaagaauaaauggguguuuucaaguuuuugcaucaugguuauuuuuaagccaucugaaccaugauaguacuuaucaacacaagauguuugucuauuuuugucauuuguauuuuguuuaauuuuacauucauaaguauacuuaaaucaauuagcaguauaugguaacacaugguaauaauggaacagcucuguaguaacuuugugcaaauuugaauuuuaugcaaaaauuuugcuuuauuuuuuacauuacugggaccuaaugucagcuacagacagacaaacacuucuguauucuaucucucagccagaacaaacaucugugacguaacauuuuuauuauucaagacuuccuuuuuacguuuucaguaagaaugccauauagccuuuucugaaacaaaaugucuggggugcuaaugaaggaaacaguuuaauaaguuuauuuauuuaaaucaguaagaaauggagaaucugcuaucuuuacuuaaaaggcuguguaaauauuuaucugucaaaacuauauacccacaugaacaaauaugugcaguucaacagcacucccuuacuggaacacgagcguuccacaucacaguucccauaaggacuuuuaaaagccucaaaaucugugucuucucuggcuugcuucucucuggguuccacccacgcuuuauuaaugguucacuuaauaucauugucuccgucuucauaaauuuucuuuagaacauuucauuaaucccucacuagggucugccucuaugucguuggaaggcuuuucuuucucuuugcauuccuuuuccaucuuguguuuucugcuuucuuucuacauagaauaauuacuguauccgucuuuacuuuuuuuugaacugcuuuccacagagauagguuucaaaagauuguucccaaucauggaguaauucuugccauugagguuuuuuacuaaaagauggagcaaccucucugugaggugcacugcacguucucagugggaaccugauggacucugguuaagguaauguagauuuucacaaacuuaucugacugaucgcauccauaauuacagauuuucacgguguauccuguuguaagaggagcaaccacagcagcuggcuuuucauuaucaaguucugguuucuucugcgacuucuuuugcaucuuguucuugaguuccgucucaaucuuggacuuuucacuuguaagaguaucacguagucuuuuccuaguggacuuuuccagcaauacuuugaccucuucuaggucuuucuguaacucuuccaaaggaagcaaugauguggcucguuagacccgaggccgaagcugcagccgugcacugaagcagaugggaaaagcugaacucgccacccacgagcagcgccggcagugagcuccacccagcaugacacggcggcccacccuccacacaagacggcuagucauuguuuuguugcuaugaagagacacugugaccauagcaucucuuauaaaggauaucacuuacuuggaacugguuuacaguuucagagguuuaguacauaaucaucaugggaguacacaagcagagauguugcuggacaaguagcucagaggucuacaucuggauccucagguaucaggaagagagaagacacuuggcuuggcuggagauuuugaaaccccaaagcuuacuccuagugauacacuuccuccaacaaggccacaccuucuagucccagccaaauagugucaucaucagacaaccaagcauucaacuauaggagucauaggggccauuuuuaucaaaccauuacugcaggcaguuuuauguauuuauuuauuuauuuugguuuuuugaggcaggguuucucucuguauccuuggcuguucuggaacugacucuguagaccagguuggucucgaacucagaaauccacuugccucugccuccaagugcugggauuaaaggcgugugccaccacugcccagcgcaauuuaauuuuuaaugacuuaaaaauuuuuuguggcuggacuuagugguacaugucuuuagucuuagcacugaggaagcaaagucaggcagaucucugaguuugaagccagccaaguuugcaggaccgccaaggcuauauggugagggucucacaaagaacaaaaacaaagaaguaaauaaguaaauuuauuagaguaggcauggugguacacaccuuaaaucccagugcuugggaggcagaggcagacaggcagaucucggaguuugagcccaauguggucaacauaguggacauaguuccaagcuagcuagggcuacauagcaagacacugucucaggauguguguguguguguguaguguguguguagguguagagacugugucuuaggguuuuacugcugugaacagacaccaugaccaaggcaacucuuacaaggacaacauuuaauuggaucuggcuuacagguugaaagggucaguccauuauugucaggguggaaaccugguggcagucaggcaggcaaagugcaggaggaguugagaguucuacaucuuuuucagaaggcugcuaacagaauacugacuuccaagcagcuaggaugagggccuuaaaaacugcacccacaaugagcacucccugggcugagcauaucauauacaaaccauaacagagugcaagucuuccucugacacagcuuucuccuuccuuccuuccuuccuuucuuucuuucuuucuuucuuucuuucuuucuuucuuucuuucuuucuuucuuucuuucuuucuuaacgauuuauuuauuguauauaaguacacuauagcugucuucagacagaccagaaaagggcaccagaucucaauacugaugguugugagccaccaugugguugcugggaaucgaacucuggaccucuggaagagcagucagugcucuuaaccguugagucaucucuccagcucccucugcuuuaguucuugagacaggguuucucacugccuggaagccagcaaggcccaggauccaccucucucuguacuuccagcacuuggguuacagaugagugcuguugcaacuggcugcccauauagcaccaguguccagacucagagucucaugcucauaggccaguacuuuaccauggugccauuuccucagccccuugaaauuuaaaguauguaugaauugcaaaagucauuagcccuuuacucagggacucuucucaaagguagcaaccaccuuugacucuugcugugucuucuagccugugccuguguucuuaguagcuugcaugugcugcuuccuuguaaguugugugaaugauaugcagaguugcucuguagcuggacagucucuuaucucuggacugcucccaguguuugacugaguaaaucaguaaugaauguucauauuuuaugucuauacaaacagugcacugagcacagaagcauacugcacuugauaguuguucuugccuuugggcaguuggggggugguuuucugguuacuuguugcuaauucuuccuaugccuuuuuuacuuauaucucagcacaguuaaccuugggcuucauguucucugucaguuguuuuuccugggaccuaccuucuagagccuguuggugugauaaggauaggcauuagggccuuuuccaaagacuaagucccacguggucuccaugggauuguuauacacugugaagaaggagagaggaguggugggcagauccucugaaugcaugaagcaucagagacgccuuuccuugucucuuuuagaggugaugguaaaaaagauggcaaaguguugaauauuuuucuguuaacaagccuacaaaaucucugucauccgaauacuggacaccucuucuuuacuugucuccuaagacuuuauuacuagugguuuggguuuaaacauucagggagagggggcucauaugcaagcugugggcuucuauccuaggugggugaacaaaccauauacacagguagugauuugccagcaguccacuuacauaauaggugugggcagaaauuccuagcacuuagcaaguggaggcaggauggucagaaauucaagguuauccucagguauauaguguguucaaagccagccugggcuucaugaacccugucucaaucaaaacaaccaaccaaccaccaacaacaaacaaagccaaguaaucccagcacucaaacggagagucaggggcucucugaguucaaggccagccuggucuacagagugagcuccaugacagaauugcauagagagaccccaucugaaaaacccaccacuaccaacaaaacaaagcaaaacaaagaaugaaagaacacacacacacaaaacccuuaaaaaauggggggucgggcacuuuuuuuuuuuuaaucugagaauggugauuucugacacccaagggagaaagaaaucuuucuauguuagacaucuuuaggaaaccagaagagcagguacucuuucccuucagcagugugaaagaagguaggccaaggaaggagccuggcauugccugggguggaggacaguaaugaagaaauggagaucaaagacuccuaauugagagcugggaagggguccuugggugauaacuagggcccuaagaauggggaauggaaaagaggaucagggaagaauuggaggaaagacuaaucuguguuauuagcacagccaugagaggguccuuugugcuugagugguagacugguccacuguugaggauaccccagaugaaucagaguccaaauggggacagcuuugccugaagaagcuguaggaacucacugguaucucaucugggcagacuaauauuuaugugugauggaaguauuagaggauuccaccucacugcacaguuaaguagcucuggcuggcauggaaucauauagaucuggcuggccucaaauucacagagauccacucaacacugccccacagaaugcuaggauuaaagcagugauucucagccuccccaaugcugucugacccuuuaauacaguaccuuaugaugugaugacccccccauccauaaaauuauuuuuguagcuacuucauaacuaauuuugcuacuguuacgaauuguaauguaaauaucugauaugugaccccugugaaagggucaguucaugcccagaaagugguugaaaccuacaaauugagagcugcuagauuaaagacuugugcuacuaugcccaguccuagcaggguuucuuuuuuuccuuuuuuuuuuuucuuuaagauuuauuuuuguaugugaguacacuguagcugucuucagacacaccagaagagggcaucagaucccguuacagaugguugugagccaccaugugguugcuaggaaaugaacucagaaccuuuggaagagcaauuagugcucuuagccacggagaccucucuccugccccaguaugcucuugaguaccaacuggacugggcuuuuaucccacugugaguugaagcccagaguccccaauuuucugacuuguuugccaguaaacccagugcuacaagaagacaggcagugaccaaccagaguagccaguauuucaggcccauagccccaaguaauauguuucuuucuaucagaugcauaccuguucuuucuuuuuagaaaauauuuauuuucuuauuuucuuuuauguguaugaauguuuugccugcgugaaugcauaauaccaagugcagugcccucagaggcagaagaagauacuacauuuccuggaacgaguuacaggugguugugagccucugugugggugcuaggaaucaaacucagguccucugagagagcaaugagugcucuuaaccacugaaccaucucuccagcccccauaaccuguucuuucuguguuguguguacagauagagggaggcaguacgugcucucugagcucuggcccaugugcauagcucuuuccccuggagugugaaaaggauaucuuuuacuaggauaguccuuuuucuaucuguauauaagauauguuuucgauguuuguugugguuuuacaauguacauugguguacuaucuccuauugugcuuaguaguuagaaguuggagcuggucucuuugguuccguuaugaagacauuacuugacauacacagacucuugccuugcgaggauugggauguggcuuguguggacuguucauuuuauaggugagaaauguagaacugcagucucacaguacucagauguagaauuggguaggggcucaggcacucacaggccuagaaauagagucuggcuagccacccacugaccuaaucaauagugcugauugugagcaaucucuugggacagucccccuguccuuaaugcccaggggcuucucuuuucuuuaagguaauugccuuuucuuuucaaccuucuuauggcccugcccuuuuucucaaauguuuaacucuggccacugcccugcugagugccucuccuugguuccuccccaggacuucagccagacuaguuccccagggauaguaccugucuaccaggguggacuugguaauguuuugacacaucucuucuuuuguauuucagugaggaugccaugaggaaagcugguguggcccacaguaaaucuagcaaggauauggagagucauguguuccugaaggccaagacccggguaagacccugcuggccaaaguccccagcagaguaauuccaggaggaguguguugcugauacugagccccuucuacuuguauccuggagaggggagugcuugcuugcugcucucagauacagcuggcuuugccacaacacucuggaaccucccauguuccauggaagaaaagucaagacuccuagauuggcacuucugcuacaggcccugccucugacccuggccucauuuuugaccaugucauauauauguaguuggcccugugauucccacaggaagcuccuuggauccuauaaaagagaugcuggcuuugugcuacacaucccugaggcaggggucuagagucaucuuugguuucucuguucagggaggcagccaaugcuggaaaaguugaggguagaacuugccggguagaauuggaagaagacuuuccaggcuaguacagcaccagccucuaugugaccuucuuucaguguguuaguucucaggaguggaaauuagaagugaaggaagaggcugaacgauaacucagcaauuacaagaccauacuguucucgaagacaacucaaguucaguucccaguacccauguaggaugguucacagcagccuaaaauuccauggacaccugugcucacaugcauaucaccuacugaccccaccucacuccauuccugccccaaccucuacacccacacaauuuugauuuaaagcuggaugcaugcuuuuuaaucuuagcacuuaggaggcagacgcagguggauuugaggccggccuggugccuggucuacauauuaaacucuagacuagccagggcuauaagugagaccuucuccaaauaaauaaaauaaacaaucuauuuuuuaaagaaaaagugacggccuagagagauggcucagcaguuaagagcacuggcugcucuuccagagguucugaguucaauuccuagcaaccacaugguggcucauaaucaucuguaauggggucugaugcccucuucuggugugucugaagacagcuacaguguacucauacauauaacaauaaauaaaucuuuuagaaaaagaaaaagugacaaaaaauagcagaaaaugaagugauauugaguagagacagacaguguguuuuuguguacaaguacauggacagacagauuuccagagcuaugggcuccucuguggauggguaacauacauuuguuuucuuugaaaagcauuguugagauugaauuaagguauaucaaauucacucacuggagguauauaguucaaucaugcaggguagaguuagagacuuuacacaaguuuguaggcauuagcagucacacuccauuuccuggccaccagcagauacucaccuacuuuauugcagugggcuuucccaccugaaguugcuuuaucagcauagucagcaugacuuggguuuuuuguaacuuacuuuuuucacauagcacaaucuuaucaggguucauacauugaccauguuguagugcauaccugauucuuuuuucuucuuuucaagccaagauuucaugguguagacuagacuagacuggccucaacagagaucaccuacuucuauauuaaaaaggcaugugccgcugugaccaucccugaucucucucuuuguugagucauauuucaucuuggauggcuguaucauuuucuguauauugaugaaucagacuucauuugagugguuuucauuuuagagcuaucaugaaaaaugacuuauuuuaaauacucauguacuaggggguguuguuguuuuugucuugagacaggauuucucuguguagcccagguuguucuggaacucauucuguagaccaggcuguccucaaauucggagaucugccugccucugccuccugagugcugggauuaaaggaaugugcuaccaccacccagcuucaucuacuaguuuuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauacaaaguuugcguguccaaugggccucucuuuccagugauggccgauuaggccaucuuuugauacauaugcagcuagagucaagagcuccgggguacugguuaguucauaauguuguuccaccuauaggguugucuacuaguuuuuuguuuguuuguuuguuugucuguugauuugaagacuucuuucauuucucuuaggaaaacaaaaacucuguacauacuuggggcucacguuucuaaacuguuuucucgaguagcuguguugugccaguucacaagccccaaaagaccacaaaggagcugauacugaugcagucuaacuagggucucuuuuauucaagcuuggcucacucaccaccaacccugacacagcaggauggucgagugcagccccgagcccucagugggacaagguuuuauaggaaauggugagcuaagaggggauuuuagcccggcaagcaucuaguugaaugacugcuguaagacuacuguaaugacuacugugggugcucugaagcaaaaccacaaacaaucacaaaaggucugaaaggacaucucagacaaucagaguaaucuugauuggcuguugcuaggaaguagcuaggggguaacucugggguauggggcaaggacaagccaugggguucuuccugguacuugggugcagcuuggguucagcugcaggucaaguucucaggcucuucuuuuuuuuuuuuuaaagauagaggccagucccaagauugaguagguuuguccucuaagcugugugucaucuaccagccacauaaggcucuguugcccccaacaaucaccaaugucuuugcuauguccgugugugagaaguggucaccagugcuucugauugcuguuugucuucguagugaugaugucacacgucucuguagugcuuuugagccaucuguaaacauucuguggaaaaauguccauguuuaucuuuuggucuucuuuuaauugacuuguugaucuuuuuaguaguuuuuuuuuuaaagauuuauuuaguuauuuauuuuauguauauggguacacuguaacugaacagaugguugugagccuucaugugguuguuggggauugaauuuuuaggaccucugcuugcucugguuggacccacuugcuccagacacaccagaagagggugucagaucucauuaugggugguugugaaccaccaugugguugcugggauuugaacucaggaucuucagaagagcagucagugcucuuacccacugagccaucuugccagcccuaguaguuuuuuauauauuuggauaccuagaucauuuaauuugcaaauaucucagagauggaauauuuuauuguugaggucuauggugguggugggggagggggagggggagggagggagguuacugcucuugccagguacuugggcaaaguacuuuaucacugagguauauccacagcccuauuaugaccuuucuuuuauuuuugaaauaugguuucucauauaccccucauugucuuggaacuugcuagagcaagcugaccucaaacuuccagaaauuuguuugcuugucuccugagugcugggauuaaagucauacacuacagugaaaggaauuuugguaaagacguaauugaagucggguguaauggugcacaccuuuaaucuuagcacuuggaggcagaggcagcuggguuucugugaguuuggggcccauuuggacuacauagugaguucuaagacagcuggagcuacauacauaaugagacgcuguaugugcuggggcugcgagguggggguggggacagauagacaggaccagaugacaacaacaaaaaccugacuugaaucauuuauuuccaaaauguaaauuuuguugguucagcuugcuuauaccagucuaaaacuuaauggcuuaaagguauaacccuuugguucuccuaagucagugggaagcuucacucaugauugcaugucccucuaaccuacaugacucuuacagugucacuaguggcauaacuuagaccuuauuaugucacuguguuuguguuucuggagggaagagauggaagcuuuuagucuucagaaguccuagaacauucuuuggauaccagaaguuuaaggccagugcaggagguucagagagaaacugccucugccuuuuggugugaucaggagccuguuuggaccagggaguacaaugacuaucgcauagccaccacagacaccagccaacucagaccuuuccaguggcugaugaauagguaccaaaggaggcacuagaggucagccuuucaucugugcaguucacucugccuugucuuugagucacagccuauugacuguuauaaguaguaccuugaugauuucuuuugaagcugucucuaacucccugacuacacaaggaggcccugacuaacuggaagagaacagauuguaaaagcacuguuggccagucuguauuuuuguuuuauuuugcauuuauuuauuuauuugagacagggacucaccaugacgcuuuugacuagccugaaacuuacagauaucaccugccucugucucccaugugcugggauugaaggcguaugcccaugccuggaaaucucuguaguuuuucuggacaguguguuugagcacugacaucugacugcccucuuuaccugcucuuccccauggagguaggugccuauauuguagugagaaccuuucaaauuguggaagaagggaaugagcuuuccuugaaauccugacaagcaugcagguccacaagcacccaccaccugaaggaagccaggauuucauuaggcgcgcuggcuguccagugcagacucauggcaaggagaaccaugaauguucuugucuggaaguguguaccacacuuuugguugguggugggcacaggcguccacugugugggcuuguguguaaagcucuccucauacugacauuuucugacuucacauuucaugacucacuuauagacucuaaaguuaugugcaugauaaguccauaugacaaguacuuaaaauauuugagcccaccugauuccccacucagcccuaugaagugguagauuaguuacuuaucuugaugcugugacaaaauaccuuaaaagaagcaacuuauggaagaaaggguucauuucccuuuacaguugaagggcauacaguccagcauaacuagaaugcaauggcagcaggagcaugaggcccauugcagcuacagccaggaagcagcagaugcuggcacucaacuggcuagcuuuuuuuuuuuuuuuuuuuuuaaaugcaguccaggacaccagcccaaggaaaagugcuuccuacagcuagacugguucuuccuacuucaguuaaacuaucuacauaagcacucauagacaugugcacagaggugucucuuuggugauuccuggucuuaacaauauuaacuaucauaaguaguuacagauggacucaaagauucuaauucccuacccagacuaauggagaguagggagugacugagggguuugggugucagaacugacagccaugucucuuacuaucuuccaucuaccaaagcacaaaguauaaaaacccacuuaucccugauguccuuaauaccugugaguugcacuccucucucucucucucuaaaggagguuaagggagaaaauacagucaagaucuggagugaugggccguguuaguaauggaagcuucauagacucugaccugggggacagaguuagcacucauuggaugagaagacgucaccaaugcauagcaggacuguagcacacacugucuagagaacaagauucuuucugucccauuugaauauaucuuucgcuauuccacuuacuugcccagaggugagacccuguaaauacucuauguaagagcuuuuuuuuuuuuuuuuuuuuuuuuuuuuuuucugucuaguuuuguuugguugguuuguuuuagacaagucucuacauagguuuggcuguacuggaacucaccauguaggcccggcuggccauaccucuaccuccuaagcacugggauuaaagucauucaccaucacacuggccucaaacucauucagauauaaguucuuauauuuaguauuauuuuauugacaugaaugccaaaagaauccauguacaagagugacccuuuugcaaauugugcugugacaacuggauugccauauauauaagauacugauuuagaccuuaaauucacucaguguacaaaaauuagcucguuguggccauugagaugguuuaguggguaaggacauuugcugccaggccugaugaccugaguuugcucucaggagcuacauggugaaagaacaugaaaggcagggaaucuaccacaugccagaauuaaacugguuaacucuuuugaugcagguacugcugucuuccuaaauccaguuuacuccuugcaauuuccuuugaccacacauucuaaacauuaauauuucucuuuacacuggauuuaacaauuguuucauuagaaauguuuugaguuggagagauggcuuagugguuaagagcacugacugcucuuccugagguccugaguucaauucccagcaaccacaugauggcucacaaccaucuguaauggggaucugaugcccucuucuggugugucugaagauggcuacaguguaccuacauguaugaaauaaauaaauaaaucauaaaacaacaaaaacaaaaaaaaaaccacucuaaaaaaacaaucuuuuuauucuaucugaauauuuauuuuacuaaaauacauuagaucagcucguugcauggcuuauacuauauucagaaauuaugaauuagauaaauuaucuuuaaagauaauaaaauaggggcuggagagauggcuuagcgguuaagagcaccgacugcucuuccaaagguccugaguucaaaucccagcaaccacaugguggcucacaaccauccuaacaagaucugacucccucuucuagagugucugaagacagcuacaguguacuuacauauaauaaauaaauaaaucuuuaauaaaaaaaaaaaaaaaagauaauaaaauaucuaucaugcuuuuaaaaguucagucacucuuggcuauguaauaaacagaagcuguuaucuagcucaagaccacaaggauuuuugccuauauuuccuucacagagcaaggucauagauucagaccccccugcccacucacucccuugagacaggguuucccuguguagcccuggcuguucuagaacuagcccuguagaccaggcugguguugaacucagagauccaaaaagaaacacauucaaauaacagcauuuauggaaagcuucagacuucaacuaccuggaaagaauaagacucccuuaauuuaaauacucuaagucaaaauaaucuuccauuugaaagaugauaauaauaaaaaagcaccagucauaaguggagcacaugccagggcuacaaagacuaucgcaaaacaaacauuauuuggagugaguuucaggggaaucagggcuacauagaggagaucucucuuucucuccgucucucugucuuucucucaaaaaaaaaaaaaaaaaaaaaagcagaauggagaggcuugagagaugguccaguagcagaggaccugaguucaguucccacccccacccucauauugagugacucacaacugccuacaacuccaguucuaggugauaucauauucucacucgcucccaugagcaucugugcuugugugcacauaaacacacagagacaauguaaaauaagggguuugagaaggagcucaaugacuaagaacaugaaaugcuccugcagaaaaucugaguucaguucccagcguccacaucaggcagcuccaaccaccuguuggcucuagcuccaaagacaguacccucuucugucuucagcuggcacugcucuuaugugcaccacccuucacauauacacauaguuaaaaauaaaaucagagccaggcgaugguggcgcaugccuuuaaucccagcucuugggaggcagaggcaggccgauuucugaguucgaggccaaccuggucuacagagugaguuccaggacagccagggcuauacagagaaaccuugucucaaaaaaccaaaauaaaauaaaauaaaaucagagauauuauugguucuuuugggacuuagaguaauaauaggaggcaaggugacaguaauuuaacacagucuguuuguccugcuccuccauauuguggauugaaccuaggaucaucuacaugcuaggcaagugcuugaccacugaguuacucaauguuuuuaagcugugaagaauauuaauacaggauaaaggauuuuauggagagaagacaauuuuagaguuaacaguucuaaaguuuauucauuagguucucuguauaguguauauuguuaacauaaauuuaagauaauaaagcuggcaugguagaacacguccuuaaaccucugaccucuacuugcaugucuguaucuuguccacccacauacauauaaagucaaucagaauacagacuuuuuauggauuagaggacacaucaaaagagugaaaggacaacugcuggcauaggagaaaauaugaauaauauuuucuaguuuauauaaacaaugcuaaaaaauagguaaaggauuugaauagauauuucucaaaagaagguauaaaauagacaaugugcacaagaagagauauucaccaccacaaaugguuaaagcuagugagauggcuccgugggugaaagcugguaaaagcagugcaagagaaccaacuuguaaagucugacccucacacaugugcagugacacagggugcucacacauagcauagauagacacaugcacacauaauaaaauacauuaaaaaguagacacuuugagagguagacauagugacauacucuuagaauccuagcacuugguagacugagucaggaggauugccacaaguucaaggccaaucaaagauucugagauagugagacccugccucaaaaacaaaacaaaacuccaaaaccauagugagauaccaguuuguaccuauuacgauggcuaugauuuuuuuuucuaaaggaaauuuaguaguaguagugauaaauguagucccuguuacuugggagcuguggcaggaugauaacuggagacaagcaagguaauauuacaagacccccauuaagaacuaaaaaaggcaagaagcaguguuagcaaaguauagagaaagcagagcucucauccauugcuggaagaauguaaaaugguacagcugcuauggaaagcacuauaaugauuucucagagaauaauggcccacucuuuguauguacuccuagguguuauuuaacauaaaugaaacaugacuauuaaaaacuuguacugauauguccauauuaucauugauaaaagccaaaagcagaggggcuggagagauggcucauugcucaagagcauugucagcucuugcagaggaccagggcucaggugguggcucauaacacugguaacucgauuuccagggcaucugguucccacuucuagucaccuuggccacugcaugcacauggugcacagacauacaugcaggcaaaauacccauacacaaacuaaaguaauaacauuaaagcccaaaauagagacaacucaaaugucuaucaacugaugggaggauuaacagaauguauccauaucuagcaauacuguuugaccuuauaaaguaugaaauguuaaugcugcugggcagugguggugcacaccuuuaaucccagcacuugggaagcagaggcagguggauuucugaguucaaggccaaccuggucuacagagugagcuccaggacagucaaagcuacacagagacccugucucgaauaaaacaacacccaacaacugcaucuugugugcauuuggauaagcucuguaacggucagacugaugaugaauuacuaguuuccuauggcuggcauaguaaauacugcggacccagaggcuuuggugcaagucucauggcuuugucuguggagagucuccaaggcaguuugcccauacacagcccuagcaugguccuaggugcccaguacuugggagaugcaugaaauguauucugucugugagaaagcucuguaacuaauugcuuucugugucccauuccucucucuuggucuauagagcugaguugaaccuuauuuaagauugucauacuguaggccaggcaugugcugcugggcaucuccgcaugcugugucuacaccccuggcucuaggaaucgggguuuuuuauucuuuugucccagccuauguguggaaaagacuuaggggacaugcuucuaugcuuugucuauuguguccugggucuaaguaaacauaggucauuccuucugaaaccuacuccuuccaggcaugucuuucauggugguaggaaaaaaaaacccugccaaauuauuuucaagauaacaugagaagauuguaccaaucuuuaacagaaagcacuugccuggcucuaggguucucuuccacugguccuuggcaauuucauuuccauuccuguuucuucagccccaaauaucccuuguuucccacucaccacaagaugauacuuuggauccuaagccuccacagaucucuguuuguggagauuuuguucaccauucucuuuucagucagaaauugaugaggcauuggaaauguacccagaaccucuuguugacaggaccucuuucauuucccucucuuccagcugugccuccuuccucacucugacccuaccccuuagagauagauuucucuggcuuccucuucuuacucuaugcugauuccuuucguugggaaacagugagaaauggagucuauugaaaagauagagaacagcugaagauuuguauacucacucagucuaucuucaccuuuuaucuuguuuucaucuuccuaucuuugucaucucgucaucucuaggugacucuggagagcagucauacagaagaauaguagauacugagggauuuucaguacagggaaagauagaugucaugggauuguaaaccaagcaucucuuuguuggccucaguauagacucauaguaguaauuucccuacaacacugaagugaguguccuuagauggacagaagauagucagaagaagcaagccccacugggcaguuucuggaaugggacagcauagauagggccuguucaggcaguggucuucaucugucacauuugaaauguguuugcucuuucucucaucugugcaacuaacagaagagcauucucagucaucccagaaauuuuagagagcuuuggagaaggaggaaggaccauaucucucuuuuguagcauucaugcagauuugugugugcauaucugucucagcagcaggggaaaggcuacuacaauguugucauagaaagcaaaucacucacauaccaguaguguaugcuugugacguugggcugaggcuuuggacacgacaaguugacugccuuguaaaaagagggugcugccugugcccuuggguuuuggugagggggcacagagucaguggcacugacucugggagcaggugugaaacacugcagcaagcacauaugaacacugcuacaaaguuccuuuaauauccgccaucugugccccauugguccccaaaaaagcaauuuuuuccaauugucuggcauugucuuuaucagcaauuuuuggugucucaggucgucuucaauuagguccuccugcaggagaugccuuuguggcugcacggccccuggcauuuacguaccuacaagaggggacuuucuuaccgcagugcucuguacauuaggguagaagcccucuacacccuucuuaauuugugcuucucagggggaaaaucauugacagcuccccugcgagaaauggauuccagaggaaaccaguggugugaauagcuguggucaucucaggcaguuucagaggccaaggcuugaaggaugaaacucagcuggauggcugggcuaucaagggcuggcaagggagagucacuugucuuugcuucuccauuugggauuaaaguacuuguguuuuuacuuuuaggaugaguaucuuucccuuguggcccgacucauuauccauuuccgagauauucguaaguaugaguuuuuauuucgggauaauugugguugcuuugacaggccuguuuugugacuguguaguagggacacucaaaguaagccuuagcaccugaguuagaacauugcauauuugcugcuucaggauucccuaccuuccuaggccucaaaugugggacucaaagugauuaaagugggcugcuuuucucacuuauccauuccaucuccuuuguuaagauuuaacauuugccucuggggagcccuuaaguaagcaguuuaccuuguaacagggguuuauucccuaaaaguugauuugauuaauccuaggaggccugaacuguguguuucuaugaaacuggaaguuuuuaaaguuaguucccgggucccugcucccucucuuugcugugcugaggguccccuuacuucaacucuugauuccucugauucagugaguacuauuguggugcuguuagcuggcaggcaguucccugacuuuucagaugugaguugccauaaccuccuggggcaagauucuuggcacacuuauguuaggcagagguauacaaggguugguaaacacugaguuccaauuuacagugcuccucccuguuguauaagcacuagacaggcuuauuuugauggccucauccuaauuccugcaugguuuggggacagaauauagguaguuguugcagucacagcuucagugucaggccacugagagcucagugaccuuggcuccacacgaccuuuuagaaaaauauuauuuuauuauuuauuaaauuauguguuugucuguggggggguggguuacgcgcaugugaguacaggugcccauggagcccagaggcagcaggugcccuggaucuggagcuacaggcaauugugaggugccagguauggguguugggaaccaaacucuggucugcugcuaguggagugcauucuuagccaggugugauggcucagaccuuaagucccagcacuccaggaggcagaggcagaggcaguguaaguuugaggccagccagaaauacacaaugagauccugucucaaaauaaagaaaaagagcaauucauguucuuaaacagugucauagugucuacuguucugauaaacacaugaccaagaguaacuugaggaggagagcauuauucugucuuucaguuccagguaacaucauuauugagaacaucagggcagguacuaaagcagaagccauagaugaguccugccuacuggcuggcucucaagacuggcucagccugcugucugcugucuuaaagcauccaggaccaccagcucagggguggcacugugcauagugaggugggcccuuccauauuaaucaucaaucucaaucaagaaaaugguaucacugguuugcccacaggccagucuaauugggggcacuuucucaauugagguuccuccucccaaaacaaaacaaaaugacuaccuugugugccaacuugacacaauacuagccagcacaaacguugaacugucucuccagcccaauuccacaguuaauuuuuuaccacaauggccagcgagguagacuccauaagaacuuaggacauguaggggaagagaaagccuuaagagagucuauacagcagucagcuggaucuccuggcauggauuuccacgcccagcucuuuaggaugguggccugagauacacacagcccacaagcucaugugcaaggacuaaguaggaggcuccugaccaccauuuguuuggguacuccuucugggagacaagguucguagccuugagcaacuuuagauagcaacuuguagguugccucacuuagaaaaugagauaaugccacaauagagugaccugaaaguggggaugcuugaguucucucucagaggugugcuuacagccccagccuggguuccuaucacuccuguuugugauucaggaucugaguccugcaagaaaggaacagcucagagucuccaagcucaggauguacuagccuugggcacagcucacugagauggaccccaaguuucuuugcccacgcugcuuccagacucccuuuguaugcaacagugcuaggaauaggucucuccucucuaguuauuaggguaccaguggcuccuugggauugaggcucuagauucuguugaccuuguuucuauguaaggucagcuuaguuuuagccaaugaccucuggucagcuaccugcagaacugaccuacccagggaaaauguguguucaugcaaaacuguuuacugcgguuuuguguuuauguuucucuguagauaacaagaaaucccaagcuucugucagugguaagucuuccuucugagguacaguuauuuccaaucuccaguauggugugacagaaaugagauagugccugugugcaugggucagcuacauauuggacaggagcauuccaaagaucucagguguggugguacugauuacuguuucgcagcaucugcuccacagucugaaggcaagccagugcuuuuccauccuguuuuauuuagaaggcuuugcugcguuaccuaggagaaccacuguggcauaguauaauaacccauaguauuuugucacacauaaaagcugugggaauucacuuucucuauuucacucauuugggggaggaggguguguguuuugaaacauguucucuguauguaucccuggcuguccuggaacacuucauugaucaggcuggcaucaaaucaauagagaucuaucuccaaugccuaccaggggcugagacaaaagauguguaccacuauagccaacuguauucacuuucuuuuuguuguugcuuugguuuuucuguguagcccuggcuguccugacacucgcccuguaguccagauuggcuuugaacacaggauccaccugccucugccucuugagugcugggauuaaaggcauacacaaccauuacccaacauuuucacuuucuuaaguuacaaaauuguuuaugaguucagaaaucuuucuauuuuaauuucaagguuuaucauauaagggaaauuguguccauucaauugaaaccuggacuuugcuuucugagcugccuucauaggauuugccaaucuacucuggccagcugauccucagccugucagaaagauugugagguucugagagagagugcuugccuaucgugugcaggguacugagcucugucugcagaaccaccaccaucaaaaaaaaaaaaaaaucgcauagacuguguagcugugcagccuacccuagaccuagagcuguaaguagccuaagccuaaauagcucccuggcccagaacuggucaagugcguguagccuggagaaugcccggcuucuguaguguugaagcauaggcucauugggcucgacccaguucuaugaccagccaggugauaccugucuauagguaauugcugugaguuuagacuacuguaaugauggcaucugacuccuuguccuuaguugcggcauugcucacugaacuacagcugcuguccugaggcuuagugggcauggcuuugccccuuagcacucuguggagccuucccauacuccuucaccugcucugauauucugcuucuggccucagaucuguguuggaguggugcguaggcuuagauuuucaaauccuauuuuaauaaggguucuuaaacacuucagccuucuuucuagcccaccaaccaaagguagaagagaaagaugguuuauaggacaagggcgauguggcccuguuuagaaguaguucucuggggcgaaccuguuuucauaucggcagucuaguccaaaacaucaaacacgaaucaguaguggcagugcaguacagucuaguacaggcggcaagcaccuaacacaaaccaguagcaaugacucaauccagaagaaaacacaagacucagccaaauuggcaggaguccuuugaaguggcaagaagcagcuggaaugccacaagaagcucuauaugaagccacaacaagcagcgaucagugaagaccagcaaaguguugcaaggcgaaccaaugcaagagcgagcgccguccacuguguauuggguuagacucaugcauaucauacauccucucaagugucugccucagcaaaacagccucucacaagacaguuucuagaaaagcaucucacgauacaacugagucucuaaggaaacccgaaauuucuacuucagugcuguucuagagagacccaggugcaaaaaugcugcauggagucuacuugugcucucccuagggagugucugccuuugcccucugcuucucuaaucuagccacuuguuccugccugcuggaaauaagggccucauacuuuggugucucuggaagucuguugugggcuuacucuguaggagaucuggacagagaagaagagucugguugcugguugagcuugagggcucagcccaucuucagugcagcugugcacgucacagggcuccauuauaauccacauuagaacacugacacaggcuggacugaaacauggaguaugcucucugguucugagccucauguuccagcaguuccaagucuugggcccagacuuggggaauuucaggccucuggcuccuacuuguuugggaauuugaaugggucaagcacauaaaggggaggggguccucuauguccugggagccauuuaccugugagauuacucaguuuggguuccuuuccucaagacauugugcccuuguguucccacagaccccaugaaugcacugcagagccuuacugguggacccaccccaggagcagcugggauuggcaugccuccucggggcccaggacagucccugggugggauggguggccuuggcgcuaugggacaaccacugccccucuccgggcaaccacccccuggaaccucuggaauggccccucauggcauggcuguggugucuacagcaacuccacagagugaguacuacacuccuuggcaggugacacugcaugcuauucuugugcucuccguguuaaugggaaaagugucaaggagcccagauagcucuguuguggacagcagguauugcaggggaaugcucuaagccuucucuaaauucagaggaguagugcuuaccugccugcuagcuaaggcagugaugcugaggagaaacuugguuauuuguaaacuuguggguuuuuucuuugcuuaggguuguuuugguuuugguuuuuagagacaggguuucucuguagcucugacuguccugaaaccauagaccagccuggucuuggacucagaguucugccugccuuugccaacggagugcuggaucaaagacuugugccaucaccaccagcaagguguguuuuaucaguaaaauaggaacuauuguuaagguuuguggacacaaauaagugaaguauuuguacucuaugccccgguggugugcuugagguuaugguacaugcgacuccuuuuaucccguggucagucuggguugugcacugcagucauucauucauuccucuguuggguuccucugucuugaaggaggugcuucgcccuccucacuuguagccuaacuuuuggcuacuuuguugauucuuucuucuucuacccuuucccaccccuuuuucagccccuuaacacuaaguaagagagaaagaaggauagaggugagagagaggcaaaagaaaucccagaauaaagucaggaauaggaaaggggccaacuuagacuacuuccugcugauuggaggcauugaguuccuuggguuaaguuugauuuucaucaucaggaugucuaauuccuucucguuguacauaugacuugacaaacagcaaccaacagcauccaaccagcagccagccaccuguggagcucuagcauguauuuauccucugaaaaguucccuggauuccaaacaccauaugcuugaaaaaacuaucugcagcugccaaaauuauaccucugcuagagcacaaggcaacccguaagucagcugcuguggacagucugaagcggccccaaucccacaccugagaucaaaaugaaagcauauucccuaagucugaaguggccccucaucccacaccugagaucaaaaugaaagcauauucccauauuucuguguuuuuuugaaagaaaccaaaauucucauuacacuauaccucucuguauuaccugcccugauuucuacauacuguuguccuggcugggacuuagguuauagucagcuacauggguauaaccuauacccauguauagguuguuuguuuguggcaaggucucacuauauagucuuggguggccuggaccuugccauguaaaaucagguuggccuuaaacuugcucagugcugcugccucugccuccugagugcuggcuguuuuacaguaagagauugcuuuagaauguugggcuuggagugcucaugugaucugucuuguaauccacuccuacgaauuugucuuaaauaaaugauuuuccagagauuuggcggagaggcuaugguguccugacaguauccucucuccaucugaccuuggcccacauccuguuagcauccagggcuggccuauuggguggcucugcuccacuucuacauccuauaggacucuguugacagcuacuuucccuuucugcccuuggcccuugccuccuagauucaccugaaguacguaccaguggccuccugcucugucuuucuuaugccuucugcaagcacuuuuauguauuuagccaagaucaggucuucaagcaguguuacuaaaagaucagagccugggucagagauugugccaaaaauagaggcugccgcucaacucaguguuagaaaaccucuaaagucaucagggcccuggguucaguccccagcacugugagcaggggagguaaauuuggaaaauaaauuaaaguauugguaagaagaacuuacugcuaagcccagugaucugaguuuaauccccaaagaccagauuuuagagagaacugucuucuauaaauuguccccccaccuuuacgcguguaaagccacuguaugcauguguccaccauuaaauaaauauaaaaaaauuuuaaaguauauuaauaauuauauguaauaaguugaaaauuauucauaaacaauagaaauaauuuauaaauuucaaagcaauaggaaaaagcaaaguaagaaacaaagcaacaaauaaccaacguauaaaguucaguacaguuaucaagauagacccuugaaauucagaaacgcagcagcuggacggauggcuccgcagucaacauguacugcucuugcagagacacagguucuguggacuggcucacaacuaccugugacuccaguuccagggguccaauaccucugauugugcaaacaccugcauucauguauaacacccaucccaugcacacauaauuuaaauaaaucuuuaauacaaaacagaaaagcagaaagcuuagcaaaacgacagagaaaggcuugggauguagcucagugguaagcuugcccaucuacugugcauguccugcauuuucaacuuauagaggagggcagaggagaaaaagguaaagcugaguugaaaauauaaguagucauaaugaaaugaacuuagccguguguguguguguguguguguguguguguguguaugcguauguacagguguauguucauagagaccagaaaagggcauuggauucccuggaaauggagguacagacuguugugugcuggccacagcaggugcugggaacugaaccugaguucucugcaagagaagcugagcucccuuauuuguuuguuuuaaagaucuauuuauuguuauaugugaguacacuguagcuguccucagacacaccagaagagggcgucagauacccauuacagaugguugugagccaccaugugguugcugggauuugaacucaggaccuucagaagaucagucagugcucuuauccucugagccaucucgccagcccagagcugagcucucuuaacugcuaagccaucucuccauccccaaguuuuucuauaaaagaugaaaauagaucuguuuuauuaauauuuuucaacuuauuacauauaauuacaaaugcaaagcuuguuacuauacuuuuuaaacuuuuuacacuuacuugaugguccacaugcauacaguggcacacaugaaaaggucagacgacaacuuauagaagacaacccaaaauguggguucuggagauuaaauucaggucaggcugaguaguaaguucuauuacauuuaagagacaugccuguaguguaagaacuagaaaaguaugaaaauaaaugguaaagauguauuagacaauuaccuaagucucauagguaauggcuaauuaaguagacaaaaauugguucauuagaaaauguguuuuaguuuucuuauguguuugaguguuuugccugcauguauguuuguguaccauauauguaccaccuacugccugugggagacagaagauugcaucggucucccucaauugcuguuauugauacaagcaauacauguucuuacugagccauauauuagaaaagauuuuaaugauguaaugaauaacuuaauuaaaguacaggauggaauaaauguuuauaaauauaauuaugaaauaagccucaauaauuucagaguauugugguccauauuuuuucugaguaucagaguuagaaaagguaaauuuaagaguucccaaaccuaccaacaguggcuaaaagaaauugugacagcaguguuagugauggaaagacagucauucauguauuucacauaagaauguaaguaaaauuguucuuugaaaaugaagcaugugggagcuggaggaauggcucaguaguuaagagcccuuguugcucuugcagagguauaguucccagcacccauauggugguucauaacuguuuguaacucugggcccaagggaccucuucugccuguggucacugcacacaugauguuuacagccauacgugcaagaaaaacauccauacacauaaaauaauaauuaauaaaccauuaaaaguuaggcauacagggacuagaaaucuggcucagcaguuaagggugcuucuuauucuuccagaggaccugaauuuaguuauuaggcaaccacauuggguggcucauaaucacuuacaacucuaaauucagggaaucuaguggucuuuucugucaucggugggcaccuaugcauauguggcauacaugaauacagacuuacacauauauaaaacaaagccuauagcucaacugcuacacuuuugggggcauuuaucacagaagaaugaacuuuuauaugaaaacuccaugugcaaaccuucauaguuuuauuuauaauagccugaaucugcuguuuccucagaucuugcaccauguaaauagucagguuaggaaguauccauacugugauuaaaccauuuggcaaauagagggaaggaacuacugaugccaccacugcaccuggguuaccagaaagucauauggguggguaaaugccaaucaccaagaguucauacuagccucuuuuaaaaauuaugguuuugcuaggcaguugugguugcacggacuuuauucucaguacuugagaggcauagccagguggaucuccaugagugugaggccagccuggucuacagcccaaguuccagguagccagggcuauacacugaaacccugucucaaaaaacauuauauacacacacacacauauauuuacauacguguguaaauauauguguguguguguguguguguguguaauuugguuuuuugagacaagguuucaguguguguguguguguguguguguguguguguauuuuuuuaaucugucagccaagguauuagguacuaggcuaauaagcuagcccuccuugggcugccccgcagguggaaaagguagauccuagcuuagcaggaagggcucucaggugggcucuugauuuuauagcacauuuguaaaaaucuuauuuauuuauuuauuuauuuauuuauuuauuuauuuauuuauuugggaggagaguauacauggcacagguaugugaggaagucagaauaaaacuucugggaguugauaguccugagacuuaaggugaggugcugaggguguuggaacuauugagugucuuacaaugauggugacugaacccauccagauccaguugugcucuugucauuuuaaccacugggcuaaguguacaaaagauuucugcuauuuuuuucuauuagcuuuauugaaauacaguucuuauuugcucauucaaaacucaccucacuauuaguggcuuuuuguauguucuuaaguuuacagcugucauccuuauccauucuagaacauuguuaucacaguaccucaagcauggaaguagcccaaauguuuaucaacuggugaauggaugaauagaccaaauauggggguacaauagaauguuauuuagcaauaaaaaugccaaugaagcuaguacccuuccacaaucuggguguacuccauagaugcuauccaagcaaaaggagugcacacaugcucucugaugcuauugugugcaguguucagauagccauacccuuagauaacaguauauuauugcuuuccagaggcuggauacuuuuggucuauccaaaagacucacuuggcccuuuucuacuugauuguuagagaguaauccaugaugguaaauuccauaaucagcacaaaugacacuuccuacuugaccugucuuccucuaguauuguguuuagcugucacagauagcuuugucaguaggcaauggcuguugcugccucccuugucaugucgcucugggacaccugcaggguggcacagccuaagucuggaugcccauuccagcucagcugcagcuccagcaaguggcauugcagcaacagcagcagcagcaacaacaacagcaauuccagcaacagcaggcagcacugcagcaacagcagcaacagcagcagcagcaacagcagcaacagcaguuccaggcacaacagaaugccaugcagcaacaguuccaagcaguagugcagcagcagcagcuucagcagcagcagcagcagcagcaccugauuaaguugcaucaucaaagccagcaacaacagguaccaaguucucuugucacuauacugggccuuaguccuguaguccuugagccugggaacaagugucacccaagguauuauuagguggaaggcuaagcuagcccuccuccuugggcugccccacagguggaaaaaguagacccuagcuuagcaggaagggcucucaggugggcucuugauucuguagcgcagacccucucuauguguagcagggucuauaaacaguacagauaagcuaauggaauaaagaaggaggcaaacacucuaagacuugaaaugcuugaguuguguuccuggcacauucuuuugaggacacauauaacuccucuuuuguuucuuauuuggugucagaacuaaaauaauuaguaggacaguaguaugccacacuagaagugcugcuugucagaaguuguuugauccuucuguguuuuguaagcagaaucuagacauguucauauccauuuuucuagcaaguguugauugaaggaaaaaagcccaaggaaacuuccuccauuuuuuggccaucccuggcuuuggaaucuccuuuucccgugcuagcuguugaucuuuagcuuugcauguguuccuuauagcccauccccaugagggucauacuucugaccacugcugacuacuccaggagaaaaagagccuuucuauagagguacaagcaucugcaguugccugaacuuaggccucccugcuguaggugugugucuauucuuccuggacccuccuugagccuguuucacuugaauuaucuuaugugugaaccagccuuuaguggccaggacacaagacaaauuugguuuguucucagugucuagaaaacagcuauuguuggucuagaggacuuaguccugaauaugccacguuccuuucacaauaugagaggccaucaggccagccuccacggaggaugagcuuauuucacgugcccaggucucguucggucaaggcuagcauccagggguggaaauggucacuguuauuauuuuaucuuuagauacaacagcagcaacugcagaggauggcacaguugcagcugcagcaacagcaacagcagcaacagcagcaggcuuugcaggcccagccaccaaugcagcagccaucaaugcagcagccacagccucccccuucucaggcccuaccccagcagcugucacagcugcaucauccacagcaucaccagccaccaccucaggcucagcagucccccauugcucaaaaccaaccaccacagaucccaccacagucacagagccagccuuuggugucacaagcacaagcccuuccuggaccgaugcuguaugcugcccaacagcagcugaaauuugugaguacccaaagccuaugguguagcagaugcaugucuuaaggugcugugugugguuggcaauuucuuagacccuuuggauguagguagcauguccuuuaugcacuggcuucaggcauccuuuccugagcuggucuaagcuuacaaugauuucagcagcaucugcugcaugucugcuacacacaauuagguuaagaggaaaucucaccauguaggaggauaugcugcaucugccagcuauuccguggauuucucuuucuguugauaccaggggaugacccugggaacuucaugaaaacuaaacauguggacuacuaugaucuccagucccagcccuuuuagccucaucauuacuacauuucugaaacagauagucauauaaaacuuuauuuccugccucauugugcaucuugauuaaagucagugucaaaauauuuacagagaaugaaauuuugccaccaaacuucguuacaaugaaaagcaacaauuugagcaucuucucugcucucuugguuuuuguggucuuuucuaccugugauacauuaagagacauggugacagggacuucaccugagcuaaaagucagggugaaaaggggucagcgggcgggguuguggguugcaggaacauuuacuguuacccagaaccagccuacugggaccagaaacuuugugugcuccuuggcagacugccuacuaggauugggccuggaagcuuggagagauguaaggagaagcucccaauguggaucuggccaaggucugcccugucccuguaguagugucuccacaugguacucccauagugauguguguuuccucugucuuccauugccuaaggucaucuuucuagcuaagcuaucugcuagcuggccagccugcuuuccuucacggagucugggcucuuggggacacuuguagacugagcuggcaggcuguaugcucagcuuuggaaguuguugcuuagcuggugauugcaguugguguauaugagagggcugucuucuuucuugucaggacuggggaggugggacguggcugauaggcugguaugggauauuggugaccaggcacagcuuacgguguccuuacaguccuaucccaagaggaagcuucuuguuuaaaaaaaaauuuuuuuuuuuuuggguugggggagaagaguuucaugugugccacaauucgaguauagaguucagaggacaacuuuucaagagucaguucucuccugccaaaugagucuuagagcucaugcccucaggcuugguggcaggcaccuuuacccacucaacuaucucaacagcucuguaaguucuguucuuaaaggucccacacugguagugagugcucugcucucugugcagaugguuccaaguugcuuuuuccuuccuccuucaagguccgugcuccgauggugguccagcagccgcaagugcagccccaggugcagcaggugcagccccaggugcagccgcaggcagcagugcaggcagcacagucugcccagaugguagcucccggcguccaggugagggccuugggagcccaggguuuccugagucucuagcaggugcaugcuggccuaugcauaaagcucuguggagaguucucguugaauuagagguuaaguugauaaaguauaggaaucuucuaucgcuuggacacauguguacacacacacacacacacacacacacacacacacacacacacacccugaggcccucagggugguuguuucugcuuggucuagaaccuauucguugucuagugugugucauuucuguuuuuccuuggguauccucaucuuuccuacauuauagcacuuggaggaagaugcuuuagagaagaaagcuccaaaguuucauccuacuucagcuuccccuggggccucaacacagauggcugagcucuagggcagcucuuuagaaagugacaggaacaguaguagcuaucuuuugaugcucuggcaugugccacagcaggagcagggagagagcauccugugcaaggaaagcauuuacauacaacgucccuaucacugacaguccauagccauucucugcauagcagaugucagugcgaugacagccugcaggaggccuaggcuaccuuuucuuggugucugaggaauuggacaucuagggucccuguaauuugugucaaagauaugcuucaucuuuguacugccauaauucuucccaucaugugggcacacugagaguccugauuuggggcuuaguuaggagcuauggcaaggcucuugauggauccuauccagagaaaaugcuaugacuacacuguguacccucagaaggccugcacuggcuggcucaugagcuaggugaguucagugucuaggugcauggcagcauggguuaggugcuuuaggaugugucagacauuuuauuccauggaggagauccccccaaguguuagaucugggaugaggaaagauguuuagucggccucuuuugucacuguacuagcugaccuggguccagggcuccugugcuaccuauacacggagauauaaccucaugugagagcaugucaugaauuuccuaugucuuggggaggcugaauacuugaugggauuccaguccauuucccgucaucacuguguaucucaggcuucugcuggcuucuuccauuuguacuauguagagaagcuguggcuuagaaucagcacaguagugacacagaaccuucccugaugguggaggcuauuuucuuguugcuuuaugauccucccuccacugaccuggaagagauaaaccucuaucuauaucacuggcucaacccagucagaaagggagauuguccccuuucauccaucucagcauuguacagcagguagccaggaaaagacaacagaugccacugguuugcaccuguucagauugcuugcuggcuucuugcuggaggaaguguguauccuguugcuagccagcuuuauuggugucuugucagccaccagaaccaggguguggccauguguccuuagagcuccaaagcaagccucuguggcaagugcagggcuucccauaguuccuggcccuucucuacuccugugggaauauggccagcacagucaccuggagcacacagcuugguugucagugucccuuuuaccccaauggagaucaguggcagcugcaguaaggcaggcacagguccuuccucauugguggaacagagagaaauugucuuaccugggagugcuuggugcuuugguuuauuuccucauggaguuagguuuuaaguacugugcuaucaguguuucaagaagugucacccacuugccauuuuuugggccuuuuguguguguauguauuccauguccucccucccucccucccucccucccucccucccucucucccuuccuuccuuccuuucuauccuguuuuuuugagacaggguuuuucuguguaguccuggcacucucuguagaccaggcuggcuucaaauucagagaccugucugccucugccuccugagugcugggacgaaaggcgugcgccaccacaccuggcuaauguguuucuaaagcagugugcuucucagcccaaacccaaugcugccuuaggagucaggccugucacagcugacuaucuuucucuuucuuuuugagauuaauauaauuacauuacucccuugccuuucuucccauacuccuucaaauucaugaccuuuuucacuaauuguuucuguguuuguguguguguguguguauauaaauucauguauuucuaauuaucuccuaucuguauaguguuacuuguauauauguauguauguauauauguauguauguauguauguauguguguuuuaggggaugaucaauuaguacugaacaguuggugugcucuucccuggggaagacuuacucuccugcucccagcuuuuuucaguuaccuauauguaggguugagguuucauaagcuuuucccugucuacuuuggcauguccauuggugucaucuuggucaguuuauauuuagguagucauguuggugagucuuuauggguguagcuuuugauguuccuaggaggcacaaucucacagcaaacuccuugacccucuagcuggcucuuacaaucuuuguuuucccaucaucuucuucacuguucccauaaccuuaguugaaggagaguuucacaacucagcauauugauugguuguaguuuucuguaacaauuuucuguugcaaagaggaaaaaaaauuuuuuugaugagggggcaaggacgacacuucacuugcacugaguggugggcuagguucccaguaccaggugugguuucccucuaguuaaguggaucuuaaguccaauuacaaaacguugguugcuaucaggguauuuguaucagugcuguacucugaggguuauccagccaugcuguuccuugacacaguucacagguaucacagauagcuagguagggcuguugguugccucucuccuuuggaaggaguuacauggugcuuucugguagcaugaaaacuaaaccugagacagugggggcauuuaggucaguuccaguuuagggaucugugggcucuguuucugaacugcaugauaucuucauaggggcuuauuuuccaccucugguggggguagguaaccaaggguaacagugauacgcuguauguuugggagucucuuggacagcccuggcuaacaacauaaaagagggcuucuuauguccgcuguugggguuuuguuguguaguuuuugggucuuugagagagcacuacuagcucagaugagaaaaguuuauuaaacuguauguguuauuuuauauauguguguguguguguguguguguguguguguguauguauauauguguauucauggaacuaacuguagguuuuuuuauuuugguaaauaguuaauaugauucuuuguggcuuuuuagacauccuuauuguuauuuuacuuaucucccugcuccuugcuaaagagccccaccuuucccauccccuaccagaacacuuguauccugcuaucuaccccauuuacccuucucccaccuucuccugucuuaucuacggggucugucgcaguugugugggucugguuggcugcucucaacaguguuguucuagcaguguugggcaaaggaguguggcuggguagcuugggcgugacaagcccuucugaagggaagggcccuggaaucaagaguccuuugaaauccagguuucguuaguggucacgaaaagggcugcagcagucugaucugugaaccuuaacaaagcuuugauaacugcagaaaauagagagauguaagagaaacacccagagcaggaaguaguguggcaucauuucagauuuucucacgucacugaaguuguauugucuauguacauugauuuauuuggacuugguuuccuguagaccuagcuggcuuuuaacuuccuauauagcugaggcugaucuugaacuucucauccuccuuccuccaccuccuuaauauuugcauugcaccaugcaccaccauacucaguguaugcaguaguaauggaacaaacuuagggcuuccugcauucuaggcaagcacucugucaucuguguccauagccccugcgcaguuuuauauaugaugcuuuccacauuaauuguguguuaguggcuuucuguuaaaggaaagguuuacuuugccucacaggugcggagguuucagcccacacagcagcuugccccauugcuauugggcgcauaguggaccagcucauaaugacagggagcaugugguagaucacagcugcacuccaggcaacuggaacaaaaagaagagggaggagcucauauccuguaguaacuaauuguccgguugcucuaauaaaauacucugacaaaagaaaugugagaggaguuuuucuggcuuauagugcaaggguacaguccauaaugucaaggagucaagguuacagaagcuugaagcagcugggcacauugcaucuacagacaagaaacagggagcagccaggcaugcuggugcacacuuuaauccuagcacuucuggaagcaguggcaggaagauuucuguucaaggccagccuggucuacauagcaaauugcagaccuacuaaggcuacauagugaaaccuaguuacagagcgaaagcagagagcaguggaugccugugugcagaucccauucucuuguuuauguaguuggaguccuguuacuaaguaacuuagguaagcuaguuaagcuaaucccucacagguauacugcaagcuugucuuuuuggugauuagagaccauugaguugacaacacuauuacuucuacacauacugcccaaaguagaggccuuagccccuacuaaaauuuuagaaugagcugugaaagcauuguuugcaguguugaggauguuuaaacuuggagugugguaagcaacugcucuaccaaggagccucagcccacagccaagcuucuaaggcuugugauuccagaguacccucugcaagcagaaacuccugggcgcccuuauuuugagugacuauaauauuugcugcuguucucaaguauugccuuguuuuuggaucuugaaguaaucuuauaaguguauggauacauucaagacaguuuuuuguaguuucccaggagugagucguaacauggcuuugagggucuuugcacagugacagcaaguuaucuaauuaaucaggagcucaaagaccuagauuagaauuuccaaccuuguguccacauauucugccaguaugcagaaaccacauauugcaucuuugugcauaugaaauaccacacaccacagacuaggccaucaggcagcucugugagaguugcuggugugggggcacuaagugaguaguucuucagcuucauuccuagaguguacccucaguaggaguguucugguagagucuauaccagugcuagaaugacaggugugaugaucugugcaguaaugguggcagggcucuucaccugggcuaaguguucuggaaaggucagccagccccaagaugucuguuuuauauagcuaucuuaucucauuauacucaaguuucugagagagauaaaaucaccuucaauggaacuuucugggguccaaaaaaacaaaacaaaaaaaaaaaccccaaaaagcagaacuauaucuuuauuuuccuacacauuggucucuuaacuuucuguucuaguaauauaaaacuaagcaauaacuugcagguaccaaagaauuaucagccaagucaaacauuugucaugcauguaugcacauucaauauagcuuacuuagaagugcucuuugaccagaccuugacccagagggccuguaucccugugaguccuccuaaauuguugccacaguugggaucuggcaaagcucuauugaguauuagaauuccuuugcagguggcaguguauggagagauagagaagagucaucuuugcaagaguugcacuugguagcugcucaucugauccuguaaagauuuucagugguuuuucucuggaguuucugccucggguaggccagguggggcuuucuuugucauaaagaaaacuaaccagggccuggagagacugcacuggcugccccaggaagugguggugcaugacuuuaaucccaguacucuagaggcagagucaaucagaucucugugaguucaaggccauccuggucuauagagugaguuccaggacagccaggacugguacacagagaaagaacaaaugaaagaaagaacagaacagaacagaguugacuucuuuuaaagaccuguguuguggcuuacagucaugugugacucucucgucuguccuccagggacacugcguguucaugugcacagacacucaugcacaggaaguaaaaaaauaagucuuuaaaaauaaaauaaaugaagcuggagagacggcuuagaaacuaagagcacuuagugcuccuccagaggauguagauucaguucccagcaaccacaugacggcucacaaccgucuguaaguccaguuucaugggaugcaauaucucuucugaucucugcagcuaccaggcauguauauaguacauauacauacauguagacaaaacucauaaacauaaaauaaaaggaaucucuaaaaaguugaaaaauaaaauaaauuuuaaaaguaguuaagaggcuucauaaugauuccuuccuuaaggcuuuucuuguuccuggagacaaguuggcauggcagacacuggcugugaauggaccucccuaagugacccccaauuauaucaagaacccuagaauacauuuuauccccucccccagaguagacagagggcccucaaacaucaacccucuuugugucugucugccagucaccuguuggggaauaggcuguuugagacagcaccccuaguuuggcacccacuaccagaaccaagagguuuguuuggcugguugcagaaauggugaaaguugcccuuucuuggcucuuaggauguucucauuagagucuuguguggugcucgcugcaugcaccucuguaugaugccauagucuuuauaggccuaucucccguuggggagccuucucucuagcauacuuugcugcacagauuggaucugcaguaaggucccacacugauagccuaacucauagccucccaggucuccaagguuuuuuuuuuuuuguacugggaucuuaccauguuaccuaucucuuaacuucagcacugaaaugacccucucacaucugcuauuagguuuuuguuuuguuuuggugucauuuuguucuuguuuguaacauucugagggcauguagcccuugcuuuccaggagucagauuggacuccauccaccaccucagaacacagagaggguagccaucuucaaagccauaacagugauaaccugcccauggcugucauaugacucaagaaacaaaaguuaaccaagggaaaggucucuguuggucuugaagcuccugauucugcagguguuuucugucccuguguggagcccucccucauuagcaaggaagcucuuugggaaaaucccagucucugcugccacccauccgcauuccuccauacuugcagaagcagcaccccagaaggccagauaggucagugugccuucucucuggguucuuuccaggugcacucuucagagaauucaguacuuauuagcaggcugcugcuucagugacacuugacuuuguucuuuguaagccuggcugacuuguccucuuuucaaguuugucccaagaacuuggucuccucaaacugccaccugagcagucuggcucugacaugacauagggucuguucugucuacaguucagagguuuguccaggacaaccaccacaggauacuggcuaguagaauagaaaggucuggcuuacuuucuuggugucuuuaaacuucuggugcuuuccugaaucuggagguguagaacgcucgagcacauccuggagcacccccucccucuacacaucugggucauuugauggggccucaccucuggauuacuccaugaggcugcaaacacccucaccugccaugcacugcaguucuuguugcaauuaccuugucuguugucccucuauccucaaagaugauugcugaagccuuggcccaaggcgggaugcacguaagagcccgguucccgcccaccuccaccaugucugcuggcccgucaagcuccaucucuuugggcggacagcccacaacacagguauuuacagauugggcuucauaugggcucggcccaaaagcuugggguuccucugagcacccccaugaaacauacuuuucauugucagugacuuucuucaggguggcuuucaaagcaguaaagaaauguuaacuuaauuugaggccaggccuugcugguguuuccucccucucucucucucucucucucucucucucucucucucucucucucucucucucucucucucucucucccccccucucccccuccuucccucccucccucccuccuuccuucccucccucucuccuuccuucccucccauacccccucuuucuuucuuccucucuuucuuccuuccucucuuccucuuucuuucuuccucccucuuucuuucuuccuuccuuccuuccuuucucuuuugguuuugguuuuuuugagacaggguuucucuguggagcccuggauguccuagaucucacucuugagacaagaccaaccuugaucuaccuucugagugcugggacuaaaggugugugccaccauggccagcucuugcugauauaucgugaggggcuuuuccucuacuuuaaaauugucauacuuuuguuuucaugguaaaauaaaacagaagacaugggcuggguauaguugccuagcauguacaaggcccuggguuugaucaccaauuuacauguauaaaauugaaugugacagucauucuagaacucaugaagagaguuugaagccagccuggacuaucugagauacuaucucagaagagaauaaccuguggcugucuagggcucugcugaccaaugcuguagugcuccgcagcauccagcuucucaggaagugcacacugcuguugacuuguacuguccagauccacuuccuaggaggagaagcugaacagacugugcucuguacacuucagggccucaugggaauauguuaccauggcccacaucugugcauucguuugcuuaacagcauuccaugugccaagagguguuugaagauuauguuaucacagagcucucuguuuugaggcuuuauuguuaaaacaaaacaaaacaacaacaacaaaaagaccuuuaaaauuccuuuuccuacacuggaaaaguguaucucugauucuagcauauagagucucugccuuugccugagggcccacaagcaggaacuauccucucugcauaaucagacauaggacacuuguguggcuuucuuuaaaggggggucuuguagcucaguacgcauuggauuuacaagcuuggguagaauuguggggauacgccacuuagcagcauagaagauuguuuuuuguagaaauuaaagguccccaacauuuugaggguaugacguaugucaaaucuugagcuagguucuucauguuuagaaucuuguuaguuuucacuguggcaggucauaauuccagcauuuagcuacuuuuacaaauggaaaggagcuguaagggagcguguugaggaucagaauucaaacuuagacaggauucuucuagaaaccccucagccuugcuuuuguugcuggucugacaaccuuguucuuucuccugacugacagaaccuaucugugcaucuuugacuagguucugcaucuugccuccauagccuacugaggagucguuccugcacuguuagcugaguaggucuuaugaucuauaguacuuccuaacccuagacggcaaggaagugaguuagauugaaggaaagagagaggagagaaaggucaaugcuaaaauaaaagguacauuaaaauuuuuggguaacucucaaaguauguuguggcuugguugauggagcagucacugauacaugccagccuaaguccucccagauugacucaucauccccugguaagugcuggcaaguggggcaugcgucccugaagcuuugcccucugcagugaagucaacugcagcagcaugaggaaucugagaugggugcuggccagagggccauggcagcaggagauaggccaggcugggcugggcugggcuuggauuuuuuuaucuuauuuuauuuuguguuuguuuguuuuuguuuuuuuuucuugagacaggguuucuuuguguaguccuagcuguccuggaacuuggagcucauucuauaagccagguuggcuuugagauuuccccugucucugccgccugagugcuaggauagaagauguggaccaccaccaugccuggcuggguuuuuuugucuaguuuuuguuuaguucuguuuuguuuuguuuuaagcacauucacuuuugcuugucuacuuaggggacaaaggcccugagaauacuuaagggagagauaucaguggagaaaacccuggaggccucccuuuuggccauacaguauaacugucuggucucagcccuuccugugaagaacuccccacuuucaaaagggccaggacagcaccauccauauugucugucugugguacauggugaauguuggcuggcaacacuguuccuuggcuagcaagaguguuccuugauucucuggagugggauuccgugguucaggcucaguucugguucgggaacaagggcaaauguaagugcuagaugcaugcagauggugagagaggggcagcguccacgucgccagccugucugagguucuggggcuccccugaauucccacuuucuugggcuuccuucccagccaugcugacaguucccaaugucuaccuucaccauugcaggagcacugcuguuuauagugccugccuuugcugucccugugagcuucuaguucugugacccugacaagugaugucaauguggucaccaguguuccugccuguaacaugcaagugacaaaugguuugcaaugugugauaguuuguaugugcuuggcccagggaguggcgcuauuaaggaaguguggcccuguuggaguaggugugucacugugggugugggcuuuaagacccucacccuaacugccuggaagccaguauucugcucgaagcuuacagaugaagauguaaaacucugccugcaccaugccagccuggaugcugccaugcuuccuccuugaugauaauggacuaaaccucugaaccuguaaagcagccccaauuaaauguugcccuuuauaagaguuaccuuagucaugguaucuguucacagcaguaaaaacucuaacuaaauugguaccagcauaguagaauauuccugugauaaucugacuguguuuuagggagaaaagacuguggaaggacuuuggaacuuuggacuagaagagccauuggguguuaagagcucugugggauguucuguagaagccuggaagauaauguaaagaacagugcaaacgauagaggccuggcuugugaaauuucagagggaagauuaaagacuuaucagggccauugauauuuugauugugaagauucuuaggguuuuuuugguuagcuggggcugaagaaucaggcugaaaccuuugcauugcuggaaccauugaugcugguuagcuggagcuaagaaauuagcagugauuaagaagagaucagcaucacuagggugaaaucuucugggaaguguauccucagagcacagaaaagcuguguuccagagauagccaagguuguaccucgugcugcagcuauacuugguaguguguaagaguuacccagaugguacugguuuugaaggcaugaaggggucaugaagaacaacugaggcucggcacugugagaggccauggaagaccauuggugaaggugcagccucaguugcaguugaugacccaggacugaaggucaugcaaaggaguugaggcuuggcaccaugaagagagccuaugagaagcuauaggugaagccuaguugcagcagaagacaacaguguuuuggagaugccaauaccaugagaugaccaccaagaacagcaggagcaauggaguacagguaguuagagccuagaagacaagaugugugcuacaaaagacagagcugggcuugcccaagcccuuggaggagcccagaagauugugaguuugauuagaguuugauuuugauuuugauugugacugugcccugauauuuuucccucuugaagaaagucuuuuauuggagcccacauuuaagagacuuugaauuguaaaaagacuuugaauuuuaaaagagauuggauauuuuaaagggauugaaauuuuaauauguaagaauuuguaaagacuuuuaaaauuauuuauuuauuuaaaauauauauaaauauauauaaaguuauuuagaucuuggggaugaauaagaaaguaaggguggaggcuagugaaguguuugugugucaaguugacaaggggucaguuguacuggcuaauuuugugucaacuugacacaagcuugaguuaucacagaguaaggagcuucaguugaggaaaugcuuccaugagauccaacuguaaggcauuuucucaauuagugaucaaggggggaaaggccccuugugggugaugccaucucuggacuggcagucuuggauuguauaagaaagcaggcugagcaagccaggggaagcaagccaguaaggaacaucccuccauggccucugcaucagcuccugcuuccugaccugcuugaguuccuuggugaugaacagccauguccuuuccucugcaguuugcuucuuggucaugguacuuugugcaggaacagaaccugacuaagacaccagggggucugucaugaguucgucccugaggugagccacgcuggcauugauagcagcugugauaggcccaugccugggccauaggacgugaccugagagagcacagccuccuuccccaacagcacaagccccaggagccagcaacccccucugguucuuccccacacccuugcucuugcuaggucacuucuguauagagauagucuuuggggugcugcuuuguaccagagauaucuguggugacuaggacuugaggaaccuggcacugacuccuagaagguucuucuaggaccuggcguuccugaucauagaggugaauggugccuugccuugguuuguucuuacuguucuaaauccuuccacugcccccaacccauagggcaugccagcugaccuguccugggguagccaaagaauccaggcagacccacauacugguucuucuucuggaagucucagaccuagugaagugcuggugagguuugcuggggcacucacaugcuguuuauaaugggucuggaugggccuuguguauaaauagacuucgugcaucuggacuacagaggccuugaagaagaaguuucuagacuauguuaggggaagaggaucaugacacuggaguccagauuucccaauaagggagagacccucuuguccccaacagcaugacccuuugccuggguccugggacguucccuauauucuaggcuucucugucucucauguuccacugauuauugcucucuugugucuuagaucaauguagcauuucuuggacagcugcuuugaccucuacuauguccucaacaaggacagaugguaucaaagcccauguccugugcccaaguauggguggguuuuuuuuguuuuuuuuguuuuucgagauaggguuucucuguauagcccuggcuguccuggaacucacucuguagaccaggcuggccucgaacucagaaauccgccugccucugccuccccagugcugggauuaaaggcgugcaccaccaccgcccggcccaaguauggguguuaaagugggacaugaacugcgagauucuuccuacuguauggcccuauucaggccugcggcccucuggguaucuaauguaguagaccugagccuuaaacuagagucaaagaacagcugccagggacagcuucugcauccaguaucagguacagguaggcaguugggacagagaaagagaagggguuccagggcuucuugagaacguauaagggucaagaacccacuauaaggaaggccugaccaacaggacagagcuuagaccgagccuuuguugguaccaucugcauggaacuauaugguccugggacuuugggacacagguugaucccaagcagguuuuauauugugugugacaugugccugccugcucugguauccuuggauucauagugcaucccagcaccaaaaguguccuggguguggauagaagagaccugaacauuuguugagcuucaagucagagugagucugcuagaagagaggcugacaugacuaucccauagccagagccugaacccacacuccuucccacaggugguuauggcauuguccaauccaccuuuuuauuuaaaauauuuuaauuguguguguguauguguuuguauguggaguggggggauguacaccugagggcagugccuacagaaaccagaagguggaauuggggucucuggagcuagaauuauagguggcugugagcagcuccaggugggguauguaagcuguuucugaauggccaagugggccacuguggcaggccacgugucuucugugaccugaccagugugggguaaggagugcagguguuguuuucccuaagaucccacucagagaugguguaggaagauguggagauguguccccacaugccagcagugccugcuaccuugggagaggcaccugauugacuugcucugcagaacagacuggccgcugagcugugaaaggcaggcugaagggguugcuugguacacagugauugacuggggaccuuuggaguugguggccucuaggcuggcccaggauggcaagaggccaacaggaagcugucuucuccuucuagaacugcaauccuuucuuugaugaaaggcgggaguacacauccugucucuuugccuggcucuauggugucaguccuuggagugcuuacagaaacccagugcugccuuugcuagcaguggugcagucagcccuguuucuguuaucugaggugccuugagaacagagggcacgcuggcuccguggacaacgccaggccucugagcccaggggacuuugauaugucauucaccucuucagauaagcucugccagacuagacaggugcuguggagccagugcaguccccucauggaugugcauguggcuccuugggcaccucacccaauuaagaugaggugaggcagcagcaucugcacagccagagccacuuugaccaaggccuuguccuuggagcuguccuccugggagacucaugaaggcacugaggaagacagucuucugggcuagccggggagggucuuuacuggcccucagagaagaguuuccuagguuaggcagaauaggacagaacauaggaccuuccgaggcucccuccuuauacaccagugcuugaggagcaggccauuaccauaucuauaccagcccagaaaccugaaauccuuguggucucccaccaaggagccaggcuaccuaccuggccuuucuucuagccccuuggauaccauguguuaugugugcccagagguaaggcuugugccugagugaaagaaauaaggguggauaagaugggaugucagagcaguggggaguuuguacaggguguguguagcauggagcuggcuaagucucuccacuuccaggucagccaaagcagccucaccaugcuguccucaccgucaccaggccagcaggugcagaccccacagucgaugccaccucccccacagccguccccacaaccuggcucacagcccaacucuaaugucagguaggcugcugggaugcacccuucccuuagccuccuucaccccauuuggccuuagggcuggcaucguguucuaggcucagaccugcuuuuauucacuuggcugcagcuccggcccugccccaucucccagcagcuuccugccuagcccuucaccacagccuucucagagcccagugacagcacgcaccccacagaacuucagcguuccuuccccuggaccuuuaaacaccccugguaaguugggccugggcuggguaggcagcuuuacaaggugccuaaauccccuucccucccaagggcucagauuggguaaagggcucaugggacccucacaucuccugugacaccugcuccacagguuguagccauccaucuuacccacccuguccccuauagugaaccccagcucugucaugagcccagcuggcucuagccaggcugaggagcagcaguaccuggacaagcugaagcaauuguccaaguacaucgagccccugcgacgcaugaucaacaagaucgacaagaaugaagguaggcuagccaaaagcaggauggggccggacacccaaggccuguucuuagugucccuuucuuuccuagacagaaaaaaggacuuaaguaagaugaagagccugcuggacauccucaccgaccccucgaagaggugaguacuggcccagggcuuugggcagggcuguguugugccacagcucacauaggguccccaagacuuggugacaguauggaucuaaucaaagguccaacagcgcucugugaccaugccugaggcuuaggugacuuuacaagugaggugugcagggaaacuucaccccucccggcaccuuuccagcacccaccuuucaaggaguugugguucucacacuuucacuuguggcugucauagccuggcucaugggucauaaugcuaggugcuggcuuguaguguccccucccuucagcuagacaugacaaguuagcugaaucugcccugaucucuucuuggcugcccucugaccuuugacagacagcuuugucucacuccccccugugggcuguaggcucagcuguagcugugugcacuaguuguauagaugaacccaaauggagccuggaaaagcucguggaugucaguaggcugccaggcugccaacuccugcccaccagccauagauagggugcugcuaacaccgcuguucagggcuguaccugcugagugccacggcucagcacaccuuaggcucugccuguccuucaguggucacugccgaaugggaccugcuacagcuacucagucuuccagguccucuuagguugaaucccuagaggcacagggccaagcuguggcacaagcugguccugcugagaaugaggccuucugugccuccuguucugaaagaagcuagugggauucuuguuuguuuguuuguuuguuuaagacaagguuucucuguauagcccuggcuguccuggaacucaguuugaagaccaggcuggccuugaacucaggguggccucugccucccgagugcugggauuaaaggcgugugccaccacugcccagcacuagugggauucuugugacaguuuccaguggcugaggcccaagaagcuacgaggugguggucgggacaagaguuaccuacccugucccuccaguagauguuagcucaugugcccuccccucagguguccccugaagacccugcaaaagugugagauugcgcuggagaagcucaagaaugacauggcaguggugaguggaaggaggcuuucuggucaggaaguagcacuucuaaagacaggaccugucaggguucuagccacccaucccaucccugcaucugcaguuguguuugggccccagcaugggggaggggagcacuaggaugggggagaggccgcaaggcugggaauccauugaagcggcagccagugugugcgcugucaggguggaggcuuuaggcaaagccucuggaucuugagugcugaugaggaccugagguuuggaagacuccucagaauggaugaggccuugagcccauaccacugacccguucuauuuugucucuuagcccacacccccaccacccccaguucuuccaaccaaacagcaggaccugugccaaccacuccuagaugcaguccuggccaacauccguucaccugucuucaaccauucccuguaccgcacauuugugccagccaugauggccauccauggcccaccuaucguguauguacacucagguugagccuagugauaaguagcagcccagaggcugugugacaucugcauaaucacuugggucgcuuccuccaggucgccagugguguguucccggaagcgccgguuugaggaggaugagcggcagagcauacccaaugugcugcaaggugaaguggcaaggcuggaucccaaguuccuggugaacuuggacccuucucacugcagcaacaacgguacuguccaccugaucugcaagcugggugaguggccagggucggggguggggugguuugccauccaugcuggcggccugcucacugcugcucugucucacucgucauuccucaggguaucucucccccaacuccccagauccuccaguccccgacccuaugcauuuauuuaucuuucuucacaaaaguagccgugguccuggggcaaccauuggcagcauucucucugcacaagguguuuccugccuuuggaagccuggggguguaagaggccucuaggucuguagcaggcuucauuggaacccuguagaguguagagagccuuuuuaggagcaggggugaggugggcaggguuguguugguguuugccaggcucucagccaggucacaugagcaguuuugugucacagaugauaaggaccucccuagugugccaccacuggagcucagugugccugcugacuacccugcccagagcccaauguggaucgaccgucaguggcaauaugguaggugagccuagaggagccauccagggacccaaugaacagaguagguuggacagauggaagggccccugugucuucugccguuugcguacaacagcuccaaggcaccugucaagugggggaggguugucacguucaugacauuccuuugaagcacuacaaagugucccagggccaccaguaggugcucauguaagucugucugugugauagucucuugggugagaacaguaccuggguucuauuggcacauagcagggaccaucuggggcccuagaccccauagaaaucccagcucucaacugaaaguuugacuggaaaaucccaucacuguggggugcaagagacuaagcagugguguaccuucccagaagugcucuaggagccagccuaggugguugcugccuugccaggcucagcacucacaacugcugcuguguugcagaugccaaccccuuucugcagucagugcaccggugcaugaccucaaggcugcugcagcucccugacaagcacucggucacagcgcugcucaacaccugggcccagagcauccaccaggccugccucucagcugccuagcaaacuggaacuucaggacugccagcagcccuucuggcuaaagaucucacgccgccuaccagacauuacuaaguguuggcuucuuagagggccuggguuagguuagcuuuccugcuuuuaccuucuuugguggggaccugccagcuguuucccauucuugugcaguauugacugggcagcugugaagcuggcugcuugagggccuggcgguuuccccagaagguuuuccauugguuugguuuguuucguuauuuuuuguuuuuuguuuuugcagaggucaggccccacacuuccuccagccuuucugggcuuccaugcccacucagcagcaugagaacucagggccccaucaaagcaucucuguuuugcaauacauuguacucauuauguggagaaugugcaggacauaggaaacccucacucuauacacaguucuccagucacacuggggcucaggcgugccuccuaaggcauguggacacgucacaggaacacgucugaauccagggcacacauuucaguuuggaagaaagaccaauagggcauccgcaggaucucugccaccagcagaaccuccacuuucugggccuccucagucaugugaggaggagaaucagcuggaggcaaggggcugucccugacauuccugcgccaaucuugggugaagggcugucagugcuaugauacacaggcagauaggcagauacuaucacugggacccaccagccucaacaccauauucucuuauucucuauaccaccaccaagcguguggguuuccuucggaauacugcagauggcgcucgccacacugggcagcaauggggagcacucuggugaaaauuccccuuuuuauaugugcacuacucugucauaugauucuuauaauaaauuuauuauuccuguguuugucaggaguuuauugcaucuaccuuuuugcgagucugagcccaucuuggaaaaccuuggacuucauccacuuucugacauuguaucaugauuccugcccaggcuguggucugauucuacugagggagugggcaguggcauugugaggucugugcugcaggaggaguaggcccaggcugaccacuuccagaagcuaugggggacaggucucucccagucaucauccugugaggccucaggcaccccagacagcaugaauguugcaguagcauuggguguccaggcaacacugucuuauucccaguauccaugugcccaguagaaggcagcccucaggccagccauguaacaaagccagcuggcccagaaugccacuucggauagcuggucacaguaccccuaggauccaccagccuuggcugccuagacagggcacuucagaguagcagggacacuugcaugaagaaggaagcuuaggacuaggagaaacaauuuuauuuucagucuacagguaggagaguaacauucuauuaugugccuuugcauaaaugcaggaauaauaaaaucgagaaaauagacaaucuccucauuucugagagcaagugcuuuuaucugucguggguucugucuguuuuggaauugcguguggcugcaaaauaggguuggugugagccacuaucgagagaggauggccgggcuccagggcgccggcucagcagcacagagcggugcaggcggcggcucuguacuacuugcagccuuuucugccgcucagcaaaguuguucuucaggcucuguuucaaugcaggcaggaugccucgcucugcagcaggcauugggcucagaauuaagcuaggguggagaacaagagagugucugccagcugccucaagggugcccugcaccaauggcugggcugggagcagggccugccuuuuuuucuggaaauccuugccuccugucucuuguggcaccaagcugcggggcacccacucccugugccugggacucaccacuucuuacuaaggcccuuggaggugaccuugggaaacugcaugguguccuggucccugagaaaggaaguuagucgugagguccacacccccucuaggcuagggcagggcgcuggguacaaggcacucacuuuggagaacccagcccagccuccucagcugcagcuuugggccuuuggu

SEQ ID NO: 8131 - RNA, 979 nt, Mus musculus
cauggcggacagugcgggagcaggcgcggugggccaggcccugggaacggccgugggggggggggggggcucgaguggugcgggcggcccugucaaucccgcuaagcugccucugggagacccgcaacucaucgcucucauaguggagcagcucaagagccaugggcuguuugacagcuuccgccgggacugccuggccgauguggacacuaagccaguuuaccagaaccugaggcagaagguggauaacacaucuggacaaacaggaauggaauccugcaaugaacaagaaccaguugcaaaaugggcugaggcagagcgugguucagucagguauguuggaagcaggaguggacaggaucauuucccaagugguagaccccaaacuaaaccacaucuacaggccacagauagagcgagcaauccaugaguuccuggcugcccagaaaaaagaagcugugccagcucugccuccagaaccugaaagccaggauccuccagcaccaucccaggauacuuccuaagaauuugcccgguaccguuggaaagcucuacuuaagcaauggacucuuguuucauacgaauauaacuuuagucggccauaucauuacugaugucaagauuuugccuugacugcggugguguccacaucagauggagagcaaguuugguggugggacaguuacccauacuugcucauggauuguguaccuuugaccagccugucgaggggugugaccccaguagacccuacagagguuuaagcacuacagugacgugggcuguccugaacgaacuuuuauacuugaacucagacacugcauguggaugucagcacuggcauuuuguggugugcagaagucaggcuggaggcuagcuggucaggacagcgagagacagugggagcagcuguuugaugguggguuuugauaugcuagaguuacagacugcagcguguggcaguuagcaucaguagccu

SEQ ID NO: 8132 - RNA, 979 nt, Mus musculus
aggcuacugaugcuaacugccacacgcugcagucuguaacucuagcauaucaaaacccaccaucaaacagcugcucccacugucucucgcuguccugaccagcuagccuccagccugacuucugcacaccacaaaaugccagugcugacauccacaugcagugucugaguucaaguauaaaaguucguucaggacagcccacgucacuguagugcuuaaaccucuguagggucuacuggggucacaccccucgacaggcuggucaaagguacacaauccaugagcaaguauggguaacugucccaccaccaaacuugcucuccaucugauguggacaccaccgcagucaaggcaaaaucuugacaucaguaaugauauggccgacuaaaguuauauucguaugaaacaagaguccauugcuuaaguagagcuuuccaacgguaccgggcaaauucuuaggaaguauccugggauggugcuggaggauccuggcuuucagguucuggaggcagagcuggcacagcuucuuuuuucugggcagccaggaacucauggauugcucgcucuaucuguggccuguagaugugguuuaguuuggggucuaccacuugggaaaugauccuguccacuccugcuuccaacauaccugacugaaccacgcucugccucagcccauuuugcaacugguucuuguucauugcaggauuccauuccuguuuguccagauguguuauccaccuucugccucagguucugguaaacuggcuuaguguccacaucggccaggcagucccggcggaagcugucaaacagcccauggcucuugagcugcuccacuaugagagcgaugaguugcgggucucccagaggcagcuuagcgggauugacagggccgcccgcaccacucgagcccccccccccccccacggccguucccagggccuggcccaccgcgccugcucccgcacuguccgccaug

SEQ ID NO: 8133 - RNA, 33814 nt, Mus musculus
gcgacccccccuagaguccccuugcgccugcgcggcaucccacgugacggagaggcuccgcccccaccuccagccucccgccucccgccugcugcgagagcggccucagcuugcggcagcaccaggucagcugcgaggcauguaccgugcgggcccggcaggccuucuucgccgagcuugugcugcacgcggggaugggagagggagcggggauggcggagggcgcggagaucugggccaaguaccgcgggcgccuggggcgggcacgggcgacugccugacguggcgggggcuuggccgggcgacccccgggcguccggcgcgggccuggcgcuguggcgcgggcccgccgaggccugcgcguggcugaagcggaccguggcccucgcagcccgguuggucagguucugucgccagccguggguccgaguguggccucuggccuguccccgucccucgaagcuauucgagcagggauugcaacaggcagcgggcgggccuggcugccucucccggcgugaccucaagcucaucagccgcggcugcgguuguugagagaagccggagagcaagcgcugucagugcaaaauccccggauuguacuaguuuagauccuguacaggccgaacgaacggaccuguccgggcgcaacggggccaccuucugcccgcggcugcuuccuaggguaaggccugaucuccgagaugcuccucguccgugcucugggaaagaagccauagagcacgucaacaccucuuggaugcucccucccacccccgugguaauaaggacccgcucccucuucugcucuucccaagcugcuguuuuuccuuuuguugcacaccuuacguugugguucagaugcguugaggacagauacggaaugggagcccccacagaagguugaggaugccuuuccaguaaaugauuccuugaagauuccucuaaaauuuguuucagugcacagcuguuuguaguagcaaacaaugguagggaaccuaguuuauaugugugagaggggcaugaaguuauaagcagaagcuaaaggaauguguagaggaauaucuuagaucugcagucaccguagucuccuuaauguuuugucguuuaaaaaaaaagagugaagccaggugugguggucccugccuuuaaucccagcacucuggagguagaguucugugaguuugaggccaggcugaucaccaaagaguuccgugacagcgaaggcuguuagaaacaaguggucuguaugugcaccugggugaaggugcucuagagaccagcagagggcgccuccacccgaugucagcgcugggagcuccaguuccgggcaggaauaguuuugcauuaagugcacugagcacucuaaccccaccucuuccuuauaggcaacuuugugaucuuuuuguaucagcacuccggagugguggaguuacagaucuguuaccauccugucuggcuauaccagagauucuggauguuguugcauucuugauuguacugaauuucuuuucuugagcuuuucuugugcucugccuguccaaaggaguagccaucuguuuuacuguacuuguuuuugugguggccguuuagagagcagaugauauccauccccuuccaagagggcagacaggcugcucagcugacaacugugaggaccaccuccacaugugcauggugggggagggucagugucuguuaggacaauuaaucacccacagauggggaagccuuccaggacucugagguuuggagauagcagccagaguuugguuagcagauauugccauagaaacuaacccugaguugcuugugagacaaacugucaaggguagagaagacagguucacuaucagagcauguuuuuuugagauuguaugaaggugcuagguagaugugaucaacuagagucacggccagaauaggacuaugagaaaagaacacaguucuguucagaggacuucaggugucccuaugggucuaagaacuggcaguggggcaggcaggagaaggaagugagguuuugagcuaagucacagggagccccaaguaugaagcagugagauagcacuugguaaguaacuauaguaugaucacaggaguauuuuugguccccuguucagaggaaacuggggauguugauguugaagcaagacgagaguuagggaaauccuuuggaacaacaguccuaugcugggacuccaaacaguggccacuggaaaaaauaaggggaugacugcaagauauaggaggagaaucaagaacaaaggaucuuauaaaacauagccuuaagaagaaaaagagaucgcugagacuaggagguuucagguagaaauguaguguguaacugacacaaacagacuaguuagaagggauucuggcuggagacgccauugagaauacgugccccggggacagggugcacugaaggaagggaagaaagaggucaggagaggagcaauuauucuaagguagaguuccaggcuggagggauccuaacccagaaauaguuggcaagacauaauauaaccaucuccagggccuugugagaaggcaucugguucagguagaaggaagguguggguaagccaauagaggcccuacauccaggagacagauggaagagaagggagcacaugugaugggaggcaggagaggcuugagagcacauaggucccgaagaggagaugggguuggggagaaaugugcuccuucaguaauaaggccuuuaggcuaguuuucccucaacaucuaauuuucauuuuaagauauacauauuugggggcuggugagaugguucaguaguuuaagagugcuuacugcucuugcagaggacuuggguuuuguucccagcaccuugguugauggcucacaauuguacuccagaggaucugacacucucuuuuggccacugagggcuccuacauaaguaaaauuaaucuuuaaacuuuucuuauuguuacuuuaugugugcauguguguaccacagguuaugagcggaggucagaaggcaauuuuguggaguucagucuuuccuuccaucuguguggguuucaggcauuggauucagguugcuagacuuauagggcaaaugucuuuacccacugagucuguuuuuguuguuguuguuuuguuuuguuuuuuggcuuuucgagacaggguuucucuguguaucccuggcuguccuggaacucacucuguagaccaggcuggucuugaacucagaaauccacuugccucugccucccaagugcugggauuaaaggcaugagccaccacugcccggugagucugguuaucauuuuuuacuuuuaaagagaugacagggaacucuaaaguguaaguagaguagcaugaaguagagaggguccauggccuucuaaauggcugaccugugcuaaaagagcauaugguuggccacuggccacaggccucuagcaacugacuauaaacaguuguuuaugguucauucauguguguguuggcaaaggaauauuuguaguagguuuguuuucaugguugaguuuuuauggcuccuuuuaaaaaucaugguuuuuugcaguuuuuaagcauaauggccaaauuauuagaagauaaucuuuaguuuuuguuuguuuguucuaguacauagggucucauauagcucagacuugccucaaacuuccacuguagauaggauggccuugaauuuuuaaaauguguguuaguuguaugugugcauguuuauaucucugugcauguuagugcauguauccaaagaaacuagagacaucagaucccucuagagcuggaauuacaggcgacuaugagauugucgacauaagugaugggaauugaacagaacucugguccuguagaacagcacaugcucuuaaacauugauccaucacuuuagccgcccaucuccaccuccuacacacacacacacacacacacacacacacacacacgcacacacacacacacgcacacacacacacacgcacacacacacacaugcacacgcgcgugcagauauacacagaggaggguggggguuggggagcagcccuggcuuuucuagaacucccuuuguagaccaagcuggacucccaauuuauagagauccacuugugucuaccuccugaguucugggauuaaaaaugugcucuaccauacccagcaugcacauauuuucuuuaauuuuccuugucuuuuuguccugccucaagucuuccaaacucuuuucuuugcccaaugcuagggaucaaguguuagaccucacacuugcuugaaaagugauuuacugaagcacaccccuauccucuuuuuuuuuuuuuuuuuuuuuuuuuugguuuuucaagacaguuucucuguacagucuuggcuguccuggaacucacucuguagaccaggcuggccucgaacuuaaaaucugccugccucugccucccaaguguugggauuaaaggcaugugccaccacugcccaacucuacccucuuuuuugauucuauuuugagacagggucucuuaaguuucugggcugcuccugaguugugaucuugcaguuucagccuuccagguaguugagauaacauucgugagucaucauggcagccucagacacucugucuuacuguagugcugaaggugacacaauaagauaaagagaccagguuauaggacagaaggccaagcgggaccaggguggcaggaaacagggucauagcgaagucacugcagcaggugccacaggugcaguacugucagccuguguguguggcacugugccaccuaccuaccuguucacuccuugcucccucugucuugcagcugacuacaguagugagggcugcuguggcugucaggauggcugaggagcaggacuuugcccagcugugcaggcugcccacacagcccucccacucccacugugucaacaauaccuaucgaagcacacagcacucccaggcccugcuccggggccugcuggcuuugcgagacagugggauccucuuugacguuguccuggugguagaggggaagcacauugaggcccaucggauucugcuagcugcaucgugugauuauuucagguaagcuaccuacaaguuaccuuuucuuuuuuguguuuguuuuuucaagaaaagauuuuucuauguagcuuuggcuauccuggaacucacuuugcagaccacacuggcauggaacaaagagugccugccucugucucccaaguggugggauuagaggcagucacuaccaugcccagcuuauguucauguuuucaguguuuuuauuggcauauauuaacuauaugugauaaugggguucauuagggcauucugauacauguauauaauguguuuugaucauauuuaccuuaauacucuuuuuuacacucccaaagacuccuuucuuuuucccugcuaacucuccuucuacguuuuuuuguuuuuguuagguuuuuuguuuguuuguuuuguuuuguuuuuuggugauccacuaaauauauuagggucuuugauaggaaaguugaaugagagauuuauuuaguaaaucgaguaccuuuccaguggcuauguuacuuaggaaaaugucuuacccucccucagcaaccauugaguacugacuauaaauccucaaggaggaaggguccuuuucuguaacuguuacuauagggcuaauaacagcuaguucgggcuuuaccauguugggguacuggcacugaagguggcugggucuucucuugccuagucucucccacagucugcuguagaggcuccaucaaccagccuagcacagaagagguuuuaagaauuuaucuuucaguuugucucucuguuggccauguugucauuuucaaaacuggaucaugacuggcuuacuuuacgauguuguguuuuauaaaugaguauucaacugcaaaugcaauauuuggugaaauuuuucuuauuguggauuuaaaccccacggauggucagaggauaguguguaaugaauaugguaauugccaacauuuugcucccuugcuuucauacacauaccugcuuucaaguguuaugacacuuuacucucacccaguuauaaggccguuuaagaaguuugcacaagccacauucacuccucugauacuucugaaagcuaaggcccaaagcuagaaaauuaugacugcauagggauuauucacacaucuacaugaucuacaccuuuccccugauuaacuacuaucugccuuauaacuccuguugcuaaaaauuccuuccagaaggagaugugaacaauguccaccccuccuccuaaggucccaacaacaaaucagagcauaauuccaccagacuucacucuggggaaccagugaguuaugcucuuaccagcaccuuggaggucugggcagagaagucaacaagggaagucugaauaguagcagcccuggaaaguccagaguucaagaugcaaagagagaugggaaaaggcuggcuaaaugaggaguauuuagaaauaaauuuaacucaugcuuaguauguaggacuuugggagcuugccaggccucuaaagagaaccccagcagagcuagacauaaagaaggucguuguguuccuugcaaagagcuaguucucucuguauuaaucugaauguuuacuauauuuccaagaagcuuuauuggaagaugugugggcaaaaggguguacugugggacacacugugacacaccguagcauccaugugagaugauuugacgguaaauugcacaaacugguuguaaacuugaaaauaaaaaagcaagcaaugguaaagaaauuguagacaacaacaguaaugcaaguaauaggccugcccuauauuugcucuaauaagaaugugcaggauuugaaacuuuguguuggugaaagagaaggaaacauagaaaaagccagguuuagaaacaucauaaguaagccggguguggcggcauacaccuuuaaucccagcacucaggaggcagaggcaggcggauuucugaguucgaggccagccuggucuacaaagugaguuccaggacagccagggcuacacggagaaacccugucucgaaaaaccaaaaaaaaaaaaaaaaaaaaaaaaaagaagcaucauaaguguaccaggaacucugcaugugacaaaaaugauaugguaaaucauaucaaauuugauaugggaggggcaauagauaucaccauugccacuggaagaacaauguuagacccuugcucuguaccucauacaaucauuaaugccaaaugaugaacaguuuuuguguugcagugcuaaaaaucaaacccagccgucuugacacaugcuagacaggugcucuguuagaggcuacaccaccagacugauauaguguguguguguguguguuaguguguguuagucuaccacccauguagagaggcccauggucauuuuuucauugcucuuuauauuauuuccauuuuugaaauagucucuuacugaaccuaaaacucacugacaggucgaacuaccugaccaguaagucccagggguucuucuggcucuguuuuguauugcugggaugacagguguuuugaagccaauguacuguagcaaacucauuacccacuacaccaucucuuuagccuucaaaccugagguuuuuaacauuuaauaacaaacuagaggcaaauacagagaaguauuuucuaauauaaacuuagaaggaaaaagucauucuaaguuugacacuaaauacugagacaagaauugaaauugauaaauuugauuacauuuaguuugacagcuagacaugguacugcacaaccuguagucccagcauuuaccuggacuauauaguucaaguuggcauacacaaacaaaacaaaacaaaaaacccucgacaaauuuucacagccaagcauaguggugcaugccuuuaaacacagcacucaggaggcagaggcaggcagaucucugugacuucaaggacagcauggucuacagaguggauuccagcauugccagagcuacauaaagagaucuugacuaaaacaaaacaaaggcccaccaacaaaacaaaacaaaaaucugccaaauuucugcauguucagaucuucauuaaaggcugggagaaaguuuaacugaucucugaaaggaccugucucuucucagguaagaauuuauaguagaaaaguagcauaauucuagguucaaaaugacuauuggaauggcuuuaucaaugugauaagauuuuucuauuccauuuauaaaaacauuucuucuccuggugguagaguuagaacaaguauuuccuagcucuuaguauacuuguggaugguguugggggcagggcuccugacuccagugugagggugacguaagaagagcagguggaugggacuauucaauugggauguauguuaacuuuugggccuagcauccacauuuguggaaauuaaaccugucagauacaguguaacaggaauggagccauauccuuugugugaauuaaaccuaaauggacuuaaggacuguuggcagacuuuacgagagugaagauaacucaaaugcugcugcaucacugaaaagcccacccuagcaugggugauugcucccaaagcuguaguucuggacucugaacaacuuuuccggcuccuccaauaguccagcagcauccucucaaggucaaucugucagaaucuccuugggaagccuguguuuacugcuucuaaaagcugggggagggcaguggagaaucuugcaagagccuucccucccuccuggaaaggcugggucuauccugcuagaccauucucaaccugggggucccaaaccccuaggagucaaacaacccuuuuauaggggucagucaccuaagaccaccugcauaucugacacuuacauuaugauugcaaauaguagcaaaauuacaguauaaaguagcaaugaaaauaauuuuaugguugcggguuaccacaacacagggaacuguauuaaagggucacacguaacauuaggaaggaaccacuuugcuagacaaugauauguaagaauugauuucccagaugugaaguggaaacuuaugguuucuuuggaaagucaguucugucagaugguguuuugcuggcgcaaacauaugaaaggguguuuuccugaagcacacacaggugaaaggaugauuugcuaaaccaagcauguggaaggacaugggaagagggauucuucucuuccauaacuauacacauguauugguucaucuuacauuuuguagcugagcuccauuugcagugacuucacagagaaaaacacaccaaaaaacuucuuguaguguucugguggcuuccucagacucgggccgguuggcagagagaugucagcugaugcagacucacgugcugaggcaagacccagaaagacaugugguauuuggaggguauauaaauaggacucaacagacggugauagaggcuggcuugcauagcuggcuuugcaucauuuuugcuaaucuugcuucguugagagaggcacagaagagaacuucuggugucccuguugguccugguugcuccugcugacucgugccaauuuggcagccuagcuguuucugcuaggucaugcuacugcugcugauucauguuuguuauccugacucuacugagcuggacugcugguauauucgugaaguauuugugaguggauugagcugcugcugcuaacuguuaacugaacugauuuccugacaaagcagacggauuuacuccaaagaacaauuucuaaacagguccacuucccccauauccuaauaaucuuucuuuuccacuaguguugaagugaugggguagaagggagguuaaagcauuuaagaacccacauuaaaaguaggauuugaaaaagcuaagcuuacacagaugugucugaauaaaagcaaaguaaaaugcagaguuuuccuuccccugaggugaccuugcggguuuggaaguacaagccagccuuagguuagaagacaagugcuagagagauuucagcacaacuuuuuauagauuuuaauuaauuaauuaauuaauuaauuaacuaguuaauuuuggggaacugggucucacugagucauuugaccagccuauaaguggaauguagacuaggcugccucccaaguacuggggugaaaggcaugcacugccauacuuggcucagaucuuaaaaaaaaaccaaaaaaacaaaaacaaaaaauucagacuuuauugucacaugauuauaauaacccaagggccacaaaacaauauuaauauuucagacugcccaccagcagaagacacuuuuuuuuuuaguuuuuuuuauacuguuucuccauguagcccuggcuguccuggaacucacucuguagaucaggcugaccuugaacucggaaaucugccugccucugccucccaagugcuggaauuaaaggcgcacaccaccacugccggaccugaagacaccuuuuuuuguuuguuuuuuguugcaguuuuuccuuaagagacaggguuucauugucuggaugucauuaaucuuggaccaggcuggcuucaaacucagagauccuccugccucugccuuccaagugcugggacuaaaggugugcccugacuccucuaccaccacuagugugcaaaagauaccuuuuaaaaaauauaucauuaccaucucaacuucucaguuuuggguuuuguucuguuuguuuuucuaagacagaguuucucuuuguagcccuggcugaauuguagcucugaauuggagaccaggcugccuccaauugagagacccauaugccucuucugccaagugcugggauuaaacgugugcaccaccacacccaggcaaucucaaacuucugucuuugacuguuucuaguuggaaacacauuguagcagaguaauauuaucaggucuuaaaucuuuaagucuguagcuuuaagucuguuuguuacauuguuaaaauauaggugaaaggucaaaguaguucucaaaaaugcugguugagauauuuagucuuccauuuuagggcuggagauguagcucaguaguaggaaacuucuguccuacuuuagcaacacaaaacaauauaaugauggugauaguaauucuaagugucaaggcucugaauggaaaaguauccugacaguccugaaccaaggaauaccacaaagucacgcuguucaacaaaccucacacaagagauucauuggaaaagacacaaaaugguggcugccucugcuaaggggagaaacagcagggaacugagcaaaagacagguuuauauagcauuugagggaugagaaguuucuagggcgaggacugguguaauuucaagcaaagccuggagauugguggaacauugugcucagggauugguggguuuaggggcucagggauggugggguuuuaguagauuuuuaaaccuguaaguaggcucagaacuuauaguguacaguaauaagaacauguuuggucuuagucauuugccucuuaccuuguaauaccugaucaaugucucuacuugaguaucuuaaugugacauggcaggacccucaacuguuuuguuuaaaccaguuccuauugaaguucucuuuauuugccuaacugcuuugcccagaaaagggccuuauguccuccuagaaucagucugucagcaagccuuuagccgguaaacucaagguuucaaauaaucuggucuuaaguguacauaauucauuuauuguuuguucuuaauguaugagugcucuaucugcauguacaccugcaugccagaagagggcauuagauuacacuacagaugauuguagagagccaccgugcaguuguugggaaugaacuuuaauuauugcugucugacugagaacagaaccaguagaagaugcaacaugcaaacuagguacuggccugcucccagaaagugaguauaggguuccugggacaguggaaagggagccaagugauuuccaggaggaaugcccagcuuggucaggcuccugccauagacucacuccgccuuucagacuguugauucagagcacagagcaaucaauguucccacaugcagccccaccacugacucuugguuccuucugaauguuuuuuguggcucacauucaaguucuggacugaguaacucuuagugccuugucucuuugccuuacagaggaauguuugcugggggauugaaggagauggagcaggaagaggucuugauccacggugugucuuacaaugccaugugccaaauccugcacuucauauacacuucugaacuagagcucagccugagcaaugugcaggagacccugguugcugccugccaacuucaggugagaguugccuuguugaucaagaaggcugagaccuauggggggcuuccccagacaccugugaugacugcugguaugagcuaggugaagagggcaggaacgccaaguaaugaggaacauuauggagcagggggggcaccuugcuguugagccuugggaacuaaagcagagugaccccaaauuccuuggcuugccccccucuucugcucuugacucuuuucuacuuaaaaaaaugauuuauuuauguguauaaguauuuugccugcaugcauguauguauguaugugugccauaucagaagaggacaucgggccuaauaguacuggagauagggaugguugugaggcaccauaugggugcugggguuugaacuaggucuucuucaggaguaacauguacuuuuaacugugcaaccgucucaucauccccacccccuguuuuaagauuccuuuauuuuauuuuacuuuaccuguagggguguuuugccuauauacuguccaugugucacauguguauagugccuguggaggccagaagaagauguuggguccccugaaacaggaguuacagaugauuaugcucugcuguguaguuguugggaaccaaacccagagucuucuguagcagccagcaguguuaacacugagccaccucucuagccccaucuuuucuuucauuuugagauaagcucacgaucacccagucuggccuagaguauauguagcuuaggaugucuaaucucauagcaguccugccucagccuccagagugcugggauuguaggcauaaacaaacauuccuagcuuguccuuuccuucuuugcugcuuccuuccucuggccugguuuuccuguaugaaaaaaaaacaaaacaaaacuacaagcuguccaacuggaggaucguguuugugauggccuauguucugugaugucuagugacuuugaaaaucccaugucuugcaguacacacaaacuuuuccugcccaucagcuguguuuguccacucuucucucuuauuuuaauuuuauaaacagucuuaaaguauuacacacaggcuguacauuuacaaucuggccucagccagcugaguaccugguaccauacacacguaccauagugcauggucccuuuucucucuucuuuauuuuuaucuuuuguauguuuuaugcuuugcuuguaugugugugugugaacaugcaugucugguuuauuuuuaucuuuuguauguuuuaugcuuugcuuguaugugugugugugaacaugcaugucugguuuauuuuuaucuuuuguauguuuuaugcuuugcuuguaugugugugugugaacaugcaugucugguuuauuuuuaucuuuuguauguuuuaugcuuugcuuguauguguguaugugaacaugcaugucugguucuggcagagacaagaagaauaugauucuggcacugggguugcaaauguuguuagcuuccaugugggugguaaaagccaagcccaaguccuuuguaagaacaguaacuaaucuuuuuaaaaccaaauaaaaaagguuuuuuagguuuauuuuauguguaugaguguuuugccuguaccacgugugugccucguuccuaaagauaucaggaaaaggcaucagauagauugccuagaguuggaguuagggaugguugugaacccauguggguccugggaacugaaccuagguucucuugcaggcagacacucauacaaauaaaaucuucaaaaaaauguuuuuuuaauauauaaaauauauacuuuacuuagagguuucuuucauuuuuuucccuuaaauaaaaaguucaaaacuaaaaacuaacuuuuagggaaagcagcuguaaggaguaggaaagacaaggagaaagaagagcccuggugguucccuccaacuaaagagccaggaggucuaugggagcagcagggcaagggagguggccuggaagcugccuagugcaaaggcucagcuacucuagagcugaagggguagagagaggcuaaugaagaaacuccaaucuccccaccugaauucagcaaagagguuagagagagggucccaacugcuucuucagggggaggacacaguauucagucccacagaaggccugugagugggaaggugagucugggucccauugggaaauaagcuaauaucaaaccagcauggugagggaggauggcccccuaccaucaauugcaaugauaggccgaucaggaaggaggggagggaagcgagggcauuucugcaacagucugaacaugugcaauauugcuguguaucaaguuuuaguugauagaacuugguggaaucugcaauccaguuugaccacugcagcuggugguuugcccccuuugcuacauccugcaauagaccuucgcagugccccuagagacauggaucugaauccuagcagaaucagccuugucggcuugcucuaggaaaguguguuccauuuugagugugucugguggggauccuauacuagaugacccucagcugugucugucugggauucuucacugcaagggaucuuggugcaagggguggguuauuucuaggguggcacugcucauucccagucaaggccauugacucucacauucugccuugucuucaaagcucaggcccuuuauuuggaaguaguauuuuagggaaaauggaggguuagaagagcuggcuagggaauuaaacaauggcaaaugacuauguccaggcgccacagagaaccuggagaauccaacaauuggguaugcauuucucugcuuguuuguagguaucuauucagccuguauuaucuggcaaguuaguaugaguugucuuuuuuuuuuaauucuaaacauauguuaauaaacuucaaauaauagcagaauuucucuguguauaguuguuaauuuguuggugauacuaguugaaucagauaauuaucuugugguucccuuagagaacugguucuagggcuuacuguggauaucagaguccaaaggucuauaggccuucguaaaguagaguaucaguugguguguaacuuaccuacaugcuucuuguaugccuuagaucaucucaagauugcuauaauaccauaucaguuaaguguuacacaaauaguuauuauacaguccuguauaaauggaugugguaaagcuggguauggaggaauacaccuuuaaucuuagcaauugggaggcagagacaggcgggaucuaugaucucagucugcagaauaaguuucaggacagacaggacuacaaaaaauaaaaaacaacagcaaaaacugguguggcaaugaauacuuggaggcaggagaaaucgucugcauaaucuggggcuagguugauacauacaguggguuugaggacagcuugaacucuccauagcaaggcuuuaucucaaacaaauauauauauauuaaauguguaggcaguuuuacccuccgaaguagaaccuguaaagagagccaccaccuguauuucuauuuuuggugagaauccaaaaucuuguuuuccuaaaaacuauauuagaaguagugguauucguguuuaaucucagcacuuggaaggcugagagaagcuacugugaguuugaagccagucugagcuucuuaguaagaucuuauuuaaaacuaaaagacuagcaguaccuaguuugcuaugcaggaagcuugccuuuugucuuuguuuuguccugcuuugcaagucugaggugucuuugaagagccuucagggcucuguugccugauucuuagcuuccuccuuccucagugccucuauggccugccuucccuccuuccagugcugugcagcuagggacagguaaugcugccaccugggaaucuuguaccgacaggaguagaguggguuucucagcucgggcugaagccccaggauaguuucacagcuucucgagaauucugauugugggucuuggcauuggugcugguccgucuggagauaccuugcugacaguucugugugugguauuaaguggcagugguggggccugcucugcaguuccagcugaugugcuuguucagagaauuuuaacagaagaaaagagccagguauacuauuggucacaggaccuuggcucuucuagugugccaggggcagggaguggccaccgguuccuucuagucuguggcaucuccugcuuccuuugcacucagacuuuuaccuaaaaguaggugauguaugucagaccuccugugugccgaguggugucugugcuugucgucaggcuguuuguuacgacuuuacccuuguuuguaaguggggacugaggcucugaaggguaaggaacaugcccuguguuaccacagcagguuuuaaacuaagccuacagaaaguuucaguuuucugucagaagagguuggggucgguugaggaaagauuccacuuugcuucucccagucccagaaggccagcuacagggacagccagcucuguaugccuuacuucugcugucauccugucuuuaauauucagaugcaguccuccagcuaagacuugaguggguauccuucuuuuuacagauaccagaaauuauccacuucugcugugauuuccucaugucauggguagaugaggagaauauccuugaugucuaccggcuagcagaccucuuugacuugaaccaucugacccaacagcuagauaccuacauccucaaaaacuuuguggccuucuccagaacugacaaguaccgccagcuucccuuggagaaggucuacucucuccucagcagcaaucgccuggagguuuccugugagacugaaguguaugaaggggcccugcucuaccauuacucccuagagcaggugcaggcugaccagaucucacugaaugagccccccaagcuccuagagacugugcgcuuuccccugauggaagcugagguccuucagcggcugcaugacaagcuugguccuagcccacugagggacacaguggccagugcccuuauguaccaccggaaugagauccugcagcccagccuucagggcccacagacagagcuucgcucggacuuccaguguguugugggcuuuggggguauucacuccacaccgucuacaauccucagugaccaggccaaguaccugaauccucuacugggagaguggaaacacuucacugccucucuggcgccccgaauguccaaucagggcauugcagugcucaacaacuucguguacuuaauuggaggggacaauaauguccaaggauuucgagcugagucccgaugcuggagguacgaaagggcacuuaccaucauugccuuuauuguuagacaacuccauggugcaggaauuguggguuaugugggcuguucaggguacacguuaucaagggcacaucucuacagaccugcaucugccuuuuauaugaaugguacagcuuuucugggguauaccugugucauguagugaaguccagaugaauccagacaaaguggaccacagugaaauaaggaaaagggcaucagaauugcuuucuugccuuuugacccugcuauccagaaacucagucacccugaagcacagccucguugucugcagaagguuacucuggcugccaguacucagggagcaugcguuauuacucaguaaggggcuggggcagcugcuccugcuaucuucagucuaccucuucaguaucuuuuuucaauuuccaugcuggucuccuccgaucuuucucuccaaauuaccagccaggaugucuuccagaugcugccugcuggagcccacaucugaguacagaggaguaggaaggaccaguaagcaucauugagccgucacuaaauucccccuugggccuguagucagaugaguauguacucaauagcuacucugugaggaggcaguuuuuccugagggguuuuguggauggcuuuggugcagguugcuucuaacugugaucccagagauccauuuuuuuuggacagaucaagagacauuaguuuaagucuccagcuaccaauggauuuuaagggauaucuucaucauacuuugguggaugugggaaccccugccaucccuggugcccgcuacaagcuaagaugauguuuuagagagcagcucuggggugggugcugaugcaguucacuuugauacacaaguucugauuuuuggcaauaagggugaggcuggauucugcucuguuccugccacaugaauugagcaagcgcagugauacucaccaagaagaaaacaggcauuucuuagucauuauuauucccuggcccuaggaagcagucaccuuugguaaacugaugagacuuaaacuuaccuauaaugauuagaugguuggaauggcagaguucaggaagaaggaaaugacucacuuccuuucaaacugaauacuggauccggugagcauggcugaauuuggcuccccucaggucaaaccugcaagcuucuuucuugcagggcucugcuucuagcugugggauuaaggccagacugcccugccuuagcuauucagagcugcaaagcagaucucuccagagcacugacagcugggagcugaacuuggaucauggcaggugggaucaaaggaacaggaauuuacaaguuugcuguggcaaguagggcuggguccugacugccagcugaccagcgugucugucaucuccaccgaacggaagcuucauuuacuucccagucaucucaaaccuuacaaagcugagggugcagcucagcaucaaauguuucccuagcaugcacaaggcccuggauuccaccuccaccccagcacuugugugguuuguuuuguuuuuggucaaacuugcacuagcugaguagugaggauguccuuaaauccauggucauucugccggaaaaucacaguggcugaaucccugaaauagauuuuucugaguuucuuucuuucuuccuauucauaguuuaacagauugaaaucuauaagcucuuagaauauaagaaaacaauauuuuacaguaaauaaaguuuugcaaucugaggacaguguuuagcagguguguacuagaacucugauguugaaacuguaagaaauugccuugugaaacaaauuaauuuugucuuuguuuccacuuguucuuuuauuuucuuucuuugaauucauauauacaaguguauuggcuuuguaucacuacuauaaaauaucuaaaguaauuaguugauaaagagaggauauuuauuuacugcauacuuugggguaugcccacugguuuguccccugugagaguagaugguagcggagggaacacugaaccuguuguuacacugugcuccaggacacaggagggagggcagggacccagaguuagaugauguuguuuaaagacaggaucuuacaaaagaaaagagagaaaaaaggagaaaaaacugaguggugguggugugauugugguauacuccuuuaauuccagcauucaagaggcaauggcagguagaucuccgaguuugaggccagccuggucugcagagugaguuccagagcagccaagcuuacacuaagaaauccugucucgagaaaucaaaagugagggguggguggugggugauaggggguugauugucuuauucuauaguccuggccgacccagaacucuacauggaccagguuggcuuugaacuuggagugaugcucugccucugcuucccuagugcuacaauaggaaguaugugcaguuauaguaggucucacuauccuuuguguggaucccagugguccuccccagauggucacccugaggaucaggccucucuuaggguuacuauugcugugaugaaacaccauauacaaaagcacauuguggaagacaggguuuauuucauucauaguucccuaucacucacaguucaucaucaaaagcaaugagugcaugaaccuggaggcaggaagugauuuagcgacuguggaggggugcugcuuacuagcuugucuucuacaguuuucucagccugauuuacagaaaccaggacauccagcccuggggcaaccccaugcaugaugagcuggguccucucacaucaaucacuaauuaggaaaaugcccuaugggcuugccuacagccugauccuaugaaggccuuuuuuuuucaguuggggcuucucugaugacucaccuugugucacugacauaaaacuaggcagcacaaggccuuuauauacagaccuuuagaggacauucuacccaugccauucuuuguacuuuuuucauagcuguagcuggauaaauuaaaguaguauuuuggguuuuucuccuaagcauuuccauguaccuuuaaaauucuaaugacuuuaaaacaguaauaguugggucuaucauuccugcuguuuaagaggcugaggcaggaagauucugccuggguuacugaaugaaugaguuaagguccagccugggcaacuuagucagacacugucacaaaauagugagaaggcggccggaagcccagugugguucuuaccuuuaaucacaguccugggagacagagacaggcagagaucugugaguuccagaccagucagggcuaugcagugagaccuuauuucaaauaaaaggagaguggugggcuggggaugaucaagcucaauaauagaacucugauagcaugcacagagcucgagguuuaaucccuagcucuucgguguauacccaucacaccacuaacaguaauggaaauacagaagaaaaaaacccaacuugcuaaauuugacaaagaccuagaacaugcuugauauuuauaauaucaauuuauaauaguuugcaauucaggggcuggagagauggcuuagcagguaagagcacugacugcucuuccaaagguccugaguucaaaucccagcaaccacauggugguucacaaucaucuguaaugagaucugacgcucucuucuggagugucugaagacagcuacaguguacuuacauauaauaaauaaauaaaucuuaguuaaaaaauaguuuggcaauucaaauaggugaaucaaaauuauuaucuuaggaagcuuugacugcuauaacaaauacuacagaguagguggcuuaacuaucaaacaccuguuucucauaaucuuggaucuggaaugucagcugauugagucugguaaggacccuuucuugcugugaccucacauaguagacagacugucucaucucuuccucucuucccuucuuccuuuuuucuaguacuuuucaagacaggguuucucugugagcccuuggcuguucuggaacucacucuguauaccaggcugaucuugaacucagagaucugccuaccucugccuccuaagugcugggauuaaaggugugugccaccacugucuggcuuuugucuguuuuucuuaauagacucuaauucuaucuugggcuucaaccucaggacuugagcacugucagggugagucagggguuucacagggguggcuuuuggaacacaggcauucuguucauagcaguguuagaugaauuacacguaauacugaauuuugugcuugagagauggcuuagucugaaaagagcuugcuuuccagccaugaggaucauucacaucucuggugccaauauaaaagccagaugagguggugcucaucuguacuccaguauguggcagggguagaaacgggaggacccugagggcccgcuggccagccagugaagccaaaacugagcuccagguuuggcgagagacucuauuucaaaauacaagguagaagacacucgguauuaaccuuugucgucuacaggcacauacaggaacguacaaaacaucauuaaaacaucuauuuagugugagcaugugccauagcacaugagaucagagaacaacuuguaaaaaguuuguucucuaccuucaccacgguggugccagggauggaauucaagucaucaggcuuggcagaaagcacccuuauucacugaaccauuuuaucagaccugugagguacacaccuauaaucccuguauuuggaaggaggaggcaggagggucaagcuacauagggagugcaaggccagccuggguuucaugagacccuguauaaaaacaaagaaagccccccaagaggccaguguuaaagcucaguagguaaaggccucauaauauuggcaauuuguaauugaucccuggaacccauacaaagguuuagaauagacuucacaaagaugaccucugaccuuacaugcauguggugguaucuuguguugucucuuucucucccagcccaugaacacacacacacacacacacucucucucucuaauacaaacaaaaacaaacuagaaaaugauuguaguaaagaggagcuugguuagcuaaauauggucauagauaccugugauucuagugcuuggaagaugaaggcaggaggaggauugggagcuaaaggccuguggucuacuuaguaaguuuaaggccagcuuuaguuauguaguaagaccuugugagggccggggaggaagaggucagauacagauagauaagauggaauaaaaucuauaaaccuauaguucuagggauuaauuguguguguuuucuuaagccugaaggcacaagguccaaagaauuucagccugagacagagcgaaucgguggacagcuccagaggcugugccacugugacagggaaggaguuucuggcguggcugagcugaggacugggaggaggggaucccauacuuaaagaaggucagugugcaggaaaggcagaaggugucccagcuuaaccggguggcaggggucucagucugccaggguaauuucaugagacccuguuucaaaaguuuggaaagguaggacuagagagaugacacagcuguuaggagaacuuacuguucuuccaaaggccucaggguugguuuccagcaccaauauauauuggcucacaaccuucucucaugggaucugaugcacucuucugucucaugcuuuucucugucaugcagacacacaagcaaauagaacacucauauacauaaaauacauaaauauuuuuauaaauguuaagguaaaaggaaaggcuggggauguaacuugucaguagagcacuuggcuagcauccaguggccaugucucagucccuagaguggcaaagggaaaaggaaugagaauggucauagguuguagagguagucauaugugggcucagauguuugggcaucagaauauaagugugcguggguuuuguugguggguuuugauggaacaaaaagacauggggaaauucaggacucuauugaggauaguuaagugaacacccacauugaucuaaaauaccauagaggccaauaggugaugguugguaugcuggguagcugagagcgccugggugaggauuguucaguggauaagagacaugggaaaagagagggagggacauccuaggcugaaugagguuggcagcagugacaggacuggcucuaugcaaggguagaugauucuuguuacuugaaauuagauuuuuuuuaacaguugucagggaaacaaagcugugucuuggggagugaccugcuaucaagaaaguaagcuauaguaacaguacuugaaaguuccacucucagcaagggguugccaaggugaauguuucuucuuuccugccucauacucuucucuuucccauauuccucuugccuggacuguucaucgucgugauuacucccagcuuagccucagccuagcagccuuccugaucccucagagaccucugguuucauauagucagccucauauuuucccuuuaguggguugcauuuucuuuaguggggucccuggaaucucaggauucugaucucuggugaccagaguucaaggugagaguugacauguccacuuuggcaaggauacccugagaggauggggguagagacaacuuccccagcugggcaagucaggaaagccaucaacuagggaacagucuaguuauuucagauguaugagagggcuuaggggaaccuauuacugucaguaagaauaaggauaugauggugcacagcaugaccuuuguagacaucacaugacacaguguuaggggagacugggaugagaugcugcaauuuuggcuuuccuauauacaggugaggggaaaauugcucuagaaacaccugugggcagccuguggcagacauuuggguagauccaaacccuagagaggcuguaccuggaagggagauuccuuacuucauuuccaggccaccuugugaguauacuguguuccaugagucugcagucacggcucugagucaacaaguuuuaacaacuaggcuagaggauguucagaccaggcugcagcaaagaaauggggaagucacuuuccaagugaguuacuuacuguccuuauguccuccaaagguaugacccaaggcacaaucgcugguuccagauccaguccuugcagcaagaacaugcagaccuauguguguguguagugggcaaguacaucuaugcuguggcaggccgugacuaccacaaugaccugagugcuguggagcgcuaugacccugccaccaacuccugggacuauguggccccacucaagaaggagguaaggaagccaucccacaggaaccuucccaauuucuuuccaugggccauauucagaggcccagaugucgaggcugguccuggucucgggccagggaaauuaagcauaguaagcggaggccuugucuaucccaggauucuguaugggguguguuggugggccugucaggaggccuugcauuaagcauucagacucauucuucagaccagugccccuugggaguucccuguguugagacugcuauucacuuugucucuauacuucuguauagauggaaauuuuucucuuaccuauucuugcugacacaagcugaaagauuucuaaauaugucaaaauagagggacucuugagagacugaagggcagccugacucacagguuuuuacacagacuccucuccuacaggaaaacagccauaggaccuuccagaagccacaacauacuucggcaguuauauuuuuauuaaagacaauaauaaucauguacauauagcauaguaccuuagguuaguccaguucagagauguuugaaauuauauagauuaugcaaagguaacgcuuuaugggagugcuacuucuuuuugugguucugagguacuuuggccucguccccaaaccacuugccaugugggaucucauggcgagaaguaggucuuguuggcaucagcucugaagccucagccucugagggaauguauguggggcuguuugauguucuuacuccaagcugacaccuuagggauccccaggcccuccauaaucaggaugguggagugggcauacauauaaacucugcccuugccaggggccuggguagcagcucuggccuuggggaugaagacuguccucaaugguuugggaucgggauccucugcacaagccacagacagcagaugugagucuugucauccuuucuacaggccucuagccaugucaaagccuuggucuuuagcuucuuuacaggaaggaagcucugcucuaguucuggaaaaaggaagagauuuugcauggcaaauaucugagaucucuugagaucuaauagauucuauuccaggaguuugagaaagguuccuggaggaagggcaaacgugacucuuugucugagacuguggacaaagcugcaguucuucaucuuagccacagaggagcagucuugaaccucacucaacuuacuuuggcaacuaguaguuaccuuccuuccuucaugcauguggucaucgccuccacuauuaaccagcuacgguguacuaaucauggagauuagugauuaccaugucacccaccaugcaguggugacaaaugacaagcuguucuucaccaggugggcuucagugacuuauuaaccacccaggaaacacuaauuaguuacaguuccaauaaguagaugaaggaaaugaaagcugaaccguucuggaggaaccaggacucuugaaggauuaaguggagauguauuauuuggggacugucugaguaagggugagagcaaggccugaaaaaagagagcuagccauuuucacuggacaaaggacaucccaggggguuaguagucuguuuugagagggacaaacuugaaggcccuuugugaagagcugaaaggcuaaagagccugaaaaggaauaagagggcugugcugagaccuguguuaguguagaguugggccagaccaauggagagggaaauggagagcugagaaugguuuggaggucacucaaaguggucuauagacugaaauguaaaacuagaccuuuuagaaaaaugaaccuauacaggagccuaauguggugaucaugccuguaaucucagcauuaggagaauggaggaggucacagcagauuuuaggucagccuggucuacauggugacuuccaggacuacauagcaaggcucucucuuaaccaaaaggacaaaacaaaaaugaaaacagaagaaaaugaucagaauacagacuaggugaguuuuuagacuugaugucaaacacaucagacaugaaaaggaaaaaccgauaagcuggauuguuucaaaaucagaaacucugcuggcaaaagaccucuuugaugaaagugcacuuauuuauuuguuuuuguagcagagguaucugucaaugucaggaauucucucauuucacuauguggaucccagggaucaaacuaguguccuuggggugggcagcaagugcuuuuaggcauagagccagcucaaaagccuaagaaagaaauuuaugaaagaaguuacugaguaggaaauagaugcgaagcaccugagccauaguauugaaggaggcaagacaaggguugggugugcaccuuuaaucacaccuuugaagcuacuguauagagagagugagggaggugggguggaaacaagaaagaaggaagugggagggaacaaaaggauaaagagguuucucugagaacacagaugauagaugaauacaaagggaaauagcauuguuuaucacaggaaaugcacaaagccacacacacacacacacacacacacacacacacacacacacacacugauacagacaagacaagauacagacaaacuguuugagaauaaaucccuuaggcuucagcuacucauugcaggaguugugacuguggguggagaggucuccuuuuaggaaugacuuucuggaguuucugguuuuagugauuccuuacaauggaucuuacugucagcacauguacaugaggacccuuuggguuugacauaaguguuucucuuuuggcucaacucucaccgagcagcuggggggugcuagugcuggcaggaguguugugggaugacauccauuucauccugguuaggacgauguaguaguuauacaaaccuucacuauucagagaaacuccuggaaggaagcgggggaccuucuaaucucaagauuauuaauuggaaaagaaaauuaaccucugcagacugcugccuaugacaggagaagaugcagacugugugccugcucugcugcugcuguguguuugcuucuccagcuccuuuuauaaccaguucugugacacuaccauggagucuccagcaucauacagagcucccuucuccucacacaauuagagccuucuuuuggccauuggaugugagucaguaaggcuuagaggggccagugagugcacauaugguuagauggguggcccauagggacacagcugucaaaguaggggcagaaaauccuugagcauuguagccuaguguccccuguaacauacacaccaucagugaagaggcaguguucuuuguauaguuguccuuugugacccaaacuagguuaguuuuacgaugcccucccaccccacccugaaggauaaugaaaacuuuaacaguaauuguguaaaaccuauacauccaauccuacucuggcacaaauguaaucccagcuacuuaggaggcagaggcaggaagaucaaaaguucaaggcuagccugggcuaaggaauaugaauccagaccuuuucugaaaguaaaaaacaaguagggguugcugguauggugcuguacgccauuaaucccagcagagccaggacucacucucugugaguuccaauacauccagaacuacacagugaaaccaucucaaacaucucaaacaucaccaaaaguggggugggggcagggaggagaggagggauuaggguugggaugugauauaugagagaagaacaaaugggagggagggaggaagggagggagggagggagggagggagggagggagggagggagggagggagggacugggaauguagguuaguugguagaguguuuggcuaacacccaugaagccaagcucucaacaacaaauaacccuggugucacacacacgcacacacacucacacauguacguacacacacacacacacacacacacacacacacaccuguaaugugccuaguauugggagguggaggcaggaauauaagaggugcaggaccauccuuggcuacauagcagguucuaaaacaacccggaauucuggaaacucugucucaaacaacaacaacaacaacaaaaguaguaagaagaaugcuggcccucagugguaggacauucgucuucauuugcaagccuguguguucaaucacccuguauuauaauacaugguacaauauacaaaauauguaaacuguuuuauacagaagacugagccucugcccgugguuaguacagauccaguauacugaucugaauauuucuuauccuuguuuugguugaaucuagagacaugaacccauggauauggagagccaaucauauuugaugccuuguuccaauuuuucuucccuacagccuacuuccuaugagugggaacuaucugcagacagauagcuuagcuagugaaacguugaauccaccaagggcagguauucguugcugguguaauucucuggcaacuuggaaagugagccuugacuuccuuguuccccauccagauuguuuccuuuagaggcagagaaacacaaaaauuacauuuaguuucugggucuguagauaacauucccuuuuggaaagagguuaggggucaacaaguagggcagucuauucagauagagucccauacauucucaguaugugauggugcaucagcuguggugaggccuugucuacuguauugucaggcaggucagaaagauacuggcagucucaguacauucugccugacuaccuuccucacugccuucuugccuaucccuuaccuuuccuggcucucuuggugucuccaaacagguauaugcccaugcaggcaccacacugcaggggaagauguauauuaccuguggucgcagaggagaggacuaccugaaagagacacacugcuaugacccaggaagcaacacguggcauacucuggcugacgggccugugcgacgggccuggcauggcauggcugcccuccucgacaagcuguuugugauuggaggcagcaacaaugaugcuggcuacagaagggaugugcaccaggugagcugggcccagacugcccacuuuagaaucgagcagaaguccaagaaguucccuuguacccucugguuccaugcaugcauaguuuaaccacuaugcauauccuugcacauuccauaugaugcauacauauacccuccauagaaguuucccuugugccuuuaguuguuauguuuguaucaaaaagucaacuuaccaagcccacauuguagacccuaacgaagcauggagaagaaugagaagcacucauauccucuacuuguauucuugguugucagucugucggugacuuacuuauagcuguucguagucaaagagcaucccaagccaaaugugguguccauuccuguaacucuagcacucacagucuggggcuagaggguugcaaguuugagaccagccugggcuaugcagugaaaugagauugaacaaaauaugagcuagcuagcgcucucuucucuucucuucucuucucuucucuucucuucucuucucuucucuucucuucucuucucuucucucucuucucucuccucucucuccucucucuccucucucuccucucucuccucucucucuccucucuccucucuccucucuccucucucuucucucuucucucuguguauaugugugugugugugcaugugcauacacaaaugccacacugguauacauugaaaaauuaauuaaacccaggaucucacauaugcuagagaagcuuucuaccacagaguuaaucuacaaaaucuacaaaugacuuuuuuuuuuuuuugagguagagcuucauuaaguugcccaggcuggccucgaacucacuucguagccuacucagaacucuuuuaaucuggcaauccuucuucauucucuuaagcuggaaauacagguucaugccugugggccaccuucauaacugcugcaugccccuacuccaguagcuggacagggcuuuguuuggguuguucuaaguuuauuucacauuacauuaugagugauaauuggcccugaagagcuugucagggguuuuuggauucucucaggucaagaauuucagccuagacuuuagaccauugauuuggaagcucuugagagugagugggccuuggccaccuggauaacauuuccucccauggcaagaccgugaccuaguguauaauguucucauuguuucuaucacugaucuccagaagccuaaauaucuccaacuuauucucggagucauaaguccagcaggcugacagauacccugguuuacuggauaacugugaacagccuuucuuggcugccuuccugcugguaaccacuucaucuucaagcagcaagggcagguggagugagucuuccuuccuauuccuucuggcugccuuuccauuucuuauuuugaguacuuacauaauuaaagauguuucuccauucaugauaggacugucuaucuauagucuuacaacaagcuacaaaguccauaaaaugcuuuuuauaugagcaugagguccagaguuugauuccccuacaacacacauaaaaaucuaagcaccaugauggcugcuuguaaccacaguacuuaggcuugaagacaguaccugagguuugcuggcuagccuaacccaaaugcugagccugggucucagugagagaucuuguaucaaaaaaaaaaaaaaaaaaaaaaaaaguaauuccugcggaacagcauauggcauugaccuuugaccuccgcacacauacaaaugcauauaaccacccuugacccaacagcugucaucacuuagcacauggaguacuguaggaacucucaaaauggaguagcuguacugaguuaacuaacuccugaaaaggacaaguucaaacuuggaaccauguugucuaacaaaacuuacaucaauguaaaagcugaaaaacuauaagugaaaccuuccuaagucagaacuguuuguugacuggccacaguugcucacuccugugcucagagcagagccaaguaagucucugcaaguucgaagccaaccuggucuacagagauuuaggccagcuaauguuauguaucuagauccugucccaaaccaaaacuauggagugguccacccaggaaauacacuuccaacccuuaaucccaucuguaaagucaguuuugccauguagcauaacauguucauagguuccaaaggcuaggauucuagggcaaggaguauuauuuugccuauuguagcaagaaccuugauuugcuugcuuaauaaagcauauaagauuuugcgcauuguuaccuaaaccuacagccucaguacuugggagcaaauaggagaccaggcuagccuugaguucacaaguagcaagccaccugcuucugccugucaguuuuuguuuagcuuuugguuuuuugaggcaggguuucucuguguagccuuggcuguccuggaacucacucuguagaccagucuggcucugaacucacagagaucuccugccucugccucccaagugcugggugacaugugccaccacugucaggcuugaagaagaggguuaagugucucuuacugaauacuacuuacuuccuuuucugacaugugagacaugcgcaccagcuuugccacaccuucacuugcacuggguuuuauggguuccuucccuccaugguuacugguuaacaggggacauuuugguguuacgcuucuuggauuauuaauagauugagcauuuuuucucaaaucuuuguuuacugcuuuagcuauuuauuuugcuuugguggucagcaaguagcugcuccacacacuccucaugaguaugaguaagggugcuugcugugaaggaagaagagaugucagguggguccauggccuccgcuccagccuuucaaagggagagaagcaggaguggaucuagagaugaugaggggaggcaucuggacucuuaggagcuaaaggaugggaaggcuagaccaccaaggugagcauccuccagugggccugcuauacaccugaccaugggcagaagugacuuggggugggcuggcaaccugucccagaagcugccuggauugacccuggucuuggcuuugcagguggcuugcuacaguuguacaucucgucaguggucaucggucugcccacucccagcugggcauggugagccuggcauugcugugcuagacagcaggauauaugugcuggguggccgcucucacaaccgaggcagccguacaggcuacgugcacaucuacgacauggagaaagacugcugggaagagggaccccagcugaacaauuccaucucaggccuggcagccugugugcucacccugccucgaucccugcuccaugagcaaccccgagggacccccaaccguagccaggcagaugcagacuuugcuucugaggugaugagugugucugacugggaagaguuugacaacucuagcgaggacuagggcucuccccaguguuuggguguucaggaaggguaaugggcagugaaggccguagagccuggguuagaacaccaggcucuaggggaggggccccuccuuaagccauccugguucaccagcugccccuuucacucuguuucuucaaccagccagcugccagcauuuguaaacucuguggcugugaauuacauuacaaagaaaagugcuggggggaaggcugcuaucaucagagggaaugacccauccucuauaaacucugaaugagugggaucuauuuggccgcuucuucucccuagucuggucccugauggguuaaguaagguccuucuuucaagagauccuggggagagcacuccuagccauagccaaaguuuguggcucccuuucugugaaccguggucagucuggugagcagcgccagcugccugcagccagggccuugagcacuggggagcucucaagguauacucuuagaguaacuauauaccuguaacuggaccuggagaugaagagauacccucauugcucugugucugacccaauauuguugaaaaaugaaauaaagcauuaugcaaaagguguuacaucuaau

SEQ ID NO: 8134 - RNA, 10652 nt, Mus musculus
agaaaaauaacuuaagggaggaaauggguuuauucagcucacacuuuccaucacaguccaucacugagggaagccagagcaggaccucaaguaggagcugaagcagacaccaugaaggagugucacguccuggcuggcuuccucucuaguuuccucccaggcuuucugacucaacccaagaccacugcccuccuacaucgauugacgaucaagaaaaugccugcagacaugccgucaagcccaucugaugagagguaauucaauugagguuccuucuucccaggugauucuagcuucugucaaacugacaaaaacuaaguaguaugaggcccaaggaggaagguacccaaccccgccucagaggcccaaugccagcagacuagaaaagguggcucucaugcaaucaaagcaagacccaggugucagaaaagucuggugugcuuaaggcugcccuuaacauagggccggccauaggaugccacuuguggccugaaaaccguacguaggcuggggaauuaggucauaguuuuugacucuguuaggccgagaagggacccuucagcucucuguaggcacaggcuaacaggcguagcuggccucuagucaccugaggacuaguuacucuuaguugcuggugcgcauggcauuugcauguuugcagggagccugcacucuuucuuuucauaguacagcucaggcugagguaaagcuggugucucagcagaguccagcaggcagagcugaagaacagugggucaagcagagaggaggacagggaggcagccagguugcugggagguacugguucgagucacaggaagagaacugguccuggugagccugauaugaagacaccugauacgaaagcccagaaccaacaaaccgaauggccagcucugacuaggaggcccacaagcucaauggcuccacuuuuggggucugugguauccuuuacagugggaggcucggggggugaucucagcauagaaggcagcuccccagcaccccuugcuuccaacccugagacacccacgugggccccaggacauggaucagcagccuggccagacaguuccagguguucuuuaaugaggauucaauuggggguuagcuagaaggcauuucagcagggcccugggaacagcaccaacgcuguacuuccaagggacugguccgcguaaugugccaaccuggccacgggaacaacacuagauauuuguggcuccuggaauaaucaacuguggucugugucuccaaggccuggaauccucugagugguagaaagcugcccuagaugcuccacaaaguguuccacaaaacauccacagguccagucaggccuggcucuaaaagaagucugaagcuuugcgucgggcagggagcugcagcagguugucugugauggaggcuggguccugugugaggggugugcguguagcagacccaggggcuggagugcuugugggugucugcggcccaccagcuggggucuugaggugggaagaucgugcuggggaugguguauagcuggcccgcagggcacgaucuguguacuugcuggcuguccugcuuacgaggcgcuguagggcuggggacauggcugggcucaagccuuugggaguaagacuguggagaagggacagaagaaaguagccagguuagggggucagggcugcuuaaggcaaggccucccucagccccacaggaaaagacauggucccucugagcagucuggccaaaccugaggcucuauggaaccuuuggcugugggguuggauggaucacagacuuuugagaguuggagucuccuacgucuauguaacuugaauggcauugaccccacaggacuaacaggagacuguagucagguaagguaccucuuagggaaaguccaaggaggauacuguggaaagaugauggagagggccucccagccugcuccacacaaagcuacauucugcagcagagaagcagccacagcacuuacagaggaacccuguggauacccugggcucugcaggcuguguacacacauggccuuagaggcugagagacuaggaauggggcaagcacaaacugaucucuacccuacuccgacccaaggacccgcugccucucaccuggccaaguucucuguaacucuccgcaacgcuuccugcuucuucgcccgguuuuuggcagccgcuucauuggccaucuucaggcccagacgcucccugcguccuggcuccaagaucuacaaggcagcaggcauguaggugaccugugcuggaccugcugucuggccaggcaguccacuauccagaagaacagcuacuacgcaaccuuuuccuuguggcugauacaauuccggcuucuucccuaauagccuuccaaaagguuccuucccgauacuccccacccucaacuggauacagugguguauuacgcaaucccagcaacuggaaggagacuguagaauuugaggauacccugagcuacauaguaagacccuguguuaaaaaacaaacaaaacccccaaaaggcucaguggacaaagguguuuguuaaaagacugacaaccugguuggaauccccuaagaccacguaggugaaaagagaaagaacgacucuuacagguucuuacacucugaccuccacacaugugcuguggcaugugccaugcauaaugcuuauacacauacucacacgaauaaauguaaaacaaggcaaaacaaggggcugagagcugggagugguggugcaugcuuucagucucaacacuugggaggcagaucucugaucugggggcagcuuugauccacacagugaguuucuggcaaaucugagcuacauagugaaacccugucucaagaaacaaaaauaaacaagagcuagucccagcacuucagacacuaaaagagauggaaccagguccuggguaaaacccccagcacaacacaagaacaaaauuagucaaacaaacaauaauaguuuaaaccacguuaauuucuaacuguuuacaguaagggucuucacuuuccuggaacuuacuuugcuauuaccacacuugggaccuaguuuacuuuauccgcaaaggccuggcaauccugcaccauccgaaacaccaucuuucccauaccuuccacucuuucuugucuguccccagcuuuccaucugcuugacacuuggacaacaaaguauacaguaggcuacaucugcccugucuccggcagagcagaauucucugccuugguaaaggccacugcgggucuaguguugcuuucugugcaaccagucagagcccugggccacauagcauccugucugcuccucucucauguuuguauugguuaucuuacaucccagacacagucuauaaccaagaccuccacaaucucuacccaugaugugucuagguguguaguacauaaccucuacaucugcucucgggaaggacccccagggccaugucagggaaagcagugucagaaccacagaacaagccagcauucgcuuucugagagcuaugcuaccccuggugacucugacaccacuguugcacuaaagugaucccuuccuaccacauuccaaacugaucacaggcaguuuggaaggccuggcuuaaaaugaucugugacccagccacuaaagcauaucuauacauuuauccuacacuaaaucugauccuguuggguuuccucagaagauucacauucuuggccugcccaugcauaccaugagucacugaggcccagcacccucauaguauguacacucucaagucucagggaccuuucuuuguucacuuuccaaacuacaccagacacugucucauccacagauucccgauagccuuggacacuguguguuuccuccccauagcucucagggcgucuaucugcucacccacccauccaugccaucaggggccaccugacaggggccacaugauguacaccacgcccuaucugacuuggacuuucuggucugcucuaggucuugaccuccauucuacccacaccuacaauacuggguucauacuguacuaccuuguguauccuuaacuaugcuauguaaccagaggcuagcacguagcccuucugucuacagggcagcuggaguuccuggucugacucugugacaguguagccuccagaccugccuuguugccuugccauggccuccacucuuccaaaucuguuugacaguccuaccguaaugcccucuucugcagaaguccagugucugugcugaguccugagcagcugguacuaagguauccugacugagucccagacugaugcccgcucagcacaacucaccuugaauguggguccagguguccuguccacauaggggcucucggauccuucuacucgcaggggcguguucucaaccucuccccaugucaucaguggggacucauucacaccugcagagggagagcacacaccucaggccggaguaccuagugcgggaguuaucuuucucuccaauacaugaagccuagcugccauugaggccaacagacaaacuccuuuccuucccucacaaauugaagggaaaauucaaaaacagcagcaccccaaagcaagauggcuguacuuaggucagggaaggcgggucuauuggaccccauccuagcacagggccaggggugccaauggaagaaaacacucuugcuuuccaagguuuccuaaaugccagugcaaccauauggugccuuccuaugugacaccuugugguguuauauuacagcaaccagcaccuaguguggaggccaugugugguggggcaccaaggacagcuggguuucacuugauucccuugcagagacugugggacuaguguccagggccucuccaccugcacaacucucuaaaucuauauaagaacugugcauacgugcaucaguaugcccauucauaucacaagcaaaaccugaggcauuucaggucacacgugugucuuagucacgguuucuauuccugcacaaacaucaugacuaagaagcaaguugggcuuuaaucccagcacuugggaggcagaggcaggaggauuucugaguuugaggcuagccuggucuacagagugaguuccaggacagccaagacuacacagagaaacccugucucacaaauacacacacacacacacagacacacacacacacacacacaaagaagcaaguuggggaggaaaagguuuauucagcuuacauuuccauauugcugucaucacuuaaggaagucagggcuggaacucaagcaggucaggaagcaggagcugaugcagaggccuuggagggauguuacuuacuggcuugcuuccuuuggcuugcucagcuugcuuucuuauagaacccaagacuaccagcccagagaugauaccauucacgaggggcccucccccacuugaucacuaauugagaaaaugccuuacagcuggaucucauggaggcauuuccucaccugaagcuccuuucucuauaauaacuccagcuugugucaaguugacacacaaccagccaguacccagugggagaggcugugcacagccuggccagccugggcguauaacguauuccuuaccaggagcaggagaaggaguggcaacaaauccaaagccgcccacucugggggacuccuggggaaugaguuccuugccgucagggccgaccuugcccuguuugugcugggagaaggagagagaccagugucagagguucucuacggcugacuaugguaggugcuaacguacacaucggaagcacuuccccucucugggaaagagcuggggcucuaggagagagggaagacccccauucucaccucuccccaaggacgugaggaacugaagcagugaacauuaaguaaagguugccccucccuucccucaaggaagagccucuuggguugcaaugcuacagagggccagugcuggcucuccccuguggcaucugaguguucccaucuccugccucgccuccaaccccaugaugaucagggacacucugagggcacguacucauccugaucgaaggaucucaguggccuggcucuuucuggaacuucccaguauacagcgcucuucucagcucgcugacugcuacacagguauauauauguaugguauguauauguaugguauauguauauagguauggccucuagaaacuucucuccucucuggccaacaucauaggagcugguaugggcuagaaccauaggucauauaucuagccccauuggaaggggccaaaacaagauacagguccugccacacaggggcuguagcaguucugacaauuaagcuccaucuagccucagaaaaacccuaacuuaaagggacaaccaagaugggagaagccacaccucuccaguuuucccaacgcagcuggucagcugccuggugacucugcuuacucaccugggcauugagggcagccgccugcugaagcugggaccugcucaaagccugacugaagggaucucggaggaaacguguguucuuauguacuaucugucucggcuucuuaaacaacugcucuucaucagggacaccuaucaaaagaacaagguagcagggcuccaaguggggggugagccccaugccucaccucagccuuacaagucaugcagccucaaggcuagauaaaccuccugagcuaagucaccccuggcaaggcagaguagagccaccuuagcucacaaacccucaacaaagcaguagggaagaccacaaugucccaaaagcgucacagauugccccaaccccaaccuggcucaaagguaacaagacagaccacuauaggccuugucuucugccuuguucacucacccucgggauaguacaugagagaguucuuggccuuguacuuccaggucuccacuccagccugacugcucucaauggcuugaugcucugccgaugggaguucaagauuaucuuucugucgcuauagugacauggggggaaagcagggucagagaggcacccagauccuguaccuguggcccugggacuccaucccaaaagaaggugccuuuguuuucaagcuccagggcuaccuucucaaauuccuccucagccugguagagccacgcgugccgugcauggcuuuuuuccuuggccaccuccaugaucuccuggaaggaggcauuguccucacuuguguacuggcucaagaagacauccaggcugggcaguggcuccuucuccucuuccucuccagccucuccugcuaagaggucacaaguagggaaacacacacugcaugauuagcacugcagggcugaggaagaccgucccacuucauaagggcuacaaccccagcuccugcuaggugacagacuaauuccgacuguucagauaaacccagguggcaaccauggccaacuggccaguucuauugaucugcuaguugccaagagaagucugggaucggguugacucaugaaggggcagggucagauacaugacgacaguuuaguaggcucuuccucugcccaaaguguauuaauccuguaggaucuaccucuacagucccaugagcucuucuuuccuccuggaauuaucuuucccuuuccuuucugacugauauuauggaugagugguggccacaaaugccucaggguaugacaguuaaucccuaaggcaggagcccauauggcccagggcuccacggagcaccacacagucccugggccaaaaagcuaaccauaccaccuugaucccugcuaccgaggaaagugauacucuugaagaugcagcacugcaaguuucagggggcugugugaaggggagguuucucaucuguucuacuagcagucuugaccaccagccaaugccuaacacagugguucuaaguucaaguccugagguuagaaaaggguaaccuugggccagguggugguggagcaugcuuuuaaucccagcacucaggaggcaaaaacagaugggcuauuugaguucgagguuagccugaucuacagagcaaucuccaggccagccaaggcuacugguaaaauauauguauaaaaagaaaacaccuucaaauuguccuauuucucugcuguaguucaauuaagggucaagcuccaagaagaacuaccaccauagcaugucccuggcaggaaaggcugggcuguugagaaaacacguuugugugagcaugcugcacacucgcucuaguacaguaugcuguccacuagagccuggcacagaaacgccuuugucuaugucuagugauacauucuacuacagacccagacaagucccuuaguggcaacgcucacauauaaauagauuuauagaguuccuccuaaccuuaagauacaucucauacuugguauggaaacaugucgaaaacaaacacucaucuguucuacaugugugucuuaaugguauaccacaugauacucuaaauguggaggcaagaccuaggcccuacucucugggagggcucaccagguaguaauuagggugagaggcaagaaacagaaaugcucccccugcacccacucaccccccacccacugaacagugagggaaacacagugagacucucuggucucaacaaaacaaacaaaucagaaaacuaaaggcacucggugagaaacagaggcccagguggcuccaacauuacacaaaaguucaagaacccaguguccagauuagcuuccgccucuaagcccaaacaguuaacaauugaauaccgaccugaagggagagacacaagugacugccuuggaagaaagaagguagaggagccuaaggcauuuucaggagacaaagcucacaaggcuggaacacugaacacagacugggacgguacugggcucucuuucuagagacaggccagaggcagagaacacaguaccuccacacccgggagcuggccucugcucuucugccucccagaccagugucucugaucccaaaaguggauacuuaugugacccuaagaaaauucacaagagccgggcgugguggcgcacgccuuuaaucccagcacucgggaggcagaggcaggcggauuucugaguucaaggccagccugggucuacagagugaguuccaggacagccagggcuacacagagaaacccugucucgaaaaaccaaaaaaaaaaaaaaaaaaaaaaaaaaaaaaaaaaagaaaauucacaagaauacaauucccaaguagucuugacuaugagacuaaaagagggaguucacucaccaucaucuaggucucggcccuggggccggggcuuguugcccagcacagcagagccuggguguaccucaggaguuucaaagguggcuggaguaacaucugagagaagcaaaucagaaauuagagugagccuuacgugauaacagacuuucccuaagcccucuaaagcagcacccguccucuuacagggugguggagguucccgagauaucuugcccagggcagagccaaacuugauggcaaucuggcgcaugcgcuccaaaucuccguuuuccucggccuccagguacuccuucugugccuguagcuucuccacaucagggaagaagucucucuggauaacugucugaagucccugccaugagcaaucagaacaaaggccagaguugucaucugggaguccugacgcacaauccaccacuguccauguuccaccccuuagaccuuucccuucugccuagcuggacaacugucaucuacaagauagguuuagaacugucuuuucuaguaaggcugucaucccacauagcucugauguaccaguuaacuacugaacaaucucuugaagcccaugaaaucccucacuaacugaucuuucucuuugcuggcuccaucuauaacaccagccagacuaauguggauauugucauccuccacccacccaugaauuuguauuucaaucuaaaccuuucucuugaaagccagucgccacuaucgccaccacaagaaaaaguccucaagauuucagauccagcccgcccuugcugugaagcugaaagucuguacagucagcugcacggcaaugguacaaggcagcauaucccagaagcauccuaaaucuaaccagucuaaaaccaacccuaugucggucuguccuccagcguguuugcaguuggacccuuaacucgaggagcaacugagacccacucacucaaugacgaagccaguuccacugucuaauuccgggacccccagccuuugacacuuuacagccuuccaaaaagucgucuucaccaucucucgaaaaacgugucaaaauucuaccuauacaagaaacuauuuccuugacucucaacagaaaacuggaugcccacuucugcauuguuuucuugguucucaaugcuuuccaacccaaaaacaguuguuccacuuccaagggcggcugagagugccaggaccagaaaaaauucaaaggacuggacaggaacgcgaauagggggaggggcccggaagucgccagcgcucgcacugagcugguaccucgauguacucuucuucauccaggacccgcugccugcuucucgcaacuccggccucuccagccuccccagccgcgcgcuuccuugagggcgcggacgcggaggacagaaacagagcacccgccgaggucccgggcguccccaucgcuaucccagaaucgcucgggcggcgucugcaccgcuccaaca

SEQ ID NO: 8135 - RNA, 1173 nt, Mus musculus
uaauauccaaagaaaucacacuuuaauaguugaaaaaugcuuguuuccugcauucuaaaaaaaaccccaaacuuuaaguagagaaucaagaaauucagaguccaagcuugcauaucugagccgugccccagcccagugacugucucauuuuaggcaaauaaaagaauucuugcuuuccuuuguaucccucccagcacucagaaaacagucucaguuuaagauuucaauuuuuuuuuuugaugcuggcuuuuaauuuccuguuucacagauucuuggacuuauaaauucguaggucuaaagcauagaauuagagucugaggaacaccuaguagccucuucaagaucugggaccaccuagacacaggacaaagaauggagauacuggcacugcaccuccuaaaaggacagugggaaaagcacuggggcgugguccuguaacguacaacguccuacucuguccuggcaauacccaagaagagcauucucccuucugaucugguuguggcaagcccugagcccccagaguggccuuuaacaccgaugucacauuugucuucucaguggaaugucagucaccuauccuccaugucaccggccuaaguaaacuaugcuccaaaggcauuaucuuaagugaccccaggagacaagccacccuuugguccucagccuaacugaaauaccuaccucacuagccugacuaccagagcagcgcagccuccuaacgcucccaggcguugggaagguuuucaagcacuggaucguaagaggacagcucagacugucuggccagccugcacaaaggcccucacagaccuacggaggcuggccacgugccagguccucuccaucaagucaccagcuccucaggugucugggagauucucccgguguuccaaaaggaaaaacaauacgccugccuccaugauccaaaagcugauccggacagagaugaacacaugagagaggcugugcccgccucgacaugcagcauggagagcacagaccguuuggugugcgagcgagggcucuuggaauucacuucuggaagaagugcuaccuagcgcucuccacgguuucggaaacacgggaggaugggaagcacggccuccgacacagagacaccaccguaagccggagcaaggcagcucuuacgccaggcggcgcuuguugaug

SEQ ID NO: 8136 - RNA, 3477 nt, Mus musculus
aggaagggaaaccugcauuugucgggggaaccugccuaggaaaauucuguuuccggacgaauccgggaagggcagagugaucaucgcacugcccgggagggugcacgaaggccaagcucuguuauuacaauaauucagaagacugaauucacgcaccgggguggaugugucccuacaucgcccccaggaucucgaggcccaccuuaaccccaaggcgcgcuccagacgcacgugucucuaaacugcaccuugacccacugcuacccgccuuggcuuagcguugcuguccggagaccacgccuccggcgggguucuccgucuccccggaauccagcaccggccauuggcugcucucagcucuccgccccgacgcgugccccagugcaucccgcccaagccucaguuucccggcuggcacggggcguggcgugggcggggcucagcucaggccacgcggggcggagcccgggagcugacgugaccaccccgccucccggaccagaauuggucguggucucaguagccuccggcuccgcugcuucccgagaaccccgcgccggaggcucggacccgaggucgacgccgggcgccucuccuccugcccgcuauggcugcgccucgcgggccccgcgcucugucggccgccgcgccgggguccgggaagcccaaacugacgcaccccgggaaggcaauccuagcaggugggucacucggaaccccaacucagagccuguccgacagcgcuuccgggugggccggggacgcccaggccccgcccaacuuccggaggggcggaggugucgggguugcgacccgggaccccuaaguccacucgucugcugucgcucagagucucuugggcacuccaggcggagaccaccgggugggggcgugggcaucgucgggacgcuggcagcgacgcgggcaaaguccgggcgggggaggggccgcgcggcggcggcagcgguggcagcgguagcggcuggguccaccgggcaagggugucccuagccccaggcauuugguccccacaggcggccuggcuggaggcaucgaaaucugcaucaccuucccgaccgaauacgugaagacgcagcugcagcuagaugaacgagcgaacccaccgcgguaccggggcaucgguaaggagggacucccggggguggcuagggggacacugcggagcagaggagcuagggucuugaccgcgccucccguaggagacugcgugcggcaaacuguccgcagccauggcguccugggccuguaccgcggccucagcuccuugcucuacggcuccauccccaaggcggcugucaggugagacucugcucuguugaaacgacccggagggaguggccgcagcgggcccccucacaugucuucuucauuagguuugggauguucgaguuccucagcaaccacaugcgggaugcccaagguaggcucgacagcaggagaggacuauugugcggucugggugccggcguggcagaagcagugguagucgugugcccuauggagaccaucaaggugagggauugagccuuucagggguagccaggguaucuucgggcucccagguuuuaauggcaugugcccccauggaggcugucaaggugggaaggguccccacacauaugcaccagguucgugguaaaugguggcagaaagggucuccuguggcggcucaugcguaauaaaagcaugagcgaagucuucaaagcauaacucacuauucaaagucuaggaaauagcaaauguaacgcuggggaaacccucugaggucuuggggccuauguguaauggaacucaagaacagccuagggauuuccugcagaagagcugggaguccccagcuuuggccuaacguugguaaggucugggucugccagauaaagugcagauguggccaggaaccagggccauugcuuccuuccuuuuaggugaaguucauccaugaccagacuuccuccaaccccaaguaccgaggauuuuuccacgggguuagagagauuauucgggaacaagguaagccuggagaauggagaccugcuaagugggacagcaucuacuugaguggcucccccuugacugcaggcagggccuggaaggcuccagcuugacuccugucugccugucccaagggcuaaagggaacauaccaaggccuuacugcgacuguacugaagcagggcucaaaccaagccauccgauucuuugucaugaccucccuacgcaacugguaccaagguacaccaaacccugagggcagcuuauuccuggaagggcaggcacacccuaccccagguuuuuccuagccuccaaagcuccccucugacuuaaucuucccaguauucugacugcaacuuacuccauccaggagacaaccacaacaaaccuaugaacccacugaucacgggggucuuuggagcuacugcgggugcagccagugucuuuggaaacacaccuuuggaugugaucaagaccaggaugcagguauggaugggaggcugagagaguagggauaugagcacuagccagaggcuagugucuaaggacucugcccugcgguguccugcagggccuggaggcacacaaauaccggaacacccuggacugcggcuugaagauccuaaagaaugaggggccaaaggcgugaguaggauagaggagagcuauugcccccauuccaggcccucuuuuccuagguggucuuccuucccacauugcucaccucagacucucugcucuacccagauucuacaagggcaccguuccccggcugggccgagucugccuggauguggccaucguauucaucaucuacgaugaaguggugaagcugcucaauaaaguguggaagacagacuaacccuggaggaugcagugggguaucccagcuccuccauuccagaccccccgccaccuacucugaugauuccagugcaguagugccaaaaggccccuuccuuugucccucaaguucuguggccuggugugucccauaguucuguauaucccauguggucuguguguguguaacacuaccauuguaucuguguccagccuggccauggcugggugucucuuuggccugugaauaugugcucacuuauccaugugcuugcuugugagccacaugccuguuucguguucucugucaugugacccugugccccacuuccuggggugccuaugugcccugguucauggccuuggagccauggucaggucacaguccggugccuuccacccccuauggcaagggcgcccugccuuggccuaccacagcugccuccaggcuuagaccuggcuucaccgcauuccaggggcuauaggccccccugcuuuucccgccauuggccuuaaauggcccucgggcccucccuccgcccggaacaggguggcaccugccacucucaggaccaccuugccaaggagaauaaaccggauccuguugcacucuccuguccau

SEQ ID NO: 8137 - RNA, 18506 nt, Mus musculus
ccuagguagcacagacacaaaccauguccuggguucuuuauuuucuaggccauccucuggcuucuuccauccagggcugggacugucaagggaggggcuacacaggaauaaggcaacacccaagccuggaaggaaugugggauaugcccagaggagaaggugcuagaaccaauauucccacucagcauccagucaaggggccuucucaugacaucauuccuauugcuugggcccuuccccuccaaaucugaacaguggauggcagcaggcauagccaggaucuaaucagccccucagagagaucagaccuguuggcagcuggacaguagcccccacacagucaaggcuguggcacccgccagccauccuaggcaacggaggacagcaaggacccccugcuuggucacagagcugccuuucccacuuggcagccccucugcugcagcuuccugaugaguuccaauagguucaucugcagcgucagcuccugggaugcaaaggaggccccaguaaggaccggcuugacaccucgggcccuucugccuuggcuaagacagauauaagggccuagaagaugucagauaaccaggcuaagggggugauuuuccuguggaaacuggauaccguggaaccagaaccacggccacagccaugagaagggagaaucugggcccuuguggcugguagggccagcagucucugacugacuuacagugaaacagaggcuggcaugccagagacaggaagaagccucugcaagguuagacaggugaacacuaccuggggcgagcacguuccccuuccugugggcgggcauggggacuagacucugcccuucacagggucuuucaccuaagcucuaucacugacccucagcucacuaggaaccaaugugccaagacuccagaugggcuugguguauugacauacacccauaaucccugcacuuagaagccgaggcagaggaccucaaguuaaaggccauagcagaccuugucucagaaauaaagaaaaaagaaaaaagaaagcaaaucacccccaaccagaagaaaaccuaaaacaaaaguuccagauagaacugaaccuucaggggcugggacacagguggugacagggcuggcugaggugcugaccugaggauugguggucacguagaaaccagcuaccccugccuucuccagugugcucugcuggucggcaaccuuccgguccagcuccaggacaaucuuucgguccauagccugcugcuccucccggauccgauguuccauggccugccaugacuugaguaagggugguuccugcuagggcuuccgcccagggaugccuuaaacacaagcucccaccugcuaccuccuccuggcugcccugcccaccacagcgauucuggugacacgguauccuugcuugugguucagcagagggguccccaacagucccagcuggaaaugccuuugagaucugucauucaucccuuggagccacugcccucauccccagcaucaaggcuuguugauuuccugagggucuacaucugccccugagcucccuggccucuuccugacuggucuuugucaucucaacauugugcuucaucaccugagauggaaagggcagggucccaacucagugacugcucuauaagcacagagaugcuuguuugccaggacaggggagugacagaugggcugugacucuccucagucaccaugggaaaaagucaugaguucaccaacccuucagcacccauuagcucugccuuggaccacccucagccccgccacugagccagcuaguacccaugaggagucaggccuagccaucuagucccaacuccuaccuccagcucacgcugcugagcugccuggagcacuggcaaguuguggggccggcaggacugcugggcuuccaggugcuucugccuuagagucugucugagcacugugaggaagggagagagguccaucagcaaaagcagguguugggaagacaggggcagcugggugagaggucuaguucaaggaagcacuucccagaaagcuguggggaguuuuagucccucaaggacugcucucaaccagcacccuccuuuaccuccacggugcugacagggcuguguagguuaggcagguauagcaaagaucagagcucaguacaaccagggcaggaacagggggcagacaggugccugaggcagguggccuuuggucucagguggcccaguucuagcuuucuuggacauccuccaaaggauaucacacagggacucugggugaguacuuaagcauucaagagcucaaagcccauacaaggaggaagggggcucugucugccaguggugcaguguguugaaucaagcuuggugcuacccuauggguaagcagagcagccccugcuuggcagccaggaggugaagccacauacugugagccuacaggguucugugcugggaaguccuuacccucugcuagcaagcaaaguacccagucccugguaaacugccacacacguagacaugcccuaacgggcagagagagaagggagcacagggugcuaaguacucacuaucacaaaacggagcgcaccacacccaaaaacacgaguguggcuggccggcucugagaaagccaacaccuuuauuccuagaggagauucaugggacagcucuauucagaagggucccugggguucccuuaaaucugacagccucggcagugcuuacagccuccccuaggucuuggcauuuuauguaccccagugauaccauuuaucauugcuguuugaaacugacuuagucuaucauaaguucaucaacacaagggcaaagaagagauggccugcuugucugguugcagugaauaugaaguagucagaaggcuuggggcagcagguacaugugugagacaucaucuccuucaguccacuuauccaauacugcagaacaucccaggucaguucccagaguccacacuggcucccugcucacuagggaccuggccaugguaauguccaaggacagcaagguggcccaugccagccaccaccuucuguaucuggcugaaggcagcagaggcacucacugccagguguaucagccuaguucaagccuucugaaagacaacuagcaaaggcuugaagcagguaccaagaacaucccacccaaaagggcucuauaggaugaugagcagcuccacagugaaaucaggggaagaagaagucaguggugucuuuccuuccuggugauggaagcaagugcuggaagaaugguggaagcaacagaaggaacaaagccuccuccugcuuacuggaaaggaugagcaagguagggccuggcccagacuuggaauuucaccacuggagaggcugagacaggacagccagcucuagacaacacagaggaacagucucggaaaaccaaaauggaaaagaaugaacuuagucguguacuuuaggcuugugaacuagauauaccacauaccuccaucaaaacauuaaaaagaauaaagaaaagcacagccgggcuggugagauggcucaguggguaagagcacccgacugcucuuccaaagguccggaguucaagucccagcaaccacaugguggcucacaaccauccguaacaagaucugacgcccucuucuggugugucugaagacagcuacaguguacuuacauauaauaaauaaauaaaucuaaaaaaaaaaauuauuaaaaaaaaaaaaaaaaaaaagaaaaagcacagccacucaaacauuuggugaagaacuaaagcucucggagaacaagagacuucucaacacauucugaggcauuaccuucauccccacacaaauauuacaagaugcauuccuagaauacaauuccuuucugggauuuagaaaucaaugucucacgagaguaacagcaaaaccaucugaucaucuccacaggaacugcaaaagauuucaacaaaauccaacaccuaucucuaaugggaaaauccugucuggcagcacacaggcauugccagaaaggcagaguauguuugcauguaaauguagcccaauauagaaaaccugcuuagcaggugagaagcccuggguucaguccucaguuucaaaauccaaagcaauaacaaagcccaaagaucuauaacguagcauggggacaucgucacacuauucuuuccuaaaauguuugaaccgagucaagcuugaacaaauaaaauggaaaggagaucugaugguacaacggaagaugccuaguauaauuuauaggaggaggugaucaagccugauacucaaugggaaggugcuggaauaauggauuaucucugugguagcacacagcuaucaacagaccuacaagcagcgagguccaucaagccuaggaggauguggguacucuagggaacgcgaguaagaaguuucuggacagcagacuaaaaggaucagcauggcucugcacccccugacccgaggcucccgcggcuagggacgcccuagggaaggucccgucgcccccugcaccucgguguucguucugcagccgcagucucugguuguagaggcucuucucagugaggugcugaaucuccagaagacccugcacgauuucaaacaccguuccgucgagcagcgccagggccaagucgcugagcgugguguaggacaggcgcugcugaaaggagcugcggguagaucgccgggugagcgcggccgcggcccuggccccggcuccggccccggccccggccccgguccucccgccgcccgucgccgcgcaccugggcagcuccuugaccaggcucuguagugcugacagcagcugguagugccgcuccugcugccgggcccgauccgccgccucauccccggcggccgcauagcgguccaucgcgcgguuuaccgcgcggucccccgccgccccucuacucggucuccuagggugccccggcgcgccccgcccccucacgucauucuccagcgcgaacgacgcaugcgccccgccccuccggucggucuccggccguucaccguggugcgucaggcacaauaagacgcgcuccacccaccagggagacugcuuguaagcgcuuuguccuagggagaagaaauaggggcucgcugagcucccaaguggugcugaccuuggaggugcgcgcccagggcucugcauucugguguuuuaaagaagcaacucuggccugcuggguguuuuaaagaagccagucuggccugcgccuagugugcgcagacugaggccacuggaagcuggacacucccagcggguugugauccacccugggggaccucaggaaaacaguacggaggagagccagcuucucuuuaggguucuuauucucauuaauaaaagacuuuaggacaauuuuauuagcguuaaaggauaccccacccccacaaggaaaccucagcgacugccuggaaguggagaguagaugagaaaagagucuugugaaguugaauucaugcuggcucaacaguccuuuaccuacugagccagccccagccccugacaguguccacauucauaauuuaguuugcagcaugaauaagagaaaugacaccuuccuacagcguuuuuuuaaauaaaaauuacauucccugaugugccaucuuuuucccuuuuauuacuauuuuaaaaauauaacucuguugaaucauccugguuacuuucuuuuuguuuucccuuuugccacgauaagcucugaaguagugaauucagaucuggguaacauaaauuacagugaagaaaccuugugaaguuugaaugcaaaugaccccauagccucagauauuuggaaacuugguccccaguugguggaauuacuaaggaaggauuaggagguguggcuuuauuggagaaagagugucacugagggcugguuuugagauuuuaaaacauacaccauccauacauucucugucugucugucugucucuguaugucugucucuguaugucucucuaccucugucucugugucucucuuugucucucucucucucugugucucugucugucucuuucugacucucugucucucugugugagugugucugucugucugucugucugucugucugucucuuucucuugucucaucacuaccagcaccaccucaugcuuuugaauuaagauauaagcuaucagcuacuuccccagggccauaccugccuaccuggcuggugccaugcucucuaccauggugguccuggagucaccuucugaagcuguaagacccccaacaaacccuucuguaaguugccuuguucaugguguccucgcagcaauagaaaagccucugaaacaccugugcauggagaaauaauuugcaugaauaaauauacuccaaaguaacuguaauuuaauguugacaguauaccaaauuauggugaaucauuuaaaucagacauuuaaaagucacgaucugcagcuggggauguagcuuaguugguagagcguugccuagcauucaagaugcagugggguucuaugugcaguaucacagaaaccaggcaugguggcgcaugucugugauuccaguacucaggaauuguaggcauggucggaugcgcaggggcaucuuuggcuacauagugaguuccaggcuggccugagaugcaguagacccuggcuccaaaagaaagucauuaauuguucacauacucaacucuggauauuggagugugagcaauccuugaacaucuuuuuagcacaccaauuaggauacaaacagauccuaaacagggacacaugccugaaacacauaguauuaguguguaccccacaaugucccguaggccacauauuacagccuaugacagcugagaaggaugaaggcuagagcaaccaugguaccaugccaucugugauaucacaugacagcuaauggaagauacaugccucugacauaucaugucacuaaaucauguaagacaucguaugacagcugggaggauggauggagacugccauauuacguaaugauucuccacagugacccagaggagacuagagagcacugugcugugucacaucaggccguugugcauauguggcacauuaagaugaucaggaguggaggccagaguuaauagcuuuuucccuguugcuuaguauggcaguccagagauggcaugcagacagugagccacagucugccauagggauaaggugaugucaccugugauauugugaugccagggcugcaaucuguccuuaugagaauaaggaauguguuucuucucagcuguuagaccaaggaggcuguaagcauaucaggucugggccuucaaccuauauaaaaugucauguacaauauaagauggaauacaggccugagaucucucucucucucuaaauauauauauauauauauauauauauauauauauauauauauauauauauaucagcugagaagagagaggcaucagucacaugucacuguguaauacaugguacuacccaacagcucagagaaggcucaaauuggcuugcaccauguuacauaugauauaugacaacugaggcacauuuuuuugucaguuugugucacuacauaacacaucuaauauauaauacuuaucuaauaauuauaagagcucacagauggaccagaccuugauucauguuacaguguuacugaggaugucauguaacaucaaagaucauaaaccucagaugcacuaugucacuguggcauauaccaaacccugcagugacuuaaagaggggacauucauccuauucaugucacauaugugucacacagcuuaugggagaggauacacucaccacucacuuagacuguguugucaugugacagcagagcaggugcauuaggacagcugcugaugggacuguggagacuagaggcacacuuggucacuguggauuaugaaauaccauacagcagccaaagguauuggaaagcaagucgugcuauauuguugggcugugcacauaagacuggucucuguacugagaacaucagacuuccugaaugacugggugcagguuaaaucuaugaaucauuuuguucagcagcauacacuguguguaagacauuggucaucuauguguguguguguguguguguguguguggugagguaucagcacacacacacacacauauauauauauauacaaauauguaugugcauuauaaauauauuuaaucuguguuuaaguacaugagugauugagauugaaacacugugcuuagaaagauaggguuccaguacugcauuaucuaucugucugucugucugucuauguauuauaagacagggucucuguguauagccuugguuguccuggaacucacuaugcaguccaggcuggccugagacucacagagauccucgggccucugccuuccaaauacuguacuuagcagcauuugccacauuggucaggaagccucacuucauccccaugaaugcuuagcauuguccaucugacacugucuauccauacaggucucaucuuuguguuuauuaaggggcagauuugugaaugacuuuauauugcacuuucucuauaaaaccagccucacagaaggugguguggguacgaagucuucauauacaagacugugcgaguggaacacugacuugaggcgaugcugugucuacaaguuucccacagugagcaccacuagacuuagcugacuuaggugcuguuguuaucucagaggaacacuguauuuagcuaugugugguguacauaauacauacuuuggggauaugcuuuuuaacucucuuuaacagcuuggugugugaauaacaaagcauauuaucaucucugagaaagacuuucuuaagcauuguacacugcauguaacauuuugcucaaugacacuuguuuuaaaugcuaucuaccagauagauguaugaguuacagaaucccacagccucugagaauaguucccaguagaugaugacacaaguguucaguguaugucagcagcucgucaccugggcuagacggccuccggagucuucugaguggguaguuugugaucuggaagguauagguugguguauuuaaagugucguaggaggggaaagcccugccaacugagaauacuauacacaacaaaaauuuucauuauucuggagaugaaauuaaaauauuccuagauggaggugcagcucagugguaaagccuaccaucuuugucacgguggcugugcaggcacaaugaccagaaaagaaagcacauaaccgagggcuugcuuagacuuuaguccauugcugagcacuacauuuucaucuguaaggagagaaggggggagggagggagagggagaaggagagggaaaugaagagggagagagagaauucgagaacaacagucuagcaugggcuuuugaaccucaaagcucaccuccagugagacacuuauuccaacaaugccacaccuccuaauccuucuaauucuuucaaagagucccucucccugguggcuaagcauucaaauguaugagccuaugggggccuguggcaggauuuucccuguccaauuacauuagugcaaaagagaucugugauuggacagggaaaagggaggcagagcuaagaauugcagagagagggagagggagaggggggaggggagggggagggagagguagagagagagaaaaaaacugucucaggguaggagaaggaagauggcuucgaacaugaaccugcauggcauuuuccagccacaaguagcuaugauuucacaagguuagaaauauugggauaaagcuuuuaucauuaucaauuggcucugaaauuauuguauuggcaucuuauaaauugugauauucuaauugguuaacuuauaaacuuaagaguuuuaauucuaccgguuaauuggguaaugugauggcugaccauggggugcgugggcguuguuugguagugagaggaacucaguggcugccugccagaaagauggcaugcagagggaccgcccagugaaaugguugucggagcccuguggcccgcagggcuggagaguuggcuggccgagagagaguuggcuggccgagagagaccauuagagugagaucaccagaugggagcccuguggcccgucguugcuggcacuagugugggaacuuaucgauucauuuguuuaaaaaaauauuuccugcaacaggggccauucucauucaaaccaucauaccuacuauguauaaguuucuagguucagucauuagaaccaccaaaaaaaaaaaaaaaaaaaaaaaaaaaaaacuaaauuaaaaaaaugaaagaaaagaaauuaagauauccccagcuaagcaaaagcugaaaaaguuuauuacuauuaaacaggaugaauaagcagugcuguaggcaacaccagcacagacaagaccaacuguggguaaagggaaauagacaugaaccccaagggugcagacguggcacacaugccucaaagcaacuaacaucuaagagagcagccaugccugguccugaaacccagacaguuauccagggccggugaaaucauggaccuuggaggagaaucuauagucacugcuuuucuaaaucagaauaaucuaacuaaauuacaaauaauuguccuuauacccacagauaagaggaguccucacccugcaucaaggaaacuucucuuugccguagauggagaccauugcagaaaacuacaacagaucacaauacggaguuguggaacccagacucaagcguagcaacuauuuaugaaaaagauagcucaagaaaaaaaauuuuuguuugagauaggguuucuccauguagcccuggcuguccuggaacucacucuguagaccaggccagccucugguucagagaucuacccaccucugccucccaagugcugggauuaaaggugcaugcuacuaauucuggcuuuuaagaggccauaaauuugaaagagagcaaagagggacaugcaggaaaauuuguagggaggaaaaggaugaaggaaauguaaucucaaaaaauaaaauaaauaauuaaaaaauuuuugagucggggcucuguuuuagaacuugcuauguagaccaggcuggcuuugaacucacagaaaugcaccugccccugccucccaagugcuggaauuaauggugggugccucugcugcaccuggucaacuguugaagaguucuucaggucuugauguuuacugacacugcacugucagccuccugaaaauaaacgcaaacauggccacagagggcaagccuucucagcucucuucauuugcaaagcucagggcacaggccuuccucuccuggacugaugucugucaagauacuguuuaccuuauuaccaguuucagagaggagcuaaacucacaaacaguuuccaauguaucuuaucccgacuccuacauuuagaggagcuugcuuuaccaugacccuucccagucaucaaccagccgcaccccauggugaaugguuggauagaaaaauaugcaaagaugacguaagguccgaggcuacaaaagcuuaugccaugagucucuaagguguuuuaagauguguggaagcaaguuauaaagguuugaggacacggacgccuaaguugugagggccuaaaaagauauuuuaaaugcaccuguuuugguaaaauuguaaagguauaagacuugaagaacguaaaaaugaaaaauguuuccuguuucuuuccuucacugagcuauuguuauauuaacacuucagaaguucagaguuuuaacaauggaguucugaugcgcaucagccucuaucaucauggccauacacucaagauuuuacauuuccuuugguugucuucuaaauguagucuuaaaaacgcuuuucacugugcuaaaaacaucugucuaucgaggcuccugcugcgccucgauacuaagguugaaaucuaccacguccacacagcuuuccugucugaaaugcagggcuccccgccccccgcacgcuuuucuuaguagagcuuccucuucuccaccuguucucuagaaugcuucuucaugcaaaugagguaccauaaaccauaaaccucagccaaugaaacgucucccuaagaagaaccccuucccacucuccaagauucauauauacauugcccugauucacccugaauaaaguauuugcacacaagugguuucacugacuaucgucuaagagagcuguuuucuaaaagcuguaacacugaaaucuucagaggaggcacaguccucgccaccccccccccgcccccguuccugcugaccgaccaguucugguucuggauuugcuccaucccuucccaccugguaugcguugggguuuggacacccuaaggaaagaggcagaccucagaacuccauggcacuccauccuucccugccugguuguacaccugccugcugugucuauuccugaggugagauuuuccccacuuucccuggucuuggaauuccccucccccaacuacuaggaccaugagccuaaaaguaucaaauauacuccuaagaaaaaaaauucccucuaaacuccauaacuuucucuucugcccuguguguguguguguguguguguguguguguguguguguguguguguguguuccagcaucuugccagguccagguguuuccucaaaaucugcauucuaggcagauuccaagcagcuaguccuagguuguccagccucagcaacugcuccaacugcugccugaauguuccaacaccagauggucccacagagccuggaaagugagcgaacuacccugcucuuccaggacuuggccaguaucuuaguuuuccuggauccccaaagauguuaauggccccaaacagcaagaagcaaucuaaagagcauggcuccccaauccugccccaccucugccucuuccaguuuccucaccuuuuauaauaaacauaagggaggaauguuagaaauuggaugcucucccggucugucuucagugacucagugccagcagcgaugucaucgccagucaccaaauacccuuuaaaaggucaccagcaccgggugugguggcgcaugccuuuaaucccagcacucgggaggcagaggcaagaggauuucugaguucgaggccagccuggucuacaaagugaguuccaggacagccagggcuauacagacaaacccugucucggaaaaaaaaaaaaaaaaaaagucaccagcacagacaugucuguccguuucucucuguuuuugucucuaucucugucuguuucuguuucugucucucugugucucugucucugacucuguaucucucugucucucucuauuucugucucugucucucucucaugcucugacucugaggcacccaucuguucucccuucuuaauaauucucugugugagaucuguuguguaguguaaucucuguggcauaccuugaccccaaauugccaagguacucugccgcaaaacucaaaacccugaaaaggagccaguuuaugacacaaggacuuagggugacacccagaaacaacagaaggaacggauuuuaguuggcaaacaauguucuucuuucccucuuucuuauuuacguguguguguguguguguguguguguguguguguguguguguugcggaaugccuuggugcugucuguauuuugaugcuaaugcugucauaugauuccaagugaaccugcuccccaagguaacugaaaaugaaggcuagagccugugauugggcaguggaaggaaaaggcagggauggaaguuuuagagaaguagagagaggaaggaaaaaaaaagauaagacagaggacggagggagaagaagauggaagaagagguggaagauugagcagacccacgaggccuggaggagcugcaaguaggcagggauuucauagcugggcaauagaguaguguaaugauauagcugcccagucuaggcguaguaguuuauaaauguguuaacugaguuguguguucuuugcacaggcauauugugguuggagauuuacugauauaaaucugaccgguauaaauauaagucucuaguguucuccuuucauggggcuagagggagcucagugagaccagagugguuguugguguucuguagagcagccaugggagggcuagauggcugcuuggagcuagcuguggggggugggcaagacugccgaugccagcaccuagccagaacaagcauggguucuuuuaaaauuacaugauauauauauauauauauggaaaucauaggcaagacacaaaggcuucucccucaggguuucaguuuuagaugcucagcaguugaguggccaagcaguuuugauagccuuuaggcagggaugcauugugcaggaauuuauggcuggucuuagugaccagagaccaauuuucccaggagugguuuuaucaacggaaguauucuuaagaauacuuuaaugagaugguauaacaauaguucaguagcccuagguuccccagugguucuaggagaaugaguugaaucauagauucauaaucuggggaauuuaauucuaggguucccagcauccacaguguuguuuggucuguuuguuguuuguuugacuggggaaauacaaaggauauaaagggguaggcagucacaucugcaaauggacauuaggaccauaaaacaaggagauggagaaaauaaacaccugcuuuaccagguagacguugguaaccauggaaacaagucauucagucagauucuaauucuuucuuuucuuuccuuuuuuguguuuucaagacaggguuuucucuguguagcucuggcugaccuggaacuugcuucuguagaccaggcuggcugagaagucacagagaucugcugccucugccuccagagugcugggauuaaaggugugugcugccaugccuggcaguaacucucugauuuucaacaggaaguugugacacuggagggacuugaaaaccagcauguacuuuggaaugcuaacaggcacaccacagacagccauguguccuuucugccaccgauuagggaaauggcuccugugguagagggaagccaucuucacagguugcugaggaaugcuggcuuuugucuaacugacagaauuuggggaaauggaguuuucuuuggaccugacauucuagccuuccguuaaugauaaggguaauguaaucucuucuguagcugcuucuuaguugaaauuaggauguuguuuucuggggguggggugggggugaaaucaggaaggcuggaauuuuggugacaugcuggggacaacuggcucacugaacaccuugggcuagucugaaauauugcccaaagcagggguuccagccuguagggaguucugucauaaguaucugguuuacaucagcuuucgguaaguccagggcucacugcuuucacagcgcugcugugcugccggccacgguugaucgaaaaucugcugagacaaauauagaauagaggcggaagguaaagcgcaggaguucaaggggaaaucuuacacuugaauccuccaugcugguggucuugguguuuggagcagugagaagagucccaggaccaggggaaggagagagcccauccuuaggaagccagcaacucugccuagagcccacuggccucauguguaucccaagcuugacugccccaauguggagguggcgcuagggagugucagugaugagcccaccgccggggagaggcaguacuacgugggaagcuucagcucuugacugacaggaguccuuaccuggaggcugaccugugagcguggguccaaguugcuuacgugaauucuuacaaaguugugaaaagauaaagaaauacuaacuugagaauauuuucacacugaaaccuguuuugucaauuuaaagcugucuaugucuguagaggcccgauuucuguguaugaaauggacugacaggcagcugcagccuuuggcggaggaucuggacacuccuuguaaacugauaaagcuacagcuagacaucagucaucgucagagaucugagaaggauaaaugggauaaaaaaggauaaacuauaaugcaauggccucccuaccaaugaaacuuacccgcuaccugaaugguuauccuaggauccuccaugacggugcugagaguaucacuagguucagaagucagggccuaccucggugagacaaaaggggggcagucaguucuccagugugcagcuuguccacaguuugagcagaguccgagcagugggugagguguggggcaguucucugcccagugguuaguauuaucacuauccggguggguugucugggcccuguucuauucuuuggagaauaccuuaggacuaacucuagaagcuagcaguucugucuaucucgggaagcuuuugcauuauucaacaggucucugaggauguugagggccaucauguaagauuagguauaucugguuuuaaacaaaacuuguuuguuuuuaguuaguugcuucaggcuuaaccuugguagcauaaacagaaagcuaaagaaggcuugucccuguaaaugaacuacguuuguacucagcauggcuacaaacaaaguccugagcacauugaagaaugugauuguguguaagguggcugacuacuaacuugcuugucuuauuguccuuaaccguuuacaaagcuguggugguuuaaguaggaaugguucccguagacgcucguguuugaaugcuuggcccauagggagaggcacuguuagguguggccuuguuggaggaagugugugccacugcaugggcaggcuuugacaucagaugcucuagcuaggucuacuuugauucagaacaagauguagagcucucagcuccuucuucagaaccaaaugugguccuccacaccuccugccacgaugauaauggacaaaaaccucugaaacuccagcuccaaucaaaugcguuccuucccuuauaggaguugcugugguuaccgugucucuuaacagcgauaaaacccuaaccgagaccggcaaguuggcagcuucuuguuuacaagauuaggauuccacaguuuuaucccuguuaaguuuuagccuuaaaaaauuuaaguugaagauuuaaaucaagauccucuagcaccaaaauaaacucuuaaaccacaaguacagcccacagagagacugagagccuugcuuuccugauucuuguagggcacguggaccaugccaccagaagaauuggcauggaacggugagguagacuauguccaagcccugggaaucuaaaaauucagauuagaaucucauucugggacuggucggaguagggcuaacgcccucccuauuucugugccugccucagagcacauaaccuagagaccuccaaccagguggucacaaguagccagucacauagaauucuggaauuccccuggcaaaugaggcaucucagaggucuuagccuucagccacugcugacgauuucccucccugaauauccucacacccuuccccaaacuauauaacccuugguucacccagaauaaagaaauauggacaagauaaaaugagcuaagaccaucucagaaaccugcaucauuaaagacguuggagaaggccuuagccugaaugaccuauagcacuaagguucuuggaggccuucucuccccuccccaugccccucuuccccuagcaguugcuccaaaccagaccuggauccuguuuguccugggauccugcauguccugggauccacgucuaccuucuggccugccaggcaguggaggaagaggacugcagaccccaccuguuucagacuuugcccgguccuguccgcccuggggguggcaugcagacaccccagaagagggcacgaagagggcacgaggagccauagauccuuuuacagugcaccauauagaauaucccacuuucuucuaaacuaaauuuaaguaucuaaagcuuaacaaaguuagcaaaggcaaagaggcuauacauauauuuucaaguuaguuuuuaccagccugaauagaccuuaggacuccuuaaaccguauuuaucaaacauaccuuauccuuaucuaaaauuuuagaggccuggcauugaacuccaucagcaaagacauaaguaguuagacacacauuuuuaaagucauuuucuguuagccugaguagaccuuuauaaccuugggaauuuauaaaccuuaaguguaccuuaaucaaacacaugcugauccagacuuguaaucuaaauaugcuucacccagugcauauacccagaaguacucacccccuccccuuguuuccuuguuaccuaccagucacuccucuccgccuguccuccuuccuguagguagcuucagacauucuaccuggcuccugugugguccgggagccuugaggggcaugucaaaucuagcugucuagcugugccuucuguugccugggucgugccuggcaggccaugcuuccgggagacgccagcggccugagacagauagccucucccacaggcucagaaaggcaaugaucugugcgaggggaaccaggccaggcuuucucgugucugcagauugguuca

SEQ ID NO: 8138 - RNA, 5788 nt, Mus musculus
gagcugagaauucuacaucuucaucugaaggcugccagaagacugucuuucaggagcuaggacaagggucuuauagcccaugcccacaguaacagacuuccuucaacaagaucacaccuacuucaacaaguucacaccuccacacugccaguccauggaucaagcauauucaaccaucacauuccauucccuggcccucauaggcuuccucaaacauaugaaucuaugagggacauaccuaaacauagaauaauaaaaaauacauuuaguccaacuuccaaagucuucaaagucuauaguagucucaacaauuuuaaaaguccaaaguucaaagucucuucugagauucauccaaucacuuaacugugacccccaaagcaagucaggaaacuagcuggacaaacuacaaacucuguaucuccgcugucugaugucaguggucuucagaucuucaacucuuucuucaucuuuguugacugcaccauauuucuuucucuggggcuaguuuuauucccuguuaucagcuuuccuagcaggugucccacagcucuggcaucucuaacauuuuggggucucugaggcaacuucaauguuacagcuccuuguuccaaugucugggauucacacaugaucuucugggcuccuccaaagggcuugggucacaucuccagcucugcccucucuagcacucuaagcacagguuaauccacuccacugcugcugcuguucuuugugaucaucacaugguacuggcaucuccaauauguuggagucuucugcugcaauuaggcuucaucaauagccucucaggcucucuucaugguaccaagccucaauuccuuugcaugaccccuuccauccugggccaccaacugcaacugagguugcaccuucaccaguggccuuccauggccucucacagugccaagccucagcugcucuucaugaccccuucauaucuucaaaaucgguaccaccugggugauucuuacacauuaccaaguccagcugcagcaugagcuacaaccuuggcuaucucuggaacacaacuucuuugugaucucagaaaauacuucgcagaagauuucacuucagugauacuggucucuucuuaaucauuacuaauuucuuagcuccagcuuaccaccaucaauuaucccaguagucucuucuauuguugacucuaaagcuagagccacaaggcugaagcugcccaguucugcugccugcuggggcugggauauggcccuccuuauuacauuaccagcuuucuguuuuucaacuccucacugccugagcuuggcuguccugauacuugaucuauagauugaccuuuaacucagagaucugcauggcucuguguccugaaugcugggauuaaaggagcauaccaccaagccuggacuuaagcuuuucuucaccuagaucuugcucugucccaggcuggccuugaacucugagaucugcuuggcuuuaucuccugggauuaaaagcauguaccaucaugccuggaucuaaacuucucauggccacuguuccucaagaucuggaucaaaaccuguaucuuuuauuucuggauuguaguucauuccagauuaaaagucuaagugaaaacaauaaccaaguaaugauaaugcuuaauauaauauuauuccuuuuucaauggcaaacacagcuuagcugggugggaucuugccacagagucaccccucccuuaaucuauuuucuccuugaacacaggauucaacuccauuucacuuccuguugucccuuuauuauuuggaccauauauuuuacauauuucuuuuccaagcuugcuauacuuauucaaaaugcuauuuaugagacuuauccagagaacaaagucucuguuggacuuuuuugaaauuuccuuugucaauucaauuaauauaaaucucuuuaccuuagacucagguagacucuucagaugagagcaaaaagcagccacauucuucaccauaauaucacaagaacagucucuaugccacauacugaaauucuucuccaccgaaacuucuugagccaggucugcacaguucaaaucacccucagcaucaaagccuuccuuauuccuaugagggauaguccauuaaucaccaguuaaagcauuccacugcuuuccaaauccaaaguccccaaauccacauccuuccaaacaaaagcauggucagaucuaucacagcaacaccccacuccugguaccaacuucuaugugugaauguguauaugucugucuguaggucaguaugcaugcaugcaugcauguuguauguauguauguagguauguauuugugugcaugaaguuauuggacucugccuuuuauuucaugcacucagcguguguguguguguguguguguguauugucucuuuccuucucuuucuugccagccccaaagaguuaaaagaguucauaguuuuuccacuagucacagagagugccagccccaguaaauuaagcuuuguuaccucagagaaaagucugcugaguaacuacucuaaucacuggcugccucuggcaguagcccuuguagguaucuggauuuaccccugucagcggcuguaaccacugacccccaauggaugccugccucaguuuaccuaccacauggauauggauaccaaaguuggccauuggcaucuucccauauacuucaacuugcuucaagcauacucauuaugugacuugagauggcccagaguuagcagcacuggcugaucuuccagaggacuagguucaauucccagcacaaaacaugggggcucacaacucucuguaauucaagccucagggaaacugauagcaucuuaugaccucuguggacaccaggcaaguaucugguacacuguuauacacguagguauauguguacccauacacauauuuuuuuuuaauuuguaaaaauuauuauuuuucuuaguuacuguucuauugcugugaagagacaccaugaccaaggcaagucuuguaaaggaaacauuuaauuggggcuggcuuacaguuuuagagggucaguccaugaucauuguggcaggaaacagacaggcauggugcuggagcaguagcugagaguauuaccuacugauccacagaugggaaacacacacacacacacacacacacacacacacacagacagacagagagacagagacagacagagagagggagagggaaggagagaggcagagacagagacacagagagagacugagacuggcaugaguguuugaaaccucaaaccccacuuccagugauaccuuuuccagcaaggccaccccucuuaauuccucuauuucccuucaaacaguucugcuaacuguggaccaagcauuuaagcauaugagucuauggggggggggugggcauuuucacucaaaccagcacauuuaucauaccuaauacaauguaaauaacacggcuauagcuguuuagaugcguuguuuagggaauaaagacaagccuguacaugcucaggaaagugcaaauuuuuccuuaauauauuucauucuugguauaaggccaagcauaaaacagaaaugugugugcaugugcacacacacacacacacacacacacacacuguuugaagaguggggauguggcucaguuggcagagugcuggccuaguacauacaaagcucuggguuugaccucuagcaccauacaaaccaagaugacaguacacaucuguaauucuaguacuugggaggaggaggcaggaggguagaggucaucuuugguuacucagugagucugaaccagucuaggauacaugagccccuuucucagacaauaauaacaauaacagcagcagaccuuguguuuagaaacuguccacgaccauuggagagauaccaaauuuuagccuacauagaauaucaagacagcagauuuucugaaguguuccccucuggucagugguaggugucuugggcuugauaagccagcuguaacuggggucuccaugaagaagcccugcccaucuugcuccuaacacauggcuuggucucauuuugccguaaguauauauaacgcagaaaccccgucagucuccccugguauggugcagugagggguggcauagcuaaagggcuaaggcaccucuccucuacacucacagcagcucauuagagugggcuuccuggcgggcuaguaaggucaacagcaaauggguacauucauauuguggcuccuuuuacugggaguaagucucuuacucagcugguguguaccugcaucucuccugccaaaugugaucuggcaaagauggggcuugggaacuugggguccagugcugauuaccaggugcaggagccagaaugcagcccaaagcaccagcugugacugcuagaggacacauggcaucaaagggguguccaacacaggaacagagcuauuuggagccagugccaguggguucacccccuaccugugcccaaagaaggucucgacuaucuaaaucauccacuuggccuucaggugcugggcgagggccagagguggucugggaagaaucagacacuaggguagggccagggggaugagccagccaccuagagccuaugacagggcauucugugucacuucuguccuuccuucucucaacagagacacacaaagugucagugaguguggcuggagugcagcaaugaccagcaaaggaaagggaugagggucuuggcugcuguggaggauggcaggggcuccugagccucugaaggaguaaagaggaggacacaggcagugcaguagggagggagggaugccucacugccacgugcaacagccuggggcuggccaauucagacaguguggcuaguuauggggacauuuccaaugcuagccuacuuccuaugagauaaguuucugagcugcuguaggguacuccugacuucugcuucugaacuucaaugcuccagacaugcucugcuuuuucucuuaggcuccagcagaaaaaaaccucagauccugccuuaggaagucgucuucagucaagauaaguggaacuuguauguuuuagguuauuucaagugugugugugugugugugugugugugugcgcgcgugugugugugugugugugcgcguguguguguguguguguguguguguguguguguguguguagagauggcgaaaaacauuccccaccacaaaguuacccuauagcucuaaauagcccuagucuaagauagauuggggaguuuaaggcuccaaaacguuucugcagagguguagggaaggcagggccaagccugugggggauacugggggucauguugccacccauaaccagacuaggucucugcaggagucugggagucucugcagagggggaacauggggugcauaagcgauacugaauguggagaagggaggaaggaaccuagagcuccaagaguucacaguggaaucgaggaucucuugcuucccccgagggcagaaagcgggucuaaagcaacaggaaaggguagcuuuaaggauacuucaggcagggguggagugacgauggggagggagagagugggccaccuuucgggacagaauucucacaggccuagccucaguuucgaggccccgcugcucuggaaccuaaaauccgggugugccaggcugucauggcauugaguggugaacucuggacccaccuggucagcuuggggacaggaaaaucccggagcuaaaaagcccgguucccaagggacggggucuugagggucggggaaggcagagcuggcagugggcucuggaggagcugggu

SEQ ID NO: 8139 - RNA, 2471 nt, Mus musculus
ugacauccaaagugcccucaaagagaguggcagguuagccaggccagagccuggaccugaggucaggaacgggucacagggacuaauggaggggccaaaaccccugggacccuguggacacucucacccccagcguccucuggccccaguuucaagcagccauggaggauaccuggaucagcccugucagggauuuguaaggugucccugucuggucccccuucaguccacucagucauuagagucuuccagaccuuucccagcuccagggacagggagugggagacccagagugggaggagaagccccugggauguuucugucaagcgaaggagagaucccacgacggagagcucgagagccagcaggggccagacaagaaggggaggcugaggcagaguggggcuggccccuacauccagggcaugagcaggggccaccuaggcagacaggaucccccaccucaggacccaggcccugcccaugcccaacacuaccuccuagaggaaaggccacagcuucaucuagaccagcucccacacagcuucagggcaggacacuggggucugcagaacaauccuuucugcagcuggagcaggagaaccagagucuggugagugcaguccauaggccacuaggcacuagcugcuccucagagccccuguccuagcccaccugcuucagcuuccugccugagaagcaaccaggacaggugaccccucccccacuucccugcuccccucccccagaaaaggcagaaccaggaccuucgggagcaacugggggcccuccuggggccagggcagcaguuccuaccucuauguuccgagcacucaagcuguacagcccuggccuggguaagcgggagcacgcacggacccaugcagucccggacccauucagcagcaccuccagcuguccacagccuugggaaugacccaggggcuuucccacagucucccgagucagccaccuggccccuggaagacagggcaccugugcagcugcugcggcaggagcucugcccagggaaagaguacuuugugcggcagucccaggugggcccuggggagaggggcuuggucuggggagcagggagcagguuccugugcccacacaccuccuccccaccuagagugagcugcaacagauccgauuguccuuugagaggaagaagauggccauuacugaggugccugcuuggcccguggugggagggagccccuguuauguccuguuccuuggguaugaugcaggccccaauucccuucucucaggugugggaugguguggccgaaguacacauggcucugaacaaccaagccaccgggcuccugguaggucgucagaggaccaugguagggaugauggccaugagggccaguggauguggcccagugaugggccggaggacuggcuucacuuccucugccucucagaaccucaagaaggacauccgggguguguuagagcagauggaagacauucagcuggagauacuggggugaugcggggaccccgggcugagccagguugggaugggguggacccuucucugaucuucagucccucagaagggguggugccaggcuggaggcaagggcugcacgguccugaagcuaugugcuuccccagggagagggcccauugccgcacucaggccaggaagcaacagcaaaugauggagguaaguccccaccccauuccugcugauuccagcguccccaccacaguagugcuagggagagucugagaaauggacuucagggaccaggucuuagggcuugagcccagggccugucccuggaaagggaggggaaacaggcacagcucagcugggaagacccuacaauggagucuguuuaugguguguaccucaggcuagggaccuggccuucccccagaguccugaaaguacugagaacaggcucuaacccagcccccucccugacagaaaggcaggccacagaugggauguuccgagggccuaaagggccaccucugguaggucacuuucggggcagagcccugucccccagguucauccccaugggcauucccuaccccuuaaacugccacugccugcaggcugcuggccuugaggcugcugcugggugcucugcuggcuugcacagcggccuacguauacgugguggaccccacacccuucgaggggcugguaccaccccugcugagcagagcugcugucuggaagcucagggcccuacugggccccuucuugcgccucgaaguggacgacuuccugccuuucuagaccggaagcccaguggccccagcaaggagaaggccagguggcuggcucuguuccagggacccaagggccuuacugguccuugccuacagcaccacugcacacagucucuaccaagagcugcagagaaggguggaggaggggcuaguccugagggcugggccugcagcuggauauacagucaugacacacuuugcau

SEQ ID NO: 8140 - RNA, 14388 nt, Mus musculus
ccguggaggugaacaaaaaaaaaauuuauuagggaaguugagggagggaaauccuauacaacagaaaacaguuugugaucuguccccauaugggagacacauaacugcugcccagaaguagcccccaggacacagccccugugugaaaagaggaguuggcagggguucuguucugacuccucccagggguauccaggcccacaggcuuggguauucccagagguaucacccuuggcugcagaagacccaggugggucagagcaggcaagaggcagagacggguggaccagguucauggugcaccaagcuggcuggcagcuccaggacuuuaaggcaucuguucaggggcuugggguugaguggaggagugcaguaaccugcggugaccugagacccccaccccagcccaacccacagaggccugggcucccuagaggaaguggcuuaaagugcuuggaagggguaaggagguugggguaaaggucaugcugguucccaguagcucugaggccacccccauuggggcacuggaccccugcagcagguggggggacuuccugaggucaccuggagacagggucguggacccuggcagacugaucagucaagauguggcugguugacggggaacgggguagggaucuccaggcuacauccagcccaacuccaaagcucuacagcaaccucgucuucuggguccccagaagacuguccauggcccuagagccaccuacuaguguccuguuagggaccugagaggcuggggaaaaggcuggaugcagcagaauguagccgacaaauggucccacggggggcugccccagcagccacgcuccagggggcccgcagcggcgggugauccucaggguggccaagguggcauagguggaggccaggagucccccuaggcguaccacgccacccccauccacggcuacagcugccaaugcgcccccuguuggccgauauccaugagagagaagcagaaagguggaagucagcaguggguagaacuaaggggccccaggcucuggacaccuccccuucuugaaacucuggaccuacccuagcccuuuccagcccugcucugaguucuuccugacacucccuaauuccucccuuggcauauggcagggaagaaguauaguaguaucuguagguuucucggccaggcauuggccucaugugcagccuccacuauauagcugcuccaagcccuuugguaccucagagucccaggaggcagcugagguccuagccuuucaccaaacacccuuccguccggcaugacacagacugggaguaagacaccuuugcaacucaccagcagaaguccauucguuaccaacuaggccugacuuggcaaugccagcagagcuguccaagaggaacaugccacccugcaccagcuggccaaccccuuuccugagacaccccuguacccacagccacagccuugcccaaggaaaggcucaaaaugauuuuuccuuuuuuuaauaaaauuauagauauauagauguaaauauaaaaacauagaacagacacgaugcaagcggacgcugccaugugcuuacucaggccccugacgccaggggacgaauggacccgcccugaugugcuuuccagcugugcuggccaagccagugcugggaacccgggaugcuuuggggugaggauucuccaguuuggcagggaaggcccgagagagagggagggggcucucggccccacuggucucccgggcagcaucuggcccccucucugcucuggccgaccccaccccccaucaccucccacaagagcauaaagcagaaguuaaggcuuugaugaaagaacaguggcagccgagcacuaacacaucagacguggcacggcagcacagcauacagacacagggacacgaacccaccagccaggcaagacacgaacagagggagcugggaccccugcuaccgcucaaguaucuguccguacguucaucuaugcaucccaacccggagcaggccaggguuaugcucccugcaaagcacaggccuugccaagcaacaagcgaccagcuuugucagugaaaggccgugaguuaggagcagcuggagaacagggcugagcaacccauccagacaggagugggugggcccaugggacugcuggggacuggccuuagggaaugagggcaauaggaugcagggcugagcuuggcugaugaaggaggcaguccaggugcccaucacagcccacagccuuggacccaucugcccugugaguacuagguaaguagaugaacaggcagaggccggagcucaagcuuguggaggcaaggcugucuuuccuguugauguguccacagcaggcuuggggagccuccucccuggggcagagaacuugauaggguuggggagcuacugcgggggguccugguccccguggcaucacagcagaugagugguggucaguucucacaccgagauuucauacguagucccacccacgccggacaccuucuuaaccagcgugugccgggcagggcuggcguugggccccauggggcuggcagcaggccccagacgggccaugccuggggacugcccguuaagcuuacuugggggggucuucagcugagggugaucccugcaucaaaacaagcacauauacacacaugcacauacagugaacacaguacagugggcaguaggacacauguagguguggacuggagcccuguguccuuguccuuaggauuaugcugucacaggacagacauuuccagaacuucugucccccucauggguucauugaucucucccaguuggaucagccaaagagcagcgagccugagcugcugggcccucccugcaguugaaauugggaagcccagcagcggacacacagcucuuucacuagucucucaggaaaaucgggugacacuccuauuccccggccuggccagagcugcuacuguucccaugagggaugcccuagaaccuuuguagccacacagccuaaauaagagcucccagggcucaccugagaccaaaacaaugaagcccaugcucaggugccuggcucccaccugcccuuccccacuuuuaagcauggaggcucccugcuaaucuggggcugcaugcucaauauacguguuguggugaggcaauaucccccugucucagcaugcugagcacguaucaagaccagggaagggacagcaugccuggaaagguaggaguucacacacccaagugaagcuagcucuaggaguacucugagugaagucugugcuggcucagcaugccaaugucucuuucccacaugcaugcugcacccagggccagacuuuuccaaacggggaacuaggcucagcuaucuuguacugucccuacagacaacuuaggggucuccaggaugagcugggaaauccaggucaugacggguccuacauggggaaacccaucuacacuccugggcacccaccucugcauagccagugagggcugccgguccgggaggucuguguggaugaaggcgacggccuuggagcccguguaggagggcgaucggggggugccugguggggaaggcaggcccugacgggcaggugaccuaugugaaccacugccaggccgggguccuggggcauuguuguuggccuggucagccugcagggaggaggaagauguccgaggugcccgacucauggagcuggacagcgaggacaaugacgucugcagggcaggauugcgggcaccaccaaagccaggcccggccacgaggucaucccuggagccguaacgcaggacagagccacgggggccuuccguuaacacacuggccuguugcaggcuguaggagcuggguguaucauagacaccagagucgccaaagagugagucagucugggagcgcagcagccguucacgcucuucccuguccuugcgcuccuggauagaggccaugaugguccgagacagguugucauagcgcacaggagaggguucccuaggccggggacccagcacagggcugaagcugcggggugggggccgcgguggaucugauggcccagggugcagguagggugaaugguagcuggcuauaccaacagagggguguguggggcaugcguggccacugggugagccaggguuaaguaggcugucauaugacaggcugccauuucgauugggcagugcaugaggagcaaagagacuacggugagguguagggggcccaccuucagagcgcaguggcuguaaggucaugugguccccaccccuccgacuggcagccuugagacucagggagcgcaaggcaccugagaaggcaucagugguguugagggguggggagggcggguagggaggacgcagaccacccggcccguggucugggagauccaggcugggcucagacacaaagucuagacugugggugcugucaucugccagaguaagggagucaggaccugggaccuguggaggacaggguauucuuacuacuguacacaccucaccucuuaccugaccccauagcaccaagaacucugaggcugugacuacagcagccauggaagcaggggccuacuauggauggaaguugggacagaagacuuggcauggugaucccagaauuuaucuccaaagggaagcugguguggagccugcuucuacccacaaucacuaacaggcugcacagacccuuccuaaggugaccaacacugggguuuuguaguaaaaggccagggcaaguuucuccagacacaggucuauggucuugggcuucuccaagccagagcagccgcagccgcagccgcagccgcagccgcagccgcagccgcagccgcagccacagccacagguagaggggcuucuuuaguuucugugacuagacuugagccacaggccccucuaauuccaaagccuguaaggauaacuugcccuggcacacucaagcagccuuauaagauccuugugggguaaagucaguccuaggaaggcgguggcacaggguguccaaagcccauccuucuaauguauauaacucuccugcugggcagcagggcuaccacacugucacuaggauuggacccuugucaggcggugcccaggcucucucucacccaauggccuacaguaaggagguccccaggacagagcuggucuggguguguggaacuagucucucaggcaaccucuagaaggagagcagcuuugggaacacucagaguucuggaucauuccacaggcugcugcuccauguugcugacuguuccacagugauagacaaagaaguacuuaacucgugaaaauaaacgugcuuucucaaacaaaccuccaauucuucugagggcucccgugggccucacagaaugacuaaggauggaauuccagacauccuaacugcuagagggggaagcugcccuccuggccugcgggcaaugccaguacagaagcagagaugccaggccgagauggucuuaccugcuccccuccaagagaccccagcucagcauacccacaggaugcaguccugccagcaugcauaugacaccucugugacaaguauggccuugucaggggcacaagcauggaaacaggacaccaugaccaaacaaggcucucccgggggacagaccuuuuccaggggcagauccccccccauaguagggcuaucuucagaguugagguccuuccuagaggcagagucuggacuuaccugcucauuagguccacaaaagggugucuugggaccaguggagaaggcuggccggaacuuauacauggcagguguuggggggcugguccucuguacugauagggcacucucugagaagagggaccacagucacggagugacacaaaagccagcccaugucccuuuccucagcugcccuccaccucaccagcacugccaggucuuggggucuucagaucucuuccaaagguaccagccucuaucuuggggggcaguggaggucccagguccagagguuucucauccagcuggucuagacugcccuuggacuaaggaagagggagcaguggugggugaagucuuaagacagaguuucucuguuuugcccuggcuguccuagaacucacuuuguaaaccaggcuggccuugaacccacagauccaccugccucugccucccgagugcuggaauuagauauguggcucuaauauccaucuuccuguggcuuuggacacaugcauaaagcguucccagucccuuuacuucuuccuguccccaccccuacacccaauagucccacucacacaccauuaccguuccaguccagaaccccaccuugcugcggccagcuuucagcccauugucgcuaaguuugaccuugaggggcacagcucguuccaggagcucaggucucaggaaggguggcuugaggcucacugagagcggcauccugggggguuccaccacauaccugugccaggguagaaaggucaguggccggacaaacaggccagaacauacaagggcagggccagccccaccuagccagagcagaaaggaaccaggcugaggguccgaggcugcccaccccacacccagaacaggccucuugucccccugcccaggccgggccucaccggggcgccaggggacugcauaacacgugcuccacguucccauagcagccucgggugaagggauucacacccccgcggaacuucccagucaccuguggacauggguccccucagccagccugaccacccagaacaggcagggagacaggcaaagguaggugggguccuuagaaguggucuucaugggaggcagcaugggcaaagcgggcccaacggcgccccuauacccaggguauccuugccugcccuugcaggaagcuauagcaugcccagaccuugaguuguuaguggcugcaguguccaugggucacaaguaugcagccggaugggcagccauggccccacaccaagccccuccucccacagccaccuaagcaaccucacaugaggguuccugagacccagcccacaggguuugcaccugcucauugguggugcggccccgcgugaccaguaccacgugaaagccagugaggccgaugacaggaaugaagaaaaggccagccacacacaugacagccaugcuggccuguuaaggccaacaguugaggcaagaacaugaagacccucccuccccccacuacagugacaguucuuguggcccccucucgccuaagcacagcgacacucccggaagaccccauguacccacugaccccccaggauaugcugccgagggcugggccauuugaagacaaggauacgugaugguggugugggcggcucccagccccuccgagugauugagcacauagagcaggccgaaggccaccacccccaccaugugcgcgcugagugacagcaggaacaggaagaaguaacgguaguugcggcguccaaugcaguuguugacccaggggcagugauggucaaaguccuggcaggggcagugugucagaacgcauggaggguaggaccugggcacagggacugguguggggaggggcagggguggucaccuccacacaguugucacagacacugcagugugagcagcgcgguggacgguaaaaguggcacguugcacaccacuucaugcggaccuggaugccccgcacauccacauucuuguacaguggggcccggaagucauccuccuuguccucguccucguccgcuggacaucaggaccaguaggguggcaagaguacagggaggugaguuuccuagcuggagaggaccucucuaaucucugcccagcccaccuacugugaauccccaaucagccacuuacacucuagugacaagaagcagaugagcugccccauacagggcccuaccucgggggaagacuccaggguccaugaagguagccauacugaaguuggccaggacaaagaggaagaggaugccauuguagacaggaauagcuggagacacagcucuugucaaccaugggcaccuacaauggacaaugggcagagaaccagggaugugaaggaggcaaggucagaauuuugagacgcagccauauguaugcuucugggcccaccaggccacugccaggcaggcacacaagcagauagaucuuagcuaucacuaggccuuggcuguguccaucugcucaguguuaagcucccugcacuaauuucaacccuggcaaccccagggcuacuguccagaacguaagucacagcugaggaaaugacuccauuaugagagguccauuagccuagggcacaggauugggguggccacacagcuaagccaaccuaccggcaacuugcccaggcuaccguacuccugagggccccagacaggagugggaauucauuggccaguaugcuacccagcagcuagagucaggccaugccagagcugugcggacagcagggcacuugcugagguauggagaggcacaacccugcuucagccagugcugggcacauccuccuuuguucuguagggugcagcucuaguccuggcagacccugauuuuggguuuguuaccuuguuugccaggugguagcacaggagagcuaaaacgcuggaaaagcacacacucuaucucucaccagcccacagcacuuggagccaaggcuuccuuucugaccccauuucccaagaggccuuccagaagguguaucucuguaacuucacaguaagagcucugcacaucugccucuguccucaccagaauccccuccacagagacacgcagagcccugacucugcaguggcuacguaaguccacccagaguucaaggagcuccucuggucccaggagucuguguuuccuucugugucacuggcugcugagacagguggggagguacacacagggguuuaauuuccugccuguguuuggucauuuguggagccagaccaguggggcuucucucccgguugcccugaccgcaagauggagugaugguggccgccugcagagccugcagcuacccgccacccgagugcacaguccacacugugcgcccacgccugccuuggccaggagccaggcccgccgccccagcaaccaccuccauggcagcagaacuauuuuuaguggaaagcaagaggcuauuuaaagcuccugcuucccacggcagcacccucuauggggccaccagccaugauaccccaucuucuuucccggaccagcauggacauacagcaugacaauacaggccacacccaugaggguccagcaggagaugggacccaaccuguagccuggaacguucacucuacuuuccccaucucugacacaaacagcacagacaacaugucugugcccuccaauccaugcuguucagcaaagcuacaguggcacccuacgaugagacucacagcccagcggugaagcacuugguagguagggagagaccucugagugaagcagucaagccuucuagggauggggugcccucuagccugacuuggguguccgaugagagggguuaguuccacacuaguacaaagugaaaauucagaccucaugcuacaaagucaaaagcauaaugucaaagcuagugccaccugcaagaaguagugagggguugcaggggugcuguaaagaggagagacaggugugaaggaagcagguggggguguacaugggaagaccaggcucggauagacuccgguuccuccucgccaugaaguggacacaacugcuguccuucucauaaacaagaaguugaagagcacaggcauuggggccaggcuacccccuagucaucaguugggcuuggcucagaaguacacugccuauguauagaaaggggauagucccaggacuggagcguuauccaagccgggcggccuguauuucuguauugccucuuuagcuccuuagcggaccaccugggcuagacagcugcccugagugagaugugugaggagcaagggggcaguccugagcuauguuuggcaguuugcacugguagggcaccucaguaguauuaagguacuggacaaccucuguacaacaugagcaagcaccgccugcauaaacauagcagagccaggaguguguguguguacgcgcaugcgccagcuaugugucagggggccugauacacuuugagcucgaguccagucacuguccuugucucuaagcuccuaaggcuugaccuggguccucuuugggugcugcauaagguccacauuuagaaagccugugugcaaggacaggguugugggggagcacagcacauacuggcacauacagaaacaugggcacacauacacaaaggcacagaagcacaaacuuacagcucacaaccauaugaaagcacaacuauuccacaugagugaacaacgaacagcugcagacacauguacacacaggaagacuugcauguagacacugugggcccacacaccaucuagacacaccugcacauuugcucaugcccagagacauguggauguggacacuugugaagacacccaggugguacccuccucucggguuuguauaacccagaucagcugccuacuaccaugggacucaggcaagccucugugugcuuuccauugccuugcacacauggcaaacauaagcagacacaaggaccacugaagccugaaaggaugugugaggacacacaaagaaacaggagaacauucgaggacaugccagcuuucccaagagauguugcaggcaggagcacuagguacuugugugcuuagcccucuacuuaguuuuagugcuugccuguagaguccacccucugcagccugagccuaugagacacaccuggccagcccuacacugcuuccagggggccagcuggagcaggguggccuguacaggcaucuggccuucaaugagcaggcaggcuacgaccugcuacguuccuaaagacucuuugcugguuggcucaagcccugcugaggacuggguaugugugugugaguguacacauguguuccuagcuacgggcucugagcaccuaaggucuuuuuuuuuuuuucaguuuuuuugagacaggguuucucuguguaacccuggcuguucuggaacucgcucuguagaccaggcuggccuugaauuaaaaaaucugccugccucugccucccaagugcugggauuaaagacaugcgccacuacugucuggcccacccaaggucugaagaugcauccugagcaacaguaacucaggcaagaacacaagccaucauuaugugccccacccaaguggaggucuggaggcccacguaggccagcagagagacaccacccaguaagggggugacuucagggacagaauaucugccaaaagccaaauguggaauggaaaauuuuuacucagacauuuuauuuuaaucaaguucuucauuaacacugucuaagaucacugcccuauggggcacccagggccaccaacaacaaccacucgcccucauccaaggacauccaaggcacuguggagaacuaagcaacuacacccaccuauguuaucccuagacauuuggacaggaagaguaacaggcucagaagagcaggacacccuagcaggagaacucacaguuuucaaaccuagucucccucccaugaugcuccaguccccaaggcuaccaggggccagaaacagacugucuacugucccagucugggcuucuuuuuuuuuuuuuuuuuuuuuuuuuauuuuucaagacaggguuucucuauaccauccuggcuguccuggaacucauucuguagaccaggcuggcuuccaacucagaaauccgccugccucugccucuacugggauuaaaggcaugcuccaccacgccuucuaaccacacagagagcucaggcccuccugaauccagcucuaacacucuaggugcccaaacggccuaacacagcucuagguuuagccauccccagccuccaccacacauguccuuuugaaaaguggauucuccuggccuggaggaagccuuuggacccauccuaacaccaaacccagcuuagcacuguaccacagagagagauacacaaaccagcacaaggccgggaggguucccgggaaaggagcucacucucccauccuaccuccagggaguucaucccaaaucucacacccugccuaccccagucuguucuagaaaagccuggaugucugcugggccaauuacucucuuggugagugggaaggagccccugguccuucagcccuugggcuccccuucuuuuuuuguuuuuuucugguuuuucgagacaggguuucucuguauagcccuggcuguccuggaacucacuuuguagaccaggcuggccucaagcucagaaaucugccugccucugccucccaagugcugggauuaaaggcaugcgccaccaccgcccggcgggcuccccuucuugacugaccagauucuccuccgcaccuugagagaagcaguucagacucacaaagaggagaucuaagggucacuuacgccagguaaaguuucaggacccgaucuaggccccaaagguaggcugagcgacugcuuccuuuucuuggugucugaggugucaguggacggagccagaaacagggcaggagggaggcaaugagaggacagggauucuaucuugaaaaagacaccuacuccaggcuggccaccagaccugccuauacccuggcacugcccaaacgagcacagcuguccagcagagccucuucugagaacagagccaccugagugucaggucagcaauacccacaucucaggaacucauccaaggggcagaugaggaugcacacagacugaacagggccccagucaugccaacugcagagccaguucaagucagaguagcugucccuuaaagagaaccccaaaccucaagagcacccacaugcacagccccagaacacuagcuucaagaacacagaggaagcacugcccagaaaaaacgguagcaaccucagagaccaaagcuugaggcagagucaaguuuccaggaaccaccuggguccucugaauccucugaaacuacuuacauucucugaggagagaaagcagggggagaggauuuuaauuucucuuaaaacuuugauucccauauugcaugucuuaauuuuagaguuauguuaaaagacaucgaaaugucccugugacacccucucugcacugaaacagaaccccacucaagaccucuggaagaccgaauuuuccaagauauguccccuccagucuuagcuccccaagcccuuccuuaguccacaauccacaacaucugagugacaagaacacagacuuucccuggagccagaaauaagcccguccacacaggccuuuuuuaaacuugcucuuugcagccaguggcacauacccaaccccagccuccagguaaggacucuccucccacaacaggcacugaauucagacuccuacaaaggcugcuauauguuucuacaaaguggaaaggguggcucaggcucacuuacaccuggggcugucacaccuggaaacaaauggccaucccuuuggucaccugaguugugucaaggcuuuggaauuguagaaagaaacgagugguccgagauucagaaccccaugaccuaugagccagcccgggguaagaaauugaggcugccuagugccaggcuggcaaagagugcucccuccccacgacuggcagccuagccucugaggucuuuugugcuccagacuuagaaguguaggauagaagccucucaguguuguguucagggagggcugagggccuugaguaggcuguaguggccagucacggcuguggggcaggccacaccuacgcugagaaacacagaaauaaguugauuuuacaugcuggccgcgacgagggggcucacagcuccuacucccccccucccccuaggaagguuggugucuguaggugacacgcgucccccuucaaagccccgagggaaugaaaggcugcaaccacacccagggccugcuagaacgcucagaggcaggcauucaccuguccgugcuccggggacgcagccccucgccgcaaccugcuaauccgcccagcccaccgccgcccccguggggcacgugcgccccuucggcucccacccccaaccucccuacccccacccgcugcuaccaggcucuggacccggcgccgacucacgugaauacgaagaagagugugcuggaaccaaccaacagcgcggcggccguggccaccgggauguacuuggcggguuugaggcgcgucccggggcugcggggcauccugggcgccgcgccgccgcaucccuccccgggccgggcgggcggggccggccgggucgggccggggucgggcgcgcgggcuggacgcggcgcaggauccgccgcagcggcaguggaggaaauccca

SEQ ID NO: 8141 - RNA, 6096 nt, Mus musculus
ucuucccuccgccccccgacccgaacccugaccccugaccccagcggcgggaaacgcgcagugauucaaaaccaguguagcuuuauuggcuccgacagcggacauucauuguccggcccgccccgcgcuucccgccaaaacgcccgcggcgcaugcccggccgcgccucagcccggggagcgcgcucucccggcgacccacgcgcgcacuuccgccugcaggcugagugccuccgacgcuggcgugagcggcugcuggaaggaucagucgggacucggcgcgcggcggugacgucaucggaaccaagcccuuagagagaggagacgcagcuagugugcgcuggccagccgaaggcaggcgcagcguguggcccuuggggacagugcauccgcaaaccucagucccagcucugagcacccgaguuuugagucccuguguggagcugcggucuaccuucacggcggcguaccucguaucugcgcccuuguugggugggaggccgagccggugguccucgugagcacccugguccgggcaacagacgagccaggagaugagugagccggccgcggaaguaaagcaaagggagacgugcaggagauguggacggggugggcggagguggguuggggcagcagucauuacugucggaucaaagauaggaugggggagaauugggucucgagaguaaaagaacggguuucuccagggcuucguggagugugcacuaauggagaucugucagcgguuugggggagcgagucauaccaauuagagccuucagccaggcccgucuguucccacguagguuccggagcccauggaggacugcggccaggaugccagugcuguacccagcucugcggccccacuaugucaaaaagaggaagcagggccugggccagcugcagggccuggaacgcagccugggcucuacagcuacauaagggaugacuuguucacaucagaaaucuuuaaacuggagcuccaaaauguaccucgccacgccagcuucagugacguccggcguuuucuaggccguuuuggucuacagucccacaaaaucaaacucuuuggacagccaccaugugccuuuguaacauuccgaagcgcugcugaacgagacaaggccuugcgagugcugcacggugcucucuggaaaggcuguccgcucagcguacgccuggcccgacccaaggcugaccccauggcuaggaagaggcggcaagaaggugauagugagccaucaguaacacaaauugccgauguggugaccccucuguggacagugcccuacacugagcagcuggagcagaagcgacuggaaugugagcgggugcuacagaaacuggccaagugaguguggugcugacaucccaagcagagcuggguuuugcucuuggccugguccauuagccauguaagcaauucaagauacacacagaguuuaugucaaugguucuguaccauuggugggaaccagugggucaccagacuuucagagggguugccuaagaccaucagaaaacacauuuacaucaugauucacaacauuagcagauuacaacuacaaaauuaaaaaauguuauggucggggaucacaacaugauuacaggaucacaggcaccauuaggaagguugagaaccaccagucugaaguggucaacgaaagaacucauaaggcccacaacagagggauagugaggucgcaaaugaauugcccaguauggauggggaacaguguuaaauccaaccaugauguauuucauccugcagagaaauugggaacacuaaucgugcccugcuacccuggcugcuuuuacagagacaacagcacaauaaagcuuguugcccccuggagggggucaagccaucaccccagcaggucagagaaaucccauucuguguguauggggaugggggggcuugggaggcuggcccuuguucaugucaauuuuauuaugcauaugcucuuugauauuuuucuugcuuuucauuucuucccaauguuugauaagccagcaguaaaaucuuguucuguuaccccuugggcaaaucugggucuuuuguucacuaugguauuucuucuuccagugcuggguaaucaagguugagaucugacucuuuacuacacuccuacagacugaauaucguaauaaaugugaauuccuggucggaguugggguagacggcaaggacaacacaguuggcugccggcuuggcaaguacaaggguggaacaugugcuguggcagcucccuuugacacugugcacauuccagaggccacuaagcagguggugaaggccuuccaggaauucauccgguggggaccuugccuggggcugggcuucugggaagucccugauccaucugggacaagggggguggccccugcacuggcaguuguggaugugggguaaggggacaagguaccaggacagaugggcacacacugaguauauuugugguuucuucaguuccacaccauacucggcauaugacccugagacauauacaggccacuggaagcaacugacuguucguaccagcagccgaggccaggccauggccauugccuacuuccauccccaggucucagguggugguccuguugggggaugugucugguauagguuggcuuuugcauagccugaugggaguuuuauaucaucuacuacagaaacugagcucugaggagguggcaggacuaaaggccucccuggugugccacuucauggaggggccaggcaaggccaguggggugaccucccucuacuuuguggaggagggacagaggugaggagcccagguggaggcaggaggggccagacagaccagugacccugacagauuuguuuucucuuguauagaaagacucccagccaggaaggccugccccuggagcauauggcuggcgaccagugcauucaggaagaccugcuagggcugaccuuccgcaucuccccucaugcauucuuccagguagcauaccccuugugagcauaaacacagagggagggaagccaguaacuagcaucaaagauuuauagaacacacucagguacugggggccccagaauaagguauaugauaacaagggauauuugcuagugauuggccucuuugcaguuagccagugaaaugcacagccuuauugcacucuguggaacccagaacaggaucaaucacuuucacuguugaaaaaacccuauggagauagaggguggagagaguccaaggucucuagcaugaggcaugcaaucacucugaguugcccugggagaaguugugaagucagggagcaaaacuccccauugaugggagucuguuguaaggacuugguuuuuaagagacugggugagaucacugguauauagaaagaaugggagcagagcaaugugggacucuagccuacacugcaguauuccauggguaacuaaucuccagguaaacacaccugcagcugaggugcucuacacaguaauccaggaaugggcacagcuagaugggggcaguacagugcuggacgugugcuguggcacuggcaccauaggccuggcccuggcuccgguaagcuucccagcccuagguaagaccgcccuacuuuguuaucaugaaccugaaggcugaaacuacuacccugucacuaacauaaccaguuaugcugugucuuucuuucccaagcaaccagaguaauggggcuuaucuaucuuuccauuucagaaggugaagagaguagugggaauugaacugugccaggaggcuguggaggaugcccggaugaacgcccucaccaauggugagaaccuuuguaucacacacaucuggaacaguaguaaccuguugugugcuuuaauuacugcgccuacaaugucuugagauauuaaggaucuucugaggaauggggugcugagagaucuguagacuucuaacaggcaaaaauaacagaucaaaaguuauuuuggccugggugcuauguaagccugccaggccaucccaauggcaggcccauagucauagagaacugugauuaucccuagagcugagcaauguugaguuccacuguggcagggcugaggaucuggugccagguuuggugagcagacugucuucccaucaacuuguagcuguucuagacccaccacgggcuggccuacgugaguggcuuccauuuggggggaggcaauaccagaaguaaaagaaccuauguuggauagucacccacuaccugcucugacuugcuagauucuaaggugauucuggccauccggaaagcugagaacaucaagcgacuccuguauguuuccuguaaccccagggcagccaugggcaacuuuguggaguaaguguguggggcagagcaucugcggcugccuagaggaauuucugaggggcuaauauugguaccucucucccaccagccucugcagggccccaucuaaccgaguaaaaggcaccccauuccauccagucaaggcuguggcaguggaccuguucccacagacuccgcacugugagaugcuuauccuguuugagaggaugcaacaacaccccaauggcauagaagcccuggagcaucaagaauuucagaccccaagaaaucuuccugauaucacuccacaggaaacagagauuucccucucauaagggaaguauaggagcacaggaaagcuggggagcgccuuacaguucccuaguaagcagagggugacuaagcauuggugaggcgugaggccugccuacuacaguucaaugagugaacaccuguguccuaaugaugggacagacagauuugagaauaaacaauugcugauuuuacuaacauuucuguggugaaccagagccuuaacucauuccuacuugccaccuuggacaauccuuucugaaaggcaggaaggauucuuuaagggugucaguuuucccagugcuauuacuguguauuuguuuuaagacagcaucucuauguagaccagacuaaucuggcuuaugacuccugagugcuggcguuaaaguauguaaacuacuaugccugccgaaugccagggcuugcuugaauuuagccccagagaaccauguuuuaggaccaaacaccacccagguauuccaggggaacacugaggauagcugaacacaaaucuaugcugaguucauauggaguuaaguguguccacuaaggcacuuaaaaacacaauugacuauagacaaccuuggccaguugaagauccacaaaucagauccagcacucccaucagaagaaagaaaccagccauucccuuuuggacaguuuuauguguucagaccaucaggguacacccuacagccuuggccaacacacagaagcacaucagcacaggcuccccacccuugcagcaugacuguacauauaagacccaccuguaagagacagggagggcacuggagaccaggaauguguggcagcaccuguugacagugccugggucggugaggcugcagagauaccaccauuaccauaugcuuuuucaauguuaaguauguuuuaagggcaaugguuagucaaaagacugaacacaacugaaugggaggcagaaaagaaucaaguguccaagucuaccaacuugaauuaaggguucuuuuugccaagauuaacauaaacauuaacugcugucacacacaugauuaaggaggaggaagaugcuguugggaggcccacaguugccaucuuaucuuucuaacagcacaugucacccauguaucuucagguacaugguuagagacacugaggauguagaguguagccccucugaacagguaauagggcucugaauaccccucuacucaauacccauuuacaggggcuauccaaugagcauagguagacaaaaaccugcaaucaggccuggcugcacagagcagcuauccuugagaucaaaaaacaccauaacuacuuaucguguacaaugugccaggcagcucuuggucagugaugggcuacauugaaggccaguucccuauuuaugcauauucaucuguugaaaugcaucuuucauucuuacuguaaaaguuucuuuccaaauuuuaaaacaucauaaaagcuuuaaaaauugaugaacaga

SEQ ID NO: 8142 - RNA, 19510 nt, Mus musculus
cacagcccugacaucagggcuacgauuaauauuggggacacaaaucccagaagacugggcuugcugccaccacaggagggccucaggcaaggcaccgccaacguuuuagacaccuggggaaaaagcagcccugcuagaagcagguccccuccuaaucagaacccuggccugugugggcacgcccacgcggacacguuccaggacagccccgccaccgcgacccccuguggacacucgcacaggcacccucuccgcgugcaccgcccacgaccccacccuaccucccgcugcacucgccgcgccccuugucccgcgugucagagcccguguccgcggccggaagcgccugcuggguccacgcagcgccgccaccaucgccgccaccaucgccgccaugguccggggaccucaggcggucagggcugcccuucgcacugccugagcguccgcgccucggggucagaccugugcgcggccuugacgaggugaguggugcccgcccggagcucggacucgggaucagaaucugcaugcaccgaacugggacuagggugaagggcccguacgugggaacugguucugaccuaggagagcgcaagccggcgcuggggaauggggacacaugugaagggggucugaucuuggcuggggggucgcugaagggaggcaggugaccgaacuugaguaucagugcugugguggaagauauguccuucgguggggcuguggaguugggcuuaaccuggauagaauguagcacauccagggccuggcccauuauaagaggguccgacuuacuuaguuguuggauugggaugcaaaccuuagggucaaaguuacagggcucagggauggucaguagaguuggaagcuguugaacagggguucuugagagaggccuuagggugcccccgggucacuccuugcaaaagaagugcuacccacccccacccccccacucccaaagggaccccuuggagcucaggagcacuagggcaggagcacuacggcaggcuuugggugugugcuaaaaagagaaagucuuccagccagggacuuuugggguccuugcuggcccuccaagccuugggagaacagugggagcugccacgacuugugggagcuuguggugggguagggcccuagaggacaucuugucacagagaaacagcaucgcccuaauaauugggacagauuuuaccuaggagcuguaggggaccggcugagucaucuccauuugagcagaggugacaagugggugucuucuggggaacaaaggagcacagaauccaugaagggaagggaagagaagggaagggugcuuuauacaggcucuucguggcuuugcugcugggcuaauucccaugaucccacagaagcuacagagcugcagacacuuuggggucuaaaguugcucuagggaugcacccgugagcugucagagaugaagcuaaaguuuauauuuuuaaaaggagcuuggcuaaauguggcuaagccuccagugugugcacccaguagaggauccuuuuccaggaagggagacguccuuccuauugaacagaaguccauuuucuguuccaugugagggucauucuuaagaagacaauagaaaaguugguguuagccacaaaucagucuuuuuuuuuuuuuuuuuuuuuuuuuuuuugguuuuucgggacaggguuucucuguguagcccuggcuucuuagaacucacuuuguagaccgggcugaccuugaacucagaaaucugccugccucccaagugcugggaucaaaggugugagccaccaccgaccggcaacaaaucagucuuugcacauuucuagaugccaggugcgagugucuuuagaugguugaugaggagcagccuggaggcuuuaccaaguuguccucugaguguaggaggcagaagugugugagcacacgguuucaggcgugaucauuuccuggagcagugugugcacccaguagaggacuuucccucguggcccuuguaaccgaggcagaaagcuguccccagaguauuugguguguugaaaucugacauuucugucagauucucccucaagcuuucccagaucguagugggauaggauagccgcaucaagcacuguucccagcaggacccaaaaccaucaggcuuuuguuccaaaggucaagaaauuaggaaggagaagaauugugaacaguuuggagaguugugggcagauauuaaagccagauguagcauguggauauauuuacacgcagcuuaaaagaugaagcagugugucagcacgcaccuguggucccagcccucaggcagaagcgagagaagcauggauuuuaggucagugugcuacauagugauuuucaggccugccuggguuacagacccugccuuuggagacagagaaaaaaaacuaaaaacaucagcacuguuuucuccuugcaaaugaagauguaagauggccuucugauguccauauuuuuauuaggggaugagagaguccuaccacagugaaacucaaaguuacagacauucuggcccauaaguaaguacaaguuuuauuguugcuuucacuuuuugaagauugucuaaaacccccaucagccucucccauguugggaugauguuccuaagcuaccgugccuggcucuaucuguguuugugugugugaguaugggcgagcgccuaccaugaugcacauguggagaccagaggacuacuguggaugucuuuucucgccuccucguugcuuggagcaggcucuuuucucuuguuuacuucuccuuaugcugugguagcuggcccucaagcuccugggguuuuucuuucucuaccucucaucucauagcacugggauuacaaacauguauuaccauguuuggcuuuaaguggguuuggggaucagaccugggugaucuuuccagccccagcuguuuuaccaucauuugaaugcauuaggaaaacacuauucuuucucuaggcaguuuuagcuuuaccagcuguauugaaguuucuugacuuuuagccaacacaaacugacccuggaauaagggacuuuuuccccuuuuccucuugaguuuuucugacuucagaaggaaagaacaaaggcuggggaauguagcuucguugguagagugcuugcuugguaugcaugagguccugggcucuaucacuagcacuucauuaaacuaggcauaguggcauaugucuguauuuccagcacccaaaaacuaaagcaagaguaugauaaauucaaugucaaccucuucuccagagcaaguuugagaguagugugggcugcaugaaaccuuaucccucacccccccaccuccaaaaucaacaaagcauguaagaaaacaggaugaaacagguaagucauaaauccucaaagauagugaagaagaucagaaucugaaaucggggcacgaggaggagcaacgucaugcuugaguucucagcgucugggagguagaaaccgcaggaucaggaguuuaaggccagucuuggcuacauagcaagucuaagcccagccagggauacaugagacccugucuuaauagaagaggaaggagaagaaaaaggaaaccaagaaucuaaugagcuaccguacuucucuguugaaacacagaaaguuacaucccuuucugauaaacauaaaacagcauuuugacuuuuuguacagugcugugauuguacccugggguauacuaaccucugagcuccugagcacagcccaagauuauuccuguuuaaaaaagauucugccaggcgugauggcgcacgccuuuaaucccagcacuugggaggcagaggcaggcggauuucugaguuugaggccauccuggucuacagagugaguuccaggacagccaggacuacacagagaaucccugucucaaaaaacaaaacaaaacaaaacaaaacaaaacaaaacaaaacaaaaaaaacaaaaggaaagaaaggaagaaagaaagaaaaagaaagaaagaaagaaagaaagaaagaaagaaagaaagaaagaaagagaaaaagaaaaagauucuaagcccagcgcgggugacauguuccuuugaucccaggacucgggagucaaaggcaggcagaucucugaguucaaggccagacuggccagaguaaguuccagaacagccagaaauacacagagaaacccugucucaaaaaaacaaaacaaaacaaaacaaaaccacaaacaaaauuuagguccuagagagaugcauuaggguuaagagcaaauacugcuuuuagaggucuguuuguuaggaccuauuucaagggacucgugacucuguaacuccagcucgaggagauuggacacccuccucuggucuccaugaacacucacacacaaauagucacacagacauauaaaucaaaauaaaaaagaauuguagcuggacauacuuuuauuuccagcauucaggaagcaaaagcagucaaauccuugaguuuaaggcagccucaggaacguuaggaugccuugaccuuggugagagcaagguacacccagauuuauagaggaugcccgcauggagggaugauggcauauucuuggaugcuucugagccuucagaggucuuuuaaaauuccuuauggaccucugaggcccaugcuuuacugguaugaauaggcaggccauuucuaagaaagcagaaugcuuuuuguuguauuuauuuauuuguuguuauuuugauuguucuagacagaguuucucuauguagccuuggcugcccuggaacucacucuguagaucaggcuggccuccaaugcagagauccgucgaugccuuccagugcugggauuaaaggcauguaacaccacccugccuuugcauuuugguuuuuguuuguuuguuuuaagggacaacauggagguuguuuuguuuugaguccgggucucuccauguaccuugauaacuuagagcuguguagaccaggcuugugaacuugcugaaauucuccugccucugcuuccagaaugguaggaugacagaugcuaccauaccuggccagcaaaguuuucaagagggcuuuguaaacauuagcucaauaaacucaaacuuaguuccuugaagcucucugauucugggugaugggucuccaacaggacauuccagucaacaggcugccugaaguuuccaauuguuuccugcuggaagagaacagacccaacugcagcucuguaaauaacugcuaccaugaaaggaaguacuugggaaguuuguuauugggaggcaucagacagugagaaaaagacgaauguuucaauuuagcaaaguauaauuuacugaauaguuaugagucauggauaguuaaagagaacuaguuucuuuuuauaaccaauagauaaaaaaaauagaacccuagagaacagugugcugaacgacaggaggcaaagccuagcuaucuuuucauuuuauucacuuccauguccuuaauucuuuauucauuuuaaauuguuuuugguuuuuagacauuuuuaauuuggggguaguuuggacacuaugaagaccugguuggcuuugaacucacagaucaacuuacccuccucccaagugcugggauugaaggcugggcuacucuccagcccuuguuccuguaguuuuauugucauauauugacuuuugaucuggaccagcagguuguucuucagugucaggaugcugaggaggaaagaucagagauaaagaagacagaacagguagcucaggaauuaugcaugaccuaucucuuauaccuagcaaguuuauuaagaaguacacuaucuuauguacuuuugcagagggacauggggcagucagugggaagcgaccauacagugggacaaagucagcaggccccugagcaagcaauauugccuagggaaacacaggaucucucaagggugucugagaccuaagcacauagcagccuuagggcucaauacagcagucacucagcagggggugcgugggugagggagguuaguuuaaaagucaaauucccaggaaauaaaaccuuaccuccuuccagucccugaccccaggcgcaaguauaggccuugccagccugccucugggcaaggacauagaaccagguuccuuugucuuuucaucagggccucuaagaaagccuuggauuggccuggcucucaacggauuauacaugguauauugauuauguauauauuugugaauacaaacucuguguguguguguguguguguguguguguguguguguguugcugaggaugggacucaggacacugcacaugcugcacacaugcuuuuuacugaaguguguucucaacucauauauuuagauauuguuaacauggaucuuacaaaaauaaacuaggaaauaaaguuacaaguuuaucacaugccaggaucugccacagauuaguacaguacaugaauucaucaucucaugaccucuagcgguauuuuuaugaugauaaugauuuuguguguguguguguguguguguguguguguguguguauguguguguacaugccuugggugucauucuucaggaacgagguaucuugauguuugagacagggucccuuacuggccuggagcucucagaguaggcccagcugacugccuagucagaggaucguccuguggcuaccucccucugugccuggcuuuuuacauggauucugggaaauaaacucaagcccacaugcuugcauagcaagcauuuugcuaacugagccagcuccugguaccuuuuuuggggggggggggcuaggggguacagucucuuuauguugcccuggcuguccugggccuugcuauggagaccaaaauaaccuugaacucacagacaucugccugccuuugccuccuaagugcuggaauuaaaggugugcacuacuacacacauuuuuuuuuaauguugaaagaauauguucauuaauuuauuaauuagaugugaacuuuuuagucauucuguacaucuaaacauacuuaguuaaaagauagagauagacagcuuaucuugccuggcagacaguuguggauuuggacccagcagagaaagagaaagagcaagggggguguugcacaucuguaacuccaacacugagaaggugaaggcaggaggaggagaaggucauuauuagcuacuagaaaauucaagaacaaccuaggcugaguaaguccuugucucaaaaaaaaaaaaaaaaaaaaaggaaggaagcugagacgauggccuggugugcacugugcuuggugugcacuuguggggaccugagugcagaaugcaagaacccauuagaauaugggcaaaauggccagacaugguggcaaaugccucuaaucccagaauucaggaagcagauguagguggagcucugugagucuggggccauccuagucuacauagagaguucugggacagccaguccuacauagagagaccaucucaaauuacuaaaccaaacaacagcaaaacaaaauaguguugcuccagggaugggaggucccuaggcugaucuccagagcucacuggccagcuaucuacaagcuccagacccugcuuaaggggggggggggggucgagagcaauaggggaagcccauugucagugucuggcuugcaugcauacagucacacccaugugcaggcaacacacaugugcuugucuaguuuggugcugggguggagugcaggguuccaaacaacaguuaguuacaugcaggccucaucccaacccuccaauuuguguuuucuucaggugguugcuuuggugggucccugaauucuuagaacaccuacaaaggugaagggucucagaucuuagagaccacccaaagcugagcagccggagaagugagggcccugucugguggcauaggcaggaguggagcuuggacuugaaagggagucuaugagaugaagcuggguugcccaaggaaagguccgugcaguggaagggugaggccaaggcugccacauggcucguuguccagugucagugccugcaguguaugcagggcuccaggcuccauccuaguguccuccccauaaaccacuccacuuuauuuuuuugagacagggucucagucuggggcucauugauucacuaaggcuggccuaacuccugggaugggccaguguagucccuaucucccacccccugccuccugccagccaagugccagguuuuuauuguguuagggaugugaacucauaucugaaugcuugugcuaauacagcuaagcaaccaccccccagcccuuccccaccaccacaggcucucacuguaaccaaagccggcuugggacucacugcauagcccaaguuagcuuugcauugguaagcuuccugccuuaggcugccaacuguuaggauuacaaacucuggucaaaucauggugaacagcauggguguagcugguggagugcuugccuugcaugcucuugagguucugucuuuagcaccagaagggaggcauugucaucugggaauguggagccugaccacugugcuggaggcggcugagcugaccuuacuauuacuuauuacuggcucauuaggccuaacuaccuauauccuggaugggagcucugugcuucuugggcauguuuguggccagcaggugccaggugcuauguaaccucuuguccugccuuguaggaucuguaagacuuucaucccagcuuacagaggaaagaacugcucaggaccuguccuaagagcaggcuugauucuugccccagaguugcccugugagccucucuucuuagccucugacugcucaggugcaagaacaucaugaucucagaguuaaccuauacgauugugcuuuccagaacugggaguugagggcacaagucagcguguggaacgcaguagacccuugggaaagccuaugcccagauguggccacagcagcagcccuggcacaaagccucuguacaaagaagcuucagggugcuugcagauguggcaccccagcgccauuccugcugcuccuucuggagauggcaacuggaggugcccacaugcaauagggcauggggguggcaccuagagguaccaaggggcaaguggccgccacccguuuuguuuuuguuuuuuuaaaaaaaaaaaaaaagcuggggcuggagagauggcucagagguuaagggcacugacugcucuuccaaagguccugaguucaguucccagaaaccacgugguugcucucaaccaucuguaauaggauucgaugcccucuucuggugugucugaagacagugauaauguacucauauaaauaaaacaaauaaaucuuuuuuuaaaaagccaaacaaaaauuuuuguagcucuggggcauuuuuguagcccuggauggccuggaaugcacuauguagcccaggcuggccucacccacucuuuuuuucuuuuuuuuuuuuuuaauaauuuuauuagguauuuuccucauuuacacuuccaaugcuaucccaaaagucccccauacccacccacccccaauccccuacccacccacucccccuuuuuggccuggcguuccccuguacuggggcauauaaaguuugcaaguccagugggccucucuuuccagugauggccgacuaggccauccuuugauacauaugcagcuagagucaagagcuccaggguacugguuaguucauauuguuguuccaccuauaggguugcagaucccuuccucacccacucuugacccuccuuucucaaucuccuguguguuggaacuccaggugcauaccaccaagcugucuucacccucccucuccuucccuccuuuccugguuucucucuuccuccuaccucccccucucagccagagcaguucagaagccuugcuggggccuugcuggggccuugcuggggccuugccgcccucccccucacagcuacaagaugagucccugguuccgucuaguaccuaccugguucagugaacccaggagucacagaggcugaggaagacugacuccccuccacacacauaccccgaaaagcugugaaccuugugaagguuguuuccccccaaccccacuccaugcaguagauaguggcucuuucuucuuccacuuaaagccgacucucccguuguucucacaacgcccccuuuacucccacccaccucgaggcucuuucgugacaaagcucauucuggcucagcuccccgcugcuugaucuaaccggaagucaguaguucuaacagugaggauucuaaccuaaaccugugugcgcaugugugcacuugugugcaugcaggcuguguccuaggaacguagaaucuaggucacacuucucacauccgagaacuuguguguuuucggacaugccgggguuaugcgccaaacacacccugcucuggguucagcagaaacagccuuuguaucaccagcagaugauuaacguucuuuccaggcugcuggcacuucuguaaauaacuuuaggaugaaaacaucagacuuggccauuugucaggcacgaagggcguucaugguauuguguaauuguuaccagaacuuucucaucauuccacgcugucacucucuagccacaaagugauuuccuauccccuucccucugcucccauagcuacucaguuuccaguccugugcuauuugcuagccugugucuggaugauuuugcuugcaggcccauccuugcuggagcaugggucuguacuucucgccacagcaacacacaccccauuguggagcguccuggcuggccuagcucaaacaagagcaggcagauaucugaagaccugcucccgguccuggcuacacagcacugucacgugcauagccucuugugggagcauaaaacuguuucccccaguuuucaccuagugugucaggggucuaauuuuuuccccauauuuuuacuaacuuuaucgucuuacuuuaaaauagaaauuaaaaaaaaaaaaaaaucaggccugauagugcagaccugagagccauucucuacggaguuguaagaagauagagaguucaaggccaaccugagcaacuuaaugacaacuugucucaaaaauacguggguggcaaugcagcucagugaagcccugugugcugccccugguaucuugccccagaaaaauguucuuuccauuguggcuuugauacacauuuccuuaguaacuguaacuaacaaugcuaagacucuucacagaaaggcuuuccugacaaagcuuguguuucccaggcuguccuugaacucacgaggaugaucuuggucuucugaccauccagcccuggaugucaggaucauaggagcguuccgucaugcuaaacuggaguggggcuggaaccgagggcuuucugaaggccagacaaacacucugucaccugagcugcaucccagccucuccccagugcccuaguuuuaaaacacuuuaugcauguuauguuagacaggcauucgaccacagagcuaacacccaagcccuaaaagcccuaaauccucuuuuccuuuuuuuuuuuuuaaagauuugaaaaaacuuuuuuuuauuauugauuuuauugauugauuugggacagagucuaguauggcccaggcugcccucaaacucaugaucuuuuuuagacucuuaagugcuagaaucucagaugucaaauacucaacacuauguuuuaacuuaccacauuguuuuaauuacuguagcuuuguaguuaguuuuaaauaaggaagguaaguucuucaccucuguuucaagauuaauuugguuauuugugcucccuagagauuggauaaaacuuagcauggauuucucuacuggguagugcugagaaucuuaacagcauaguaucaacaauguuaucaauagcaagucuuccauucugccucgguuacugacaucuucauuuuuauacucucuugaucaacuaagaucaacuaaaugugagaucugcagagcccagccccugccuagaacuccuaaagaguugauuccaggagccugcagaauagggcucagagcuguggagcuaccccagcacugcuuccauuuccucacuuacacgaucuuuucugagcuuugggaaacaggcugcaguguggcccgucagccucaguauugagcuuacugugugcauuaccacaaauggcuuuuccucuguaaaaacccuaggaaguaaugacugcuugaguuuggcaguugccccuuaguugcuccauuucccauggccaggugggcauggcuccacccacuccucacagugcacaaagcagaggagggcaguuuucaacugagccuugcacucuggggaucccccccaaggaagaugagucuuuuggaaggcaauuggggcuguauuaggguucucuagaggaacaaaacugauaaaauaucuauauauuaaauauuguguagauagauauagguuuuucaagacaggguuccucuguguagcucuggcucuccuagaacucauuuuguagguuaggcugaccuugaacucagaguuacaccugccucugccucaugaggauuaaaggauuaaagguguguaacaccacugccagguuuaaauauguguguguguguguacaugcauguauacauacauauauacauacauacauacauacauacauacauacauacauacuuaggcugaccucaaacuguuaauuauacugucaauguuguguaagcuucuaagcuaccucucuagcugaauuuuggauggauggauggauggauggauggauggauggauggauagacaguauagcucauugacucacauccaaugcuacuucuaguauaauaauggauaguauaaacuaagacacccaagcacguguuaggaaaacugagccacagaauggaggaaaaugaggccggcgucagauagucccgaaaugcccauaaucccaguccgcagccuuucaggcagacucuggcgccuguuuccacuuugcugcacccacucuuggccuucucugguaagcugcacaguagccacagggaccauugucccccuggauaguuuccuguagguuuacaugugugcucuguaacugacugcuggugugugauagugggaagcaauggacugagcaaagcaacucucuccugcuucucccaaguacacaugacaucagggccccugauuggagcgauacccacacucucugagacugggaaugugcuggaauauuuggaccuuggucauuucuaggucaguuucugucaaaaauuggccaaaagacaaguugaguuccucagaauuucauacaguuuccaugucugcucagcucaauaagagguggaguccaggcccuuccuagaaccgaucaugaggguaagagcuggaugugagauggcuugacugacggaagcccauggguauauaaaggcucaggcccagugugcaugcagagugaccacaugagcacucugccuuuuggaaauaggugacaugagugugugggcuguagagccucagcuuugaggucccucucuugagacuauccugaagcagcccucacaccuagggcuuggaccugccuccucuaaagacucuuccacaagccuucccaaccuagaucagcacucuacccuggaaggaacuguaaguggccacagucguggguggaagcuucccuaguuccucuuucuugugucuuuuuagguucucgcaagccuuugcugugaacuuagugaacccagugucagcuguggggacgcuggugaacugcaucuauuagauccugggcuaugcuccccagcucuugcuuaccagaaggagugugugugugugugugugugagcauagucacucacacuuaccguguacuggggacagaacucaggcccuucugugugcuaaacacuacacuacugagcucacccagcccugugguuuuagaucugcaaucugaagcuauuccuuacuucaauggggagagaucccagugucucacuuaguuccucugugagucuucagccaagucugguaaaucagucagugcaaggcuuaguggcaagaggagagcucacguuuuauuaaauuugcacagcccuggagaucuacacaaggagaugugccccagcgaaaugaccaaaugauuauaggcaugguaguacaugccuauauauaaucccagcccucaggaagauuaggaguucaagacuagccugggcuguauagccuggcugaagaaagcggguugaucaguagagguuagugguggagugcuuaccuuguacacauaaagugccauccacaaccaaaagaaaauaaaguacacagggccacagcuuuccugcuuucugaggcaaagaaugauaauuuuauaggggaaaaaggacauagaucucuggaugaggcuggugaauucuagagauguugcuugguaaucaaugcggguugugaagccagcuaggaaaugagggucacuccaaagagauuauuuauucagguccccagccccauuaacagucucugcuugacgaaggcuauuuuuccaucuugguacuagagaacucucaccccaagaaaucuucacauucugccacuuguaggagcaaacaggucacauggcccauccuguacccacaguuccucuuucugcuagaaacagucggaaugcugguucagugcaaaaugacacugccuuccuggagaaaauacucagggcuugggaccaugccucacgguccucuacacgggacuccaggaggcacaaaugugccugcucugcagccacaggccagugagcaggguggcuucacccagcgaggcacugacccaucuucauguagucucugaaccuuggaccuccuuggcacaagggaccaauuaagcgagccaagaacaaguggguaggcaggaagggcacaugacacacagccugucuacccugcccccgcccugcagaugcuguuggcugcugucucauugggucuccuguugcuggccuuccuccugcuccugcgacaccuaggcuggggcuugguggcuauugguugguuugaguucgugcagcagccgguccacaaccugcucauggguggcacaaaggagcagcgcauccugcgccaugugcagcaacacgcaaagccuggagacccccagagcguccuggaggccauugauaccuacugcucagagaaggagugggccaugaacgugggugacgcaaaagguacauggcccagcagcaugcaagugacggggaaacugaaguggguauggcagcgcuuauaggagagccuguuagagggagagcgaaucaugggucaugcuucugucuagccccuguggagaccgaaucauuuacacuggaaaaggccagguaggugggugagaggggucccugugugugaaaguccagugaacucuccaaggguguaugcagcaggguccucugggcuaucagaaggcaaagggccuuucucagcaggucaggagcaugagaggaauguguguugcugguccggagaggaguaaggccagaguuggggauggguuucccucccucuaccuguacuuacgcccuacucaccacccucaggccaaaucauggaugcagugauucgggaguacaggcccucgcuggugcuggagcuaggagcuuauuguggcuacucagccgugcgaauggcccgccugcugccaccuggagccaggcuucucaccauggagauuaacccugacuacgcugccaucacccagcaaaugcuggacuucgcaggccuacaggacaaaguagggcccaguguggcagcugaggggugaagagggggagagcugggcaggcagugggggagggugaugagauccuuggccagccacuaagcaccugccguaucuaacacuggagucaaggaagcaaccccagcaaguuaggcacauggucuuacuggccuauccuguagagcaagcaacagccaggacugccagggaaacucaaugcagauuccucuccaaagccccaaagagauguagacacagguggggggguccaggcaagcuccugcaugucacagugggcacaguucugacagagcauuguuccagguuuccauccucaucggggcaucccaggaccuuaucccccagcugaagaagaaguacgauguggacacauuagacauggucuuucuugaccacuggaaagaccgcuaccuuccagacacacuucuccuggaggugagcugaacuacugcugcucagcacgauggccucugugcgguuacugcuggggucacugagccuugaccucuugaacagcccaagggcauaggugggcccagggacagucugaguucuguggguugcagaggcccugugguggguggagaugaaaggaagagguaggaaugccaagccagggacucccugcacugcaagcaggguacuguagggaguggggcagguaccagagaccagaacacuugggccugaaggacccagaacugaguacccaagggagcagaacugggugucaaaugggucugacugggggucaacuggggcuacccacggggauggcaagcaugucuacgcucccuaagccuuuucagcccucagcacugcccagccacuuuccccuagcaggaccccagcucugacuggggaagccaucccuacucccaagugacuagaguauaaggggacauuaccuuguccugcucugguggccugcaaagagacauggaauggcuccuuggcccucacuuggucuccucacagccuuucacagccaauggggcuguccaugugguauuuaccagccagcugucucaagagcuguauacccugucauauacaguggagucccgaaugugggaggaucaggcaguaagcccaggggcaggacagggccacuguggcuugggcaggauucagauggcucuggugcguguaagaacacagacaaaggaaaauucaggcaugggcucacuagggucagaggcagggauagcccagggcaggcaaaaaggagaccagcaggcccggucaaccaugggaagcugccucagacaggguccugucccuggcagacacugaacacgauguuaccuacugagaacagagaaaggcagcugagcagucaggcucuaccuauacaggagagucaagcacagugcagggaguugggcuucugcacuuucugugugugaucauugaagaggccugccuuuagaaaagacggaaauacugcuguucaguaacuaggaaacuaacgguuuucagugcugcugcuuaaagcuggcaauuagcuccagaagagaggcauacauuggaaaugggcacacucauuuuuuuuuucaauguaugauuguagggaauugaacccaaaggaagaaccuuuaagaauagagaucauaaacuaaaacuacuuguacccaggcuuacugcugcacacggacaaucucaguacuugaaggcaggaggaucaucugcuggaggccagccuagguuacacaauaagauauugucucacaaagcaagcaucuugucuuaccuauagcauucaguacucuaucuccuuagcauagaagccccagcacucagacacagaugcagucuuaccuggaauucccuggguggccugagaauucuuucaggaggcucuugguaccugaauacugucaccagacaaggcauguuuccugaagggcagcaugggugccuagcaccaccaaagugcauaccuuccugucaugaaaucggaaguuuucugucucagugucugacugacagucaacauguaacucuugauguuuccaugucccuggcuaagccucagcaccucaugcucaucuugacccuuucccacucuaacugcaggguccccuucuggacugggcaggguccuauucauagcgagacacuuggauguuguggcgggagacuaucccgagcuuacugaccagccucagggucccucagcccucucauaguccacaccccacccccacccacuagggccagcuggagcccuggucaacuguaagagcacagcacuggugugugaggacccagagcccucugcuuucucucugggacagcagcaugaugggauguuuuuauuugugugugugccugcuagcagugcucuucccacugagacacacuucagccaagggcuacuuacuggauuuuacuuuccauuuuggguugcuuccaguauguuugaagacaagugccuuacaugucuuacauaguccggguagccuggaaccaaugaaucugccucagccucccgaccgcugagauuacagacgugaccccaucagacagaacugcuguuauuaucuuuuguuucaugauuauguuaaaaacaacccccuaagccuccugggcaaacagauauucaaguguccuguuuccuggcucucccuaccccugcccccucccaccccuuucuuggcagguacuucaguuauuuguaugcuaucagcugauauacuucccagagaggauagacaagcauccuacaugggauucucacaaucacaaguucuagacccacugcuccaagggcccaggaacgacucccuccugcucagagccuagcaccuagugucuucccuggcccaaaaaaaguccagagcagauccucaagggcaggguuguuggugaggaugccauauucuuggcauagaguguuggagggaaacuggcgaaccuccaaaccuucacuguguggccuacaugcuccucuagggcuggggauggauucgaggaagaauaggaguuggaagugguuccaugggagagcagcugcccauggauugcacugugcuugccaagcauuccugacccucccugucuguccccugcaggaauguggccugcugcgcaaggggacggugcuccuagcugacaaugucauugucccgggaaccccugacuuccuggcguaugugagggggagcagcagcuucgagugcacacacuacagcucauaccuggaguacaugaaagugguggacggcuuggagaaggcagucuaccaggguccaggcagcagccccgugaaguccugaccacucagccugaugagcuuccgucccagcucccuucugcacgaugacacacacucacucugacccccucuaugcuucuggggccuuuccucagggccuguggcuccagauugucauacacuggcacauuaaagguagugagcucaccaugcaaaccacuacaauaccccuggaaaacaccugugcaucaaaggcugcauugaggccagagaugcaguagaucacagugcgugccuggcacgcaaaaccccucacggugaauccucugcacccaagaacaaaaagggagauuuaaaaaaaaaaaaaaagggggacuggugagauggcucaguggguaagagcacccgacugcucuucugaagguccagaguucaaaucccagcaaccacaugguggcucacaaccauccguaacaagaucugaugcccucuucuggugugucugaagacagcuacaguguauuuacauauaauaaauaaauaaaucuuuuaaaaaaaaaaaaaaaa

SEQ ID NO: 8143 - RNA, 5999 nt, Mus musculus
ccugucucaaaaaaacaaaacaaaacaaaacaaaaccacaaacaaaauuuagguccuagagagaugcauuaggguuaagagcaaauacugcuuuuagaggucuguuuguuaggaccuauuucaagggacucgugacucuguaacuccagcucgaggagauuggacacccuccucuggucuccaugaacacucacacacaaauagucacacagacauauaaaucaaaauaaaaaagaauuguagcuggacauacuuuuauuuccagcauucaggaagcaaaagcagucaaauccuugaguuuaaggcagccucaggaacguuaggaugccuugaccuuggugagagcaagguacacccagauuuauagaggaugcccgcauggagggaugauggcauauucuuggaugcuucugagccuucagaggucuuuuaaaauuccuuauggaccucugaggcccaugcuuuacugguaugaauaggcaggccauuucuaagaaagcagaaugcuuuuuguuguauuuauuuauuuguuguuauuuugauuguucuagacagaguuucucuauguagccuuggcugcccuggaacucacucuguagaucaggcuggccuccaaugcagagauccgucgaugccuuccagugcugggauuaaaggcauguaacaccacccugccuuugcauuuugguuuuuguuuguuuguuuuaagggacaacauggagguuguuuuguuuugaguccgggucucuccauguaccuugauaacuuagagcuguguagaccaggcuugugaacuugcugaaauucuccugccucugcuuccagaaugguaggaugacagaugcuaccauaccuggccagcaaaguuuucaagagggcuuuguaaacauuagcucaauaaacucaaacuuaguuccuugaagcucucugauucugggugaugggucuccaacaggacauuccagucaacaggcugccugaaguuuccaauuguuuccugcuggaagagaacagacccaacugcagcucuguaaauaacugcuaccaugaaaggaaguacuugggaaguuuguuauugggaggcaucagacagugagaaaaagacgaauguuucaauuuagcaaaguauaauuuacugaauaguuaugagucauggauaguuaaagagaacuaguuucuuuuuauaaccaauagauaaaaaaaauagaacccuagagaacagugugcugaacgacaggaggcaaagccuagcuaucuuuucauuuuauucacuuccauguccuuaauucuuuauucauuuuaaauuguuuuugguuuuuagacauuuuuaauuuggggguaguuuggacacuaugaagaccugguuggcuuugaacucacagaucaacuuacccuccucccaagugcugggauugaaggcugggcuacucuccagcccuuguuccuguaguuuuauugucauauauugacuuuugaucuggaccagcagguuguucuucagugucaggaugcugaggaggaaagaucagagauaaagaagacagaacagguagcucaggaauuaugcaugaccuaucucuuauaccuagcaaguuuauuaagaaguacacuaucuuauguacuuuugcagagggacauggggcagucagugggaagcgaccauacagugggacaaagucagcaggccccugagcaagcaauauugccuagggaaacacaggaucucucaagggugucugagaccuaagcacauagcagccuuagggcucaauacagcagucacucagcagggggugcgugggugagggagguuaguuuaaaagucaaauucccaggaaauaaaaccuuaccuccuuccagucccugaccccaggcgcaaguauaggccuugccagccugccucugggcaaggacauagaaccagguuccuuugucuuuucaucagggccucuaagaaagccuuggauuggccuggcucucaacggauuauacaugguauauugauuauguauauauuugugaauacaaacucuguguguguguguguguguguguguguguguguguguguugcugaggaugggacucaggacacugcacaugcugcacacaugcuuuuuacugaaguguguucucaacucauauauuuagauauuguuaacauggaucuuacaaaaauaaacuaggaaauaaaguuacaaguuuaucacaugccaggaucugccacagauuaguacaguacaugaauucaucaucucaugaccucuagcgguauuuuuaugaugauaaugauuuuguguguguguguguguguguguguguguguguguguauguguguguacaugccuugggugucauucuucaggaacgagguaucuugauguuugagacagggucccuuacuggccuggagcucucagaguaggcccagcugacugccuagucagaggaucguccuguggcuaccucccucugugccuggcuuuuuacauggauucugggaaauaaacucaagcccacaugcuugcauagcaagcauuuugcuaacugagccagcuccugguaccuuuuuuggggggggggggcuaggggguacagucucuuuauguugcccuggcuguccugggccuugcuauggagaccaaaauaaccuugaacucacagacaucugccugccuuugccuccuaagugcuggaauuaaaggugugcacuacuacacacauuuuuuuuuaauguugaaagaauauguucauuaauuuauuaauuagaugugaacuuuuuagucauucuguacaucuaaacauacuuaguuaaaagauagagauagacagcuuaucuugccuggcagacaguuguggauuuggacccagcagagaaagagaaagagcaagggggguguugcacaucuguaacuccaacacugagaaggugaaggcaggaggaggagaaggucauuauuagcuacuagaaaauucaagaacaaccuaggcugaguaaguccuugucucaaaaaaaaaaaaaaaaaaaaaggaaggaagcugagacgauggccuggugugcacugugcuuggugugcacuuguggggaccugagugcagaaugcaagaacccauuagaauaugggcaaaauggccagacaugguggcaaaugccucuaaucccagaauucaggaagcagauguagguggagcucugugagucuggggccauccuagucuacauagagaguucugggacagccaguccuacauagagagaccaucucaaauuacuaaaccaaacaacagcaaaacaaaauaguguugcuccagggaugggaggucccuaggcugaucuccagagcucacuggccagcuaucuacaagcuccagacccugcuuaaggggggggggggggucgagagcaauaggggaagcccauugucagugucuggcuugcaugcauacagucacacccaugugcaggcaacacacaugugcuugucuaguuuggugcugggguggagugcaggguuccaaacaacaguuaguuacaugcaggccucaucccaacccuccaauuuguguuuucuucaggugguugcuuuggugggucccugaauucuuagaacaccuacaaaggugaagggucucagaucuuagagaccacccaaagcugagcagccggagaagugagggcccugucugguggcauaggcaggaguggagcuuggacuugaaagggagucuaugagaugaagcuggguugcccaaggaaagguccgugcaguggaagggugaggccaaggcugccacauggcucguuguccagugucagugccugcaguguaugcagggcuccaggcuccauccuaguguccuccccauaaaccacuccacuuuauuuuuuugagacagggucucagucuggggcucauugauucacuaaggcuggccuaacuccugggaugggccaguguagucccuaucucccacccccugccuccugccagccaagugccagguuuuuauuguguuagggaugugaacucauaucugaaugcuugugcuaauacagcuaagcaaccaccccccagcccuuccccaccaccacaggcucucacuguaaccaaagccggcuugggacucacugcauagcccaaguuagcuuugcauugguaagcuuccugccuuaggcugccaacuguuaggauuacaaacucuggucaaaucauggugaacagcauggguguagcugguggagugcuugccuugcaugcucuugagguucugucuuuagcaccagaagggaggcauugucaucugggaauguggagccugaccacugugcuggaggcggcugagcugaccuuacuauuacuuauuacuggcucauuaggccuaacuaccuauauccuggaugggagcucugugcuucuugggcauguuuguggccagcaggugccaggugcuauguaaccucuuguccugccuuguaggaucuguaagacuuucaucccagcuuacagaggaaagaacugcucaggaccuguccuaagagcaggcuugauucuugccccagaguugcccugugagccucucuucuuagccucugacugcucaggugcaagaacaucaugaucucagaguuaaccuauacgauugugcuuuccagaacugggaguugagggcacaagucagcguguggaacgcaguagacccuugggaaagccuaugcccagauguggccacagcagcagcccuggcacaaagccucuguacaaagaagcuucagggugcuugcagauguggcaccccagcgccauuccugcugcuccuucuggagauggcaacuggaggugcccacaugcaauagggcauggggguggcaccuagagguaccaaggggcaaguggccgccacccguuuuguuuuuguuuuuuuaaaaaaaaaaaaaaagcuggggcuggagagauggcucagagguuaagggcacugacugcucuuccaaagguccugaguucaguucccagaaaccacgugguugcucucaaccaucuguaauaggauucgaugcccucuucuggugugucugaagacagugauaauguacucauauaaauaaaacaaauaaaucuuuuuuuaaaaagccaaacaaaaauuuuuguagcucuggggcauuuuuguagcccuggauggccuggaaugcacuauguagcccaggcuggccucacccacucuuuuuuucuuuuuuuuuuuuuuaauaauuuuauuagguauuuuccucauuuacacuuccaaugcuaucccaaaagucccccauacccacccacccccaauccccuacccacccacucccccuuuuuggccuggcguuccccuguacuggggcauauaaaguuugcaaguccagugggccucucuuuccagugauggccgacuaggccauccuuugauacauaugcagcuagagucaagagcuccaggguacugguuaguucauauuguuguuccaccuauaggguugcagaucccuuccucacccacucuugacccuccuuucucaaucuccuguguguuggaacuccaggugcauaccaccaagcugucuucacccucccucuccuucccuccuuuccugguuucucucuuccuccuaccucccccucucagccagagcaguucagaagccuugcuggggccuugcuggggccuugcuggggccuugccgcccucccccucacagcuacaagaugagucccugguuccgucuaguaccuaccugguucagugaacccaggagucacagaggcugaggaagacugacuccccuccacacacauaccccgaaaagcugugaaccuugugaagguuguuuccccccaaccccacuccaugcaguagauaguggcucuuucuucuuccacuuaaagccgacucucccguuguucucacaacgcccccuuuacucccacccaccucgaggcucuuucgugacaaagcucauucuggcucagc

SEQ ID NO: 8144 - RNA, 3501 nt, Mus musculus
acugagcaacugcuagauccuuggacuuccauucacagcugcuacugaccauuguugggaauuggacugcagacuguaagucaucaauaaauuccuuuacuauauagagacuauccauaaguucugugacucuagagaaccccaauacaccacccaaaaauaaacaaacaaaagcuaauugaucccucucgugagugucugcacugcccaucaucccuuaugacacugaacuguuugugcugguggccacugugggauaacagugcuguaggaucacugaucacuguaccuuaggguuucuauugcuuugaugaaacaccaugaccaaaagguaaguuggggugggggguuuauuuguccuacacuuucagaucuuagucuaucauuggaggaagucaggacuagaacucaaacugggcaggaaccuggagggaggagugcugcuuacuggcugcuccuugcagcuugcucagcgugcuuucuuauagaacccagaacuaucagccaaaguauggcaccaucuauaaugagcuggacccucccucauugaucacugaauagaaaaaugcccuacagaccugacugcagccugaucuuauggaggcauuuuuuaacugagguucccuccucucaggugaauuuaguuuaugucaaguuggcauaaaacuagccaggacacacuguaaaagauguuugagucacugguuuuaauuuauuuaaaaaaaaaaaaaagcggggggugggggugggagagggcuggagagauggcucaacgguuaagagcaccgacugcucuuccagagauccugaguucaaucacaucguggcucacaaccaucuguaaugggaucugaugcgcucuucuggugugccugaagggagcaaugguguacucauauacauaaaauaaauagaucuuuaaaaaaaaagauuuauuuauuuacuguaugugagcguucuaucugcauauacaucuacaugccagaagagggcauaagaccccauuauagauggugugagccacaaugcauuugcugggaauugaacucaggacuucuagaagaagauggccacaucauuaucuguugccaucaguggugcacaagucuuccaauaccuccacaaccugccaacaaguagcuaugcucuggguuugccaugcagauacucaguuucccagaacuauucauuaaagauauugucccuucucugucuugucaccuuugucaaaagucauuggugggcuuagagagguggcucauugguuaagagcacuuguugcuuucacacaggacccagguucaguucucagcacccacaugacagcucacaacugucugcaacucuaguuccaggguauucaacaccuucuggccuuugaagacacugcaugcauguauuguacauauaugcaggcaaaauagucauacucauaagauaaaaaacauucuuaaaaagucauuugauauugugugcacaagcucacacacauuacacacauacuagcaaucacaaacguguguuucuuuuuauacagagcuuucuguuguuuuccauuggucuauauaucugauuuuuuuuuucaagauaggguuucucuguguagcccuggcuguccuggaacucacuuuguagaccaggcuggccuugaacucagaaauccaccugccucugccucccaagugcugggauuaacggugugugccaccacacccagccuauaugucugauuuaaugcuaguaccacacuguuuugaguacuguagcuuuauaguuaaguuugaaaucaagaaguauaagaccuucaaauuugcucuuucuuucuuccuuccuuccuuccuuucuuucuuuuuuuuaaaagauuuauuuauuuauuauauguaauaaguacacuguagcugucuucagacacuccagaagagggcgucagaucuuguuacagauaguugugaaccaccaugugguugcugggauuugaacuccggaccuucggaagagcaguugggugcucuuacccacugagccaucucaccagccccucuuucuuucuuucuuucuuucuuucuuucuuucuuucuuucuuucuuucuuucuuucuuucuuucuuucuuucuuucucucucucucucucucucucucucucucucucccucccucccucccucccucccucccccgauucuuucuuucauagcccccuucuuucuuacugagacagacagccucauucuguagccuacauuggcagcugagguauguugccccuugccaaacagucucuaccacagcugguugaacauguugaugcagaauccacaagcacugaagacuauauguggguugucuguauaucaaccuauguacauaucacacacacauuauuuauuugaaauccugcugucucagauucuucccucucaguugccaggguuacagacauauaccaccaaggccgguuuagaauagguuuuucuauuuuuaccaaaacaccauugaaguguuaauacaaaucgcuuaagucuuuagaucacuuaggguguauugauauuuuaaaauauugugcugggauuccagguguggugguacacaccuuuagucccagcacucagaaguuaaaagcagguggaucucugaguucaauaacauccuggucuacauugcaaguuacaggacagacccugucucacuacccccucccccaauaaauaaaauauugggcuaggauuauagaucagcaauggaccacaugucuaguaugaaugaaacacagcacaaaaauacuaaguuuuccaaucuaugagcauagaauauuuuuuucuuuugaagucaucuuuaguguuuuuucagcagaauuagacaugguaguguuaggauuaaaggcacgugccaccaccgcccagcaacauuauuauuauuauuacucuugcucauggcaguguuugagaacuucaguaacacacgggaaguaguagcagugggcaccuuugacucaucccuugccuuaaagggaaauauugguuuuuuguuguuuuuuuuuuuuaaccacgugugacauuggcugcugauguucaucccacuguuuugcuaguuuaaagggguuuuacuuuuaaacauuuauuauuuaaauuguauuuuacaugcacguuguuuugccuuguauuuaugucuuuuuuuuuuuuucaucucuccagccuguauuuaugucuuuuaccacauguauaccugguacucucagaggccaggaaagcaucuaggauccucuggaaccagaguuugugagucaccaugugagcguuagaaaccaagccugauccucaggaagagcaguaagugcucuuagcugcugagccagcucugcagucccagaguauuuuuccugaagguuuucauaaaaugugugauaaacuuaguuaaauauacuuccucuauuaauaugauuuugauauuuucuuuaccaucuaguuaagguauuaaauuauauaaauaaaauguucaaaagga

SEQ ID NO: 8145 - RNA, 8916 nt, Mus musculus
ccuagccugggaaacuuugagcugguugaucgucuggcauggguuuuuuggcuucauucacucuccaagucugcugagauaccacuuccacaaugucugccaagggaauagacauccaggaagcuuccagagugugagugauucuagcaggcauuuggacagucaagccccaccucccgucccuguccccaagagaacuguuauaggcuccguuaugcccaaacaguucagacccacuaggguuugggugaaagggggccugggaacgggcaaagcgcuggagucuuaacuccccucacauguauucugaagccagccuugaggcuggauaccuacagggccaccaccaccaccaccaccccagccccaucccugaacugacagaggucucucuaacccugaagcauaguuaguacacaguaagugggcccugugugagcgcaaacccuacauuuccuaaauacaggucaugcgcaacaagcaggccccauccccagccugugguuugcuucccuccugcugcagucagccuuucucuucccgggacaagagcucucauagcucccgugcagccgaaaguaaagcuggagaauagaaaauaguagaagauuccagagauuagcacaggaagaguggcagaggaggcagccugcucugcagagacacaggagguaagcccugucucacuugguguuugguuucagaccccagaacaagggacugagaugcauauuuuacauaucaaagcagaccuggcuuccagguucacccagcaucccucagucccuuccuggcagacucuguccucaacccugaacuuuccagcccaggggcugggcugcccuuccccuagaggcucuucccuauauaauccagauauuuuggucugcucucuguuggcauuccuucuaugcuccacccaacagugaccuagcaacagccagguaggccuggcuugcaauaagaggaacuguuuggccucucugacucucugauucccuucacucucucugaccccuuucucccucucucccuuucccccuccucccccuuucuccaugugcuccuggccagccccgucugucucugucucucucugucucuuucugucucugucucucuuucucugucucuuucugucucucucugucucuuugucucugucucuccuucucuguccccucucuuucucugccucuacucccuucucaacuccccuucccaugcccacaaauaaacucuauucuauacuagaccugucuaguauaugacugguaccucgaggaaggaaggagggaugcuucaguguggaccacugaguaaaguacccccucccacuauacuauaccucccuucuauaaaacauauccuuggauaacacauugcucuucuucuucuucuucuucuucuucuucuucuucuucuucuucuucuucuucuucuucuucuucuucuucuucuucuccuccuccuccuccuccuccuccuccuccuccuucuccuccucuuccuccuccucuccuccuccuccuccuuccccuccuccuccuccuucuccuucucuccuccuccuuccccuccuccuccuccuccuucuccuccuucuccuuuuccuccuccucuucuuccucuuccuccuccucuuccuccuucuucuccuucuuccucuucuucuuccucucccuuuucuucuuuuuccuuuuccucuucuucuccugucucucuuacccaugcccuuucucucuuucucuuccuccuacccccuucucuucccauggugacuucccuggccucaguccuuggagccagucaaaucacccaagagcagcuucccaauaaacaugccuguaauauaaucuaaucugguuugaauaggcucauuucaccagcagagaaauaauuuuaucacuuggguuuuauucaagcccuccccaccucccucacccacuacaggaacagagagaggcagacacugucacuggccuuuacaaguccuuugccaaucccccccccccauccuuucccuuauuuuuuguucucuuggagccaugcuacaggugggcaggcucauccccaagcccuugugcaucucucucuuaaucugcuaucucuucuccuguaacucuccaugugucucuggaagccccagcagccacucagguggguacaaggggauccugagucugacuggauggguccaguguaccagguggaaggagagaacaagcucuggcaaguuguccucugaccuccacauguguuguggcacacacagaaccaagaaauguaaaaugcuuuuuaacaagauuaccaguguuggaaacagacucaguaucucaguguugcacuuuaaaacauuuuuuuuucuuaaagacuuauccaucuuauuuuauguuguauuuugccugcauguaugcaugcgcgucauguguauguauggugccugaggaggucagaauagaacaucagaucuggaacuggagaugauuguggacugccaagugagugcugggucccaaacccagguccucugcaagagcaacaagugcucuuaaccacugagcaucgcugcagccuucaccuuagguuuugagacagagucacugagcuagaacuagccugcuaaaguagcuggccagugagcuucagggauccuccugccucugccuccucaaugccagauuacagguucucaguuaccuuuccuucuaugcuccacgcaacgauuaccuagcaacagccagguaggucuggcucgauauaaaagggaguuugugcuuguucucucucucuuucucuuucucucucccucccuccccccucccuauuuuuuucugucucuguucccuucucaacuccuguuccuacgcccuaaauaagcucuguucuguacuauccccguguaguauauggcugguaccacaggggguagugaugcuucagugugggccagcgggagacaugaggcacccuucacaccucaccauaucgcacucuacaaaacguauucugaucuuuuuaauaaaacacagcauucaacacugaauaaaaugggugcgguaaagaaaccaacguagcagcucuguggguuaaaaggaaaaaauuuacaccaaacagccaagacugugucucaggaaagaggcuggagguuccagagcauggaaguccaggguuauuaggggacagguaccugggaggaggagaacccauaaacugagguggaagacuugaaguguguagcagguacuagugacuggggauugaaggggccuagaaguuagcguggaccuugaugugcaauagacaccacaggcgauuguuaauggaaaugcacccuuaugccagagaggaggagaaagguuccuuuuagcagguagaaauuauuuucucaagacccugaggggacgcuggcuuugccagacuuugggaagagagauuucuugggaccagagacaacugcuaaaccaaauuuuuuguuuguuuguuuuuacauuuacuucauuuuuauguguuugaauguuuugcuugcauguuugucugugcaccauguacaugcguggugcccaccgaggucauaggcacuggauucccugguacuagagugaugggugguuuuaggccuccaugugagugcugggaguugaacacugguccucugcaagaacaaguucuuuuaacuauugagcaucucucuacuuccaagccugguuuuucuagguggguaugugacagccacaguuauguuuaaguuuuaauuacugugccuaacauauccauaaaacaacgugccucuagccuauaagccauuugcccgaagacagauacuucccgaaacacuggagguuguuuaugggaaauaaaggcacgcuuaucuccucccuagauaaguguuuuugacccaacggcuccagcugugcucgaucacaucuguagguaggaaauaugucacgauguaugcuugccccugauuggaccugcugggaaauauauagccuuauagguuugcuuuuauaagccucaucaaaaugugacuugucacuauuuuucugggaaccaagaaauagacaugaucagaguccaucauucuagccaguauuuaauuaaagcuugcuucaaguuuggcucagaacugugguaguggucuuauuccugaacagugggaccaacaguagcuagggaucagaauuauacagauccuagugcaagggcuuuacugagacaagcccagcccuaucccuuuuuuaauuaaaaauuuuauuuuauguguaugacuacuuugccugcaaauagguagauagauagauagaaaaaagauagaaagaaagauagauugaaagaaagauagauagaugauugauagauagaaagauauauagaugauagguagauagauagacagacagacagacagacagacagauagauagagucuuugagggccagaagaggccacuggauucgcuggaacuggaguuguacaugguuucaaauuacccugaaccuugguccucugaaaaaauaacaaagcuccuaaccacugagcaaucucucugagccccuagccauccuuuuuaaaaacaaguuuaucaugugggcacaguggugcacaccuucacucccagcccuugggaggugaagacgggcagaucaggaguuacuucaagauuauucuugucuacauucuaagcuugagacuacaugagaccucgucucaaagucgccaaaacuagggcuggagagaaggcucggcacauaagagcacuuguugcucuugcagaggaccuggguuugacuccaguacccacgugguaacccacagccaucugaaacugcaguuccaggagauccuacgucuccucuguggguacugaauguacaugcugcccagacaugcguguaagaaaaacaccacacaugagaaaauaaaauaaauaaaccucaaaaauguaagaacucgagacuaaaauaaaaccaagauaaaauaacaaguuuauuauagaaaaauacaaguguggucacaagcaaaaugaccuucaauucucuauggcccaugacccagcuucaaaaggucccaaauaauuuaacagcaucuuguuuugucuugucccucgucugaucccuggauuaaucaaaagcaaacccugagcgacagucucugcuauuaguauuucagcuucugaagggugaagagauuucuuacaggugugacaagaugaucagccaucaugggguagaggcuuacgagugcuccccuacaaauguguggcuccacagccaugcaaugaaauaugcagaaaaucagagaaacccggagggcucaggugagggcucugguaacuuucuaauagaaggagaaggagaggcucaguggaaucucaccuggggucccagccauuacuccuuacugccucccagcugaucaugauuuaguggugcuggacucuguggcagguggaugguuaacacaaggcagcgcuccagugaugacaaguucaugaguccuaacccgagccgggaugggacuuuccagugaugcagcugccuuugauuugccugugaguaacccccacccaugcucuugugaauaaugccaacaaacuguuucacaggcugaaccagggugagacuguuccuuggucuguuguugguguccuauaugugguaaagagacgcuuguucgugacucccaaggacaagugaggccgggacagacaggguguagggaugagaacuuccagaagccguguuaccagccugggugggugggugggacaucacucagucugagaucacagugcagccccuguuugcaugacauccgaauggggccagccuggcuccugcugcugcgcagguguccugggucauuuccuuccuguucggacauaggcguagugacuggcuucagacucccacguguuuucccccuuuccauuuccugucacuguuuugaagcugagaggaagagaggaucuucgaucugauaacaggguuuaugaugaggcugaugucacugcuuaagaggaagcacaggcugcgcucacgagcgucaguggcugaggucagcuaaugugccggccggauagaagggacugggcaguuucauuuuaaggcugggcacacaaugcuuucuuugcucaggacugagagcgucuguguggugcuuuagaucaggggaaagcguaaaccucaucccucacuguagcgaugucuuguacggaauccacgucuuucuguuaaaaccaaugguggcggcuugaaaagcaaggcacguuuaaauaugguucguuaaucucuguuucuacuucugaaguuuaaaagaaaacaggucucagucauuaaaauaaaccgaggugaaauucauuuuaaaaaaaaucugaaacagguuagcaaaaugacccgguggauaaagguacuuucuuaccugccucaagucugcugguccgagcucaagccccagcaucuacauggugugguggaaagagaaaacacucccacaagcuguccuuugaccuccacacccaagucaugucacacacgugccucuacacauacauacagagagagagauuaaaugauuguagcuuaaaaaaaaaagucagauccuuagaagggcagagugauacaugccuauauucuuagcacuuuagagguagaaacaagaccugaguucaaggucauuuuuagcuagauguguucaagguagaccuagacuauauaagauucugucaaaagaaagaaagggggguggacugaauauacauguaucuauacauacacauaugcauguacauauauaugauuuuucagacaagguuucucuguguagcccugucuguccuggaauucacucuguaggccaggcuggccucaaaucacagagauccacugccucccggguacugggauuaaaggcaugcaucacuauaaccagauuaaaaauacauauuuuuaaaaaucagaacuugccgggcgugguggcacaugccuuuaauccuagcacucgggaggcagaggcaggcggauuucugaguucgaggccagccuggucuacaaaugaguuccaggacagucagagcuacacagagaaacccugucuagaaaaaccaaaaaaaaaaaaaaaaaaaaaaaaaaaaucagaacuuggucaauaugguggguauucuuuguuguuccuuugacuagaucuggaauuaacuaaaacucaaaauagggcucaccugugagaaguuugcuucauuugaagugagaagguccauuucuaaccugcuggaagccuauauaggacacggaggaaggaagccucgcucuucacccuugcccuuaccuuacuagcuucaaguccaucccuucacagccuccaggauucugguguacgcugaagaccagcugaaguuuccccugugaacugaauaaggacuggauucuuggaccuucuguccacagucagccauuauuguauuagcuagaccacagccugugaguaaugcuaauaaaccuucauucauucuauguguuccguuagucuagagaacccugacuaauacaaccagucaugaugguugccaauugaacccaaggccaagugaauggugagggcccugccccucaccuaccuuuaaucugagcacucuggaggcagagguaaguggaucucuaggaguuccaggccagcguggucuacaaagggaggcaucuagucacuagagagagagaaaaagaggggcagggggugggggagaacuuaaaacgugauuuaaacauggacauguuuguccaaagaagauguagaaacagcccagcaguccaugaagagcugcucaguuccuacuuaguggaagaaugcacauuaagccaaacaccaaaggccagugagauggcuccuucagccaaagcucucccugcaugagcauguggggcugaacucagauccucacaaccccugugagccaaguguggcuccugcacuugucacccaaacacuggagcaggaggauugcuggggcuugcuaguugccagcccagcaacauguccagugagcaacccaaucagaagggacuaagguagaaagugacagagccagauggcugaugaccucccaugaccucuucaugcauacccaaugggcacuagcacauagaccaugcacacucacacauguauacacacaggaaacuaaauaaaaugcgagccaaggcugaugagugguagggcacucaccauacaguuggcauugggugcaacuggcaacaaagaacaaagccagcuaagguacuuucugucaccaguggcuuggcucuugguccccacgcaggugauccuuacaguguuuguucuuuugugccuggguucuuccucugugcaguugucaaggccacuccaugugcucagacuccuuccugcuugaggcugcucaauauuuuauugcacauuuucuguucuguucacacccucaccugugacaggcacacaucuccuucuagcucuuggcucugugccuaguguggccaugaaugcacgugaaugugugcagcuauuccaguuccugguuuccagucccucucggguuugcucugcaguggaaugcugcuucauauaacuguauuuaacaguugagaaguugucaaacuguucuccauggugccugccccauuuugccuucgcacaagcaacacacagaacuucaaaacagggucuagugaacaacagcaaagcacuucgucuacccucugugugagcaugcuugugaugaaguggguuucaagagcagcucuuuguuuugccugcaaaucacauacgcggugcggggacucuuacucucaagguaguuguuugagagagcagauugguguaagcgcuuagaacagagccuguaagcaccgauaccauugucaucaaugucagcuucugccauu

SEQ ID NO: 8146 - RNA, 4440 nt, Mus musculus
gcuuuuuuggucgggcuuuugagaaggcagcagaaagcaccagcucucggacucuacacaauuacuuugaccucucaggugagugucucugcccagugaccacauuucugccuucacaccuuccaggccagcauuggcccuggagggaggcaagcuggugauggagguauccagccagcaauccaccuugcccuuccaaaacagcccucggcaaagcugccuuuauaauucucacaacucuugcugggaaggcacaggccuacaugcagccucacuacccugcucuaaagucaguucccacccugaggggcugacugugguaacuccagaggccaagccagucuccaucauguacaaaaggaaacaacacagccuguggcuggcaaagcuggcaccaugaaggaccuuaccuggggcuccagcacucuacccugcaagacaguuuuugcaacuguugggugagucagagaguggaaaggcguaguccggugaccaccagagagagcagcacacaacuugguucaugcuugagcagauuuaccuucuuuuuuuuuuuuuuuuuuuuuuuuuugagacacaggcuauauagcccaagcuagccuuguucuuaucauuuuccugccuaugcuucucaagugcagagauuauaagcuuggggcuaccaaacuggucugucuuuuuuuguugguuuacuuggcuggcuuuaaugucuugguuuuuguuggaggguuugggggaaggcuguuauuguuuuuguuuguuuguuuuuauuuugugaagucucucuauagcucuggcuguccuugucuuauuuuugagaugggaucucacuguguagaugaggcuggcuagagugcaccaagguggaaacugccucugccugccaagugcucggguuagagggcugcaccacaacaccuggcccgucuuguucuugcucacaucucuuuuuuuuuuuuuuuuugcuucauuuauuuuacuuuauguguaugaauguugugccugcauguaugucuguacaccaugagcaugccuguuggaacuccuggaaaugggauuauagaugguugugagccacuguuuaagugcugggaauugagccuggaccauccucuacaagaguaacaagugcuuuuaacugcugggccaacucuccagccccucgcugacacauuuuacaguaaaacaggcuugacuugacaaugcacugcugucaguggcucccuaggcugcagagugcaauagccuggugacuuccacgggcuaauuccucucagugccgugucuggcacuggaagucaaggugucaguaugacuggcagccucuguccuuagcuacauaguuucuucuuucugaaacuccucuauguaugucucugcccugaucucuucuuacaaggccccuaauauuguggguaggacacacccucagcaccuuauuuugaccuguuugaaacuccugacucaaggugucagauacuggaguugggguuucaacaaaggaacuuggggaacacagcucucuguuucuucugcuucugcuucuucuucuucuucuucuucuccuucuccuucuccuucuccuucuccuucuccuucuccuccuccuccuccuccuccuccuccuccuccuccuccuccuucuccuucuccuuauuuuuuuucgccugaagggggggguuauuauauauaaauacauaguaguugucuucagaugcgccagaagagggcaucagaucucacuacaggugguuggaagccaccaugugguugcugggauuugaacucaggaccuuuggaagagcagucagugcucuuaaacucugagccaucucuccagccccucucuguuucuuuuuaguuuuguuuguuuuuguuuuguuguuguggugguugguuguggauagguugguuuuguuuguuuuauuuugagacaaggucuguaauguagcuuuguguauccuagaacuuacucuagaacaaacgaggcugucuucaaacuuacaaagaucugguugccucugccuccugagugcugacaccacuaugcccagcuaccucgguguuuuaucugcaucucucagaaagggaauuucuuacauuaccaugcucugauaccccaacacugauuugucuguguucaaguugccugcagugucucaggcaggcuucuuugggccaggcagcuguagcuauggcauugugggguugguccaccaugaacagcagcuccugauuccugccugugaugugaguggguuggccacaacacaccuuuguugcacagggaggguguaggcuagaagcucccuggauuccucugaggguugagaacuggagguagcaaguguggaaguauggucaguaucagccuggugggcaaggcuuuguacucuagggagcuagccagcagcacagagcaccccacucauagcaagcaagcccucuucagcgucugacuuugcuuuaucauaccugccuaaaccugucugcccuucaaaacacaaguauuuuguguuggguccucuccagaagacacugaaguacaccacagagcagggcugauguggccugcaccacuauggggacaggcauuaaugccggucccuguccaggucuguaucaggguugucaccugcuugguguucccuaugcugccagccaucguuuaccccugcaugcucuggaguccucgcaggauaaggcucuggacucuccacaguggagccgacagaucuaaaacaagaguacagugggaaagagaugaaacccaacacugcagaaccuuccaggccugccaggagcccgcaguguggaaugccaggagaguugucagccugagggaggagggggaggccacguaccaugccuuguuucucacuccucccugcucaugggauguuuuccuuucauuacuucaguaauugagcugaaggcugaggaccggagcaaguuccuggacgcucuugugucacugcuguccugaggguaagcaugggcgggccggguccgagggcccaacuccugcucuuguaucucucaacagaggcguuuacuuguguuucccaucagaacacggucuugagauuuuucccaggaaugucugaccuaagaaugccagcaaggccacaauggagcacuuuugagaaagcuuaauuaauuaauuaauuucauuaagcaccuuugacaccaccaccacccuccccaaaaugaccucagauuuucucucucaugcccacaccaucggcugagcaucaugugugacauacagguuaucuaguaccagccccagaggucacucagucucuuacagccacagucacaagccccaggcuggggcccacagaaguggcacucugggcuuuucugcacucaggcuuuaauaagaaagcaagcuguugguuccgcaugggcucucagcccacuguggcucaacaccucccuaaugaagcccucacuauucucccacacaauccuacuuucccacauuggaaaguggaaguaguuuucuccuaugcuugugugaccaucucagccuccguuuggccgagcagacuuuccaagccucugauauaaggagcuuucaggcugaggcugcucaauccauguuaaacccaaccuauaggggaacagaauggccucauguggcucaggaacuucauuccgucaagauagcaugagcacuaggggccauauuaaggaaagugucuagacuggaccuggaaauccuuggucagacuugcagguagucagcagugacuugggccagguaaguuuaacuuuaaauuagucuaacuccaaaaaaaaggagcccacgagugucaaguguguacugagcuuguggggagcaauacggggccagggcugacuggaggcagaucucuccugcacugccaauagcacugcuaugugugucuggcuaccgagcagggguguaacugggaggggaaggagaagauguuguuacaugaugggggaagcaagagacugccuggcaggggaaggaaggggcccuuguauacaaaccaugaagcugcccgggcaggacaaguggccagccagggucuaccaggugaaagggucuggguacuuuucaugcagauagacagucagacucaguagggaguguggaaggacagugaguaccucaauagauauggggugaccuuuacuccaaacucacccucacccucacuguugaagcugcucagaagcagcagcccaucacgccaugggaccgcccacucuaguuugaugaaauggagagaaaggaugaauuguaggaaaccuuuuuuuuuuuuuccuuccagaauucaacuucuccagaagugaccuccuuuuccuuauuuauauuuccuggccacuauucaguuguaagauaacauuugaaaugugagacuauaugguuuuuaauaaaauguuugauguuuuauccccucu

SEQ ID NO: 8147 - RNA, 23440 nt, Mus musculus
cuaacguccagucacccaaaaccaccuauguuuggcagacaucuuuacuucgggaaggaaggucuauuaucugacccuggcauacuuagaaaacaauauacucuuagacauaaaguaaauucagucacacauuauuugaauguguuuccaauaaguuuccaauacacgguucgucgaauuagagugagcuauagauuacuuccgcccgaauccaugauggccgggaucaacgccggaaacucuagcugcauucuggguauuguaguccguaaggagaacggcuccuaucaaguuguuuggaagagaguacuaucuaaacauuauaaacagucgcuauccugugaaaucaauuaucaaguguuuuaauguuuacuuuaaguaauauucaaaccucaggccuucccaugacuuucuguuuuuccgccgcugacuucaggccuccguaccccauccccugcgguguuccgucacuuccggcgagccucucgcgguuucuggguuucagagcaguggccuggacugcaaagagggagcuguggguuuuuauuguaagguucaggaaaagaagcggcaucaccaaacgcugucagucauggugaguugaccggggaucgcgaaccggaugaugccagaguugccccuggagcuggcagggagggccuggaccugguggcggaggugccgagucacccgggccugcgucgggccccgacacugucccgagagcuucugucccaagugggacccauaauuacgagccaccucuuuucuucuuagcuuguccgagucaugacucgaaugccuuucggcgggacagcagccccgagaguaaaaaggaaccugcuacuuuaugucgauaguucucauaagugcucgacacgcaacaaguuuccaugaacucggaguuaacuggagauuucuugggggaguggcgcgagggaggagaaaacgaaggacauuaagcucagccaaaguucccugaccuuuuauuuaguagaaaucaugucuuaggcuguaugucacguuguguucaucacguugugauaacgacaauagguaauauguagugcgccuuuuuucuaucaacguauacuuauuuaauuccugcauuccccauggaacauagguacguaguuauuauauuuaccgguagaacuaaaacuuagagaggugguacucaggaaagugaggcucagagguuggaagucaaguccauccggcugcagugaugucucaucacuccuguauauaguguugacuccgugccauuuguuuguuuguuaaaaacaagaagugauuauuagauuuuuauccugagugucacaguaagucccugucuaaguucauuuacauaaccagcacugaguguuugauguguuaggcauaaaagcuuuaaaggaaguaacauggaugauagaagcucauguucauugguggcugaguuggaaggauaccguucggguguugcauacuucauguacguuguuuauguuccagagagaagcaguagguuagauggauggcauaggugaagaugcuuugacgagcacacaccccccaccccccaaccccauggcucaaaaaagggcuuuguggguuaugcaccuaagacugagucacacaguucugguacuuaaagaaaaagauaaaagacugaagcacgccuuuaaucccagcacuagggaagcagaggcaggcagauuucugaguucaaggccagccuggucuacaaagugaguuccaggacagccaggacgauacagagaaacccugucucgaauaaaccaaaaaaaaaaaaaaaaaagacugaaaacuuguguacuaguaacugaagaacaguuuauuggugggggauguuggugugcacgugggcuugagaauagaagccuucggguggguaugugagcccguaugugcaugugaaggucagcagacugucuuggauguaguucuucgugucuugacuuugcuggcugguaugagaaaauacuugauaugcagugugcaggucuguucugugcugugagcaccaggagaagcacuaacucugaccccugccaaagcaagggaggcuugcugaagaagaaaaagcauuguuacugaaagccagguggaggaauacauacaugggcaucugcuuuucaccaccugcaaugcucuuuuggguuucuugcccaguugacacucagacauguaggucuuuaaugagggucuccuccugaacacuugguuaacauccauucucgggugcucucugucccgauaccuguuucuugucuuuaaaacuccuagacauagguauuuuauuguuaucuuccuugucuuucauaucaaguuccccagggcagaggugauaucugccugcaguacccaaacauuacuaaagugauauccccuaaaguccagauuggagccacacaaaugguaggcacucaggaaaagagguggcuucuaaguuaaggaugguggggaaagggcuccagguggaguuacaaguccagagacagaaacguuagguuaggagaugguggauggucaguaaugagucucugugaaguguauguaaggcccagccuugauccaucuugagaauagggaauaguagcagaagaauaggaggggaaggccugguuuuauauuuaguaaaguugcacugucuauagauaauagaaacuggaccugagggaugaguuugggaggcacaagaaggauuugagguucaccgugccgccgagguggucaaaagaacauucugguuaguugagauuuuaguuugcuguguucuuugaccacauuuauacgcacugaugacuugcuauguuagugcuuggccuaaagaaacauaccuuugagguagauacagugcacauuuguguacauuuguuaugugggaggcuaagucaaggucaccgggauucaggacuugaugaccagccucuuuuuuuuuuacagugccuuuguuucuuuguuuuaauaauaauaccauuucuuucuuucuuucuccuaguuuucuuucaacauguuugaccacccgauuccccgggucuuccagaaccgcuucuccacgcaguaccgcugcuucuccguguccaugcuagcagggccuaaugacaggucagauguggagaaaggagggaagaguaugugccuguuuuuauuuugaauaguaaccuuuccugcccuaaacucuaugagcccuguagccuucuauagcccuuaguuugcaugugggcaccagacacuaacauuauaguaaaaaugucacuguccuaaggcauggguggugggaguagggugcuaauuauguuuguugacuaaaugccauucagagcacaaaaauaaauuacuucaaguaagauucuuuaugaaaagucguuaugaaauucuggcuagccccaaaccacuguuuaaagcuuuuaaaagaugcaucagaaaguauacaucuugccuuuggucuacccuuuuguuuuuauuuacuuaauauuccugaaauauucuuuucacaguaauuaugccacccucagcccucgaucaacucaguaaguacuuucuauauaaguacgggaagccagaaaugggcaugggcuuuucauuguccucagagucuguguaacauuugucaggaugugguuagaauccucuuuggagggugugcuggccuagaaggaccaggggcaaguaccuuagaugaggcaaagcauggcucugcuucccacugcaagggugcuauaagcacccacucaguaaaggguacucuuuucucuuucuucucaccucagccccuuccccagugccuggcuugucucaagaacuugucuagauacaaaggaacagcacuuuguauagugcuugaguaguucauacuguggugugggcucacuagguugucuuccuaaaggggaaaaaaagcuugaucuccaagagaacugcaugacccagaucucccaaaccugaguuuuucacuuccaguguggcauuguauccugaggaagccagagguugaacugccacuuucucuuccugugccagauaaagccguugugagaaaagccccaggcuugcucucucucggauuaugaacagcccugauuguggacacaaucuuugcuuuggaaacuugaagaucuucccauacugaauucauccugugggucuuuggucuugcuuuuggggugagcuggccaaggagcccaggugugucccuuagcaaaguguccagaaagauacuuuggaauggaaucagugggauuuagaccagaucagagcaacauucagaccuuucuuuguuugcuuuugcuguacuaaggguugcaugcuaguugaguguuuauucacugaguagacccuucagcccuuuaaagcccuuuuucuuccuucacacugggucucacccaacuuaacuaggaugaccuugaacuuaaaaucuuccugccuugacuuucugaguuacaggugugccaccuugcucagcuguugaggccuguuaagugguggaaaaaacccacuguaaccaaguaagaccaagggagucuugauuugugagaugcagguuauugcucaggcuguagcaauuaagugucucagaggacuggggagcucgaagucaggcucucccaucagucaguggcugaagggugcuagaguuuccuuuaauuuccucugccucagaucuuugguggagccuggucugcagcacccagacucugggucaacuuguagcuuccaugguuggagcuguuuuagugacaaagaacauaaaccuaauuccuuggcccugggccacuugucucagucacccuuguccuggcaagaucaccuccauucuacagugaggcaguuuucuaggcugcuuuggagcuucccacccaagcucuucccugauugacuuuauucauucaacauuuacagagaggccagaagucuucucugccuccugauacuaagugaacuuuucuugccagaugugguggcaagccucugagguagaggccauuuagggcuaugaagugagucuuggugugugcuuaaccugacaagcugcagucuacugacaaguggcagaguucugacuucugcacacuaaguauggaucccagcacgaccacuccugagcgugcucauugagggcauguuacuuuauccacaugccucaguuucuccaacaaacuaaaaagggaggaaugauagugccuucauuauucugggaagauuaaacaauugcccaggacauagcaaacaccacugagaaccucacagcacuuuccuauugcccuggucuccuggccuuuucugguuucguguggccaggcccuccucucucugcccuugugccuuugagucagcauuccacuagucccguugcuggcuccugcccucugugcagccauuaacucauagaccauuggaauucagaaacaugccauguuguggccuucugagcuagggcugcccacuggccugguacuugucucuguuccauguguucucauagugucucccuuccugacuuacucucacaccugaucccagccaucuugccuaauuacuggucauuccuugaacuggcugaauucucauccauuccuuugcuuagcugucccucuuccuggauugugugucugguagcugaccuggaaaacugugucuuuagggcuuggaaagucuauucccuggucuuucucccuuaccaccccuuugcuucccuggugccugcaguguguacugguucacaaucucaccucucuacaugaaaaccuuuaaaggaacagauuuuuuuuuuuuuuuugugacacaugguugacacuuaaguuauugaugaauaaaugaacacguuacuuuuaagaaucaugauuucaaaaaaucauguuuacgcuggugcuacaugacuaagucaccaagcuccucuagggccacaugguguguucuugcagugauaccccucugacuagaacaguaggggaaugugggaguaggcucugaaguuuaggccacaggagggcauuggguggaugggguuuccuucacaggaacuggugguaggugugguacuugcuuguguguuauaacaucuuuguucuuaggccggcucaacauuaccuauccuaugcuguuuaaauugaccaauaagaauucagaucggaugacacacugcgguguacuggaguuuguugcugaugaaggcaucuguuaccucccccacugggugaguugagcugugaaggucugccccuuuuccaugugugugcaugccugagcauccuuucaaguagaagaucucaguaagaggaagacaucuucagcagugcgcugugccacaggucaagcugaugugaagggugggugucauuccagaccugggugccucaucaagggcuccucagaagggcuggcagagguacuuaacauuucggggaggaugcugagguggcaagcauucuguagugugguuuggagaccguagcacccuugcuucccgucucucucuccuuucaguccuagcccaguugacaagcucagcuuuaggaagccuucauggggaagcauguauccuggucuuugugcuuuaauggugucagguauccugaaaggccccuggcaggcuguggauggggcugaggacacagaaguacuuugucugcuauucuuggaggccccacugccaccagaacaguguucugagguucaguccccacccgcuugcucaucgcagugaccagcacauuucaaaggaguagcuuuuccuuuuuacaacuacaugugauucaaguacuaaagaguguuucuuucuugucauugccaccccuuccagcugggccccaaggugcuugaugagccauggccaugucuuccccaacaggaguccugcuuggauuugcaccuccuacuucuaggcuuuucuuuguugccugucuccuugcccugacuugcugugggacuuuuuacuaaagcugggaucugacuuguuuaucacuuauacucaucacuuacuguccugugucuaccccugcauaaggcagcaucuuguuguagcagcaggccuggccacuggagcugcaguggauggugaaggguagggcagugacucuuucagcacuucucuuccuacaguggcccuauggcucaccuauugagaugaaaguugacguagacaacgcugagcucugaaaacucucccuuuaaaucccuggugugcaguuaauagcuacagagucuuugacaccuuuagccugagaagcuaucugcauuucuuucucugagaugccacauggcacuuaggaagccuguggggaugugagauuauuuuucccagccuuuuugggcuggcuuuccagcaugagcaggcauuugccuacugucgcccagcuucuauuucaggugacaaggggcauguacacagauuaucucacuuggcugcucagugggcuucacccagccuaagcuaccaaguuucagggagaaccaggcugcagcaagugcuggccugcuguucgaaccucgucuguugacccaagcuuauuggagugccaucaggccugggccugccaugcugucugcaucaaagugcccacgaaugggcuagggaggguguacuuucaggucuucuugcuuccuuguuguccucaagucauuucagaagucuguuccccagggcuuggucuggcccuuuuuccugcuuuguacugucugugguucuuuccugcuucugucuggggaagcuguaggcuucacucgggccugcaaccguccuuguguucuauguguuccagagccucaugcaacaguuaccuuccuccuaacugaccacuuuauacugcuuuggucuguaccaggcugguauugacccuugggaaacuugugcuuagggucacagaucccucacuugccaaaaccuuagcagccuauuguggcauuuggaggaguggcuaucuuccauuuuugucauucccacccuuuuagcacagugugcuggauggagccuccguagucuguggcugccccauucuuuagaugagcaccuuccuacuugcaccauagcccucuguccuugcuucuuuguaauguucucaacgggauuugcauccuaaggacaugcuugggguagccuagcauaggaggggcuagcauugggugucugucuuauuaaggguuuaacugcugugaacagacacuaugaccaaggcaagucuuguaaggacaguauuuaauuggggcuggcuuacagguuuagagguucagucuauuaucaucaaggugggagcaugccagcaucuagggaggcaugguacaggagaagcugagaguucuacaucuuugucugaaggcugccagcagaauaauggcuuccaggcagccaagaugaugguuuuaaagcccacacccacagugacacaccuacuccaacagagccacaccuucuaauagugccacucccugggccaagcauauacaaaccaucauagaccgggaaagauaaaaguggguagagagguguuaaggaaggccaauggaaauucacucuucaguucuuucuacuuaugcauuuauguauucaacuuauuuuuuaaauuaucaaaaaauccauucugagaccuguaaccuaucccucuuuccugacccauagcucucugccucugacuuaagacuucugguacuacaguggccugguuuccuacaugcuagauuuccccagccuuuguucaucucucucuguuccucuccucagucauuaucugucuuacugggcaguuaaucagugcacuaguauuaguguuuuuaugauccuuaguagcagacaugucuggggccuuccaugacuagcuuuuccuugugugaucuuucuauuguaaguguggucuugauugcuucagggccaugaaaacugccuguggggcagcuuuggagcugggagguaagcauuguguacaguaggcuggaaacugauggccugucaggugcccuuggcagacaggucacaacucagucuaaguugaaucccuuacuugaccagcuucccaugugcaucccucacuugguuuucuucucuggcauagcuccauggcauagcuccauggcacuuuuaauuugcuuguuucaagucuucauccugggcccuucuacccaaauaagacuuagaccccgucaguguacuaacuggcagauguucaccauguaggcuuguugauuuucaggaguuucaugcugauuucuuuuccucagaugaugcagaauuugcuguuggaggaagggggccugguucagguggaaagugucaaccuccaaguggcgaccuacucuaaguuccagccucagagcccagacuuccuggauauuaccaacccuaaagcgguguauccuuuggacauaagaguuccucugcaaagaagggcuucuugcuugucacugaacaucauggggaaacacacaucuguuucugauugaagucaugauugcuaguacugucacuuggcuaguacgaguccucuggguccugaccaagccuucgccaggcacuugcagauacuuguuagauuccagagcagagccuucuuuuaguuucauggcuaccuagcacaaagacugaaauacgcagucuauccagugggaaggcaucguggcucaucuaucuccagcccucuguggagcccuuggcucugguucaacaugaaccaggugaucaagcccacuuugugcucagacuuaggacccauucaaaauaagacaauaaagguuugcugaguacauuuucugauuuuuagcaagggggaaggaaaagguuuauguuuuuguucuaaugauuuuuuuuucuuuuauguucgccucucagguuaagcuggguauguguauuuauaaaugugaccugugugagugagggacauccuuugugucaagaugugcauaguaagacuuugaagaaaaacagaacaaaaaucgcaaacagcaacauggacaaguagaacauuugaaagcaaacauacugacagaacccgcuuuuacuucucuugacaccugccaccucucuccacucacugucagaagcaggcuguugugccaagggucaaauccuggaugccagugagccugcugcugucuggguccuagacaaaggggcauguuggauacuugucuccacaguguagauagugguagagguguccuguccaacagacaggggacaucugugugaagagcuacuuaauuuguccaucagaaugaacuacaauguuuugcugucaguguaggaugggucuugucuucaucgucaccuuuuaggaucuuugugguuuccuauauuauaauguagauuuaugaaauugcuuccaggagcuuuuuaaaagauuuuuaaaagaaucuuauggguaugucuguguggauguuugugcauacagguacucaaggaggccagaaaaggccauuagauucccuagggcuuguguuauaggugguuguaaaccauguaauauggaugcugggaaugaaacauugauccucugaaagaguaguacacacucuuaaccauugggccaucucuccagccccuguucuaucuuuuaaauuauguguauguguguggauaugugcuugugggucuaggugccuuuggaggccaaaagaguguaucagauacccuaguuacugguaauuguaaucugucagugugggugcugggaaccaaucuugggucuucuccaagagcuguauucacucuuaacagccgagcucucucuccugggaggcuuuuucucuuuguuaucaugggaaauaggguaucccuuugguuaacuguuguuccuggguauaacugauaagguaaaggcagucucaguguacauaaugguuaguuuuuauuuucagcuugacuguuagaaucauacaguagacauauauaggcuuguuugugaguauuuuuuaaaaagaagacucacuugaguguggggagccccaucaugugaucugggucccaggcugacuaaagggagaagguagggaagccaauugagagcuuucauucccuuuucucggcuuuuugauccacccaggugugaauagacacccaccaccacagccacaagccuuuccugccugcaugcccuuuccuuucaugauaaacuguuuuagggcacacugaacccaaauaaauccuuccuaauguugcuuuugguugaauauuuuguuucagggaugagaaaaggaacaaagacaguguagagcagaagccuguggaguaccauagcauuugccagggccugccaaagaaauucuaggagccagucccgcucaucugagucagcucuuccaucuguucgauggaagaguuuuccuucuagagucacuggaaguaguaauccauuguguaauugaaggcaugcagcuuguccuguuaccuugacaacuuguaugcagauuagaaaaugcauugagaaacuucgccugucugacgacuggagaugugauugcuaucaacuacaaugagaaggugggugagccuggcuaccuuaccuguuaaagacuguucugcuacugugccuguuuaccagagagagggaacgacagagcuaagaaaugauuccaucuaaguguuuuagugaugcaaagaauucauugggguggauacaggagcaugggugagccaggaugugacuuguagaagcugcaucaguggaguuccuguacagggcagggguagccucuugagccugcugacuuucuucuggucuuggugggcaccaggagugccugugguacacauguauacacgcggggggcaaaauguucagaaaaaaaucuucccuuccuuccucccucccucccucccucucucucucucucuuucuuucuuucuuucuuccugccccccucucuuucuuucauuuguuuuuuauguguuaaaaaugucuuugcuggcugacccuggugguacauauuuguaaucuuaccaccuaggagaugguuguggggucaagguuucaugagaguccccacacccuccacaagagaauguuugaauccacaaugaagagucauuguccauucuaguauugaaugagguguucugaaaguggcuuuuaucaccuaauugcuuccugcuguuuguuuuuuuaaauuuuccugguucacauuuaaagcccuaauucacucaauauugauaguuauauauaaugucuauauugggccaucucccuagccuuucauggugguuaauuugauuacuauuugaugggauuuagaaacucaauagaaucaagacccuucccagcauggcaaggggcuugacuuagauaaaaggacagaaaacccuuuggcagggagaggagaguaggagccugcuuugugguccagaccaaccuugaaccuacgacccugcugcuggucaucagcuggcacuuuaccuuaccagggagccucugccauuuuauuuuauuauuugcuucuggagugcuggggauugaaccuagggccuugcaaacacuguacgaaugcucuacagucaagcuguagggcuggugaggugcagguaaagaugcugguccugugagccuaguaaucugaguuugauccuggagcccaaagguaggaggaaagagccaaccucugaccuccacguggacacuguugccgaugcauguugguauauaggugucagugugugaaacaacugagcuagcucuguauaaucuuagccuaacuuuucuuuucuuuucucuucccuuuucuuuuuucugucuuuuucucucccccccccucccuccuucccucccaucuccuacccucccucucaaauuuaagcaguacaauucauuuaucauuuugggaggauagacuuagcauuauuggugugagcguucuuacucuugucuccuuaaacaccuagccaauucuuuucuuagaauaaacuagauugcgauuuuagauacuagaauuuauuuagaauguauaauaauauuagaauauuagauuuuacuuguugacuaaauuagauaugaauagcuagaccagaauagucuugcaguauggugcuaauuagcuuguggaauuagaucaacauguggggacaaguaccuuuugaucugaccugaagcagcauugucagugcuggaagguuugaugcuggugugaugcugcccguguugccagcccuuacuacuucauuuuccuguucuuuuugcagaucuaugagcugcgggugauggagaccaaaccugacaaggcuguauccauuauugaaugugacaugaaugugaguaacuuuccauuauaagugaggucagaacccaugagugugucacacaaggggaagaggaggaaaaugccaucagaauaggaggagauggccauucaccuaguauucccuccuagggaauagaaguggcaguugacuguacuuaaagugguuggauccacagucaccucaggccugucaaagacugaauguuacaguauuaagagcuaagugaaaacaaauuauugacaggacucaugguugucaaggaaaaagaaagguugcacugucuccugucuccguucauuuacauugauaucuaagguuucagacuuuagaaagggaagagagauuaauaguugccaggaacauguguguuguuguaguauuaucaguaccuucucugggguaauggguacacacacuuccauggugauaugguuauauuuaacuauagacacacacacacacacacacacagagagagagagagagagagagagagagagagagagagagagagagagagagagagagagcgagagcgcucccaacaauagccgugugucuauaauguguucaugucauuguagugauguugagcaguguaaagcacuauuguugggacaacuggacucucaagcuguuguauugguuauuuaaagaggcagaguggcugcgucucagaaguuaaccuuuauuuucaaaacccagguggauuuugaugcucccuugggauacaaagaaccagaaagaccagugcagcaugaggagucaauaguaagucauuuccuugagcuccuccugauauuuuuguaccugugcuucuuuuguuuguuuuaauuacauuuaaacauguugugugcgguuggagguguguguacugugcauggguauggaggucagaggacaacuuuugggaguuguuucucuuuccaccauuggauaccaaggauugcacucaggucuucaggcuugggggcaaguauuuuuaccuggugagcugacuuacuggucaguucauguauuuuuuuguguggacucugcaggggcuagcugggccaugguccuugcuccuaggaggaggcuugccuccugugaggauaguguguucuggcugauggagacgggcaacuguagaaacaaggggcuccgaggaaaacugaccacccauuccaagaagcucauguccuguuucuuuuuuuuccccuguuaggagggagaagcugaccacaguggcuaugccggagaggugggcuuccgugugaguaccaggcacugcgugucucucugcauccugaugccagcaacuauucuuagugaugauuuaugagcacuucuggaagaucagccagugcucuuaacucuugagcuaucucgccagccuucgaaccuuuuaauauguacuuuuuccuggaaccuugacaacccugaaaggcuuccaacuucuauuguuucuuucaaaacuuaugccuaucauaggacuuggauauggucucuagguguguguggggugucuacuaaaaagucaaauuaguauaaugaauacgacacuuccuuuaggcucaacaguuguuagcacauuugcuuuaccucugaaaacacacccugcuuuuauuugccuacacuauuugaagguaaguagcauguuugcuaaccaggcucccuggugagcaggcagaaguggcucgugcaggugcugagaagcugggaagcagaagaggaaggaugacuagcgguguggggaggggggccuggcaaguguuugcaacagagaucagcuaucacugcugcugccuguuuagagaguucuugggcuuccugcggucccuugaggggcugguugaggugccuuggcugucagcacucagagggccuggcagugcaccaacucccuccucuucuggggucucuacacagagguccaggguugcucgcucuugggguugagcaugcgcccucuuggcuuccuuuccuaggccuucucugguucugggaauagacuggaugggaagaaaaaagggguugagcccagucccuccccaaucaagccuggagacaucaaaagguaggucuguccuagcuugucccugaugaguauuugccauuuacuaagaaagguuugacacaugacaugggcuuugugucaaagcauaggacgcaguagagccucauuccaguguuggagacaaaccagcagcuacugaauaggcucacguucucacucgcucucugacacugguagagcacaaugguaucuguccagggauucacgguggacucucuuuugguggcuaccugguaggaguggggauguguuaguugucuaugugugaccaggaagagaacaggagauaggaugcauuggagcacuuucagaaggagucuaaggcuaggccaguacccacaguuccuaccccaugaccaguguuuuuacuuuguguucccuccuagcagguacauagagggcaaagcaguguauaccagacaauuaucaaaaaggcacugcugucucuuccuaccuuccucuugauugucagaagcaaaucuuaguccuccuuggaacuaaccuuucuccuugucuguaauuuucacagaggaauuccuaauuacgaauuuaagcuugguaagaucacuuucaucagaaauucacguccauuggucaaaaagguugaagagguaaguuaauuucauuggucauaggauuuacuuacuagugaugacuaguguuucuaccauucaaaauaugaugcuucugugauauuuaugccccuucuuguggcccugcuguuccuaaugggcugauuacucuguagaaccauugcaggucuauugacuaaggucuggcaaugcaggggucaagaacagacuccagguucugccacaaaaaaauaaucuggagccccagguggguuucaucuucucuuugcuuacuguuuguuucagaaugggaaguugaacccaggacuucacacaugcuuaacuauacucuugcuuaucacuguucuuucuaaccuagaacuagaccuuaccauuucuauacagugacuccuaaguaaguggcauggcuguaagauagggacaguauggcuaagaguccugcagagacgaaugcuuugaacaggcccagcugacucugguuggacaugauaccugggaauaggugcauaugcucauaggaaaccagauugaccaaaaucaagacauugaggguuaauaugaacacagucaugaagguucaggccucugcuacagcccugauaccacucaacaguggugacuaacaugauacuggcucuuggagucaaugccaagucaggugccaaguaccucugugugcuucuuaaguaacaucucauugcugagauguaccugugagcuucaugcugugauugcauuuguacagagccagagccccugaccaccucacacaugauaucuauugcucuccauuuagaaagugagcuucagcugaguggugguggcccacgccuuuaaucccagcacuugggagccagaggcaggcuaauuucugaguuugaggccugccuggucuacagagugaguuccaggacagccaggacuacacagagaaacccugucucgaaaaaacaaaacaaacaaacaaacaaacaaaaaaaaaccccagaaugcuagaaagugaccuucacaaagacaucgggacagcaagcuucuaugaccaacauguuccugucacugggcaugggagucaggggagcugccuuagaagcagaagggaacuuaguccaagguguuaggcauuaguuauaaguuacucauccugcugcagauugcauucugcacagcagcugugucuggaaugcagccacccaagugugacauguauuucuagaauacauauguuagacccuaggcuuuccugguucauuucuuagaggcucgcacuuagcugggcauagagcauaacuguaaucucagugauugggaaguugaagcaagaggauccaggagcucagagucaggcuuugcuaaaugagaacuaucuuaaaagaagacaagaaaggaagaaaagaagagaaggaaggaagggagggagggaggaaggaaggaaggaaggaaggaaggaaggaaggaaaggaaggaaggaagaaaggaagguagguugaucggucggucgguccccuugaggggucucaauagggcagagaucagcugugcugugagacuguguaagcugggcugcuggaucauugccagacacucuugacuacugaacuuauuccgcucuaguauucuggguggccugagacaaagaccagggugcuucccggcccaacugcaaucucuuggcaccuuuaaugucccuuaggcugacacaguguuguaaguuuuccaggcuuggaguagaugucaguagacuuuuaacaucuccaugaaaccuuccuacauccuuuaucagauacaguucagcuuucaucgugcucauacuccagugugacuuacagacaggagaauaggcuggcagccucagcaggauuuguuuuauccacaaauauuuagguauaugaaauuuaaaacauagcuuuacucuaucuucaaagccacuacgguuuuggugaaagguaaugggauaauaaguuuggaagaggaggcaaguuuagcaaggacuugacaaaaggacaagcagaaccugcuuuuaauuagccauagacagcuacagccuaagccuggccugggaaaagccaagaggcaguuugguguagaucccagaguucgaggucaccugaaacuggauuccaaggaugauuuggcgggaauggccccucccccuucuucauaacccagugucuuggaauaguaaaauugaaccuuggucagacugaaaaaaaaaaaaaaaaagaucccagaguucucagaaggcaccuuuggaaaugacagaauaccuauuacaauguguuuagagccucagcaccuuucccacacuauauugugccucugcaaccccaggaaaaaggccucauggaaggucccaagccuaggaccacacuuuauuaucacacuagauaauaaagucuguuguagccuuugguaauuggcugcuauuugaccucagacaguagcagccaggcuugcuuauugcucuugaagaucagagcuuacacaagaaagaaggccuaaauauacuguuaaacagcaggauuucuaaggaguguucccuucuaguaaagauacagaaaacucauaggucugagcuagaggugaagcucagcucuagauagaguacuuggucagcauggccugauguccauuccuaacacuaaggugaaaugagaugaaagaauauaugcaaguacugcagauugugaaaagccaggcaugguaguguguaucuauagccccugcacucggagacugaagcaguaggguggcuugagcuuaggaauucaagagcagucugggcaacauagaaagacuucauugcaaaaacaaaugaaugaaugagugaaugaaugaaugaaugaaugaaugaauggaagaaaggggaaagaauugugcaaguaacuucucuaaguugaaguccauuaguuagcagauuagacagugcuacugaguucgaacaauggauaaaaauaggucuagguugaagcaggaaaaagaucuaggaaggucagaggucuuacuauaguuagagacaucaucuuuuaaugaaauaauuuuauggcaguuucugcaacauccuuuuucauuuagcuccugaguaacagcacaaagacaucaaaauuuauuaacaaguuacaaaccuaaucugggaagguucugagaugaguacaaucuggcuaggcuauuaauaaccagauaaaugcccuauuauuugccagcugagucuugcuuuguuucauguauguccucaauuugagcuugcuuuggucauguccucauggcccauccugccucguggcccauccugccucauggggaccuccuuccucccuugccuuuuuccuucuccuugugggcuuuaccugagaucccauacuccaucucaagacucacguuucucuccugcccaguaacaggcucuagccuuuuauuguccaaucagagauuacuagggagcguucuuuacagcacauuggucaauacaacguccauguccagacuacaaccugaucuuggggcacagaacucagcaucugaaugcacagcacacaagaccaaccucaacaaucuuuggaugcacacacaggaacuggguaguagaacagugucucagaaucugauaagggccuaaaaagauaguugagugguuaagagcauguguucuugcagaggaccuggguuuauuucccaacccacaugaugguuuacaaccacucuugacucuaguuccagagaaccuucuauagaggcaccagacacauacucaguacauauacauaggcaaaauauacaaaugagcaaaaaaaaaaauuuuuuuuuuuaaguucugaaaggacauagaggaaggacuaaugauucugggaagagagucaucauguucauuuauacagccacuacuaagccuaccaguuuccauuagauagcuccaaacccauguucacacagauauccugguuaaauccagucagucuccaaauagaacagacagaaauaggaagguuuguagggacgaggggcuguagaggcagcugggaaggagauaagagaaagugagagaugagagccaucuaugugcuacauacauauaugaacuugacaacacauuugauuuaagguuuucaugggaagccaagcaugguagcacauuguaacucuaacacuugggaggcuacagcaggauuguggguuugaagccucuucaggcugcuuaaaaugauucuuucaacaaagcaagacaaaaauucuaagaggaaaaauuuccagccuaaaauuuuguacccaacucuuucugggcuaaacuuuguccacucagaauuucuaucuguccucauaaugugacuguuuggacauagggcccuuuacaagguauaauuaaggggaaaugggguccuaauccaaucuaaucuauuuucuaauuuucacaggaaagggaaauguaaccauguagaggaaaggccaggcacaggcagaaaagggccauuuuucaagccagaggggucugaagacaccuuggucucagcuucucaucuccagaaugcucauaaauuaaugugcuauuuuagccacuaagucuauggugacugacauggcagcucuaccaggcuggcucacuagcugagcuaccaucagguucaaccagguucagaacaaaaguauuuucugacauguaagcccucaaaacaaagacaccuuugagaagcuuuucuugggacgcuacuuaacuauuaccauuuuauaauuuauaaaguacaagauagaccuaacgcccaguccaucauuuuugucaauaaaauggaagacugucaucuauccuaacuuaaaagacauucuacaguauaccucacugaagaaaggaaguagaaauagcuagagccaguggcaacucgcacugccucccagcacugaugggagccagucugggcucucggucaagaaaauggcaaguccuagcuugagauauacguucaaacagacgaaauuggucaagucuugugcucagauggauggaagagagagaaguaggacagacagaaggcuguguggcagaggccugcauucuagagcucacauaggcucugcacuucggcgcuuggcacagaagcauggaaugaccucagggugcagcaggugugacgauguguuuuagaagcugcgacuaucuuaggaaaccaagagguaacgucgcagauacugagcaguuaaaagcaugucggguaaaaccuacuguuuuuguaguguuaaagaaacaaaucugcucaugaaagaauugauugugaguguuccuaacgcugaucggaauauacaaaggguuuuguuuguuuguuuguuuguuuguuuuuaagugcaucuuuuaagcuaggaauucccuucuagaaauaaaaaaagacaaaacaaaacaaaaucagagcugugugcagacagugagccacuaaccucugcagugccaaccaggaaguaagagaauuuagauuagaaacucacagguuugagauuuaggaguuaaguaaacacgugcagaaaagugaguggaaacacuccuauuuuggguuguugcaguugagagugacuuuuuuccuuggagcauugugcuuacuuuugaaucaguugcuguggggcuggagccuuggcaaagcucugagagcacugacaucuucugagaguacugacaugguggcucaaaauccucugcaacuucaguccuaggggcaaucuggggcccccuucugcauauuuuacacagauguaugcugacaaaacaccuguacacgcaaaaauuuagaaauacaaagcgauuauuguguaaaagguucccaagcuaucaugguucaauuuaggauuuucaacuuucuagugauaugauagugauagauguucaauagaaauugugcuuagaguuuugaauuuugguuauuuccuaggcuaauggguagugggauccuuucugaguguuagauggcagcacggagccacaggcucccuucccucauauggucacaagggggagacuaccagaacacugccgugugguuuguaauugaguugggguauuuggaagggagguguaugaaaugucuuuccaacuuaaugauaacuucagcugaaaauggcuucuuaagacauaacugccuccauaaguuguggagagguuguacaguaaaucuaaacacaaagguggugguggacucacacagcuaucaucugugggguucucaaugccauaaaugcagggacauuugaugcuuauuuuauuuauguguguguguuugcccugugugugcaggugcccuggcagccccgaagagggagucagaucccuuggaguuggaggcaauugugagcugcccagcaugggugcuggagacugaacuggguccucugaaagagcagcacacacuuuuaaccccugaggcaucucuucagccccccccagggcacuucuuauuaugauuaaugaaguggggaaaguagauggauggcacacaaguccauggaauaaagugguuauuguaaacuuugaggaguuucugaaaauaauauccuauuuucauaccuaggaugaagcuggaggcagauucauugcuuucucuggagaaggacagucacugcguaagaagggaagaaagcccuaagucuaaaacuguuggcugacuggaaaauaaaagauccgauugcaccuggcuuacaguuacuggcucugacaaguucagagauacucuguuauuuaugguuuguuuaaaguuaccugagaacuaucaagcuuguccuggauacaaagcagcagaacuuggagguugugugcuugaucugggggagagagcgcugggguccucuaggugguggccuccuccacucccuaacuccagcuucagggcccucacagccucagcagagcagcucccgauuccugacucacucuucuuccccaugucuguucauggugcagugucuuuagcccaucauggcuacucaggccagcacuugaguaccagacaaagauggccucuguuuuuauuuacagugacucagaagggaucucauccagaugaaagcgcucucauuuuaaucugcucgcucucagugaauuccaugaugaagccagauaugaaaggcagaaugaauacaugcuugaguaacgugcccccguuacauuuauuuuuuauuauuauuuuuauuuauuuuuguggcuuuucaagacagaguucccuggcuguccuggaacucacuuuguagacuaggcuggccuugaacucaaaaauccaccugccucugccucccaagugcugggauuaaaggugugcgccaccacugcccgcccuccgcuacauuuauuacccaagguucugaugguuugucuguuuuucaagugcuaggauugaaccagaaccucgugaauauuaagcaugccacacacucugccacugaggcucccccauaccccauuuucuuacuguuuuauugucuucagaucugcacuuuguaugauguaaggucuuuugacaugcugauccagcuauuuaaaauuuguucccugagaauaauucuuauugaagaauuaaauaaacugauuaaaacucgccucua

SEQ ID NO: 8148 - RNA, 1925 nt, Mus musculus
ugugacacaugguugacacuuaaguuauugaugaauaaaugaacacguuacuuuuaagaaucaugauuucaaaaaaucauguuuacgcuggugcuacaugacuaagucaccaagcuccucuagggccacaugguguguucuugcagugauaccccucugacuagaacaguaggggaaugugggaguaggcucugaaguuuaggccacaggagggcauuggguggaugggguuuccuucacaggaacuggugguaggugugguacuugcuuguguguuauaacaucuuuguucuuaggccggcucaacauuaccuauccuaugcuguuuaaauugaccaauaagaauucagaucggaugacacacugcgguguacuggaguuuguugcugaugaaggcaucuguuaccucccccacugggugaguugagcugugaaggucugccccuuuuccaugugugugcaugccugagcauccuuucaaguagaagaucucaguaagaggaagacaucuucagcagugcgcugugccacaggucaagcugaugugaagggugggugucauuccagaccugggugccucaucaagggcuccucagaagggcuggcagagguacuuaacauuucggggaggaugcugagguggcaagcauucuguagugugguuuggagaccguagcacccuugcuucccgucucucucuccuuucaguccuagcccaguugacaagcucagcuuuaggaagccuucauggggaagcauguauccuggucuuugugcuuuaauggugucagguauccugaaaggccccuggcaggcuguggauggggcugaggacacagaaguacuuugucugcuauucuuggaggccccacugccaccagaacaguguucugagguucaguccccacccgcuugcucaucgcagugaccagcacauuucaaaggaguagcuuuuccuuuuuacaacuacaugugauucaaguacuaaagaguguuucuuucuugucauugccaccccuuccagcugggccccaaggugcuugaugagccauggccaugucuuccccaacaggaguccugcuuggauuugcaccuccuacuucuaggcuuuucuuuguugccugucuccuugcccugacuugcugugggacuuuuuacuaaagcugggaucugacuuguuuaucacuuauacucaucacuuacuguccugugucuaccccugcauaaggcagcaucuuguuguagcagcaggccuggccacuggagcugcaguggauggugaaggguagggcagugacucuuucagcacuucucuuccuacaguggcccuauggcucaccuauugagaugaaaguugacguagacaacgcugagcucugaaaacucucccuuuaaaucccuggugugcaguuaauagcuacagagucuuugacaccuuuagccugagaagcuaucugcauuucuuucucugagaugccacauggcacuuaggaagccuguggggaugugagauuauuuuucccagccuuuuugggcuggcuuuccagcaugagcaggcauuugccuacugucgcccagcuucuauuucaggugacaaggggcauguacacagauuaucucacuuggcugcucagugggcuucacccagccuaagcuaccaaguuucagggagaaccaggcugcagcaagugcuggccugcuguucgaaccucgucuguugacccaagcuuauuggagugccaucaggccugggccugccaugcugucugcaucaaagugcccacgaaugggcuagggaggguguacuuucaggucuucuugcuuccuuguuguccucaagucauuucagaagucuguuccccagggcuuggucuggcccuuuuuccugcuuuguacugucugugguucuuuccugcuucugucug

SEQ ID NO: 8149 - RNA, 5132 nt, Mus musculus
auacuuuugauuacccuuuauuuguugauuacaauaaaugacagccgggcaugguggcgaaugccuuuauucccagcacuugggaggcagaggcaggugaauuuccgaguucgaggccagccuggucuacagagugaguuccaggacagccaggacuacacagagaaacccugacuugaaaaaaacaaaacaaaagacagauacucuugauuacccuuuauuuguuccuaggaugacucacuugucuguggaaaguagacuuuagaucucuacuccagacuccuagggccagcauguucccaggacagcaguuuucagucucuuaucuuuugaauucuacuuguguguacaccuuggugauaucauuguaccugccuucaggggccugguaguuagagauaggugguguguaauguggcccuucuuucucgaaggggaauaggcugguaucccgcuuuauggccucggcauagagcucugcagauucaaguuucagcuccuccagggcuuccugcugggcuucuagcauggaucugauggcgucccucuccaucucaugcuccugcugcuuaaacagugcccaccucuucagcagaagagcucuccguucacucuccucaggugaaugcuccuccugaggucgcugucugugaacaaacacauagagcaaacaugggaggccaaagaguacugacacuauugcagagggacccuugugacugcacaugacuuaagugcccuacuaccagcacggccaggcauaaccagggcucaggaaaauaguaaauuugaggauauauuaagaauguaaugucagggcuggggggaggauucagagguuaagagcauuuacuguucuuagacaccagaauuucuucuuagcacuagaauuauguggcucaaaacugcuuauaacucaagccaagagcaucugcugccuguaaggguacuugcauucauaugaacauacucccaacacacaauuacauauuacaaaaaaaaagaaaaaaaaaaaaccgcucagcauagaacauggcagcagcugcuuuccuccggcagaaggagccugcuugccugcuuggagagaacuauacuguuucugccccaggcaaauuauccuuuuggugagcuggggguacaguagaaaaaugaaacaaacaccaacuagagacaagagcuuguuuaguccuagaacacuagaaaaacacuggugcuucccaacuuguacgguuuuauaaacugugcacuuuugauaggaugagggcuacagagcuagggucuaugucaagggucagagccaaggcucauggaaauaaauaacacgaacccuggagcaaagcugaucuaaacucccugagaaucuccccccaaaauccccaaaagcacaaucaaaaugaaaaggauucaggucagggccaagucaaaccuacucacuuguuccuaccacagacaugaacuucaguuagaacuacuugaggaacuccuuugcauuaaagaugucucccagaggagaacucuuaccuugauuuauccaagaaccucacagggguaauaaaaucuucaauaggaaucaguucuugggaggcuuuuuccaguuuucggauccucuuuuucaagcgauccuuugcugcuugauccuuucuggggucuaccuucuucuucuuccgcagagguucugcucuaguggguacaagcacucaaccucaggacggauaggaugcuaaauaaaguaucucauacuugugcuauaugcuaacaagaaagcuguccgcagcccuaacuccacgagcuuaguccacugucuucccgaggacgguauggguccuaucaauuccaggaaggacagggaucuacuaagaggaacuguugauucuuucuuuuuguuggugggguggggugggugguucugagacaggguuucucuguagcccuggcuguccugaacucacucuguagaccaggcuggccuugucaaacugucucugccucccaaguguugauauuaaaggggugugcaaccacugcccaacuuuuuuuuuuuuuuuaacuuuuauucuuacacaguccuagcuugccuuuaacuggcuauguugucaaggauguccuugaacucugauccuacugucucuaccuccagacuuccagccuaguuauuuucuacuacucccaguauucuggugcuggggauuaacuuaaggcuuugugcaugcuaggcaaggauccaauaaaccaagcuacauucuuagcuuggaagugccagucugugauucagguguaucuuaaagcugcccugagaagugaacgugcugaacuaagggaguaaaagcucauucacauuugaaaugaauuugugauuuacaaaaugcuucaagacuaaaagagacaggacaguaaaaaugacugccagauuuuuuuuuuuuuaaaucaguuucugggguguugagagggcuccgugguuaagaacacuugcugcucuugccgaggaucuagguuuuguucccagcacucacauggcagcuuacaaccaucauugauucugguuccaagggaucugggacccucuucuggccuuugugggcaccaugcauguagacauaacacauuacaaaauuagccauguccuaaagcuuuggcaaguaucugauuuacuuuuaggaacacacuucccaggcuaaauguggcauuaggaauaaucaaauuugaagcuggagagaugacuuaggaguuacaaggagugcuugcagaucuuaaacacuggaguuugguucccagaacccacaucaggggcucacaacuguuuguaacuaggagagcuauaaccccugacuggcuuugggcaccccaaacacauguguauacauaugucaggaacauaaacauuaaaaaaaaaaaacccuuaaagcaaaccuuuuagcaauaaacuaaauaaagccccaagaaagcauccaaaguuccuagaguaacuauuauuagucuuugaaccuuucucccacucagugaaucagaaugagcagggaagagcaaggccuauggaaauacagaaguuaagauaugcccuuugaaacacauaagacuccuuaaaucuagcugcuacuuauuuaaacuacucaaguagcaauacauauaugcuaugcuaucauaguacagagcuccuucaaaggacagaggcauccacuuaaauuuaacuauuaguuccacagacugaaaucugcuugcuaacccaagguugggcacucuugcuuuguuuuggucauaugcauacacguguuucucauaccccaagagcuaaggguuaugcuggauuuuaccucauggggaugagaucccagaaggccaguaaggaagcucucuggugggugugucugacgugugccuggcagguuccagggauccugaaggagagaaggguauguauaaagaucuggggaaagagaaggcacauacacauaacuauaggucuuccuaaaacccggaggauguuuguaaguaucuauuuuguauuuuuuucagacaaaagucucccuaauucgggcuaucuugcaacuugagacaauuuucuugccucagcugcuccaccaugucuaguucauuuguauuaggccagcaaggucaaagugaggaauuuacagaacucuguuucucacuggggcagagccuuuacuugcucuggcaggaucuucuucuucuucuccuucuucuuccgucucucuguuucuuucugucucucucucucuccccuucucuguccccucucuuucucugccucuacucucuucucaauuccccuucccauacccacaaauaaacucuauucuauacuagaccugucuaguauaugacugguaccucgaggaaggaaggagggaugcuucaguguggaccacugaguaaaguacccccucccacuguacuauacgucccuucuauaaaacauauccuuggauuuuuaaaaacacauugcucuucuuccuuuuuuuuuuuuuuuuuuuuuuuuuggguuuuuuugagacagaguuucucuguaaagcccuggcuguccuggaacucccuuuguagacugggcugaccucgaacucagaaauccgccugccuuugccucccaagugcuggguuuaaaggcgugcuccaccacgcccggcgucuuuuucuucuuuuuaaaaaugggguguaauauagccagguuuguaugcagcuguuacgaccuugacuuucugaccuagccuccaccuccauagugcugggguugcaggaguaggccaccacuuaagcacgacuuaggcuucacacuuguuaggcaaauagccuguuaagugaguacacuuccaguucggauuuucauccgcaacagaugcgguaggcucaugcccagaaauaaucugcgagcacuagcgagcagcuacggggcaaagcccgcgcacgcgcccuggguauucugccacccgcggcuacacucaccagcuccgaggccgcagagcccgcgcagcacacagcaucaccccgguagccauaguuuuucacgccacccgcuggcgggcagcuuccgggagcacgccccugggcgguccgaccugagguacccggucgggucuggcaggccucggcccggaacucgcgggucugggauuccgagaggcgggcccgcagcuggccccgcccccgacgcagccccgccccgggcaagcaacgguggcuucgccgcgcccuuuugcgggcgucccgccuucuguggaugcugcgguguuuuccugcucucugcuccgccuggccuauguguuuacaucuaugaaaacgccccgcucuucuaauaaaugcgcccgucuggcccccuauccuucaccagccuaguucuuuuaugcaugcaaucgagcucagggcccgcugccgucugccgcuagaugcaugcuggcgcccgcccggcuggcgcucgcgagaugcccaauagcgcgaauugauggauggcggaagcuaguuacuaagcuggacucggagccgcggagguagaacuagagaucugcacaccacccugguucugcaucgccgggcgggaucucaaggcuuugccagccugcucacaccgacccucaucggcgaccacaucaguggcagcggaguauccccguccuccccccccu

SEQ ID NO: 8150 - RNA, 5132 nt, Mus musculus
aggggggggaggacggggauacuccgcugccacugauguggucgccgaugagggucggugugagcaggcuggcaaagccuugagaucccgcccggcgaugcagaaccaggguggugugcagaucucuaguucuaccuccgcggcuccgaguccagcuuaguaacuagcuuccgccauccaucaauucgcgcuauugggcaucucgcgagcgccagccgggcgggcgccagcaugcaucuagcggcagacggcagcgggcccugagcucgauugcaugcauaaaagaacuaggcuggugaaggauagggggccagacgggcgcauuuauuagaagagcggggcguuuucauagauguaaacacauaggccaggcggagcagagagcaggaaaacaccgcagcauccacagaaggcgggacgcccgcaaaagggcgcggcgaagccaccguugcuugcccggggcggggcugcgucgggggcggggccagcugcgggcccgccucucggaaucccagacccgcgaguuccgggccgaggccugccagacccgaccggguaccucaggucggaccgcccaggggcgugcucccggaagcugcccgccagcggguggcgugaaaaacuauggcuaccggggugaugcugugugcugcgcgggcucugcggccucggagcuggugaguguagccgcggguggcagaauacccagggcgcgugcgcgggcuuugccccguagcugcucgcuagugcucgcagauuauuucugggcaugagccuaccgcaucuguugcggaugaaaauccgaacuggaaguguacucacuuaacaggcuauuugccuaacaagugugaagccuaagucgugcuuaagugguggccuacuccugcaaccccagcacuauggagguggaggcuaggucagaaagucaaggucguaacagcugcauacaaaccuggcuauauuacaccccauuuuuaaaaagaagaaaaagacgccgggcgugguggagcacgccuuuaaacccagcacuugggaggcaaaggcaggcggauuucugaguucgaggucagcccagucuacaaagggaguuccaggacagccagggcuuuacagagaaacucugucucaaaaaaacccaaaaaaaaaaaaaaaaaaaaaaaaaggaagaagagcaauguguuuuuaaaaauccaaggauauguuuuauagaagggacguauaguacagugggaggggguacuuuacucagugguccacacugaagcaucccuccuuccuuccucgagguaccagucauauacuagacaggucuaguauagaauagaguuuauuuguggguaugggaaggggaauugagaagagaguagaggcagagaaagagaggggacagagaaggggagagagagagagacagaaagaaacagagagacggaagaagaaggagaagaagaagaagauccugccagagcaaguaaaggcucugccccagugagaaacagaguucuguaaauuccucacuuugaccuugcuggccuaauacaaaugaacuagacaugguggagcagcugaggcaagaaaauugucucaaguugcaagauagcccgaauuagggagacuuuugucugaaaaaaauacaaaauagauacuuacaaacauccuccggguuuuaggaagaccuauaguuauguguaugugccuucucuuuccccagaucuuuauacauacccuucucuccuucaggaucccuggaaccugccaggcacacgucagacacacccaccagagagcuuccuuacuggccuucugggaucucauccccaugagguaaaauccagcauaacccuuagcucuugggguaugagaaacacguguaugcauaugaccaaaacaaagcaagagugcccaaccuuggguuagcaagcagauuucagucuguggaacuaauaguuaaauuuaaguggaugccucuguccuuugaaggagcucuguacuaugauagcauagcauauauguauugcuacuugaguaguuuaaauaaguagcagcuagauuuaaggagucuuauguguuucaaagggcauaucuuaacuucuguauuuccauaggccuugcucuucccugcucauucugauucacugagugggagaaagguucaaagacuaauaauaguuacucuaggaacuuuggaugcuuucuuggggcuuuauuuaguuuauugcuaaaagguuugcuuuaaggguuuuuuuuuuuuaauguuuauguuccugacauauguauacacauguguuuggggugcccaaagccagucagggguuauagcucuccuaguuacaaacaguugugagccccugauguggguucugggaaccaaacuccaguguuuaagaucugcaagcacuccuuguaacuccuaagucaucucuccagcuucaaauuugauuauuccuaaugccacauuuagccugggaaguguguuccuaaaaguaaaucagauacuugccaaagcuuuaggacauggcuaauuuuguaauguguuaugucuacaugcauggugcccacaaaggccagaagagggucccagaucccuuggaaccagaaucaaugaugguuguaagcugccaugugagugcugggaacaaaaccuagauccucggcaagagcagcaaguguucuuaaccacggagcccucucaacaccccagaaacugauuuaaaaaaaaaaaaaucuggcagucauuuuuacuguccugucucuuuuagucuugaagcauuuuguaaaucacaaauucauuucaaaugugaaugagcuuuuacucccuuaguucagcacguucacuucucagggcagcuuuaagauacaccugaaucacagacuggcacuuccaagcuaagaauguagcuugguuuauuggauccuugccuagcaugcacaaagccuuaaguuaauccccagcaccagaauacugggaguaguagaaaauaacuaggcuggaagucuggagguagagacaguaggaucagaguucaaggacauccuugacaacauagccaguuaaaggcaagcuaggacuguguaagaauaaaaguuaaaaaaaaaaaaaaaguugggcagugguugcacaccccuuuaauaucaacacuugggaggcagagacaguuugacaaggccagccuggucuacagagugaguucaggacagccagggcuacagagaaacccugucucagaaccacccaccccaccccaccaacaaaaagaaagaaucaacaguuccucuuaguagaucccuguccuuccuggaauugauaggacccauaccguccucgggaagacaguggacuaagcucguggaguuagggcugcggacagcuuucuuguuagcauauagcacaaguaugagauacuuuauuuagcauccuauccguccugagguugagugcuuguacccacuagagcagaaccucugcggaagaagaagaagguagaccccagaaaggaucaagcagcaaaggaucgcuugaaaaagaggauccgaaaacuggaaaaagccucccaagaacugauuccuauugaagauuuuauuaccccugugagguucuuggauaaaucaagguaagaguucuccucugggagacaucuuuaaugcaaaggaguuccucaaguaguucuaacugaaguucaugucugugguaggaacaagugaguagguuugacuuggcccugaccugaauccuuuucauuuugauugugcuuuuggggauuuuggggggagauucucagggaguuuagaucagcuuugcuccaggguucguguuauuuauuuccaugagccuuggcucugacccuugacauagacccuagcucuguagcccucauccuaucaaaagugcacaguuuauaaaaccguacaaguugggaagcaccaguguuuuucuaguguucuaggacuaaacaagcucuugucucuaguugguguuuguuucauuuuucuacuguacccccagcucaccaaaaggauaauuugccuggggcagaaacaguauaguucucuccaagcaggcaagcaggcuccuucugccggaggaaagcagcugcugccauguucuaugcugagcgguuuuuuuuuuuucuuuuuuuuuguaauauguaauuguguguugggaguauguucauaugaaugcaaguacccuuacaggcagcagaugcucuuggcuugaguuauaagcaguuuugagccacauaauucuagugcuaagaagaaauucuggugucuaagaacaguaaaugcucuuaaccucugaauccuccccccagcccugacauuacauucuuaauauauccucaaauuuacuauuuuccugagcccugguuaugccuggccgugcugguaguagggcacuuaagucaugugcagucacaagggucccucugcaauagugucaguacucuuuggccucccauguuugcucuauguguuuguucacagacagcgaccucaggaggagcauucaccugaggagagugaacggagagcucuucugcugaagaggugggcacuguuuaagcagcaggagcaugagauggagagggacgccaucagauccaugcuagaagcccagcaggaagcccuggaggagcugaaacuugaaucugcagagcucuaugccgaggccauaaagcgggauaccagccuauuccccuucgagaaagaagggccacauuacacaccaccuaucucuaacuaccaggccccugaaggcagguacaaugauaucaccaagguguacacacaaguagaauucaaaagauaagagacugaaaacugcuguccugggaacaugcuggcccuaggagucuggaguagagaucuaaagucuacuuuccacagacaagugagucauccuaggaacaaauaaaggguaaucaagaguaucugucuuuuguuuuguuuuuuucaagucaggguuucucuguguaguccuggcuguccuggaacucacucuguagaccaggcuggccucgaacucggaaauucaccugccucugccucccaagugcugggaauaaaggcauucgccaccaugcccggcugucauuuauuguaaucaacaaauaaaggguaaucaaaaguau

SEQ ID NO: 8151 - RNA, 452 nt, Mus musculus
uggguggugcaucugguagcaggagaagaugacggucuccacaggaguuccucauaauuuucgcuuguuggaagaacuugaagaaggacaaaaaggaguaggugauaguacuguuagcuggggccuugaagaugauggagacaugacaccuacaugguggacaggcaugauuauugggccaccaaggacaaacuaugaaaacagaauauauagccugaaaguagaauguggaucuaaauacccagaaguuccuccaucaguuagauuuauaacaaaaauuaauaugaaugggaucaauaauuccaguggaaugguggaugcacagagcauaccaguauuagcaaaauggcaaaauuucuauagaauuaaagucauaccucaagagcuaagaugucuuaugagguccaaagaaaauaugaagccaccagaaggacagauguacaacaacuaau

SEQ ID NO: 8152 - RNA, 944 nt, Mus musculus
uucauuuuuuauucaaaaaauuacuuuggacgauguuuuucacagccauaaggacaucuuuauuacgaaagcuguagauuaugggguugagugugggugucaggaugguguagaauauugccaaaaauuuauccugcccuggagugugguaugagcgaggucucauauauguaaaaaugaauggcccauaguacauuaugacaacaaccauguggaaggaacagguggaaaaggacuuuugccgggccccugaugacugcauuuggaauacagugaggagaauuugcacauaagauauagagaucauggaaaaugggaucagcagaaaaauaaugccacucacauaaacgccucguucauaguguguugugucuauacaugacaauuucaacauggcagggacuucgcagaaaaagugaucaauggcucuugaguggcagaagggaaaguggagugcaaaaacuguguguacuauggaguugaggauccccaccagccaggagccugcagccaggagccuacuggaguuaucccucaucagcacaggguagcgaaguggguggcagauggccacauaucgaucauaggacauggcugccaggagaaggcacucaccaccuagcaagguaagagagagaaauaucuggaaggcacagccugcaaaggaaauaguucugcugccugagaggaagucagcaaucauuuuaggaacaauguuggaaaugugcaagauauccaugaaggagagaugacuaagcaggaaauacauugggguauggagucgagaaucccuguggauuaggaggaucaugagggcauuuucuguuauagccauaauaaaaaugaaaaauauaaaugagaaaaaaguuaagcuugucuuugaagaagagaacagucccaagaggaugaagucgcuguuaaaaguguaguucucauauuccauc

SEQ ID NO: 8153 - RNA, 31742 nt, Mus musculus
aaugcuccgggaaggcggaugccucccccccauuggccaagggugggugacgcuaaguguuuuggcucgacggucacauguuuccuuuguugugagcaguggcagagacuggcgguggcucgaggagacgccggcgcagcagggacgggggucgccgcucgugccgcuuccagccugcgccgagagguaccaggguggccgcuccaagcggcaugcgaccgcggcgcugauccccggcaccggcgggagggaggcgaggucccuggcugccagaagcccgaugcggccucgggcguggggacagggcagggacgagccccgcggcagcaauacacuuaggguggaagcggccggaguguuucggccucggaccuggaguuuccguggggugaccgugagugcugucgccuagcacggauaaggaucggggugcuggggccauagcagccagcagcacaguugcgaaacaugcggggcguggucaccugaccguuacccgcccccgcgaagccuuuguuuaccgggagcgcggccucgggccgucccgggggagcccccacccggcugcccgcuuccuucucagggcccucugcuucuuaauuuaguucccaauguucccgcccccaagcccugggcacccgaggcgaagaucguucgggcggccgggauugggcgcugcaggcgggccgggccggcgaguuccgaauuuuuauuggcagggggugguagguggguggcccgugccaggcagucccgcccucgccugaaggugaccuggaggacgcgggcgccgagggaggggagcagcggggcgguggguaggaagggggcgugcccugcagaggccagggggugggggcuaacccguagcuccuggcguaggacagcgcgcagcucugcgaaguugcccuugccugcucuguccagccuuagguaguaaaggaugacccacaaggccacauuugagaagcuucaauaucagcucuagcggauuuuaaucaugucaauuuuuuuuucuguuaguguucucagcugacaccuggcacaaccaccagaugguugaugguugauaaugguuugguguuuuguuuuucuuuauuaggauuuaauauguaucccuugccacuaaaaauauaaacgguggcuuuuaccuuuaaaaaaaaagauauuuugagguuauucaccuaaaaguuuuuugguuuuggauuuuugaaugagcuuucuuaguuuucccuuuuuggggcacacaauuucguguauuaaucucccagguaauugagaaguuucugauaagugaguugaagguguguuuggaaaacuguacauuaagauaaccgaaagcccagucauuuccagacggaggauauuaaaggugguuuuccaaaucucuuaaacuuauggugcagcuagguuuugucauuuuaucucagaaaaguugaguuucuucaguaaagcagguauaauauacuuaauaaagcagccuuaauauacuuuuuaaagauuuauucuguguggguguuugaccagcauguacccacccaccuguguucggugccaacgaaggccagaagagggcgucagaucuccuggaacuggaguucuagaugguucaaguugucagcugccuugugagugcuggaaaccaaaccuggguccucugcaagagcacugcuaaaccauccuuccagccccucuuaauauuaaaaauccaaguacugaugccuguuagaauaagaaguugucugaucaggacacauagucacucguauacuaagguuauucagaucuuaacauauacaaaugcaacccaguauacuuuaauaagaacuaccuaccauuugauaaguugaguuucuuuaaacaaagcuugugacuuagucuuuaaacaggaagaagaaaacaauauucugagagcuaucaguuauaucuuaaacuuuccuggcuuucguccagauugccaaaaccuuaaugcuuuuccggugugcuuuuuaacuuccuuguuuuccugccauuucauuaagagucagaggucaagacuuuggaaaauaaauacuuagcaaauauguugcagcauuuauucuuguaugcacuuuauuuacucuuaccuggaaaauuuaggacagcucuuuuaucaaauauguaaguguggacucuguaaugaaaaaugucaauaaaauguccucacaagcauuuaugcaaaaaaaaaaagauuucauuucuguugugacuacaacaaugauacaagacagcuggauguuuuuaacauuucuguucuucaugcuauaaauacucccauaagcucaaggugaauccccugugggcagcuccaguuauuugggagacugaaguaagagcaauacucaguagaccuaggaguugaagaccauccugggcaacauagacuugggaguccaacaacagaauagcuaauuaucuucaagaguuuucauucuuccagcacacccucucccacacgcacacucuccuuugauacugaggacugaaccaagggccuucucacacaugcuagccacugaguucuccuuaguugacugaucuuagaugauccaaaacauucuaaaccaaauggaaaauaaggagaaugaaaaccuucuuaaggguggaguucaugccuguaacugcaggacggggaugggggacuauaguuugcaucaagccugaaauauacagacugaaauauaccuggucucaaaccaaagugauuagguuuuguuggugcuucuaaaacuauuucugaauaauugguguaauacuauguuaaaaaucauugacuuccgaguguuuuuguauauuaaaaggcuauuuagaaucccaggucacagagcauuuuauuggcaccauagcuaguuugguuguaauaagccaaaacuaauuuuguuagcagaaaaaguaacugucaaaauucuguuucgggcuggugagauggcucaguggguaagagcauccgacuguucuuccgaaggucuggaguucaaaucccagcaaccacaugguggcucacaaccauccauaacgagaucugacucccucuucugagugucugaagacagcuacaguguacuuacauguaauaaauaaaucuuuuaaaaaaaauuccguuucucccucucauucacagcagggacuuguuuuguaguccuggcugaccuggaacuugcuauguaaauuaaaauagucucuaauucacaaugauccuccugacucagcuuauggagugcugggguuacaaauguucacucucuuguuuugcuaggcuuuucauuuuuaaauaaaaaugcagugaguguauuggggguggggggagcuacaaaaugacauuguuuccaugucaggucuagugaagagcauaagucaagcaaagccuuuucagucaguaaaaaugccaacccuacagugucuaaaauugaauuuggaucuagcauuugcuacccuagugucagacaguaguaggacucucauuggcuuugggccuuacuaacuacugauaaagaauacuuacuuagguaggacuaaccaucaccugacuuaccaagacccaauauucuucaucaaguguacagauaaauuauucugccuaaugaaaguaaagaaauguacaagauaguauucauguccuaaucuuagcuuacucugauugugguauuuuggguuuuuuguuuuaaguugguuacucauauuuguuuuuaauaucgacuuuugaaucugcguaaacuugagaauguacaaguucucuuaauggaugauuggaucagaacagcaguuaaauauaauugcuauucuauguacuacucuaaauccugguauguacuuuuaagcauucuucucuaucuccuacacacaaacacacacacacacacauccagauacgcacaauagcucacaaaaauugugcugaauuaguuguguggacauuguaagguucaguaaagcagaagaauuauguauuaaaguuacuugauaagcuuggagguucuauauaaaaagguauauaauaaaagcuuaaauuaaaacuaggugagguuuuuuuuuucuuuuaacucuugagacuuuucucaaauugauuccauaguuacauguaguacagagugaauaaacuguuuacucuugacauauuuggcuuugauaucaacuuugaaucugccuaaacuuaagacaucaacucuuagaguaacuuaauucuaucgaauuugaaugcaauguaaguuuguaagcauccuucaaauauucaaaguggaauuaucacaggauauacuuuucuucaucucaccaucaaauuuagcuuacugcuuucauaaauaguaaaagaaauuugaauaucauugaauauaaaauuaauuuccuuuaagagaguguuacuuuuaaugaucuguaugaaacugaacuuuaaauuaaaaaguuguaauuuacuaagaacuguuuucagcauauuacuaauguacuugagcugauagcaucugucuuauaugucacuguucucuauuuuaggugugaaaauuuaaauaacacaaguauuuugccuggggcuuuggucaaacaaaugcugagaagguauauuuauauuuacuggcuauugaaacaucguuacuaguuuaaaccauuucauuucuuuaagccaggaucauuuggugcuaguaagaauaauagugaauaacagugaccaauucuaucaacacagaaucggacugaguguggugaggcacacuuguaaucccaacacucaggaaaugugguuaauuuuuaacuauugcuaguuuacuuguaaaaaaaauagauaaguaaaacuguauuuguuaaaaaugggaaaacaauggcugauuaauuuuacauggaagacuaaaaguuauacuuugaaagcauaucauacuguaagaugacugcaaaucaccuacccugugauaaguaguaagaauuuguauuuguuucuguuguggaaugcugguuaaugaaguguucuuagaaaagagauagcaagggguucuuguucuguuuugguuuuuuuguuauuuugguuuugguuuuaguuuugauuuugagacaaaguuuucauguaggcaugguuguccuggaacuagcucuguagaccaggcuggccucaaacucagagguccaacagccucugccucccaagugcuaagauuaaagaugauugccaucauugcccagcaagaaagcaaguuuuaauuaaucucuuuaugucccauaauuuaccuaauacuccauacauugcccuggcuacagaaagcaggcccauguuuuccuauaggugucaaggaaaugcaaauaugugcaaagccaaggucuaguagaugaaguguuaaaggguuguuucuucuuaaggugguaauuuuguugucuuuguuggcuaguugguugguuugauuuguuuugaguuuuuagacaguguaucucucuaagucaggcuggccuuagaccugcagcugucuuccugugucugccucaucauggcuaagauuguaggcauauauugccauucccagcuuaaagagguuuuuauugucaacaccagucguuauaucacuaaucaaaguccuaauugcuuauugaauuuucugagccugaaauacagagaugaugaugaugaugauaaacuagauaagcugauacaaagaauacauccuugauuuuucuggaugcuugauuugggaacugacuuuuaacuaauuuaaccauaauuugaaucuagucuaguaaagauucaaauacgaauuccuuuccaugucauaacuauuucuguguguaugcuuguuuugagagagggucucauguaucccaagcuagccuagaacucacucuuaacugaggaugaccuugaacaugugauguuccugccugccaaggaccagucucagcuuccaauacaacuugguuugggaacuacaaaagaacaacuugaagucaauuguggguacaaccugacagcucuguguucuacuugaacuggugacagcucaccucuugcauaccaaagcccagucuuuuucauuuacauaucaauucaaucauuuacccaggguccuguuuuauuaucccacgaaucagcacuuuacgaccauagccccuugauucauagaaaaaaacaaauacauuuuuuuaacauagcaaguguauuuaggggucugccugccuuuguaagcacagacaauaagcuagcugaguaggauccagcucugagauuacaauuccuacaaccccuggaccuagauuuacccuguccaaggcugaucuugaacucaggaucuaccugccuuuguaaacacagacaauaagcuaccugggugggaucuagcucugagauaacuauucucaccucaucuggacccaaauuccaucuuucccaggcugaccuugaacucagaaaucugccuuuguauuuuucugauaaucuggcucauuagugcaacugccuuuguucucucugguccaugaagccgccucauacaguucauaaugaauccuuauauuuugcauagugagaaauuauacauucuugaacucauguuuucagaguucuuucccacagccuuaugggcuauccugaaguuuacagcauuuaccauuuuguugaggaacacauucucaccucccagacucaugcuguuucuaauuaucauggagucauuaacuuuaacaaggagagugcuccccaaaggaggaacaugaaaauauguacauuauuauacaaacaagcccuacacccacacccacagcaacugucagcacaacugggggcccaccccuugcuaucucugcuccaggggcagaaaaccauaccaugcugucccuuccauggccaugcaggacucaguaccugccucuaccacuggagugcuaugcuugcaggcaugcaccacccugcuugguugauccugaaccuccuugugcucauucucagaggacaucaaagaauauuauguucuuuaguuauguuaggaaucuuaagugcuaagaauuuaaguuagagaggaaucuauuuggcaucuugucugugcuacugcauauuaucaugcauuaucauuuuguaauuuuugcucuguucaacucuucuaaagacuggauauaaagccagauaagucuguacaaaaaaaaaaaaacaaaaacaaaaacaaaacauuacaguauuaauucaccuaaggauagaaaauaggaagagguguuuauuacuuguauuuuugugcugguuuguuuuuuggggguggguuuuguuguuguuuguuuuucaacuugauacaagcgagaguuauuugaggaagaggaacuuuaauugagaaaauauccccauuggguugcuuguaguugucuguaggacauuuuuuugaugauugacauaggugggcccagacaaccuuggggcagcaccaucgcuggacaagugguccugagcuacauaagaaagcagcuggcgugaugugcauacaagccaggaaacaguucuucaugcccucugcuucaguuucugccucaaguuccuucccugacuuucccagugauagaguguaaccugagaguaucaagcggaaagaaaccuuuuccuccucaacuugcuuuuggccaugcuguuuaucauagcauaguaacccuaacuaguacaauuuuucuccaaacuuccauuauaaauagguaguucugcauuacaauguuaaaugugcauguuauuuaggcccagcucuucacugucacgcuuauuuguuuaucauguugaaaggcacauguaugccacagaaugcaucuggaugucagaaaaggaguugcaggagccaguuuucuccuaauugcuuggguucuggggaucuaacucagguugucaggcacgugacagcuccaguguaacagugccuaucuaugacuaagaaaugugucccaaucccucagagagacugcccgugaguaaccaaaggacuuagucacucuucuaaagacaguucuuuuuugguuuuauuguuuuugggguuuuuguuuguuuguuuuuuguuuuguuuuuucgagacaggguuucucuguguggcccuggcuguccuggaacucacucuguagaccaggcuggccucgaacucagaaauccgccugccucugccucccaagugcugggauuaaaggcgugagccaccacugccuggccuuuuuuguucuuuuaagaauaaggucucacuuauguagccuuggcuggccugcugaaacucucuauguagaccaggcuagucuugaacucacuauauagccaagcaugaccuugaacucuugaguuucuugccuccaccuccaaguaaugagauuacaaauguuuacuaugaaccuaguuuauguaauacaaaacccaaggcuucaugcauacuaggcaaacacuuuaccaacugagcuauguccccacuuuuuaauagcuguaauaaacuacucuaucuuaaagauauccugagguuuaguugcgggccuuuagcuuguuuuaaguauuuucugcuaauacaacacugaaaaucuauauaaauaaauuguucaaaaaauuauugauuauuucuuugagaaaaugguagaaaauaaggcuggucauacaguuuacauauuuaaaaauacagugauagauaaauucuaacgcuguuauauuaagguaauaauuguuuauauuaagauucuagcuguaagccaugccuguggggugugccuauaaaucauagcuuccaggaggcugaggcaggaggaguuccagaccauccugggcuauguauagggaagaccuuguuucaaauaaaccaaaacaauaguugaagauuguuaguccaguucuguaugcuuuuuuucucuuugcuauguagaacagaguagaaacugagcaucuaaaagagaauguauaacccuuugagcucaggaccacgcaaaaguugaaggucaugcuuagcuauguaauaaauucaugcuuagcuaugucuuaucuacauagagagcuccagcaggccaggcaagaauacauauggauacacuaggauauugcaaaguaacucucauguucuaaucaugcaaaugcaaacuuuuaucgguuuuuauuaaaaugagccagcuaguguauauuguagaauaugcuaaucaugugacuuguauuuacaaaacaaaugaaauugucuaaauauuuuuauuuuguuuuuuuaguuacauaaagaagaucccuaggagccauuucucagcaauuauauagucaacugauguaacaaugguacuaauauugggacgcagauuaaacagagaggaucuuggggugcgugauuccccagcaacuaagcguaaaguuuuugaaauggaccccaaaucucugacaggucaugaguauuuugacuucucuucaggaucaucccaugcugaaaacauccuccagauauuuaaugaguuccgagacagccgcuuauucacagaugucauuaucuguguggaaggaaaagaauucccaugccaucgagcuguccucucagccugcagcagcuacuucagagccauguucuguaacgaccacagggagagccgagaaaugcugguugagaucaauggcauuuuagcugaagcuauggaaugcuuucugcaguauguguauacugggaaggugaagaucacaacagagaauguccaguaccucuucgaaaccuccagccucuuucagauuaguguucuccgugaugcuugugccaaguucuuagaggaacagcuugauccuugcaauugccuaggaauccagcgcuuugccgacacccacucgcucaaaacacucuucacaaaaugcaagaccuuugcauuacagacuuuugaggaugugucccagcaugaagaauuucucgagcuugacaaagaugaacuuauugauuauaucugcagugaugaacuuguuauugguaaagaggagaugguuuuugaggccgucaugcgcugggucuaccgggcgguugaucugcgaagaccacuguuacaugagcuccugacgcacgucaggcuuccucucuugcaucccaacuacuuuguucagacaguugaaguggaccaguugauccagaauucccccgaguguuaucaguugcugcacgaagcaaggcgguaccacauacuuggcaaugaaaugauguccccaaggacuaggccacgcaggugagaaggugcuuuacaaguacggcuaguaacaguugcuguuuuaacuauauauuuuacacucgugaacucagucucaguguacucauuugaguguauagcuuauaugagacacacugguuuagggauguagcuuaguuuguagaggaccuaccuacauaaacuggguguggaagcacacaauuguaaucuuagcacacagagacugguggaugaguuaaagguuaucuucagauacuauguaaaucuuacuaaaugccagucucaacuuucaacgacuuuuuuaguguuuuguuuuuugacauacuaggcuacauauuauguaggcuaggcuggccuugaaaaucuauguaaccugacuuugaacucuugauccuccugcuucuaccucccaaguacuagcacuacugacaugggaccaugccccgcucagguccuuugccugaaauggaaaauuacauccauguugaagaauaguuaaccuuauguuuggagaaaacugugauuguugguauuuuauacguuuuauauuuuauuuuauauuauauauauauauauauauauauaugccuuaauaauggaaggcaaagauuuauuuggcaggguuguaucuuugugggugcccacuccacagcaugugugugacagucugaugacaacuuuguggagucaguuuucucuucccaccuuugcaugaguucuggggauacagugguccccaagcuuacauaguagcacuuuuacccacugagccaucucauuaguccuaaguuuaccuuuccaaaaaguuuuucuuuguuuuuuaguuuaugugcauggguguuuguuuaccucuaagucuguguaccauauacaugcagaacccauagagaccugaaaagggcauggaauccuuuccagcuaaaguuaaagacaguuguuagacccagugugagugcugggaauugaacccaggcccucuggaagaacagccagugucccuaaccuuugagccaucucauuaaccccauuauuuaucuuuuguauguaugaauguuuugccugcauuaggcugccuacaaaugagguucccaaguagcagcauggguaacauugaaugaaccagacaagucuuugcugauauaaugaccauguguggcaaauacuuccuauugggggugagggguugaauacucggaagaacuaagaguuuguaaguucgucauauugagguuagacccagcgguuaguuguauccgugaauccugacuucuaacauuuacauguguucacucuuguagaaguaaguacaguauggugaugaaagucaaauggcaaccaugagaggagaaaggguuucugucaggggcgggcagaguaguagagugcagaaaguggacggggcuacuggguggagaggaguagagguuggaggauccaacaaagcaaagcacaaugacagcuaccgugugugcugccuuaccuuguuugccugcaugugugucuguacaccauguggaugcaguucccccaguagccugaggagggcaucagauccccuuggaacuagagaaauggacagugugagucaccacguggaugcugaaaccaaaucacccugugggaaucuauccuaggucuuuggguagugguggcgcacaccuuuaaucccagcacuuuggaggcagaggcagauggauuucugaguucgaggccagccuggucuacaaagugaguuccaggacagccagagcuacacagagaaaccugucuugaaaaaaauaaaaccaaaaaaagcaaaaaaccaaaaaccuaggucuucugaaagagcagcaaguucucagagcugauuuuuuaauuuauuuuuauguuaaugaguguuugccuccaucuauguaaguacacauguagaugccuguucuagugcaucuuaacuaagauauucucccauguggcuggacuguacaauucaccauuauuacauguuuaaaugcuuugaagucagccacuuuauacaaaguauucauugagcguuuccuguuaauccugagauaaaaccaacuccacuauuuugagccaaguuuaaagcaagcuuuauuaaauauuaaaugcugaccaagggauagacuuuggucaggaccauucucuggaauuucccagcugagacuguccccaagccguguguugcagggauuuauaaggauaagcguauaggcccuaugcuuucccacgaggcuuuguuauuuucuaugaauuccagcucccugcauuacaggaagcucugcaccuucccucuaccugacccuuaggcacuccuuagcgcuccuucucagaugauaccucuguuaccaguuuuuaauuccuuuuagaaauauucucgguguaggaauguguauguagccgugucuccugccuuucuguacagauggcacauggcuucccucacaguuccuucccuugccuuuaccacuuggcaguuccuggcuuuccuuuuuuauugccagugcuggagguuuaaccaaaggccucgcuguaaaaccguguuuaacugugugcagcuggguucugagugaccacgugcagaucuuuacuuuuuguguuauuagaaaagcuuccuauguuguucucaagaguuuguguguguguguguguguguguguguguguguguguguguguguguggugucaacagauaggccagaagagggcauuggcuuccuugagauggaguugcaggcacuugaguagccugacagagguacuaggaacugagcucugcaagaccaguucgugcucugaagcacggagccaucuccagccaccucuacuuccuucucuuaagcaacauuuacauaguacucuauguauggauagaacauaauuagguuuuguuguuuuauuuuauuuuauugagaaagaaucucauuguguaucucugacuguccuggagauuagagauguaaaccaggcugaccucaaacucacagagaucugccuaccucucugccucuaguacuggcaucaguagaggugaauaccaccauuccuggcucacaaauuuuuuuuccccauugucuuuacuguuaguuauuuaaugggcauuuugauuguuucuguccuuuggcuaauaugaacauggcuacucauggguuugcauuuguguauuacuguucugucacucagaaugaaucucuacuuuagccagacaacuuuagaacaacuuucuggccacaugggaguagaauagcuaagcaaaaagauguuaauugaaaaccucacccuauauuagucuggacaaacaaccagaagugaccauuaaaagcaagauguugugggggucccuacaagcucuacugccagcagagaaacaacuucaggaggcaagaaggacuuagcuguccuggcucaaggaguuguuaccucagucagucaauuuuugauauauuuaagcuuaguacaaguuuggaaaaaaguucccaugugacagugaucacaacaaagcuuaaggcaugauuauaucaaaacuccuuugcaaacuacaugugaccucuuccauaaggaugcauucuauucacugagaaucaguguucaugaccagggacuagggaggaaggguuuguaauaagcauagaaguaaacucuuuugcaaguacauagaaccucuuucauaggaauggguucuauuaagaaacagugucugggcauuuggaggauucuggugaagcuuggcucuguagguaaaagaucaccagguuauaacaacauccacuccagcauucuaggaagaaagcagguacacacaucccuuccgcuuuaagagaaaagccugcauauauaacauuucugguuucucuaaugcuuaucugugagcaggaggaacucaugacuacuaugagaugugguaguuuucuuuuguuugguacuagagauagacucagggcuuauucugcaacuaaguuauuucccuaguccuauugucuuaaugguuuuuauuacuaucuugacaauuucauguguauaaauauguauuauauauuaugauccacuaccacaguuccugcucuuacccucucccauuucugcugaccacagcccccuucucaacuacccacucaccccucuacuuucauguuuauguguguguucaaagcauaugugggagaguauuaccuggcacuugggcagcuuacccaagacuguacuacugaagaaagugacuuucucuccucuggccaucauuaaugccaauagcaauucagggaaggauggagcuuuauggccccuccuucauccauggugaaauguugaaaggucccaucuuguacagauaaccugugugguccuuauugcuacagcugcuguguauuucuuacugcuacagccauggcguguccagaaaauagagcugcaucacacucugccguucuucagcucuuagcaguguucucugagccuuggaagggugugguagugauugucucauucagggaacuccacuuaccagucacuuguucccagcauuuuaacccacugccuacugcaaaaugcuuccuucaucaaggcugagagcagcacuuuggguauaaacacaaauaccuagaaggcaguuugaccuuauguccauuuauguguugguuuuuuugaaacagagucucacugugaagcccugccuccuuaugagcccccugccucuuccuccugaggguugggauuagaaguaugugacaccacacucagaugucuuuuuaaucuaugaauguacuauccauuuacaugaucaccgugcuuuguggcgugaacguguuucugugucauggcaucuaauaaucaucacccugcccacagaguuaagcugucucugaacauuguacauuuaagucacaugggcauaauugugucucaguauuuaaacauuucuaccauuaguucccaauaguaauuuuuagauaauugccacuuuuuuuuucaguuuuuuuuaauuagguauuuuccucauuuacauuuucaaugcuaucccaaaggucccccauacccacccccccaauccccuacccacccacucccccuuuuuggcccugguguuccccuguacuggggcaucuaaaguuaauugccacuuuuuuaaaaguaaacauugugagucuuggucacuacauuuguuuuccuuauaaaagccgccugccugggguaguucccaguggagagcccuggcacacagacuccuguguccuugccaaguuuagaaaauaagaaaaucagauuucuguagggguggaucuaauguugacuaugagaaaccaauuaacuugcuucucuucuagucuguguuagucuauucugcucugguggcugauaccaggagauuacaaugucaacgacucaaggcuagccugagcaacaauagugagacccuguccugucacaaaaaaauuuuuaaaaauuaaaaauuaaaauuaaaaaaauugugagguugaaaauuuagguugggggcuaaaagcuugccuagcauguacaaggcccuggguucaaaacuaguaccauacaaaaagagaaaggaggagaaccagcuagcagauuaaauguguuaaagcugccugcucagcauguuguuauagucaagucucuacaggagagcuuuagaacuggguccuuucagcugauagcaacuugagaaauucacccaacauuaaaauuuuuccugccaaagaauuuguaauguucaagucaauauugcugagacaauaaguugaguggcuauagcaaauauucacucuaugauuuauucuuuuacuccuucauucauuuauguauuucuucuagggcuggccaauccugucuuuagauaauacaaugaauugauagcauuagaucuuacagauggagaacucuucugucucuuuaagguuuaaagucuugugaucuccauuuuuaauggaugcaugcauauuguaacaguuagacauacagauguuuuugaauuuucuuugauuucauauaucccuaguggacagcaugaagaccuugcaaauauaauaacuuauuucugaagaaauacucuuaaauacauagacauuggauuuguuuuuagcaauaauaaaaggugguagaauucuugccuugaaagcccaaugaccauguuuccgacccuaguacuauggcaaaacagaaggcuuaaaaagucaaaaccuauaaaagccagaguguuauuccuugccucuaauuucagcauucaggaggcagaaacuagugagucugugugccaggauagucuggucuacauagugaguucccagcuagccagagcuacauagagagacccuguaucuagaucaaccagccaaccagaaaagacagguuugauggcuguaaucccuuuuccaucacucacuuguauucucaggcugagacaggaggaucaugauguuuaaaccagccuggaugggugauauuuugaggcugugucuuuuuaaagaagaagaagaagaaaaaguuuaauaguaggggcaggcucacugguuaagagcacuugauacucuugcaaaagaccagggauugguucccagcacccacauggugacucauagccaucccuaacuccaauuccaggguauccaguauccagucccauucuuugaccuccguagaaaccaagcucaugggugguacacauacauacauguaggcaaaacacucauacauguaaaccuaaaacacuuuaaaagaaaaauccuuguagauauuuucuguggcauaaugaugccacuaaugaaucauugcaaaguaaaucacuggcagccuguacuguucagcauaucugcaaggacaaauuuaauugccugucauggcguuagggcuugauuauauuuuaacagucuugauuauauuuuaauauaccacuuaacuauuauuugugcauucuuaacaauaacuauuuuaggucuacuggcuauucagaggugauaguugugguuggaggcugugaacgaguuggaggauuuaaucuuccauacacugagugcuaugauccaguaacaggagaauggaaguccuuggccaagcuuccagaauuuaccaaauccgaguaugcagucugugcacugaggaaugauauucuuguuucagguaaauacaaauuauuauaguagcuacaacuuuugauugggaaucagauuggcuguuuuuaaaugauaaugacuuacugaguguaaaaugaauauuucagauaaacaaguuuauacaacaaaacugaaaagacuuuuugcccuugaaagcaagaauacuuacaaaaguucuaccaaaaauugguuuggucauaauauuuuaaaugcuuuuauguacauuuagaguauauguauuuuaacuguguguguguguguguguguguguguguguguguguguguguguguguguuuauauaugugugugcccagaagaacauagaagugccuucagaggccaaaagagaucaugagaucuccuggaguuggaguuguaggaaguuguaagccuccacgggagugcugaguacacucaggucuuccgggcuagcagcaacugcucuaaucacugagccacugagccaccucucuagcuaaaaguuaguuauagaaguuaugguuuaucuuuuuuucuuuuucuuucuuuuuuuuuuuuuaagaaucauuauaaacuguaaaguuagaaguauucauacaauuaaauauguuuaauuugcuuguuuucuaaaauucucuccccagguuuaucaauuagaauuuaccuauaaaaauuauuaacuugaacauauuuauuauauaugauguaguccuaaaagucagacaaaaugacagauuugaaaaaguauagcuaguguuuaugcuuugaagccuguugauuaacagcaguuauugcugauugcuauuuuacuacccagugauugguucuggacauauaccugauuuucugugguuuuuacaacaucuuuagaauuacccuauuuguacuuaucugggaugccugguuuauagaacccacuuucuguauuuuauuauuuuggaccuuacagucacuauuuuucaagauaagaguuggcagaauuuaaaucugcuguguguaacuuguucuauuaagccauagaagguuccuccuuuauuugcugagcaaaugcugaacuucuugaauugaacaggaaaauucggcuucauuaccuguguuaguggcauuggccucugguuguacuuaagugauauuaccacaugugcauuguuuuacauuugaagguggaagaaucaacagccgugaugucuggauuuauaauucacaguuaaauaucuggaucagaguugcuucucuaaauaaaggcagauggcgucacaaaauggcuguccuucuugguaaaguaagagaaaaagcuuuuuauuauuucugcugguaaauguccaaaagaaaugccacagcugcaucuugcauuuuccucuggguauuuuggcuucgaaugguauuuccuuccauuacuaaccaagauaaacuaaagacauaaacaauaugacacugugcuuuuugaauagauauucuguucucccaauuucagauuuguagcaguacagcacauuucuuacccauuggaaucccaaggcuuaagaacuagaaaagcauuaugucagauuacaaaaccaggccagugucuaggccacacaacuuuuucccuuugacugaauuuggcaaucaagcagaaaaaauguuuaucucaaguaguauuauuucgccuucuuuauuugugcaagaggggauaaaacgaagauaagcucuccaacacguuuguuuacucucuguguguuggggugguaguggugauggauuguguucuuuguuguguguauuccugugucugugcccuugaaggccagaaaauggugucagauccucuggaccuggcugcugggaagagaaccuggguccucuguaggagcagcaggaguuccugacugcuaacucuccagcccauauucacuuucuuuuucuuuuuuaagacaaggucacauugcacaugagaaaagugcaauguacagaaguggcauugguuacuguggaggcacagaggcaccgagcuaaauuguggccagauuuaaauuacaaagugugaaguuuagcucgacucuuaagcauucauugaugcucuguuaaaggauugauuggugauguuugcagaagguuggcaugugauuugaggaacuaugaaaugaugcagacccuuggauaaaugguaaugauggagaacaaacagaagggcaggugugagagacccuuuggaagacccaguuggacuucgcaguuaauuacauguggcaagaagaguuuguuuguuuguucguauguuuguuuguuuguuuuguuaaagauuuguuaauuucauguauguggguacacuauugcuaucuucagacgcaccagaagacaacaucauaugcccaucacagaugguugggagccaccaugugguugcugggaauugaacucgagacuucuagaagagcagucagugcucuuaacugccgagccaucucuccagcuccaaaagaagagcuuauaauuguuuauuaaaagaaauguggguguaaaaugaaaaaguugauuaauaaaaauuucugauacacccgcacgauccacaggggaugguucugcauaagccauuuacuaaaugccauguuuauuguuccaccugucauguaaagguugcccuaccauuauucauggaaaauauugagaaagcccuuugagcuuacuaugucuccaguacuuuacuugcugcuauagguacugaaaggugguccuugccuuuagagagcucacacugcugacccuuaccuaguguuacacuuacacggcuuuauuacuuuauaaucaaauagcucauuguugagugaacaaaacaugaaaaaccuuauucccacagguaugguaaagacuuauucauccaaggguguggaaagcacacauacaagacauagaucacauacacaguagggaaaacaaauacacagugugcuugugggauuaaaaugucccugaaggaagcauaacagaaaggcucuguauuagucauagaggggugcuaaaaauuaaacaggcucagaaaacugagcuaaauacacuguaguuauagccgucaaguccuugaaugagagagauucucuaauuuuaacagagcagauaaacauuuuagacuugcuaauuaagauucuuuucccuguacuuuauguauagguguauguuguuggcggcuaugaugggcaaaacaggcuuagcaguguggaguguuacgauuccuuuucaaaucguuggacggaaguugcuccacuuaaggaagcagugagcucuccugcagugacaagcuguauaggaaaauuguuugugauugguggaggaccugaugauaauacuuguucugauaagguaagacauaugcuuagagaaacuacccaugcuauguacaaaagggagagacagguggucucuugaauagauagauggcuaggauacuaaaugugagggaucuuuuaaaaauugucugguauuuucuucuuugaggggaaaggcauucaauuccaaguugccauagugauaccauaaugcagccagugauuuucuauguguaacaaaugggauuaaaccuuuuugaaaugagcuaaucucaggguuaaacuucauugucgucuauaggauuuaaaaguuacaugcaucacagaaaauuaaugagcaaagguaaauuauacugcuuccaacuaggucauuuucuuuaaaccuuugaaaggaacaaaagaagagggaagauugccuauauagcgugaacagaggauggcccaaauagcagcaguucacccaacucugggacagaagaacaugugcuguccuggcauuucgguagacaucauauuuauucuagggaagaguauccaauggauaauuggcuuagcagugauaaugaaauuucaaaucauuuuccuacuaacuguuaauauaucaucaaauauuauggcaccagcgaguggcacagcagccaaagugcuuaccaccaaaccugacagucugggugaaguccucagauccuguaauuauaggagggcagcagcaacucugcagguuccucugaccuucacaugggcacuacgacaauacauacagaguuuaugcucauuaaaaauauacuaaacugagcuugcuugcuguucuucugagguaaggacucccuaaaagcauaaagaaauuauagucagauugagagaugauuaauuuacaugaggcaauuucagagaaacuuaagacuugaauuuaguguauauaagucaaccuagaggccauuccucuuggaaaaaauucuguguguauuuuguuguggguuaauaaugggguccugcgucaaguccaacacagggcuagagccacucauagaggcagacgcaggaaguuugacuagugcacaccccaugucgcuacccacccauagugcaucagucugugggaagccucaggauccacuccagugguggggagccgcagucugaggucccugcagaaccugucagaguuggcuugcaccacagaagagcugagaacagagugugagccugugggugggcucuggcccugggccgaagggaaaaggacagggaggagagaguuccggcugguucccuuggggaggagaguccuaggcuugaugugguagagacccucugggaacccugagaggcuuccuuuggaagguuggacgaacagcucucugagaacaaccugcuccauuguuccagcguggcgggucccaaugagacgagguaguccaugguuuuaagguguuuauuguagaaagccagagagagggagaagaguagagaaguagagaccggccauggccacauggagagaggagagaagggaaagugggggggggggggacacaagagggcaagagagaggcaagaguuaaguaagagcaggggggcgggguuggcaaguagcuccuuuuauaguggcuagccauccugcuguugccagguaacugugggguggacuguggacagccuaugugacugauggccacaaaauuauggagcuggguccuugugucaggagccuauaucugggagcauggcaaacaggccuuccgcgucccuugcagauugaucugcugggucucccggguuuaaaccuagcuggaccagaaaacaggcugccuuucacagucccacauuuuguuacuaucuuauguuugaugguaaaaaauuagccuuucuuugauuuuuuuuuuuuucaaacaaaggaguuuuauccuugaccaagaagcaagaauuuuccuaauacauaaauuuuguuaaucagaguaaccucauuuauuucuuugaauuaacaggauuuuauuuuuaaccauguuucuacauauuaacacauuuuuaaagcagauuugcauauuuauauagacauuuuacuccauauuuuucuguauuauuagguccaaucuuaugacccagaaaccaauucuuggcuacuucgugcagcuaucccuaucgccaagaggugcaucacagcugucucuuuaaacaaccugaucuacguagcuggugggcugaccaaggcaguguauuguuacgaucccguugaagacuacuggaugcauguacaaaacacauucagccggcagguaaaagcacagagaguccagacagaaauacaagagggaacaagugaccugauuauuuacuggaaucucacuuuucaaauaguuaauauauuuuaaauuuuccucccaaggaguuguuuuuauuuuuucuuuguuuuuguggugcugagauuggguccagagccucaugacacuagguacacccuacccagauccaugcucugccccaaggacuagcuuuagcaaacuaacuuaccauucaauagcccaacaguaaguauccauuauauuuaggcuuuuugguuuuucgagacaggguuucucuguguagcccuggcuguccuggaacucacucuguagaccaggcuggccugguacucagaaguccaccugccucugccucccgagugcugggauuaaagacgugcaccaccgugcccggcuauauuuaggcuuuugguuuaaaaaaauucaaccuuuaccuuuuuuagaauuucauucuagucuuccuacccuuucucuuuauauuucagaaaaggagaaaauggcucuguuuguagucugauucguuguuuuguuauaaaggaagugguuguguucauaccucauucauccacacauuccaccugaagccccagcuccccuuuuucucugcuauuucagaaaggcucccaacuugcggggucuuggcuuugcuuauccuccuuuuauuaccaaaaugcugcuccuaaggcuagaacuuugucucuccucguaucaguaacgaugauguagagggagacagcacaauggagugaauguguugguaugugcacaggaaugugagugcccagagagaccagaagacgggccagugcccuguaguuucaguuacaggugguugucagcuaccugaugggggugcuggggaccaaacugcaguccucugcaagggaaggagguguccuuaaccucuccccagccugcccucccaaaauguauuccuuccaucuguccauccagaaacuuucugucucuuucucgcucucucucuuucuuucuuucucucucucucucucucucucuuucuuucuuucuuuuuucacuuguuggcucuauuuugucuuucucaguuugauuaguuggcuagauuuuugcuugccuuccuuccuuuuucuuuuucuccucuuccuuuuucuccucccccuccuccucuuuuuaaaaaaacaaacaaacaaacaaacaaaaaccagggucucacguuguaacccuggcuggcauguaacucacagaucuguuuucuucacccuccucauuucugcaugcccaggcuccaaagacaagucacuaguagucauuucuucauuucuuuuuaguuucuuaccuuuuucuucuuaagucuuuauauaugaguguugcuuaggccucuuucucaugacuuaacucuaguuuauuccugacuuacuucauuuacugcucacgauugaucuuguuucgaaugccuguuugcaccugcuguguggccuugcccauggugcaccaagguuucagacuuagagaggaaucugccugcuucucucaugcugucucuaucuugauguuucagaauccuuagcuagguuuuuucacugucucuaacagagagaagcacacauuaaaccuguccuuagaauucuguccucuaacugguauagcuucucuauaucaguuugcuaccaguuauuuuccaauaaauuucauuauguccccuuaaugagaagccuccugagcaacucuaaagcucgccacuuucuucuagaccuucugauaucucaucuuugcuuuguucucagcuaaaaggccaagaagggauugcuuugugcucuccccccucaaucucugucucugucccugucuuuuggcuguccuggaacucgcuauguaaaccaggcugggcuugaacucagacaucagccugccugccucuugagugcugggauuaaaagcgugugucauuacuacauguguguguguguguguguguguguguguguguguguguguguguguaugugugugugucacagcacauguggaggucagaggucaacauguaggauuccaccaugaggguccugcaauggaacacacaaauuauugggauuggcagcaaacaucuuuuacccagaaacccauuuaccagguccccuuaugguuugaggugucuguguguguacacacgugugugugcauuccauguguauaaguacuccccuccccucaugccccagauaccagaaaagaguguuggauccccuagaaugccugcugggaacugaacauggguccucuggaagaacagcagaugcucuuaagcacagugccaucuccagcccugcucugguuuuuuaaaugcuuauuuccuauacuggaaugaaagccuugucaaucucaucuaggccucuguuaguaacaauucaucuuaguauucacuucauguaaaucucaacacucaaacauacaacaggaguugggcaaaagggauauuaugucucccuuucuuauauuuuguuaaugcauguugaugcuuuuuuaguuuauugucaaauccuuuaucucuaauaguuaauugguuuuuuuguuuguuuuuuuauauauuugguuaaacaggaaaacugugguaugucuguuuguaaugguaaaaucuauauccuggguggaagacgggaaaauggagaagccacagauacuauucucuguuacgauccugcgacaaguaucaucacaggaguggcugcaaugcccaggccaguguccuaccacggcuguguaacuauucauagauacaaugagaagugcuuuaagcucuaacuaaacccaggauaccucacacaagaagccaacgucaauccaagaggaaaguuuuuaaaacgaccacgugagaacucaacuccuuugcauaaagaaauaaauaauccugaugccuuucugacccaaaauuccaauauuucaagcagucauaaauccuuuccuguacugggggugggagguugguugagugagaccagugcucaccuuuaccccagcacucagaaggcagacuucuauacguuugaacccagccuggucuacauaacaaguucuaggccagcaaagguuacacaauaaggccuugucuuuugaaaaaaaaaagucauaauuuggccuaugaauauacuuuggcauuuuugaaauacuaugugggguaggcaguacugcccaguguaaacuucauagggauuugugaaccauuuuucaggaguguguccuguuuuugucaauuauguagagaguauugcaugaaugaagcuuuuuuuuuuuuuuuuuuugguugaauugccugauguuaagaauguuuagaauucauugugagaggaagaaaugaguuuguuuuguucauucguucacuuuaacaauuuauuuaacuuuguguacauugguagaaggggaucagaucccuuggaacuggaguuacagacaguugugaacugccaugugggugcugagaacugaaccccgguccuuuggaagaacagacagugcucuuaaccacugagccaucucucaagccccaagaaaugacuuuauccauacugguuaauucuauugaaggcuuuuugggguuuuguuugguguuuuuucuaauuguaaaaguguagugacaauucagcuaccauaaaauaccaaauuuuaugacuuuauagacuauucucugauauuaaauacuuuuugugaguugauguaggagauguaaaaguaaggagauuuaaauuauacauuagucccuaaggaaaaauuaaaauuacuauugaagaaaaaaaaaaugugauccacuuugguucucaggguauuuaaugacucaucugugcguccacuaaagaauuucuuuccuuuaaacuaacauaggaguugaaaucccuuuuacagagcaaggcaggugucuguguucaggaucuguuucccaggcaugguagugcagaccuguauccaggaucugggaagugcaucaaaagaaaccagaugggcugaagagauggcucaguguuuacgaacacuuccugcacuugcagagaaccuagguuugguucccacccuuaucagguagcucacaauuucugcaauucuaguuccagggaaucgaacaccuucuguccucccugggcaucuacaaauauauggugcacauaaauucauacaggaacacguguauaaaagaaauauaucuuaagacaaaauugcauuugcaauacugcuguaagaaaaacaagaacagguuugcuccuacccagccugacagaguuggaccuaacuugugugaugccuugugagugccucuccgcugccuugugagcaguuauuagccuaggagaguugucuaauuccuuaauauccuacagcaguggggccucucacuuguaacucugaccagcagcaguuccggucuccagagagaaaucucuuauuugggagagcucuuuuauuuguauaaaauacugaucaucauuuucagauuucuauuaaauuuuucccucuagguuuuuuaccuccauuuuguaaagcuuagcaguuugcaaagggaaaugugaaauuuuucuuagacacauaagugaauacagcaggaauuagcacaacuaauuauuguaacuuccagugcccugggcugcagcaggugacuugcuguguaacuucccagucucucacuauaauauacuccuugucaaugacaauggugucaaucgauuucuguucaaauucaggcaguuaucagaaaccuagcauuggcaaacaacuuuuuccucaucuuaggauaauacaaauguauuuuaagagucaugcuuaguuggaaucuaaauucugagaaaaaugcuaaaaaauacacuuaggaaaugguuuucaagucauaaauuauaagugauauagcuauagaaacaaugcagaaaaucaucugucaggugagcaacagauguauguaaaacugaggguauguguacuguaauuuuauaguaaguaucugcauuaugcuuuuguuagagaauggaaauuguuuaguucagaaauucuuaacaguuaagugugugaacaaaaguguuuuauaaaugcuuaggauucuacaaaugauaauuguuauucucauguauauuuguaagaucauguccauucauaaauauauauaaaagacuuggucaaaguaaauuuguauuuuaguauuuuugucuguuguaaaaguauuaucuacuuguaucuuauaauguuuaucuuucauauauucucauguuuauugcaguaaauuggaaaaaauccugaaaaucagaauuuguucaaacaaauuaauuuuuauguuacaaauuauauuaaaaguuaccagaaaguaccugaauccuagaaaauuaacuuuuaaaagcuacccaauugguauuuuaacuuccuuuaauuacuuaccuuugcuaauccuugauaaauaauagugguaagcccugguuuaaaaaauaauaauuuugccgggcagugguggcacacgccuuuaauaccagcacuugaggggcagaggcaggcaaauuucugaguuccaggacagccagggcuacacagagaaacuauguccugaaaaaaauaauuaauuuuaggguauaauaaauguauuaaaagggcuauaucaaccauccuagagucagacuaucuucauucuguuaucccauaauuggcagacuuucuuuugauaggugauguuuauaugagccucuaaguuaggauguguguguguuuauauguagauaguaugauguguacauauaucacaaacacccaaugguuuuugcaguuuaauuaucagaaauuuguauaaauuaaaaaauuaguugaucauagacaauuugauuacauaagacuaaauuugaacauuucuagaguacucuuuauuguugagacaggaucucuguagccugugcuagccucaaacucuuagcaauucuuugccuucugagagcugcaguuagaagaggaagccaggaccauuuucuaaaauaagcauuucaucugaaagugcagaucuggucuuaaggaucugugcaccuguguaacuacagcguuacaaggccaggaagcagaccuggagaucuguguaacgacaguguuacaaggucagaaagcagaccuggagaucuguguaacgacaguguuacaaggccaggaagcagaccuggagaucuguguaacgacaguguuacaaggccaggaagcagaccuggagaucuguguaacgacaguguuacaaggccaggaagcagaccuggagagaagcgugcaaacaccgcuuguggcuguucaguuggaaaggucauauguuuugugaaucaacaggaaauuacaguugguuuuuguguacauuuucaugaacuugaauccuccuccaagucuucuccauguacuccacaagguggccugacuuccucccugucugcuguacucucccacacugacugacugacaggaauuggguucuccacagccguuugucauagaugggcgguugggauccagguguuuacuccauuggaaucagguuuuaaacgaccaaaugcucagggagggcauuggcuugucugagucacccaucgggugugcaaagcacucucaccauuuaguugauggcucuagacggauauguuucagaaauuucacuucuagcagugguuaaacauccauucugcuuggaaagaugacagugcuuggugagccggcacacucuccuggugaauaugaauuguuucugcaucugcugucagacccccauuuugaaacucaggaaagacaaagguggguuuucugcuuuugucauuguccaacccaggugugugcugcuuuuuccugaucugacaguagauuuuuaaaaaucacucugagagcccaugcacauacacgaagagagaacgggaguuggauuauuugugugugccuuuaacgucuugagaggauacauccuacagacuucaugugguaccaagauaauguccggaagcuuccuguggacugccucauagucaacccaagacauuacuaguuaaaacgauuuggucuugcuggaguuagugguacagagcugagugugguggcaaugucugauuccaguccuugggagaugugacaagaagaucaggaaaguuccaggacagccauggcaacagagccaguuugaggucagaguuggccacaugaauucccaugugagaaacaguaauggcauugauuggcauuguguagaaagcuggaaugauaucauuucauccauuauuauguuccaaaccacauaaccaacaugaaaauucacuguaucacguaaccagaaugaagcagguucgcugaccugugaugcaauagauuugacuagcuaauuaugcuucuugccacaucuagugcuaggcaucaaacagcacuuccagguguauaaacuaauaccagagauguuucaaaauauuuuagacauuuuaaaguguuuuauuuguaagcggguugcgagauggcucagcgguuaggagcaagcacuagcaauugcugcuguagcagaggaucuggcuuggguuccaagcaccuucauuguggcuaacaauugucuguaacucuagucacugggguucuacuacucucuggccucuacaggcacacaugaugcauauacaugauaugcaaacugucauaguacaggcaaaacauacacauaaaaauaaguaucacgggcuggugagauggcucaguggguaagagcacccgacugcucuucugaagguccggaguucaaaucccagcaaccacaugguggcucacaaccaucuguaacgagaucugacucccucuucuggagugucugaggacagcuacaguguacuuacauauaaccaauaaauaaaucuuuaaaaaaaaauaaguaucacuaaaauguuguaugugagccuuuuacaugugugugguugccuuaaauaucaaacuuauacagugcuaaaggugauagaacauagaaagugaagucauaacuucauauauuguuccaaagaaguuuuguuuuaauguuugugccuuaagcuacccagugccauuuuagucugauaaaccucaguauugguuuuugagggucuaguuuuguuuuauuuuuugaguccgggcgauauagauccaaggcuugccuaaaacucuguuuugcugaaaaugaucuugaacuccaaucauucugucauagcucccaagugcuuggaugauagcuugugccaccaugcuuggcuguguggguuucuguggucuggguggguuguuugguugguucuucaauugguugauuuaauguagcccuggcuaaccuggaacucaguauaugaccagguugaccuugagcuaguggcaauucuccugccucugucugugagugcugaugcuuuugugaauaccagcugccugcuaggcagaaagagaauguuaacugagguuguugcuuggaguuuuacauuuuuaacuuuugguaccuaggugcuuuguaaaauacucagauaaauacccacugagcuauuuggaauagugaagaguaugcguaguuauuucuguuugucauuauauuaguagugcugcuccaggcuuuuccuugagaaaacacuuccucuucaucgcucccgcuccugcagugugagucuccagagcuaucgaaggcuuucagaaccgaacaagugugcgugcuuuucuguaacuuccacacagccauugccuagagugaaugcucacagugaagaaaggaguguucuccauguccuuguucuccguucagcaguaguacaguaauguaguacaguaaugcuuacaguuuuguuuaauugcacuuccuccauaguuuaaauuuuuaaaaguuguaucuaaugucuuuuaaacauuacuugacuauaugguuacauuaaauuuuguuuaccaaaaaucugau

SEQ ID NO: 8154 - RNA, 31742 nt, Mus musculus
aucagauuuuugguaaacaaaauuuaauguaaccauauagucaaguaauguuuaaaagacauuagauacaacuuuuaaaaauuuaaacuauggaggaagugcaauuaaacaaaacuguaagcauuacuguacuacauuacuguacuacugcugaacggagaacaaggacauggagaacacuccuuucuucacugugagcauucacucuaggcaauggcuguguggaaguuacagaaaagcacgcacacuuguucgguucugaaagccuucgauagcucuggagacucacacugcaggagcgggagcgaugaagaggaaguguuuucucaaggaaaagccuggagcagcacuacuaauauaaugacaaacagaaauaacuacgcauacucuucacuauuccaaauagcucaguggguauuuaucugaguauuuuacaaagcaccuagguaccaaaaguuaaaaauguaaaacuccaagcaacaaccucaguuaacauucucuuucugccuagcaggcagcugguauucacaaaagcaucagcacucacagacagaggcaggagaauugccacuagcucaaggucaaccuggucauauacugaguuccagguuagccagggcuacauuaaaucaaccaauugaagaaccaaccaaacaacccacccagaccacagaaacccacacagccaagcaugguggcacaagcuaucauccaagcacuugggagcuaugacagaaugauuggaguucaagaucauuuucagcaaaacagaguuuuaggcaagccuuggaucuauaucgcccggacucaaaaaauaaaacaaaacuagacccucaaaaaccaauacugagguuuaucagacuaaaauggcacuggguagcuuaaggcacaaacauuaaaacaaaacuucuuuggaacaauauaugaaguuaugacuucacuuucuauguucuaucaccuuuagcacuguauaaguuugauauuuaaggcaaccacacacauguaaaaggcucacauacaacauuuuagugauacuuauuuuuuuuuaaagauuuauuuauugguuauauguaaguacacuguagcuguccucagacacuccagaagagggagucagaucucguuacagaugguugugagccaccaugugguugcugggauuugaacuccggaccuucagaagagcagucgggugcucuuacccacugagccaucucaccagcccgugauacuuauuuuuauguguauguuuugccuguacuaugacaguuugcauaucauguauaugcaucaugugugccuguagaggccagagaguaguagaaccccagugacuagaguuacagacaauuguuagccacaaugaaggugcuuggaacccaagccagauccucugcuacagcagcaauugcuagugcuugcuccuaaccgcugagccaucucgcaacccgcuuacaaauaaaacacuuuaaaaugucuaaaauauuuugaaacaucucugguauuaguuuauacaccuggaagugcuguuugaugccuagcacuagauguggcaagaagcauaauuagcuagucaaaucuauugcaucacaggucagcgaaccugcuucauucugguuacgugauacagugaauuuucauguugguuaugugguuuggaacauaauaauggaugaaaugauaucauuccagcuuucuacacaaugccaaucaaugccauuacuguuucucacaugggaauucauguggccaacucugaccucaaacuggcucuguugccauggcuguccuggaacuuuccugaucuucuugucacaucucccaaggacuggaaucagacauugccaccacacucagcucuguaccacuaacuccagcaagaccaaaucguuuuaacuaguaaugucuuggguugacuaugaggcaguccacaggaagcuuccggacauuaucuugguaccacaugaagucuguaggauguauccucucaagacguuaaaggcacacacaaauaauccaacucccguucucucuucguguaugugcaugggcucucagagugauuuuuaaaaaucuacugucagaucaggaaaaagcagcacacaccuggguuggacaaugacaaaagcagaaaacccaccuuugucuuuccugaguuucaaaaugggggucugacagcagaugcagaaacaauucauauucaccaggagagugugccggcucaccaagcacugucaucuuuccaagcagaauggauguuuaaccacugcuagaagugaaauuucugaaacauauccgucuagagccaucaacuaaauggugagagugcuuugcacacccgaugggugacucagacaagccaaugcccucccugagcauuuggucguuuaaaaccugauuccaauggaguaaacaccuggaucccaaccgcccaucuaugacaaacggcuguggagaacccaauuccugucagucagucagugugggagaguacagcagacagggaggaagucaggccaccuuguggaguacauggagaagacuuggaggaggauucaaguucaugaaaauguacacaaaaaccaacuguaauuuccuguugauucacaaaacauaugaccuuuccaacugaacagccacaagcgguguuugcacgcuucucuccaggucugcuuccuggccuuguaacacugucguuacacagaucuccaggucugcuuccuggccuuguaacacugucguuacacagaucuccaggucugcuuccuggccuuguaacacugucguuacacagaucuccaggucugcuuucugaccuuguaacacugucguuacacagaucuccaggucugcuuccuggccuuguaacgcuguaguuacacaggugcacagauccuuaagaccagaucugcacuuucagaugaaaugcuuauuuuagaaaaugguccuggcuuccucuucuaacugcagcucucagaaggcaaagaauugcuaagaguuugaggcuagcacaggcuacagagauccugucucaacaauaaagaguacucuagaaauguucaaauuuagucuuauguaaucaaauugucuaugaucaacuaauuuuuuaauuuauacaaauuucugauaauuaaacugcaaaaaccauuggguguuugugauauauguacacaucauacuaucuacauauaaacacacacacauccuaacuuagaggcucauauaaacaucaccuaucaaaagaaagucugccaauuaugggauaacagaaugaagauagucugacucuaggaugguugauauagcccuuuuaauacauuuauuauacccuaaaauuaauuauuuuuuucaggacauaguuucucuguguagcccuggcuguccuggaacucagaaauuugccugccucugccccucaagugcugguauuaaaggcgugugccaccacugcccggcaaaauuauuauuuuuuaaaccagggcuuaccacuauuauuuaucaaggauuagcaaagguaaguaauuaaaggaaguuaaaauaccaauuggguagcuuuuaaaaguuaauuuucuaggauucagguacuuucugguaacuuuuaauauaauuuguaacauaaaaauuaauuuguuugaacaaauucugauuuucaggauuuuuuccaauuuacugcaauaaacaugagaauauaugaaagauaaacauuauaagauacaaguagauaauacuuuuacaacagacaaaaauacuaaaauacaaauuuacuuugaccaagucuuuuauauauauuuaugaauggacaugaucuuacaaauauacaugagaauaacaauuaucauuuguagaauccuaagcauuuauaaaacacuuuuguucacacacuuaacuguuaagaauuucugaacuaaacaauuuccauucucuaacaaaagcauaaugcagauacuuacuauaaaauuacaguacacauacccucaguuuuacauacaucuguugcucaccugacagaugauuuucugcauuguuucuauagcuauaucacuuauaauuuaugacuugaaaaccauuuccuaaguguauuuuuuagcauuuuucucagaauuuagauuccaacuaagcaugacucuuaaaauacauuuguauuauccuaagaugaggaaaaaguuguuugccaaugcuagguuucugauaacugccugaauuugaacagaaaucgauugacaccauugucauugacaaggaguauauuauagugagagacugggaaguuacacagcaagucaccugcugcagcccagggcacuggaaguuacaauaauuaguugugcuaauuccugcuguauucacuuaugugucuaagaaaaauuucacauuucccuuugcaaacugcuaagcuuuacaaaauggagguaaaaaaccuagagggaaaaauuuaauagaaaucugaaaaugaugaucaguauuuuauacaaauaaaagagcucucccaaauaagagauuucucucuggagaccggaacugcugcuggucagaguuacaagugagaggccccacugcuguaggauauuaaggaauuagacaacucuccuaggcuaauaacugcucacaaggcagcggagaggcacucacaaggcaucacacaaguuagguccaacucugucaggcuggguaggagcaaaccuguucuuguuuuucuuacagcaguauugcaaaugcaauuuugucuuaagauauauuucuuuuauacacguguuccuguaugaauuuaugugcaccauauauuuguagaugcccagggaggacagaagguguucgauucccuggaacuagaauugcagaaauugugagcuaccugauaagggugggaaccaaaccuagguucucugcaagugcaggaaguguucguaaacacugagccaucucuucagcccaucugguuucuuuugaugcacuucccagauccuggauacaggucugcacuaccaugccugggaaacagauccugaacacagacaccugccuugcucuguaaaagggauuucaacuccuauguuaguuuaaaggaaagaaauucuuuaguggacgcacagaugagucauuaaauacccugagaaccaaaguggaucacauuuuuuuuuucuucaauaguaauuuuaauuuuuccuuagggacuaauguauaauuuaaaucuccuuacuuuuacaucuccuacaucaacucacaaaaaguauuuaauaucagagaauagucuauaaagucauaaaauuugguauuuuaugguagcugaauugucacuacacuuuuacaauuagaaaaaacaccaaacaaaaccccaaaaagccuucaauagaauuaaccaguauggauaaagucauuucuuggggcuugagagauggcucagugguuaagagcacugucuguucuuccaaaggaccgggguucaguucucagcacccacauggcaguucacaacugucuguaacuccaguuccaagggaucugauccccuucuaccaauguacacaaaguuaaauaaauuguuaaagugaacgaaugaacaaaacaaacucauuucuuccucucacaaugaauucuaaacauucuuaacaucaggcaauucaaccaaaaaaaaaaaaaaaaaaagcuucauucaugcaauacucucuacauaauugacaaaaacaggacacacuccugaaaaaugguucacaaaucccuaugaaguuuacacugggcaguacugccuaccccacauaguauuucaaaaaugccaaaguauauucauaggccaaauuaugacuuuuuuuuuucaaaagacaaggccuuauuguguaaccuuugcuggccuagaacuuguuauguagaccaggcuggguucaaacguauagaagucugccuucugagugcugggguaaaggugagcacuggucucacucaaccaaccucccacccccaguacaggaaaggauuuaugacugcuugaaauauuggaauuuugggucagaaaggcaucaggauuauuuauuucuuuaugcaaaggaguugaguucucacguggucguuuuaaaaacuuuccucuuggauugacguuggcuucuugugugagguauccuggguuuaguuagagcuuaaagcacuucucauuguaucuaugaauaguuacacagccgugguaggacacuggccugggcauugcagccacuccugugaugauacuugucgcaggaucguaacagagaauaguaucuguggcuucuccauuuucccgucuuccacccaggauauagauuuuaccauuacaaacagacauaccacaguuuuccuguuuaaccaaauauauaaaaaaacaaacaaaaaaaccaauuaacuauuagagauaaaggauuugacaauaaacuaaaaaagcaucaacaugcauuaacaaaauauaagaaagggagacauaauaucccuuuugcccaacuccuguuguauguuugaguguugagauuuacaugaagugaauacuaagaugaauuguuacuaacagaggccuagaugagauugacaaggcuuucauuccaguauaggaaauaagcauuuaaaaaaccagagcagggcuggagauggcacugugcuuaagagcaucugcuguucuuccagaggacccauguucaguucccagcaggcauucuaggggauccaacacucuuuucugguaucuggggcaugaggggaggggaguacuuauacacauggaaugcacacacacguguguacacacacagacaccucaaaccauaaggggaccugguaaauggguuucuggguaaaagauguuugcugccaaucccaauaauuuguguguuccauugcaggacccucaugguggaauccuacauguugaccucugaccuccacaugugcugugacacacacacauacacacacacacacacacacacacacacacacacacacacacacacauguaguaaugacacacgcuuuuaaucccagcacucaagaggcaggcaggcugaugucugaguucaagcccagccugguuuacauagcgaguuccaggacagccaaaagacagggacagagacagagauugaggggggagagcacaaagcaaucccuucuuggccuuuuagcugagaacaaagcaaagaugagauaucagaaggucuagaagaaaguggcgagcuuuagaguugcucaggaggcuucucauuaaggggacauaaugaaauuuauuggaaaauaacugguagcaaacugauauagagaagcuauaccaguuagaggacagaauucuaaggacagguuuaaugugugcuucucucuguuagagacagugaaaaaaccuagcuaaggauucugaaacaucaagauagagacagcaugagagaagcaggcagauuccucucuaagucugaaaccuuggugcaccaugggcaaggccacacagcaggugcaaacaggcauucgaaacaagaucaaucgugagcaguaaaugaaguaagucaggaauaaacuagaguuaagucaugagaaagaggccuaagcaacacucauauauaaagacuuaagaagaaaaagguaagaaacuaaaaagaaaugaagaaaugacuacuagugacuugucuuuggagccugggcaugcagaaaugaggagggugaagaaaacagaucugugaguuacaugccagccaggguuacaacgugagacccugguuuuuguuuguuuguuuguuuguuuuuuuaaaaagaggaggagggggaggagaaaaaggaagaggagaaaaagaaaaaggaaggaaggcaagcaaaaaucuagccaacuaaucaaacugagaaagacaaaauagagccaacaagugaaaaaagaaagaaagaaagagagagagagagagagagagaaagaaagaaagagagagagcgagaaagagacagaaaguuucuggauggacagauggaaggaauacauuuugggagggcaggcuggggagagguuaaggacaccuccuucccuugcagaggacugcaguuugguccccagcacccccaucagguagcugacaaccaccuguaacugaaacuacagggcacuggcccgucuucuggucucucugggcacucacauuccugugcacauaccaacacauucacuccauugugcugucucccucuacaucaucguuacugauacgaggagagacaaaguucuagccuuaggagcagcauuuugguaauaaaaggaggauaagcaaagccaagaccccgcaaguugggagccuuucugaaauagcagagaaaaaggggagcuggggcuucagguggaauguguggaugaaugagguaugaacacaaccacuuccuuuauaacaaaacaacgaaucagacuacaaacagagccauuuucuccuuuucugaaauauaaagagaaaggguaggaagacuagaaugaaauucuaaaaaagguaaagguugaauuuuuuuaaaccaaaagccuaaauauagccgggcacgguggugcacgucuuuaaucccagcacucgggaggcagaggcagguggacuucugaguaccaggccagccuggucuacagagugaguuccaggacagccagggcuacacagagaaacccugucucgaaaaaccaaaaagccuaaauauaauggauacuuacuguugggcuauugaaugguaaguuaguuugcuaaagcuaguccuuggggcagagcauggaucuggguaggguguaccuagugucaugaggcucuggacccaaucucagcaccacaaaaacaaagaaaaaauaaaaacaacuccuugggaggaaaauuuaaaauauauuaacuauuugaaaagugagauuccaguaaauaaucaggucacuuguucccucuuguauuucugucuggacucucugugcuuuuaccugccggcugaauguguuuuguacaugcauccaguagucuucaacgggaucguaacaauacacugccuuggucagcccaccagcuacguagaucagguuguuuaaagagacagcugugaugcaccucuuggcgauagggauagcugcacgaaguagccaagaauugguuucugggucauaagauuggaccuaauaauacagaaaaauauggaguaaaaugucuauauaaauaugcaaaucugcuuuaaaaauguguuaauauguagaaacaugguuaaaaauaaaauccuguuaauucaaagaaauaaaugagguuacucugauuaacaaaauuuauguauuaggaaaauucuugcuucuuggucaaggauaaaacuccuuuguuugaaaaaaaaaaaaaucaaagaaaggcuaauuuuuuaccaucaaacauaagauaguaacaaaaugugggacugugaaaggcagccuguuuucugguccagcuagguuuaaacccgggagacccagcagaucaaucugcaagggacgcggaaggccuguuugccaugcucccagauauaggcuccugacacaaggacccagcuccauaauuuuguggccaucagucacauaggcuguccacaguccaccccacaguuaccuggcaacagcaggauggcuagccacuauaaaaggagcuacuugccaaccccgccccccugcucuuacuuaacucuugccucucucuugcccucuugugucccccccccccccacuuucccuucucuccucucuccauguggccauggccggucucuacuucucuacucuucucccucucucuggcuuucuacaauaaacaccuuaaaaccauggacuaccucgucucauugggacccgccacgcuggaacaauggagcagguuguucucagagagcuguucguccaaccuuccaaaggaagccucucaggguucccagagggucucuaccacaucaagccuaggacucuccuccccaagggaaccagccggaacucucuccucccuguccuuuucccuucggcccagggccagagcccacccacaggcucacacucuguucucagcucuucuguggugcaagccaacucugacagguucugcagggaccucagacugcggcuccccaccacuggaguggauccugaggcuucccacagacugaugcacuauggguggguagcgacauggggugugcacuagucaaacuuccugcgucugccucuaugaguggcucuagcccuguguuggacuugacgcaggaccccauuauuaacccacaacaaaauacacacagaauuuuuuccaagaggaauggccucuagguugacuuauauacacuaaauucaagucuuaaguuucucugaaauugccucauguaaauuaaucaucucucaaucugacuauaauuucuuuaugcuuuuagggaguccuuaccucagaagaacagcaagcaagcucaguuuaguauauuuuuaaugagcauaaacucuguauguauugucguagugcccaugugaaggucagaggaaccugcagaguugcugcugcccuccuauaauuacaggaucugaggacuucacccagacugucagguuuggugguaagcacuuuggcugcugugccacucgcuggugccauaauauuugaugauauauuaacaguuaguaggaaaaugauuugaaauuucauuaucacugcuaagccaauuauccauuggauacucuucccuagaauaaauaugaugucuaccgaaaugccaggacagcacauguucuucugucccagaguugggugaacugcugcuauuugggccauccucuguucacgcuauauaggcaaucuucccucuucuuuuguuccuuucaaagguuuaaagaaaaugaccuaguuggaagcaguauaauuuaccuuugcucauuaauuuucugugaugcauguaacuuuuaaauccuauagacgacaaugaaguuuaacccugagauuagcucauuucaaaaagguuuaaucccauuuguuacacauagaaaaucacuggcugcauuaugguaucacuauggcaacuuggaauugaaugccuuuccccucaaagaagaaaauaccagacaauuuuuaaaagaucccucacauuuaguauccuagccaucuaucuauucaagagaccaccugucucucccuuuuguacauagcauggguaguuucucuaagcauaugucuuaccuuaucagaacaaguauuaucaucagguccuccaccaaucacaaacaauuuuccuauacagcuugucacugcaggagagcucacugcuuccuuaaguggagcaacuuccguccaacgauuugaaaaggaaucguaacacuccacacugcuaagccuguuuugcccaucauagccgccaacaacauacaccuauacauaaaguacagggaaaagaaucuuaauuagcaagucuaaaauguuuaucugcucuguuaaaauuagagaaucucucucauucaaggacuugacggcuauaacuacaguguauuuagcucaguuuucugagccuguuuaauuuuuagcaccccucuaugacuaauacagagccuuucuguuaugcuuccuucagggacauuuuaaucccacaagcacacuguguauuuguuuucccuacuguguaugugaucuaugucuuguaugugugcuuuccacacccuuggaugaauaagucuuuaccauaccugugggaauaagguuuuucauguuuuguucacucaacaaugagcuauuugauuauaaaguaauaaagccguguaaguguaacacuagguaagggucagcagugugagcucucuaaaggcaaggaccaccuuucaguaccuauagcagcaaguaaaguacuggagacauaguaagcucaaagggcuuucucaauauuuuccaugaauaaugguagggcaaccuuuacaugacagguggaacaauaaacauggcauuuaguaaauggcuuaugcagaaccauccccuguggaucgugcggguguaucagaaauuuuuauuaaucaacuuuuucauuuuacacccacauuucuuuuaauaaacaauuauaagcucuucuuuuggagcuggagagauggcucggcaguuaagagcacugacugcucuucuagaagucucgaguucaauucccagcaaccacaugguggcucccaaccaucugugaugggcauaugauguugucuucuggugcgucugaagauagcaauaguguacccacauacaugaaauuaacaaaucuuuaacaaaacaaacaaacaaacauacgaacaaacaaacaaacucuucuugccacauguaauuaacugcgaaguccaacugggucuuccaaagggucucucacaccugcccuucuguuuguucuccaucauuaccauuuauccaagggucugcaucauuucauaguuccucaaaucacaugccaaccuucugcaaacaucaccaaucaauccuuuaacagagcaucaaugaaugcuuaagagucgagcuaaacuucacacuuuguaauuuaaaucuggccacaauuuagcucggugccucugugccuccacaguaaccaaugccacuucuguacauugcacuuuucucaugugcaaugugaccuugucuuaaaaaagaaaaagaaagugaauaugggcuggagaguuagcagucaggaacuccugcugcuccuacagaggacccagguucucuucccagcagccagguccagaggaucugacaccauuuucuggccuucaagggcacagacacaggaauacacacaacaaagaacacaauccaucaccacuaccaccccaacacacagagaguaaacaaacguguuggagagcuuaucuucguuuuauccccucuugcacaaauaaagaaggcgaaauaauacuacuugagauaaacauuuuuucugcuugauugccaaauucagucaaagggaaaaaguuguguggccuagacacuggccugguuuuguaaucugacauaaugcuuuucuaguucuuaagccuugggauuccaauggguaagaaaugugcuguacugcuacaaaucugaaauugggagaacagaauaucuauucaaaaagcacagugucauauuguuuaugucuuuaguuuaucuugguuaguaauggaaggaaauaccauucgaagccaaaauacccagaggaaaaugcaagaugcagcuguggcauuucuuuuggacauuuaccagcagaaauaauaaaaagcuuuuucucuuacuuuaccaagaaggacagccauuuugugacgccaucugccuuuauuuagagaagcaacucugauccagauauuuaacugugaauuauaaauccagacaucacggcuguugauucuuccaccuucaaauguaaaacaaugcacaugugguaauaucacuuaaguacaaccagaggccaaugccacuaacacagguaaugaagccgaauuuuccuguucaauucaagaaguucagcauuugcucagcaaauaaaggaggaaccuucuauggcuuaauagaacaaguuacacacagcagauuuaaauucugccaacucuuaucuugaaaaauagugacuguaagguccaaaauaauaaaauacagaaaguggguucuauaaaccaggcaucccagauaaguacaaauaggguaauucuaaagauguuguaaaaaccacagaaaaucagguauauguccagaaccaaucacuggguaguaaaauagcaaucagcaauaacugcuguuaaucaacaggcuucaaagcauaaacacuagcuauacuuuuucaaaucugucauuuugucugacuuuuaggacuacaucauauauaauaaauauguucaaguuaauaauuuuuauagguaaauucuaauugauaaaccuggggagagaauuuuagaaaacaagcaaauuaaacauauuuaauuguaugaauacuucuaacuuuacaguuuauaaugauucuuaaaaaaaaaaaaagaaagaaaaagaaaaaaagauaaaccauaacuucuauaacuaacuuuuagcuagagagguggcucaguggcucagugauuagagcaguugcugcuagcccggaagaccugaguguacucagcacucccguggaggcuuacaacuuccuacaacuccaacuccaggagaucucaugaucucuuuuggccucugaaggcacuucuauguucuucugggcacacacauauauaaacacacacacacacacacacacacacacacacacacacacacacacacacaguuaaaauacauauacucuaaauguacauaaaagcauuuaaaauauuaugaccaaaccaauuuuugguagaacuuuuguaaguauucuugcuuucaagggcaaaaagucuuuucaguuuuguuguauaaacuuguuuaucugaaauauucauuuuacacucaguaagucauuaucauuuaaaaacagccaaucugauucccaaucaaaaguuguagcuacuauaauaauuuguauuuaccugaaacaagaauaucauuccucagugcacagacugcauacucggauuugguaaauucuggaagcuuggccaaggacuuccauucuccuguuacuggaucauagcacucaguguauggaagauuaaauccuccaacucguucacagccuccaaccacaacuaucaccucugaauagccaguagaccuaaaauaguuauuguuaagaaugcacaaauaauaguuaagugguauauuaaaauauaaucaagacuguuaaaauauaaucaagcccuaacgccaugacaggcaauuaaauuuguccuugcagauaugcugaacaguacaggcugccagugauuuacuuugcaaugauucauuaguggcaucauuaugccacagaaaauaucuacaaggauuuuucuuuuaaaguguuuuagguuuacauguaugaguguuuugccuacauguauguauguguaccacccaugagcuugguuucuacggaggucaaagaaugggacuggauacuggauacccuggaauuggaguuagggauggcuaugagucaccaugugggugcugggaaccaaucccuggucuuuugcaagaguaucaagugcucuuaaccagugagccugccccuacuauuaaacuuuuucuucuucuucuucuuuaaaaagacacagccucaaaauaucacccauccaggcugguuuaaacaucaugauccuccugucucagccugagaauacaagugagugauggaaaagggauuacagccaucaaaccugucuuuucugguuggcugguugaucuagauacagggucucucuauguagcucuggcuagcugggaacucacuauguagaccagacuauccuggcacacagacucacuaguuucugccuccugaaugcugaaauuagaggcaaggaauaacacucuggcuuuuauagguuuugacuuuuuaagccuucuguuuugccauaguacuagggucggaaacauggucauugggcuuucaaggcaagaauucuaccaccuuuuauuauugcuaaaaacaaauccaaugucuauguauuuaagaguauuucuucagaaauaaguuauuauauuugcaaggucuucaugcuguccacuagggauauaugaaaucaaagaaaauucaaaaacaucuguaugucuaacuguuacaauaugcaugcauccauuaaaaauggagaucacaagacuuuaaaccuuaaagagacagaagaguucuccaucuguaagaucuaaugcuaucaauucauuguauuaucuaaagacaggauuggccagcccuagaagaaauacauaaaugaaugaaggaguaaaagaauaaaucauagagugaauauuugcuauagccacucaacuuauugucucagcaauauugacuugaacauuacaaauucuuuggcaggaaaaauuuuaauguugggugaauuucucaaguugcuaucagcugaaaggacccaguucuaaagcucuccuguagagacuugacuauaacaacaugcugagcaggcagcuuuaacacauuuaaucugcuagcugguucuccuccuuucucuuuuuguaugguacuaguuuugaacccagggccuuguacaugcuaggcaagcuuuuagcccccaaccuaaauuuucaaccucacaauuuuuuuaauuuuaauuuuuaauuuuuaaaaauuuuuuugugacaggacagggucucacuauuguugcucaggcuagccuugagucguugacauuguaaucuccugguaucagccaccagagcagaauagacuaacacagacuagaagagaagcaaguuaauugguuucucauagucaacauuagauccaccccuacagaaaucugauuuucuuauuuucuaaacuuggcaaggacacaggagucugugugccagggcucuccacugggaacuaccccaggcaggcggcuuuuauaaggaaaacaaauguagugaccaagacucacaauguuuacuuuuaaaaaaguggcaauuaacuuuagaugccccaguacaggggaacaccagggccaaaaagggggaguggguggguaggggauuggggggguggguaugggggaccuuugggauagcauugaaaauguaaaugaggaaaauaccuaauuaaaaaaaacugaaaaaaaaaguggcaauuaucuaaaaauuacuauugggaacuaaugguagaaauguuuaaauacugagacacaauuaugcccaugugacuuaaauguacaauguucagagacagcuuaacucugugggcagggugaugauuauuagaugccaugacacagaaacacguucacgccacaaagcacggugaucauguaaauggauaguacauucauagauuaaaaagacaucugaguguggugucacauacuucuaaucccaacccucaggaggaagaggcagggggcucauaaggaggcagggcuucacagugagacucuguuucaaaaaaaccaacacauaaauggacauaaggucaaacugccuucuagguauuuguguuuauacccaaagugcugcucucagccuugaugaaggaagcauuuugcaguaggcaguggguuaaaaugcugggaacaagugacugguaaguggaguucccugaaugagacaaucacuaccacacccuuccaaggcucagagaacacugcuaagagcugaagaacggcagagugugaugcagcucuauuuucuggacacgccauggcuguagcaguaagaaauacacagcagcuguagcaauaaggaccacacagguuaucuguacaagaugggaccuuucaacauuucaccauggaugaaggaggggccauaaagcuccauccuucccugaauugcuauuggcauuaaugauggccagaggagagaaagucacuuucuucaguaguacagucuuggguaagcugcccaagugccagguaauacucucccacauaugcuuugaacacacacauaaacaugaaaguagaggggugaguggguaguugagaagggggcuguggucagcagaaaugggagaggguaagagcaggaacugugguaguggaucauaauauauaauacauauuuauacacaugaaauugucaagauaguaauaaaaaccauuaagacaauaggacuagggaaauaacuuaguugcagaauaagcccugagucuaucucuaguaccaaacaaaagaaaacuaccacaucucauaguagucaugaguuccuccugcucacagauaagcauuagagaaaccagaaauguuauauaugcaggcuuuucucuuaaagcggaagggauguguguaccugcuuucuuccuagaaugcuggaguggauguuguuauaaccuggugaucuuuuaccuacagagccaagcuucaccagaauccuccaaaugcccagacacuguuucuuaauagaacccauuccuaugaaagagguucuauguacuugcaaaagaguuuacuucuaugcuuauuacaaacccuuccucccuagucccuggucaugaacacugauucucagugaauagaaugcauccuuauggaagaggucacauguaguuugcaaaggaguuuugauauaaucaugccuuaagcuuuguugugaucacugucacaugggaacuuuuuuccaaacuuguacuaagcuuaaauauaucaaaaauugacugacugagguaacaacuccuugagccaggacagcuaaguccuucuugccuccugaaguuguuucucugcuggcaguagagcuuguagggacccccacaacaucuugcuuuuaauggucacuucugguuguuuguccagacuaauauagggugagguuuucaauuaacaucuuuuugcuuagcuauucuacucccauguggccagaaaguuguucuaaaguugucuggcuaaaguagagauucauucugagugacagaacaguaauacacaaaugcaaacccaugaguagccauguucauauuagccaaaggacagaaacaaucaaaaugcccauuaaauaacuaacaguaaagacaauggggaaaaaaaauuugugagccaggaauggugguauucaccucuacugaugccaguacuagaggcagagagguaggcagaucucugugaguuugaggucagccugguuuacaucucuaaucuccaggacagucagagauacacaaugagauucuuucucaauaaaauaaaauaaaacaacaaaaccuaauuauguucuauccauacauagaguacuauguaaauguugcuuaagagaaggaaguagagguggcuggagauggcuccgugcuucagagcacgaacuggucuugcagagcucaguuccuaguaccucugucaggcuacucaagugccugcaacuccaucucaaggaagccaaugcccucuucuggccuaucuguugacaccacacacacacacacacacacacacacacacacacacacacacacacaaacucuugagaacaacauaggaagcuuuucuaauaacacaaaaaguaaagaucugcacguggucacucagaacccagcugcacacaguuaaacacgguuuuacagcgaggccuuugguuaaaccuccagcacuggcaauaaaaaaggaaagccaggaacugccaagugguaaaggcaagggaaggaacugugagggaagccaugugccaucuguacagaaaggcaggagacacggcuacauacacauuccuacaccgagaauauuucuaaaaggaauuaaaaacugguaacagagguaucaucugagaaggagcgcuaaggagugccuaagggucagguagagggaaggugcagagcuuccuguaaugcagggagcuggaauucauagaaaauaacaaagccucgugggaaagcauagggccuauacgcuuauccuuauaaaucccugcaacacacggcuuggggacagucucagcugggaaauuccagagaaugguccugaccaaagucuaucccuuggucagcauuuaauauuuaauaaagcuugcuuuaaacuuggcucaaaauaguggaguugguuuuaucucaggauuaacaggaaacgcucaaugaauacuuuguauaaaguggcugacuucaaagcauuuaaacauguaauaauggugaauuguacaguccagccacaugggagaauaucuuaguuaagaugcacuagaacaggcaucuacauguguacuuacauagauggaggcaaacacucauuaacauaaaaauaaauuaaaaaaucagcucugagaacuugcugcucuuucagaagaccuagguuuuugguuuuuugcuuuuuuugguuuuauuuuuuucaagacagguuucucuguguagcucuggcuguccuggaacucacuuuguagaccaggcuggccucgaacucagaaauccaucugccucugccuccaaagugcugggauuaaaggugugcgccaccacuacccaaagaccuaggauagauucccacagggugauuugguuucagcauccacguggugacucacacuguccauuucucuaguuccaaggggaucugaugcccuccucaggcuacugggggaacugcauccacaugguguacagacacacaugcaggcaaacaagguaaggcagcacacacgguagcugucauugugcuuugcuuuguuggauccuccaaccucuacuccucuccacccaguagccccguccacuuucugcacucuacuacucugcccgccccugacagaaacccuuucuccucucaugguugccauuugacuuucaucaccauacuguacuuacuucuacaagagugaacacauguaaauguuagaagucaggauucacggauacaacuaaccgcugggucuaaccucaauaugacgaacuuacaaacucuuaguucuuccgaguauucaaccccucacccccaauaggaaguauuugccacacauggucauuauaucagcaaagacuugucugguucauucaauguuacccaugcugcuacuugggaaccucauuuguaggcagccuaaugcaggcaaaacauucauacauacaaaagauaaauaaugggguuaaugagauggcucaaagguuagggacacuggcuguucuuccagagggccuggguucaauucccagcacucacacugggucuaacaacugucuuuaacuuuagcuggaaaggauuccaugcccuuuucaggucucuauggguucugcauguauaugguacacagacuuagagguaaacaaacacccaugcacauaaacuaaaaaacaaagaaaaacuuuuuggaaagguaaacuuaggacuaaugagauggcucaguggguaaaagugcuacuauguaagcuuggggaccacuguauccccagaacucaugcaaaggugggaagagaaaacugacuccacaaaguugucaucagacugucacacacaugcuguggagugggcacccacaaagauacaacccugccaaauaaaucuuugccuuccauuauuaaggcauauauauauauauauauauauauaauauaaaauaaaauauaaaacguauaaaauaccaacaaucacaguuuucuccaaacauaagguuaacuauucuucaacauggauguaauuuuccauuucaggcaaaggaccugagcggggcauggucccaugucaguagugcuaguacuugggagguagaagcaggaggaucaagaguucaaagucagguuacauagauuuucaaggccagccuagccuacauaauauguagccuaguaugucaaaaaacaaaacacuaaaaaagucguugaaaguugagacuggcauuuaguaagauuuacauaguaucugaagauaaccuuuaacucauccaccagucucugugugcuaagauuacaauugugugcuuccacacccaguuuauguagguagguccucuacaaacuaagcuacaucccuaaaccagugugucucauauaagcuauacacucaaaugaguacacugagacugaguucacgaguguaaaauauauaguuaaaacagcaacuguuacuagccguacuuguaaagcaccuucucaccugcguggccuaguccuuggggacaucauuucauugccaaguaugugguaccgccuugcuucgugcagcaacugauaacacucgggggaauucuggaucaacugguccacuucaacugucugaacaaaguaguugggaugcaagagaggaagccugacgugcgucaggagcucauguaacaguggucuucgcagaucaaccgcccgguagacccagcgcaugacggccucaaaaaccaucuccucuuuaccaauaacaaguucaucacugcagauauaaucaauaaguucaucuuugucaagcucgagaaauucuucaugcugggacacauccucaaaagucuguaaugcaaaggucuugcauuuugugaagaguguuuugagcgagugggugucggcaaagcgcuggauuccuaggcaauugcaaggaucaagcuguuccucuaagaacuuggcacaagcaucacggagaacacuaaucugaaagaggcuggagguuucgaagagguacuggacauucucuguugugaucuucaccuucccaguauacacauacugcagaaagcauuccauagcuucagcuaaaaugccauugaucucaaccagcauuucucggcucucccuguggucguuacagaacauggcucugaaguagcugcugcaggcugagaggacagcucgauggcaugggaauucuuuuccuuccacacagauaaugacaucugugaauaagcggcugucucggaacucauuaaauaucuggaggauguuuucagcaugggaugauccugaagagaagucaaaauacucaugaccugucagagauuugggguccauuucaaaaacuuuacgcuuaguugcuggggaaucacgcaccccaagauccucucuguuuaaucugcgucccaauauuaguaccauuguuacaucaguugacuauauaauugcugagaaauggcuccuagggaucuucuuuauguaacuaaaaaaacaaaauaaaaauauuuagacaauuucauuuguuuuguaaauacaagucacaugauuagcauauucuacaauauacacuagcuggcucauuuuaauaaaaaccgauaaaaguuugcauuugcaugauuagaacaugagaguuacuuugcaauauccuaguguauccauauguauucuugccuggccugcuggagcucucuauguagauaagacauagcuaagcaugaauuuauuacauagcuaagcaugaccuucaacuuuugcgugguccugagcucaaaggguuauacauucucuuuuagaugcucaguuucuacucuguucuacauagcaaagagaaaaaaagcauacagaacuggacuaacaaucuucaacuauuguuuugguuuauuugaaacaaggucuucccuauacauagcccaggauggucuggaacuccuccugccucagccuccuggaagcuaugauuuauaggcacaccccacaggcauggcuuacagcuagaaucuuaauauaaacaauuauuaccuuaauauaacagcguuagaauuuaucuaucacuguauuuuuaaauauguaaacuguaugaccagccuuauuuucuaccauuuucucaaagaaauaaucaauaauuuuuugaacaauuuauuuauauagauuuucaguguuguauuagcagaaaauacuuaaaacaagcuaaaggcccgcaacuaaaccucaggauaucuuuaagauagaguaguuuauuacagcuauuaaaaaguggggacauagcucaguugguaaaguguuugccuaguaugcaugaagccuuggguuuuguauuacauaaacuagguucauaguaaacauuuguaaucucauuacuuggagguggaggcaagaaacucaagaguucaaggucaugcuuggcuauauagugaguucaagacuagccuggucuacauagagaguuucagcaggccagccaaggcuacauaagugagaccuuauucuuaaaagaacaaaaaaggccaggcagugguggcucacgccuuuaaucccagcacuugggaggcagaggcaggcggauuucugaguucgaggccagccuggucuacagagugaguuccaggacagccagggccacacagagaaacccugucucgaaaaaacaaaacaaaaaacaaacaaacaaaaaccccaaaaacaauaaaaccaaaaaagaacugucuuuagaagagugacuaaguccuuugguuacucacgggcagucucucugagggauugggacacauuucuuagucauagauaggcacuguuacacuggagcugucacgugccugacaaccugaguuagauccccagaacccaagcaauuaggagaaaacuggcuccugcaacuccuuuucugacauccagaugcauucuguggcauacaugugccuuucaacaugauaaacaaauaagcgugacagugaagagcugggccuaaauaacaugcacauuuaacauuguaaugcagaacuaccuauuuauaauggaaguuuggagaaaaauuguacuaguuaggguuacuaugcuaugauaaacagcauggccaaaagcaaguugaggaggaaaagguuucuuuccgcuugauacucucagguuacacucuaucacugggaaagucagggaaggaacuugaggcagaaacugaagcagagggcaugaagaacuguuuccuggcuuguaugcacaucacgccagcugcuuucuuauguagcucaggaccacuuguccagcgauggugcugccccaagguugucugggcccaccuaugucaaucaucaaaaaaauguccuacagacaacuacaagcaacccaauggggauauuuucucaauuaaaguuccucuuccucaaauaacucucgcuuguaucaaguugaaaaacaaacaacaacaaaacccacccccaaaaaacaaaccagcacaaaaauacaaguaauaaacaccucuuccuauuuucuauccuuaggugaauuaauacuguaauguuuuguuuuuguuuuuguuuuuuuuuuuuuguacagacuuaucuggcuuuauauccagucuuuagaagaguugaacagagcaaaaauuacaaaaugauaaugcaugauaauaugcaguagcacagacaagaugccaaauagauuccucucuaacuuaaauucuuagcacuuaagauuccuaacauaacuaaagaacauaauauucuuugauguccucugagaaugagcacaaggagguucaggaucaaccaagcaggguggugcaugccugcaagcauagcacuccagugguagaggcagguacugaguccugcauggccauggaagggacagcaugguaugguuuucugccccuggagcagagauagcaaggggugggcccccaguugugcugacaguugcuguggguguggguguagggcuuguuuguauaauaauguacauauuuucauguuccuccuuuggggagcacucuccuuguuaaaguuaaugacuccaugauaauuagaaacagcaugagucugggaggugagaauguguuccucaacaaaaugguaaaugcuguaaacuucaggauagcccauaaggcugugggaaagaacucugaaaacaugaguucaagaauguauaauuucucacuaugcaaaauauaaggauucauuaugaacuguaugaggcggcuucauggaccagagagaacaaaggcaguugcacuaaugagccagauuaucagaaaaauacaaaggcagauuucugaguucaaggucagccugggaaagauggaauuuggguccagaugaggugagaauaguuaucucagagcuagaucccacccagguagcuuauugucuguguuuacaaaggcagguagauccugaguucaagaucagccuuggacaggguaaaucuagguccagggguuguaggaauuguaaucucagagcuggauccuacucagcuagcuuauugucugugcuuacaaaggcaggcagaccccuaaauacacuugcuauguuaaaaaaauguauuuguuuuuuucuaugaaucaaggggcuauggucguaaagugcugauucgugggauaauaaaacaggacccuggguaaaugauugaauugauauguaaaugaaaaagacugggcuuugguaugcaagaggugagcugucaccaguucaaguagaacacagagcugucagguuguacccacaauugacuucaaguuguucuuuuguaguucccaaaccaaguuguauuggaagcugagacugguccuuggcaggcaggaacaucacauguucaaggucauccucaguuaagagugaguucuaggcuagcuugggauacaugagacccucucucaaaacaagcauacacacagaaauaguuaugacauggaaaggaauucguauuugaaucuuuacuagacuagauucaaauuaugguuaaauuaguuaaaagucaguucccaaaucaagcauccagaaaaaucaaggauguauucuuuguaucagcuuaucuaguuuaucaucaucaucaucaucucuguauuucaggcucagaaaauucaauaagcaauuaggacuuugauuagugauauaacgacugguguugacaauaaaaaccucuuuaagcugggaauggcaauauaugccuacaaucuuagccaugaugaggcagacacaggaagacagcugcaggucuaaggccagccugacuuagagagauacacugucuaaaaacucaaaacaaaucaaaccaaccaacuagccaacaaagacaacaaaauuaccaccuuaagaagaaacaacccuuuaacacuucaucuacuagaccuuggcuuugcacauauuugcauuuccuugacaccuauaggaaaacaugggccugcuuucuguagccagggcaauguauggaguauuagguaaauuaugggacauaaagagauuaauuaaaacuugcuuucuugcugggcaaugauggcaaucaucuuuaaucuuagcacuugggaggcagaggcuguuggaccucugaguuugaggccagccuggucuacagagcuaguuccaggacaaccaugccuacaugaaaacuuugucucaaaaucaaaacuaaaaccaaaaccaaaauaacaaaaaaaccaaaacagaacaagaaccccuugcuaucucuuuucuaagaacacuucauuaaccagcauuccacaacagaaacaaauacaaauucuuacuacuuaucacaggguaggugauuugcagucaucuuacaguaugauaugcuuucaaaguauaacuuuuagucuuccauguaaaauuaaucagccauuguuuucccauuuuuaacaaauacaguuuuacuuaucuauuuuuuuuacaaguaaacuagcaauaguuaaaaauuaaccacauuuccugaguguugggauuacaagugugccucaccacacucaguccgauucuguguugauagaauuggucacuguuauucacuauuauucuuacuagcaccaaaugauccuggcuuaaagaaaugaaaugguuuaaacuaguaacgauguuucaauagccaguaaauauaaauauaccuucucagcauuuguuugaccaaagccccaggcaaaauacuuguguuauuuaaauuuucacaccuaaaauagagaacagugacauauaagacagaugcuaucagcucaaguacauuaguaauaugcugaaaacaguucuuaguaaauuacaacuuuuuaauuuaaaguucaguuucauacagaucauuaaaaguaacacucucuuaaaggaaauuaauuuuauauucaaugauauucaaauuucuuuuacuauuuaugaaagcaguaagcuaaauuugauggugagaugaagaaaaguauauccugugauaauuccacuuugaauauuugaaggaugcuuacaaacuuacauugcauucaaauucgauagaauuaaguuacucuaagaguugaugucuuaaguuuaggcagauucaaaguugauaucaaagccaaauaugucaagaguaaacaguuuauucacucuguacuacauguaacuauggaaucaauuugagaaaagucucaagaguuaaaagaaaaaaaaaaccucaccuaguuuuaauuuaagcuuuuauuauauaccuuuuuauauagaaccuccaagcuuaucaaguaacuuuaauacauaauucuucugcuuuacugaaccuuacaauguccacacaacuaauucagcacaauuuuugugagcuauugugcguaucuggauguguguguguguguguuuguguguaggagauagagaagaaugcuuaaaaguacauaccaggauuuagaguaguacauagaauagcaauuauauuuaacugcuguucugauccaaucauccauuaagagaacuuguacauucucaaguuuacgcagauucaaaagucgauauuaaaaacaaauaugaguaaccaacuuaaaacaaaaaacccaaaauaccacaaucagaguaagcuaagauuaggacaugaauacuaucuuguacauuucuuuacuuucauuaggcagaauaauuuaucuguacacuugaugaagaauauugggucuugguaagucaggugaugguuaguccuaccuaaguaaguauucuuuaucaguaguuaguaaggcccaaagccaaugagaguccuacuacugucugacacuaggguagcaaaugcuagauccaaauucaauuuuagacacuguaggguuggcauuuuuacugacugaaaaggcuuugcuugacuuaugcucuucacuagaccugacauggaaacaaugucauuuuguagcuccccccacccccaauacacucacugcauuuuuauuuaaaaaugaaaagccuagcaaaacaagagagugaacauuuguaaccccagcacuccauaagcugagucaggaggaucauugugaauuagagacuauuuuaauuuacauagcaaguuccaggucagccaggacuacaaaacaagucccugcugugaaugagagggagaaacggaauuuuuuuuaaaagauuuauuuauuacauguaaguacacuguagcugucuucagacacucagaagagggagucagaucucguuauggaugguugugagccaccaugugguugcugggauuugaacuccagaccuucggaagaacagucggaugcucuuacccacugagccaucucaccagcccgaaacagaauuuugacaguuacuuuuucugcuaacaaaauuaguuuuggcuuauuacaaccaaacuagcuauggugccaauaaaaugcucugugaccugggauucuaaauagccuuuuaauauacaaaaacacucggaagucaaugauuuuuaacauaguauuacaccaauuauucagaaauaguuuuagaagcaccaacaaaaccuaaucacuuugguuugagaccagguauauuucagucuguauauuucaggcuugaugcaaacuauagucccccauccccguccugcaguuacaggcaugaacuccacccuuaagaagguuuucauucuccuuauuuuccauuugguuuagaauguuuuggaucaucuaagaucagucaacuaaggagaacucaguggcuagcaugugugagaaggcccuugguucaguccucaguaucaaaggagagugugcgugugggagagggugugcuggaagaaugaaaacucuugaagauaauuagcuauucuguuguuggacucccaagucuauguugcccaggauggucuucaacuccuaggucuacugaguauugcucuuacuucagucucccaaauaacuggagcugcccacaggggauucaccuugagcuuaugggaguauuuauagcaugaagaacagaaauguuaaaaacauccagcugucuuguaucauuguuguagucacaacagaaaugaaaucuuuuuuuuuuugcauaaaugcuugugaggacauuuuauugacauuuuucauuacagaguccacacuuacauauuugauaaaagagcuguccuaaauuuuccagguaagaguaaauaaagugcauacaagaauaaaugcugcaacauauuugcuaaguauuuauuuuccaaagucuugaccucugacucuuaaugaaauggcaggaaaacaaggaaguuaaaaagcacaccggaaaagcauuaagguuuuggcaaucuggacgaaagccaggaaaguuuaagauauaacugauagcucucagaauauuguuuucuucuuccuguuuaaagacuaagucacaagcuuuguuuaaagaaacucaacuuaucaaaugguagguaguucuuauuaaaguauacuggguugcauuuguauauguuaagaucugaauaaccuuaguauacgagugacuauguguccugaucagacaacuucuuauucuaacaggcaucaguacuuggauuuuuaauauuaagaggggcuggaaggaugguuuagcagugcucuugcagaggacccagguuugguuuccagcacucacaaggcagcugacaacuugaaccaucuagaacuccaguuccaggagaucugacgcccucuucuggccuucguuggcaccgaacacagguggguggguacaugcuggucaaacacccacacagaauaaaucuuuaaaaaguauauuaaggcugcuuuauuaaguauauuauaccugcuuuacugaagaaacucaacuuuucugagauaaaaugacaaaaccuagcugcaccauaaguuuaagagauuuggaaaaccaccuuuaauauccuccgucuggaaaugacugggcuuucgguuaucuuaauguacaguuuuccaaacacaccuucaacucacuuaucagaaacuucucaauuaccugggagauuaauacacgaaauugugugccccaaaaagggaaaacuaagaaagcucauucaaaaauccaaaaccaaaaaacuuuuaggugaauaaccucaaaauaucuuuuuuuuuaaagguaaaagccaccguuuauauuuuuaguggcaagggauacauauuaaauccuaauaaagaaaaacaaaacaccaaaccauuaucaaccaucaaccaucuggugguugugccaggugucagcugagaacacuaacagaaaaaaaaauugacaugauuaaaauccgcuagagcugauauugaagcuucucaaauguggccuugugggucauccuuuacuaccuaaggcuggacagagcaggcaagggcaacuucgcagagcugcgcgcuguccuacgccaggagcuacggguuagcccccacccccuggccucugcagggcacgcccccuuccuacccaccgccccgcugcuccccucccucggcgcccgcguccuccaggucaccuucaggcgagggcgggacugccuggcacgggccacccaccuaccacccccugccaauaaaaauucggaacucgccggcccggcccgccugcagcgcccaaucccggccgcccgaacgaucuucgccucgggugcccagggcuugggggcgggaacauugggaacuaaauuaagaagcagagggcccugagaaggaagcgggcagccgggugggggcucccccgggacggcccgaggccgcgcucccgguaaacaaaggcuucgcgggggcggguaacggucaggugaccacgccccgcauguuucgcaacugugcugcuggcugcuauggccccagcaccccgauccuuauccgugcuaggcgacagcacucacggucaccccacggaaacuccagguccgaggccgaaacacuccggccgcuuccacccuaaguguauugcugccgcggggcucgucccugcccuguccccacgcccgaggccgcaucgggcuucuggcagccagggaccucgccucccucccgccggugccggggaucagcgccgcggucgcaugccgcuuggagcggccacccugguaccucucggcgcaggcuggaagcggcacgagcggcgacccccgucccugcugcgccggcgucuccucgagccaccgccagucucugccacugcucacaacaaaggaaacaugugaccgucgagccaaaacacuuagcgucacccacccuuggccaaugggggggaggcauccgccuucccggagcauu

SEQ ID NO: 8155 - RNA, 95095 nt, Mus musculus
cgauucccuucggucuugcgcaagcuuugugcaucgcgcuugcgcguugugggggacuaugccgcuauaaaggcuuguuuugcucaggguccgauguucgcgagcgugcccgggcuguuugcucucguguggggaggcuggggugcagguaggugacgguucacgccuuuuucaugcagugucggaggcugucacgggcucacuucuuugggcucuccaaggcggggugggcggugggaagccucggacgggagaaacggggccugucucguuccgaucucgcgcgguccccggcuuguuggcgaccucgcgggcugugcggaggucuagauguuagaaggcaggaggggagguuugauggguggucacggccggcuccacucuccgcgcggccaccagggggagcugcguucgcugugggugggucguggagccugugcucgcaggcccggggcuggcaugggaacgcccuagggccggguggcggagcuguccagagagaagccccaaccucccuccgggacuggaggcugucagccacuuacuacguaagucauuaucuauguuuuguuuuguuuuuuguuuguuuguuuugcuacugguauguggagguacguggcaucagcacacacagcgaagccgagguagagaugggagccuagaucuucugucaccaguguccuuuucggugcugacacgcaaaggagcuaguggcuuuguguuuauaacaccuggauuugguguuuucguacagaugugggagucucgaugcaggugggcacaggaaugaccggggaagucuugaguuccgaagggagaaauggauggguuuuacuggggucucuggaguaagugacaggugagggagcuuggaggcacaggugggcccugggggagagguggggggggcgugauaagugguucagcuuccuuguagcuuccaguagcuuccaguagcugcagggccugaaggagcuuccugaggcgccuaaaaccugagagauguugcgauaacagaacuuggaaacaccaaccugguuaguuacaguucuccaggccuacacaaugccccuccccccugcagaaucgucacauccaccccucuucacuggaaagagaauuuuagagcaaaaccagguggcccccaacccugucaguuuugagucgggguacuaaugugagaguccccacuuuguuuauucuucuuucucccuuuauagugcuggcuuaaaccaaaauaugccagguuuuccuaguccugauacacacacccuuuccuuuggauuuggcagggcuggggacuggaaagaaccucuggccuacaugcuuuuaucacugagccuaaguuagcauuaguuuuauaaaaagacuuuacauuagcugcaagggaguugucuagaaaaugggaaguaugaauugcucuuugggcuggagaggguccugguguaguaauccuuucuuaguugauugcuucauauccauauucaccuuagcccuacucuaccggcuucuguguguucuucuugucauaucccagacacacagaagaugguggucuccuuguguucagugugaagaaacaguaacuuuauggcuacucagguguuugcauacuuuaaggugcugcaccuuuauuuauuuauuuauugaaagugaagcuaugacauuggugaagaucauggggacaacgauuccccauaccccauucuuauagaaacucgcuuugucuggaagguuagggaaguuagaauaggccacugaaguccuaucuuaucucaccauuaggaaaacaguuguuucugucaaaacugucuuugcuaccacagucuguguguacacuuuaccgguuccgcuucauaauauaugauugaacacacacaacugagaaaaaacauugccucguacaguucuucgauaacuuucccuguuguucuugauguguuugguguugugaauggggucccuugggcuccucccuuuuaagcuuccccagcccccucuugccuauuuuuaaaguagcgaguaaucuuccucuuccagaugacaauggcagaugccagaucuguuuauagcuuggcuuucggaagagccagagccacaagcguuguuuuugcuuaguaagcugguuuugguuuuguuuauaguguacacagucauugggcuaggugcucuuucuuucuuccuuucuuucuuucuuucuuucuuucuuucuuucuuucuuacuuucuuucuuucuuucugucuuaaauaaacaacuuaucuguaucaacuuccagugcuugaaccagaauucugauaagcaaaauggccaguccagcccucauuggagauuugagggucuuaauuuuuuuuuuaagauuuauuuauuauaucuaaguacacuguagcugucuuaagacacaccagaggagggcgucagagcucauuacggaugguugugagccaccaugugguugcugggauuugaacucaggaucuucggaagagcaguuggugcucuuaaccacugagccaucucuccagcccuuuuuugguuuucgagacaggguuucucuguauagcccuggcuguccuggaacucacuuuguagaccaggcuggccuugaacucagaaauccaccugccucugccuccugagugcugggauuaaaggcaugcgcuaccacuacccggcuuaauuuauuauuauuauuuuuuuuuuacuucaaggauuaauaaguauuuuucuucugaugauuuaaaaaugaguaauaggagcuugggauguaccucugcugucagagugcuugccugaaguuugcaaagccuuggguuccaucccccgcaccagauaaacugggcguaguagugcaguuuugaaaucccagcuguugugauguagagucaggagggucagaaguucaaggccauccuucgaagaccaagaguaggaagccaaccugggcuacuuacuugagauccugugucaaaaacagcaaugccuuacaguugucaaaauuuugugcugcaagagacacaguccuuacuagugucaucauggcuggacuuauggacuacaguguagcauggccauaugucagauaucugugguguuuucauuaucuguuguucaggaauuugagcuucugacaacgggggaccuucuagaggggcaaguauguguuuaguuuuuaaaaaguggccugugccaaacugaggacuggaguuccauccccagaaaccuggaugguagaaagagagaacugacucuugcaaguugcaaguguacaugauuaucuuuguuuucuguguguccaucugucugucucguacccaccccacccuauaaauaagauaaaugcaaacuuuugaaaaaagugaccagaguugauacagaauguugacuggaauuagccagacaggcagugguguggaaacacagaacagaguuuuaggaguagaccaggugaugcuuaaaaagguagaacauagacccuuuuucuuuauucuuucuuucuuucuuucuuucuuucuuucuuucuuucuuucuuucuuucuuucuuucuuucuuuugagucagggguuucucaguguaguccugcuguccuggaacucgcucuguagaccaggcucaucuugaacucagagaucugccuaccucugccuucugagugcugggauuaaaguugugcaccacugugucuggcuugguaaauuuucuugaugcuagaacccuuuguuuguuuguuuguuuguuuguuuguuuguuuguuuaaaaaaaagaaagaaacugaagggauauuuaaaauaauuuuguagcuauauugguaaagaagugucaauacuuuuguuccguucuguuuuaaagcacuuuggcauauacuuuaagcaugauuaggaggcaucugcuuuuguaaauuuuuaauuucagaauuucugaagugaaaggaggagucugcacccugguccucuguguggugaagaugaaagauauugacaugggaaaagaauauaucauccccagcccuggguacagaagugacagggacagaagcgcuguaccagggcaacacagagaccccgaggaacccagguuccggagaacaagaucggugagugauugccuccccagacuugguuccuacaccauaucuccuucuuuucauaugauacagauuuuaucauuuuauuuuucuuuauuggcuugaaguccauguuaagauuccuuaggcuggagcguagcucaaugguacgcuuagcuuucaugaagcccuggcuucagaccagcuucacaagaaggagcugguucacgaagggauugagaaguugucuugugcugccugugugugugugugugugugugugugugugugagagagagagagagagagagagacagacagacagacagacagacagagagacagggccacacuauguaguauguagccugguuuagcuuggaacucuuaguguggaacauccgccuguuucugucucagaggcacugagaggcuuguagcauauaccuggcuucucucuuuuucacugacucuuauuuucuuaccugcugaaaaccccuugauuaaaaagacggauggguauguagcuaagugguagagcucgugccuggcauauauaaagccauguguggcuggguucaguacccauuacugagaaaggaaagagacggauaggcuggggugggguugagggagggagaacaccagaggacagugguaaugcagaccauucggcuucuuucauauacuucaaaugguuuucacuuuugcuuuuuuucuccugucuuugcuuucugugcuuaaaauaggaauuauuuugccaggccugacauugcacaccuucaguaccagcacuaagaggcaaagcaggagggucuuauaagugugaggccagccugcucuacauaguaaguuccagaauagccagggcuauacacagagacccugugucauaauuggguuaccauugcugagauaaaacacuaugaccaaagcaaggugggaaggaaaggguuuguuugccuuauacuuccaugucauucaaccaaggaagucagggcagggacucaaacaaggcagcuccuggaggcaggagcugauggaaaggccauggagggugcugcugacuggcuugcucuucauagcuugcucagccugcuuucuuauagaccccaggaucaccagaccagggacggcaccacccaccaugagcugugcccuuacccaucacacccaccaugagcagugcccuuacccaucaaucacuaauuaagacauacccuaaaggcuugucugcagccucuucuuaagaguggcauuuucucaauagauguucccuuuaacguaggucaaguugacauaaaaccagcuaguauacccugccaacaaaacaaaacaagaaaaggaaucauuuuaagagacuuucucagauuucagagaauggguggaauaauuauucuagauagugguaggauaaucaguaaauuuugcuugugaauuuaugaauauaaagcauuuuugguaacaaucuaaauuuccuccaauaggaauacuaagauacauuuuaauuuuuaaguuaguagauguguuuuuuccuguuuuguuuuguuuuuuguuuuuuuuaaagcauucuaucuuuucuggaauugcaaaagaaauaaguaagguaggaaggcaucuaggauuaggaaguuucagguuuaugcaaugugaacacuugugaaguguuugcugugugagcaauugucucuucuuugccaugugaacacuagucacgucuaugccaugugaacacuagucacgucuaugccaugugaacacuagucacgucuaagccaugugaacacugugaagucuuugcaugugagcaccugucaccuuugccauaugaacacuagucacgucuaagccaugugaacacuagucacaucuuugccaugugaauacuguggagucuuugccaugugagcacuugaggcuguggccuuuggagcugaaauuggugucucagccugacaugguuuugcaucuuggguggaugaaagccauugcuuacucgucgucaaucaauaguuuuuuuuuguuuguuuguuuuguuuuguuuuuguuuuuuuguuuuuguuaaugggcgucuuuguccucacugagaaugccucauuuucaguguccagugcuucuugggaccaguuuuguaacuacgcgucccuauuagcuagaucuuguguuaaccaaacauuucuugaauguaugucuaauacuugucaggaaauugucugguaguuagaucugggaaaguuuuaaggguccacuggagcagggcuuugaaggaugaugggaauuuucuuaggcuacagagguaaagaccuagauguauagaaaagaacguggcguguuggaccuugacuaagcagcuugugccauugugccuuauacaguagugagaugauacacacaccauucuaagagugguggcugcaugggcagugcucaguagagaauuugcucuuagaugagaguggaauguguaaagagggugugucagggaagugucugcacgccaugcuaagaacuuuugggagcggaagcauuggaaauuaaugagauuuaaagauuagugauuugagauaacuaaauuaaugugcuguuauaaaaaauaauaaugagaaucacuacaggauugacagugauccaggacacugauuuauuaaaaguccaggagcuuggguugaggagacaaggccuucuugcaaugcuguacuauaguuaugcgagauguuaguuaguacuggggaaccuaaaaauugcauaaggaaauucucacuguuauuuuaugucaucagauguaaguaaaugaauaaauagagaauagaggacauuacccagaguccaucucuacuuugaccacucagguguagguggguucaccugcacacagguucuuucccaaaguggcuguauuauauuauaucccccuuucauuuguuuuuuccuguucuugcccagauugggggugguuaucauuuucauuuuaggcagucugauagaugcuuuugaaaccucuuugcaguuuucauuugcauuuccccaguggcuacugguguugauauaaaaaggcgauuuaaaauuuucauuuuguuuugucccuagcauugaggaauggucguugaguuuuuugcaugcuaggcaagcacucucucaaugagcuauuuuuuuggcuaagaaccugcucuauauuccaggcagaccuugaacuguacccaaguaccugucgugugccauuaggccuugcuuucuuaccuauccauguaggaaugacaguauccuguaguucugacugacauccagcuuuugauccuccugcaguagccuccuaaauaaugaguuacaggugugagacaccacccuugccucugagaaagaacuuuuguuuuuguuuuuaaagagguucucaugaagccaaggccagccuugaacucccucuauaacuggaggcuggccuugagcuucugguauucuuagugcuaggaugucaggcauauggucagcauacccagcugagaagaauuuuuuuuuuuuuugagacagguucucuuuguagcucuggcuguccuggaacucacuucguaggccagacuggacuugaacucacugccugcugccuccugaaugcagguguguaucacuaugcccagcugagaagagauuuuuuuaaaaaaaguaugucuauauacauauauuuauacauaugcaaauuauuuaucuaucuaucucuuggauuugucuugaaguaauggagaaaaaccauagacagaggagagacaggaaauuaauacaaggagcaucaggugacugcuaugcagaccaugugggcaaaucuggggucugcuuucagacacaggugaggaaggagauacaggaggagauugggguuucucugaaagcugaugagaugucugagauuggcuagaauuuaaaauugaggaaacaggaaaucuggaagaaagaagagugauuuugauuacuucugcuccccuuggcuaacauaaggugugaagaaugagcgauuuuuacaggaaauguugcaacccaugaugcucacauugaguccuaucgaguuuguugagguuauugcccuggguaugcaggagcucugccaggccuuuccucuguagacagagaggaacuguaaaugaagccauguuuacuaagucaaccuugggcaagaagguugcuaguaagccuguuaaauuucaggaauucuuucuuguuucccaagguguuauguuugcucuuuucuucuuuuucuuaacauuuuuggcuuaaaauauuuaagaaauacuuauuuuuaagaaguuauucuuagccuugaacuaagcaaugaaaccauagguuuauucaacuuauuuuuguacauaaauuauuacgaauguauagcuauucaguauuuugagaaguacacauaccuucugaaaucuucaguauuuccuuucaaaacugugauuucuuagauacacucauugcaagcuuguagaugguguaagcuuuauugcugaggaauuagaacgauuccagaaguuuucaggcuugaaauaauauucaugucaauuauuucaguuuuuaaggaagagaaaacacacacuuuauuuauuuguuuguuugucuguuuguuuguuuguuuuucgagacaggguuccucuguguagcccuggcuguccuggaacucucucuggagaccaggcuggccuugaaaucagaaauucuccagccuuugccucccaagugcugggauuaaaggcgugcgccaccacugcccagcugagaauaauauauuuuaaagagaaacaaaacaaaacaaacaaacaagacccugaacagcugauuggguaaagagugauguuucuugccacacuuccugaguaucugcuccauccuuagagaaugguucugcuaggagcacucucccugcugcucauuacaaaggaacuguaucugcaccguagaaggcuuucuaggccaccucugaucuccaguuaacauauaagcauacaacaguugcaaacauguuagaaucaaaaaggaccaagaagccaguguguuagaaaggaccugaaaacacgcuuuggacaguucuugguauuguaugauuuuuuuuuuuuuaauauucuggggaaauuguguuaaacaguuacauuaaguaucuauagucuauuauaaaugcuuggaguuaauuaguguaaaaaguaacauuuguacucuuuagaacuguaaaauuagugugaauugccacauauaaucugagacuuagcagacaugguuuacucucaagugcugauugcauuuucugugucuuuuccuugaucuaagaaugaauauugguuggcauuauuugagcuuaaguguagacuucucucuuuggaucacugcugaacacugucauguuucuugugugcaugguucuugcuuguaccaaagccugcuuuuugcauuguguuuauaugugcacauggagaccgagugcauggugugcacacagagaguguccaaguccaggagcucagaugaguuuugguuuuggugguguuguugagccuguggcauuacacacacuaggcgugcaugcuacuccuuccuaguccuuuuuuuuuuuuuuuaaauugugugauguuuuuauuuguguagcaaauguguugauuugaauguaaugacccucuucugcucauguguuugaaugcuugguccccaguuguuagaacuguuuuuuauuggaggagguaugucacugggagugggcauugaaguuuaaaaagcccacaccacucuccguuagcucucucugccuugugguuguugucucagaguguaagcucucagcugcucuacugcuccagcaccauagcugccuccugccacucucccuaccaugauggucaaggacucacccucugaaauguuaaacaaguccccuauugaaugauuucuuuuacaaguugacauggucauguuauguccucacagccaaagaauggugacuaagucagcaagcguguaagcacacuuuaguauguaugcauguaugaugcugcacaccaccuaucugauacagacacaguugaauugaggcagagcuugccuuucuguagaauuuuaacucagauauguacauacauacacacacacauauauacauauauauguauauaauuuaacaaggaaaaaguccuucucuuagggaagaccuuaggaaaagauaacauuuagcuggagaacagagaaucagcauuuggagaaaggagagaccguggagguagaagguauaaguccuggaccuauacagcuagguccuuggacuuacugcauguuugagcuaagugagauaaagcugucaggugcuuuguaaagcuugacuuauguggucacguuggugaucaggcuaaaguucggggugacuuguuuuucaugagcuuguugaauggaggacaagaggaagaauggaaaauaaccagaaaucagcuagaguucaugcaccguugugauugcauuauuuuuucucguugguggaauuuuccuucaaguuagaauauuuugcgucuaggaaaguaaggaaucagcauucugaaaauccagggaucuuuauuaaagcuuagauggacucuuggcauugguuagaguuuucauaguuagcuacucaagauaucuugaugaguuugaguuguauuuuagggauuuaggauguaaaucuuaucucuuccagaaauuauucuaagaccuuauuaggaaaggaauaggagccuauugcagaaaugugugaagcacauacgauuauaucagaaacagaaaucaccucuccccaccucugcaaucauuuccugcaauacuuuguaugacauuacacuuuuagaggauuugacccugaaagcuuuuacagcuaaaaggcaugugauuuuguuuuagcucuuauguucucagaguggagaacagugcccggugagucagccugguuuagggaggagggcaggacagcagcuaguauuucauaucucugcauaaguguuucugcagcaacucagugcaucuucuggaugccucugcccccagucccuuucccccauguaagcaucuaucagcucugugaggcccuggaguuucuuaggcuuggugguaugaaaagguagcuggccuccagucagaugccagucucagugcuggccacagccccaggagagauggccgucgugcuguugcuggugagagcugcuugugucuacagcaacagcucacugauucccaccugaaaagaaaauuguuagauggggcuugggguaguucuuucuuuuugugugugugacggucucauuauguagcccuaggcgguguggaacuuacuguguagaccaggcuagccucaaacucagaugugucugcugccucugccucugaugugcugggaacgaaaggugugcgagccaugacacuagcauagcuuacuguuuuuaagguaguucuaagcacuagugucuauuaaaguaguugggagaugacaaauggccagugaaacucuuaguaaagcuuggcucuguggcauaguaaagaccugcuguccuucaugccuugugucugaucacaaauuaaagggccagugcuaaggagagacauccucucuacaaguccuugcaaugacugaaccuguguguuucaaacacggugacgugagguucuucugguacacugaagcccgauaguagaguuaaacuugucuaguucuuccuuccuucccuuuuaaaggaaggaguuagcuguuuagguguuauguaugcuuuuccuuauucaagacucuucuucuggcugggccugggccucucuaauucucaugcuugggugugguugagguggaaggauaaucccaaauuuaaggccagccugggcuguauaguaaaaacauguuuccaaauagcagauuauuuucuucugcaucugucguucaaagaacuuguggaaaaacacgauugacaaaguccauucaugaacgccugaagcaagacugguuuacaaaugagugucccucacagggaaccaaguguaggccaggcuguccuguggccucaccuccccguggguguggcacaguagaacuuaucagcagaucugauaggguacugugaucugcugauugucccagugugguauuucuggagugaggugacucagagcagagcuauuggguucucugaaacauuaauuuccccugccuauuguuuuagccuaguguguggggccaucagaagaacagugggacagccagccaaaaucaacaggauugacuaugcauggcaccuaucuuuaagaugccuuuguuucuggagcaaacauugugaaaacgauuuaugugcuaugcugugucacagaaauacuuacauuugguuuugagagguagguacacauucuaaguaccuauaaaagcugaagucaugugacuuugaagaagucccugaagcagggccugggugugugugggaagcuccauugguaaagugcuugauuuguaggugugagguccugagugugaguccuagaacccacguaaaagcagguacagcagcagugagggagacaggcgggagaauccuuggggcugauuguauagccuggucccagugagagacccuagcucaaaaacgaaaaucgaugggucccgagaacugacacccgggcugaccuuggcaugaggaaaguucuauuuuuguguuuuuguuuuccaaagcuaaaaacugaaaaucuuaaaggcauuuucaccaacauuuacaaguuuuaguaucuaaaucaguaauuuaaaagucagacuguguauuaaagucauauguagaguauuaaaaagaaauagggcccuauucuagauacaaaagucucugcaauggaaucaaguuauugguggagguuuaguuuccugguguggcuacacugggccuccugagaucucauggaauaaaggcaggucuuacuccuuaagcagggcuucucaaccugugggucacgagccccuugggggucauaugaguccuuuucaguccuuuucccucacccaauaucagaucaggcucccccccuccccugccuguccacuuucucucucauaucccucccucccucucacuugagauagcuuucuucucucucgaaagugggacugaggcauccucgcuugggcuucagcuuguugaccuguaugaguucugugguauucugugcuauguuuuuuuuguuuguuuuaauuuuauuuuuuggcugauaucuacuuauuagugaguacauacuaugcauguccuuuugggucugaguuacuucacuccggaugauauuuucuaguuccauccauuugccuacaaaacucagcacguccuuguucuuaauagcugaguagugcuccacuguguaaaugaaccacauccucuguauccacucuucugucgugggacaucuguuuuguuuuguuuuuccagcuucuggcuaucgcaaauaaggcuguuaugaacauaguggaacacgugccccuguggcaugguggaggaacuauauuaaaggguugcagcauuaggaaggcugagaaccacugccucaagcauugagcuccaaguauuuccucaucccgugauucguuuucagcuuaaucauuugaaacuuaaucaugguauugacaaauuuaaucucagaccucccccaccgauuguaauacaaacuuugaauuaauugcuucagaucaagcuuaugcaacaacuuaaguucuuccucauuguaaguaauaccagauuaccgcugguagaaaauaccuauguuaccaugcugacaccauauuguguucuuuggcuuuacgcauuugcccugauuuauggcuuguacuaacagguggcaugggaaugugaguugacaugggucgguuuucccaggguggcaugcuugucaggagggcuuuggauugcucccgggggaaugauuccuggucccugaccauugcagggcaagcacauugugcccugucagcagauuggcagucuggagggagacgggcagcccaggcauucaguggcugugcaugcaguaggugugugaacuaugacaaaugccaagauggcaaacguaagaugguaaauguaguaaaacaaagggaagagcucugugugcugugggucagcugucucuuuaucuuuccagcuaggcacgugagugcaggucuuugaccucuagcuguguuuaggcagaauccggacuuuuguuccuuuuuagcucugcagugucucuauccccuccuccuccuugccucaguaguaagguguucaguaugugcgacucacacagcugcagagcaggcaaaacugguggcagcaucuucuuauuggugucuugccaccucccuguccccuuuggaaaagccacugcugcaguaccugugccuguggcugggcaucuggccacugaggaccuuugauaccuguggggaacccuggguuccuuucucagcacugcagaaaccuagugugguggucaugccuguagucugagcacuggagguggacacaggaggaucaagaguuuaaggucauacguggcugcauauuagucaugaucagcuuuggcuacuugagaccccauuuaaaaaauuacuucugaaaaggauuuaaagaauuauaacauuaaaaaaaaugaccucauaaaucccuucuuucagaguaguguguacugucuacuacuuacugccucagcuaccucagcuaccucagcuaccucagugcuacugacauuguggcauaaaggauuuuuguuguggggugguccugugcaguguagaauguccaccaacuuuccugccucugccuagaacagcuagcagcacucuguacuggugacagcuacgcaugucucuaaauauucucuggaaaaacaaaacaaaaccacccucacuugagaacugugugcaucgcccaguuauaguagcugccagccacacgugguucuuaaacauuugaaauauuuggaaacugagcuugccccaagaacaaaauacuaaauuuuaccacagaaaacagucccucaugaagaaaaucccaauaauguuauagugaucguauguuaaaaaggugguccuuuucaugauguguuaaguaaaagaugugaaaauguucucucuacucuaaaagaauuucagcuugcaugaacaggcguagauugaggcuugugcugucugucugucugucugacagcacugagcugcagugacagcaugcugugauuuaaccgugauucugccauucgagcucuggaagcuguugggugugaaugguuuccccugcuuuggaaauguuccucuauacaaugaaauuguggagcuguauauccagagguauuauucuuccgguggcugaggcucaguuaggcaucucacagugugcucuuguuuaaaccccccuguugguauuggguugcucucuguuuugauuaagguaguuuuuauuacaguaguuguaucuugaguuucaguuuauguuucuuguuggugacaguguguuucuacuuucuuauauccuuauccuuuacaauacuauuuauacauaguagacccuuaauuaagaaccuacucaguggauagacauuuuuucagagaaagucuaccgauauaaacgcauuagcuaucuauaucuccauuuaacuuuaugcccuuuaguguuaauuuuaauuuaauaacuuuuuuguuuguuuguuuuuuguuuuuuugagacaggguuucucuguguagcccuggcuguccuggaacucacucuguagaccaggcugaccuugaacucagaaauccaccugccucugacucccgagcucugggauuaaaggcgugugccaccacgccuggcuccugguuuuuauuuuuauauguaaacccauccauccaucuuaccuuugauacauuuuugacuuugggggguaaguggaagcucucucccauucagcuuaagcuacuauuuaauuuucuuccauuuacuuaaucauuuuaauguaaccuguuaggcuuaauuccacauguguuacuguucugugacgaacaggccucucccugguucauuuccauuucaauccauucaaccgcagacuguaaagaauuuacagcuaauagagucuucuucugcaguaguaguagguacguguucuaaauaguuaguaaugaaguuaacuguggcagacugaguagcugugcaauuguuaggguuuucauucuuuagucuuguccuacugauggaguguagucuauauaaucaagaaagagcaaagugaauaauuauuuauuacauuauuuucuuagggcuccuauugcugugauaaaacaaaagcaaaacaaaagaaacaacaaacaaaaaacaaaauaaaagccuauucugaccagagucaacuuggggagaaaaagggagaacacuuguaguuugucauccaaggaagucagggcaggaucucaaggcaggagcuuagaggccaugccuggugcucugucugcuuccuuauacuagcccagggggcaccuccugcugugggcuaaguccucacacauacaucagucaagaaaauguuccaagguuuacccacaggacagucuggugggagcauuaucucaauugagguuccccugauagaaugacuauauccugugucagguugacuuaaaagcuugccagcacuacuguuaaucgaucauaagcaaaguuuuaagugacaaguacaaguacaaguggaguggguagaaaucucucuagugauuuacuagauagcauuggaugcuugguugugcugcuggugaggcgaccuuugacuuuccaauaacaggugccagguucuguaugcaaacgcucugcaggcaugccuaguggccggacccugugucacacaugcagugguguagaugugcgggauacuuaguggauggaugacugagggccagauaaccuaaggaaggaggaaauaaucgagguguugcccuugaucgaaagguaauauauagauccuguguauuaaaugucugcuaagcacuuacguaaccuuaucugcuuucagcauggugcaguucacacacaaguaaaugugagcacugaagcucacaguguggcaguaacaggcuaaaggcugguggcagggucagcauucaauccacaccugccuugccuucuaaaacccauguucaaaaccucugcaugguacagucggacccuucaagucuguaagagaaaaugguuuuauuauagugcaggaacucuuuucucugaguguuuuguucucugucugucugucuuucccucccuuccuuccuuccuuccuuccuuccuuccuuccuuccuuccuuccuuccuuccuuccuuuuuuuaauguuagcauucuaaagcucuugccagaaucuaaggcucuguugcucuguguuuggacgaggucugucucugaagcucccugcugccuaugugcagcaggacccugaguccuucuauuccauucuccucccgugacaugggcagaacauguagcauaccagggcugacccucuggaaacugucugugaaagagaaucagauguggagcaacagcagcaaauuuuaaguuuuuagauaaaaaauguguuguauaauuuaaguuuaggacucccuguuuucuuauuacauaagauauuacauacuacuauuauuacauauuacauaccacuauuauuacauacuacuauuauuacauauuaauuauauacuacuauuacacaggauaagucagcuuaugauggcuugccuuugucagggcaagauuuuagagaguccacguucuaaaaccuuagccuucgugucaugcaucggaugccacuguggcacuagacaacccucagcaaauggucuugcuugccaguucucguucaaaguuuuuuugaguuugguaaucugccuguacagaaaauaacauaacacuggaagauaugggacauaucauuaaaugugaucacagaaacaaaacccaugccaucagguuuauuuauuuauuuauuaaauuguuugguuuucuaguaacagcuuuuuaaaaaacaaaaaacaaaaaacaaaaauaccugucaguaggcauuuuacauuuaauuuuagccaaaggccaggaugugauuuauuacuauuuauuauuauguuauuguuauuguuauuauuguuauuauuuuugaugaagcaaaugaaaugaauggguuguaaacaucagcacucucaugcucucuucccaucauccagaacagucuuaaauaucagaagcgcucaggaacuaauuguuacaagauggagguaaaagaggugacgguucuaguuuucucuuagugcugaugccuuauggaaguguacuaguggauggcacacugcauugcuaguuuuaugucaacaagcuagagucguuagguaacaggaggcucaacugagaaaauacccuucaacagcuuguauuaugggugagccugauuagugauagauguagaaaggcccgguucauuguggacagugucaugucuggacuggugggccugguugcuguaagaaaguaggcugagcaagucauaggcaaguuaacaaauucaaauuacagagcgagccaauaaacaacacuccucuauggccucugugucaguuuuuacuuccagguuccugcuuuuaguuccuguccugauuucccuggaugacagacuauaagguuuguggugguuugagugacguuggccccauaggcucauauauuugaauauuuggcucccaguugguggagucuuuaguaaggacuagaaaguaugcucuuauuagaagagaugugugauuguuugaaugaaaguggcuccaguaggcacauagggagugacauuacuaugaggugguguggcuuuguuggaguuaagugugguguuguuggagauggugucuuacuuacugugcgugagcuuugaggguucaaacggucaaaccaggcagaggggcuuucgccucaagcucuuucugucagccugcaggcuaccacgauuccugcccugacaauaauggacuaaacaucuaaaccaguaaggcagucccaauuaaaaugucuuccuuuauaggaguagccaugguaauaaugugucuucucaacaauagaaacccuaacaaaggugcccuaacuaggaguagacuuugagguuucaaaagacugucccaggcccagcuccccacggucucuguuuccuauuuguggaucaggaugugagcucucaguuauuccccagugccauguauaccugccaugaugcucauggacucacccucuggaacucucagcaaacuccugauuaaaugcuuuuuuauaaguugccuuggucaugaugucucuucucagcaauagaacaguaacuacaauaagcuguaagcugaaguaaacacagcgcuucucaagaugaaccaucucagggacuauauauuuuggacugagaauguugggguaguugggugggcaaccugcugaacacccaugcuguacucuucuuuugcugaugagagagggagacaggacaucccggcucucaugguuaguugggacugacuuugaaauuuuguaauagaaaacuagcaauauaauuuucaguuauuggugaaaggauuaacuuucaguauaugacucucaggaaaaagaagaucaaauauuugauuuuaaaaaucauuuaucuuuguguguggcuccagggaauuauucagggcuuucugugcucuuuccucccuucugcuaaagaucaaaccuagggucucauguauucuagggaaguacucuaccauuggacuauaucccuagcccaugauaaaagauuugaguuauaaaaaauuuauguuuugaauguauaacacaaagaaugaaccuaguguaauguggauuccaguuacugugucagcacuggccugucgauguaacacuuguaccaucuuaugggagaucuaacauaggagaaggagguggaggugauggcacagauaugagaacuauacuuugcacuucauucuacaaaccuaaaaaaaccucguauguauguguuugguugaauguucuuuuuuuuuuaauuuuuauuuauuuauuauagcucucuucggccccauucucuccaaagauugauugauugauuauauguaaguacacuguagcugucuucagacacaccacaagagagcaucagaucucauuauagaugguugugagccaccaugugguugcugggauuugaacucaggaccuucagaagagcagucagugcucuuaaccucugagccaucucucagcacaccccccauuugaauauucuuuaauggguucuuagcaugcagguuuagugucuagcccuguguccuaggguuuuccagugcugauggagugguuugcuccugguguauuuugaguuguagucagcuagauuuagcucucuucucucuauauuaauucuccuuaacuguucuccccaucacaguuggaaugccaagaugcucucgaaacagcagcccgaguugaggggcuuucccuggauaucucugugcauucucaucuccaaauucuggacgaggagcauucuaagggaaaauaccaccaugguuuaaguguccugaagcccuuccggaccacuaccaaguaaggcuuuguuggcugauguuucauaugcaaagcacuaagagcaguuuugaaaucucaggcuaaagcgagaacagcuaguggggaccaacauuugucaagaacuguuuacuaaggguguuucucacuuaugcucaaaucucuguguguguugacaccucgugguuggacuucuccucuaggcaccagcacccaguggacaaugcuggacuuuucuccuacaugaccuuuucauggcucucuccucuggcccgagugguucacaagaagggggagcuguuaauggaggauguguggccuuuguccaaguaugagucuucugaugugaacagcagaagguaggcgucucugguccacccuauauauacugggugcuaggccugagcuagugggugggccagcaguguggaaucuaaagcuccacacccauuaagaacuucagcugagggugggcuaccuguggacucucuucccuuugccuuaucucuguuucccucuaauuguguuuuaaccaagggcuuucacucucucagucucuuucucaaucucucucucucucucucucucucucucucagccccacuucuagaacuuucugugccuccagggagauauuguugcugccuugugacacaauacauuuuuggugguagcugauugucugauuaaagucuaguuuguagcuuugcauuuuauuacaggauccuucagaaaggguuggugcccuugccaaaggaaguuuucauccacaaacuuuauucagggagagaccuuugaggagcggaaguaaaggcuccugcucuucuuguguuuuguauuucagauauccccuuuugggagucaauacacauaggccaggaagggaguuuuucuguacaagauguaggcuaugugcauaauuuugaaggagagauuuguguaugcaacaauagaaccugcgauggcaggaagggggcuaggauguguccuuucccuggggagauguguaacacaggacaugugcccuuguuaagacuagagagacuguggcaagaagagcugaaugaaguugggccagacgcugccucccugcgaaggguuguguggaucuuuugccgcaccaggcucauccuguccaucgugugccugaugaucacgcaguuggcuggcuucaguggaccaguaaguucugacuauccuuucugaacaucuccagacccggccauggccagcucuaaccuuguuuuucgguuguagagguaaugauaauuuuugagcuaguuagcagccuuaaauauacuucuagggcuauugaauagggugaguggauuugggagugaacgguggcuugucagcuagacuguuaagaacaaagagcugcagaagaagaaacugcuggcuuguuguccuggggcugcacaaaucugaauggauccugguuccacacagcuccugcuuguugauuaagugcugccaugaacagccacgucuuggcaguacugcgagcgaguaagcugagcguuguguggcucgggcuagcaagccuauguuggugacguaccagaugccuggaggcauaguugcuauguugacugacucuguaaccaaugaucccucaagaagcuagaagucuaccagggguuuugagagucuguuucaaguuuuacauauagcguuaacuguggcagauuuggggcgaccgcugugguuucuaccaagccuguguggauucaguguaguagcuaagggagcuuugggcaggaggaguuuucggggcauccuuucuugcauuucucugugcugccugacacuugagauugugauugaauuuauucucuacauauuugccuugaggcaucggagcaguaguacuguuuaacugugcguuuuccguguguggguaagcuggagguucaugguggguaaguaugugucuaagaugcauggugacuaggugacacuaauuuacacuuuggagguuuuuuguuuuuuauuuuguuuuucuucuuuuuaauguaugaucuuuaaagaaaaaaaaguuuugguauuagguuucuuaauugaccaacuaacacuuuuauauaaguuuuaaauaaaagagaccauguaacugaaauguuauuagccaaaauggcacguguuucauagagccagcauucccccaagaagagcuucugucauuguaucacuacagagcugguggcugcucugacacuucgcacaguuccuucaucuggguaguacagaauuucucaauaauauaaugggcuuucuuaauucuuuauuuccccauuucuuuaaaaaaaauccuggauugcagggauaaaguuuuuacuccacaaaaaguaauugcaaaaugcaugcucacuuugaugccuugaaggucauuccuuugagcaucuguuaaguuguuaaucuuucaauucugaugcagcaaccgggaugcuaacuucuagagacugcuucuagaugcccguggagagcugggugccuucccauaacaggaacucaggcacaucucccucugcugccguuuugggaagaacccuggggagucaauaggccuagagagcugugggcuugucuguugucuuuuugugaaacagauaugcaaguauaaacaauguagacaucuuuuuuuggaacccuaaucccaauaaauucuuuugacuggaaauuggagaaucaggcugguuuugacaaaagaaaugaaauuaacauuagcagugagcaaaccugugaguccuucugaggaaauccaauguuagauuuugcacacuuucuaaauugggcaugauuuucagauuggcucauucuguucuuaccaauaucuuagccuaaauuguacacuccauacaugggacaucccauuaggucuuguugagccuugguggucauacauagaacaaaugaaacacagucaggcuguauuuaugugcauuauuuuuuaaaaauuuggucaguugauacugaccccagaacaguguggcaaccaacacuccugcuuuaugucaggugccucagguucaggaaaguucuagcacagugccaccauuuauaaggguacuggccauacucaaaaugcagaaccaaaucacugcaauuauauagaugcuuuggggcccuucuuagacuaaguuaguuuuagaaguccaggccugacccaggacuugugucuggagaguuagcacccacccuagacuugcuagagaaggcugcugucugcagugccaucucuuagugagcgcuaacucugcuccaggccuuguggggaaagggcacugggaagccuugagagagguaaguucccacccuccagccugucuccagccacagcuugcuccaugcugucaggaucuggacuuggggggagugucucuguagugggaccagugacagaagcuguucuuuagaauuuucaggauggcuguauucugcggucagaaugagagagucaagcugggcagaaucucucgccaagagcucagguaagguaauguuuauucacugggaaugccuuccccagcaagacagcuaugcugacagucuucaguuuccucccaguuagcuuagacauaaaugauaaacuuacgacuuuaaaaaaaaaacugaauuuguuugaauuuuucauguaaaacugcuuuucuuucccccauacgagcucauuugaaaugccguugcuuuuuaaagcccuguguuggauauguguuaccucugucaucuuuuccccuuggaaaguuucgcauagugcaaacacacccaugucuuucaccuucccuucuccucucugggagggccugauugcuuauccagugcugccaagggggcacccuaagguauaggaaaggaaggagcccaaacagcacccgcugcccugggagacugcuccacacugcugcccuguguggggaaaugcuucacugcaggccuuccuacugaguugcaucacuacaggaggcgaggcuuuggccucgugacccaguuccacaguuuggaugcauacuggaaaagaaaccaaucuucuugcuaguuaaucuaugcagugaggaccaaacauggguucuaaaaauucugcaggaggguaaagguggauugcaguaguucucagaaucugaaaucccccauuugaucagguuauuuacuggggcuugacaugacccaagagaccuccuaggacauuaguaaacaauuugguauuaaguuacuuucauaaaaacugaaagagacuauuuaccccagaaaccuggcuuccggaauucagcguuaggcacuacaggcuggcccaucugucucuguuguaugccauuuaguaucuuacagcugcagacagaauuccuuacugaaggaaccaggguagaugggugcaugaguuuaauuucuuuuuuccuuuaagguggguacugguuuggcuuucuuuuguuaugguuugguuugauuuuugccaaccucaauuuuagcuaccaggacucgaaaagacuccgaaggaugccagcauccuugcccagcaggccuagaaucucgcagucugucgggagcagaguguuuccucgcagcuuagcgugccaacagcacuugcaguuuuaagcagaguaccucuuuagggaaauuuuaguuguuguuguuuuuuuuuuuuuuuuuuuuuuuuuuucuucuccuuaaucuucuuucuucagcagcaaggucuuuauugcuagagacucuacuucauugcagcuuugggauucccuccucggugaaagcugccauccugaugcauuguacuccagacucuggaagcagauauggcucugccaugcauuuccucuacuguguauaguugcaagugggaggccagcccaucugugugauggcuauccccguucggcucuguauguucccaccaaauguuccugaugccccugcuaauguacaguguuugugagaugcucuuugaacaugguaucuuuaaauauauauuucauuuucaauaaaaguacacugcuucccacuuccugguauuuacugcuguugcugaaugugccugugugagugugugcuccggcguugcaggaccucagagcuggaggugacacucgugguuucugggggcuggcugucuucccucccugcaggugguguuagacauaagcuaccugagguaacauguuuuuguuuuugagagggagugggcguggggagggccagagggagggucucuggaguuugguagcuuguauuguuugcucucuucuguccuauuaaacugccccuguuuguuugcagggauguuuugcacuucccacucuuccguacaacuguagguacacuguuccuuuuuaucgaauaagcacgugugaaaggguacagagaaaggucucgguuucauguaaagagagguagccaugugugaagaugcuggaguaaggucaauauauaccuuuggaugaccaugcguuuagaaugcauugcagcucaugggcagguuuauguuacauuagaaagaguaguggucacgauggcgcccuucagaagaaaagcaagugaccccgcuguccuucaccugggggcagauugccgggaauauuugguccaacaacacaguuucucuuugcuuacacacugaucacuguccguggagcagccugcucuuucuaaccuaacauaacacuguggcuuugugugggguuaccgugggcgauguugacugugguguguguuucucccuguaggccuucguggugaagcaccucuuggaguacacccaggcaacagagucuaaccugcaguacagcuugcuguuaguguuaggccuacuccugacagaaguuguacgcuccuggucacuugcacugacuugggcauugaauuaucgaacugguguccgguugcggggggcuauccugacuauggcauucaagaagauccugaaguuaaagaacauuaaagaaaagucccuaggggaggugaguucagagccugugcuuuguucucagagcaacccagagcagacucucagccugaguuccuccuuuccuuggucccugcucugaccuugaccuuucuccugaauauaguggccuauguccuacacgcucccucacuauuugucauuucuuacagcucaucaauaucugcuccaaugaugggcaaaggauguuugaggcagccgcugugggcagcuugcuggcuggaggaccuguuguugccaucuugggcaugauuuauaauguaaucauccuaggacccacgggcuuccugggaucagcgguuuuuauccucuuuuauccagcaauggugagugagccucuuggcuguaucaugguagcaucuucauaugggauacauaaaguacuuguacuggguugaagaaagaggauagacgacuucucaaagaagguaguugguaaagucugaugcuagauagugcucaguucaccugagcauaauuuuaacuugggaggaaguaaggagucauuugcauaaaagaccauagccaacugaaggcagagggaguguggguggagcagaaggcucuaggugaacccaccccgagacaaaacuggagcuacuggggcugacaugguggcaccagugucugugagaucugaccaguaauugucuucaucgcccuacaaggagaugaggauuaaauauuuucuaacucuaaagaccccuuuaguuaaacaacagcacaaccaugugaaaucauguuugucccaggaacaggcucugugcccguuuggcugagaccauugugaggcagguccugaggugcuucagucugauagggcgcugcuuucccuuccagauguucgugucacggcuaacugcauauuucaggagaaaguguguagcugccacagaugaccguguccagaagaugaaugaaguucuuaccuacauuaaauucauuaaaauguaugccugggucaaagcguuuucucagugugugcaaagugaguuuaaagacuuuccuuguguacguggugaagggauuuuggauucuuugggucuauucagucauguacgucgcuuccuaagcacauuagaaacuagacuuccaaugucuacaaucuucauauagaaucguuucuaagcacauuagaaacuagacuucugaugucuaaaaucuucauauagaaucguuucuaagcacauuagaaacuagacuucugaugucuacaaucuucauauagaaucguuucuaagcacauuagaaacuagacuuccgaugucuacaaucuucauauagaaucguuucuaagcacauuagaaacuagacuuccgaugucuacaaucuucauauagaaucguuucuaagcacauuagaaacuagacuuccgaugucuacaaucuucauauagaaucguuucuauuuaaaagagcucagggauuugagcucgggaacugauuuugccccagguguuauugcuagcuagaacgguauggacaaaucuagcuauuagaauauaugcaaauccuccucuuacccagggcaugguuuuuggcagaaggcgcucagaugauugccaagagcccaucuauucugugauuguauagguaccagaggugguugugugacccccgagggaugaccugggcuucacgaugccucgacuaagcaccucccucuguuacuugcuaggggcuccuuuugucaucuuuuaaaacgauugauauaauuacaguguucucagugcuggcgcuauucacauuuuaaguucagagcaggcauaagcaugugaaguauucucgcagcacaagccugucaggguaacuaacaugacacuggcauuuaaacacuucuacacaagaauaggaaggcugggccuuaaaaacaguggcauuuaagaagagaagcuaaaaaaaaaaggauaaccuuaauuucaguaaaaaguauauaugggcuguuaauggacuuaaugacauaguaacuaccauaaauguuguaaacauuaagacaauuuuaaauagaauaaagaguuguuuguuaguaucagggcaacugguuugcuuucucugauuaaacuuuccggaacuuaucuggacucugcucuuauaaggugguugaacaccccagaguaaauaauaagcacuaaccauauacacaaagaaagcugccagguguagaugcaaauaaaguguucuuuuuauugaaacccaggagacagauggcagggaaccagaguacuuguguuguagcugcuuucuuucagauuucuucuugugacuuguuccauucacaucugaauuguagugauggaaucgauaguccuagggugggggcuggacagugcuuacccagcacaugugagugacgccuuagguccagccuacagaacugacaaaaccagaguugauaguccauuaaacggcuuucuuuuucaucauugguacugaaggaucauuuaaaaaccugccuguauccuaacaucauggcucuugggaggcugaagaaggaaagucuacacugcacgauaagcauaggcuacauagcaagaaccugucuuaaacaaucaaacaaaacccaaaauacaaaagauaaauuuguaguuggaaccugguucuuguuuggugguggaguaacaguuucccaaaguguguuuugacuugcuuugaggauggguugcuuuucauuagaaauccgagaggaggaacgucggauauuggagaaagccggguacuuucagagcaucacuguuggaguggcuccuauugugguagugaucgccaguguggugacguucuccguucacaugacccugggcuuccaucugacugcggcacaggugaggacagucagacacguucucugcagagcugugugcuccucuuguuacuucacuugggacugcuuccaagaauuaggugucuccuucacucauaucacuaaguugagaaguggaagaauacggcauuaucccuuauacaggaauaauguggcuuauuuucagucagccuggguuuggguuuaauuuuguaaauacagaugaaccuuuguuucauguuuaugaagaauguuaggugaaagucucauucaauacaaacccugccuuuaaaauacaaaugugagcugaagcccagagugaaacccagagguuaagauauuuauuacucuugcagaggacuauguaguucaauuuccagcacccauagugggcugcuuggaacccauggguaaccccaguuccaggagaucugacaccucugggcugggcucugaggauaccacauucauuugcacguacugucagacacacacacacacacacacauucucucucucucucucucucucucucucucucucucucucucauaauuuaaaaacgaaacuuuaaacugugauugaggcugacaagguggacagaggcacuugccaccaugccuaaugcccugagcccaguuauuggaacacacacggggaaggagagagccagcuccuuuaaguuguccucagaccuccacacaugcacugccaugcacacaaauguacucgcccacaagacaaauuacuuuaguaugacugcgugcacuaacguuugauaguuacagccuuccuuccacccgaaaggagaguggugccgccuugucuacugugugaccucucgagaggcuugcucucaccucuuuuuuguauuuuaaggccuucacaguggugacugucuucaauuccaugacuuuugcuuuaaaaguaacaccauucucagugaagucccucucugaagcaucaguggcuguugacagauuuaagguaaguggucccuugcccguauccggagcuauccuugguacagcuugcuugcugccuguauuccgagaguccacauaggccagcugcacuugccuuugguuugccuuuaggagauggaggagacaacugaauuaagggaugagaguaaugccuuuuaaaauuaaugugcaucuuucucucucccgauuggcucuggguugugcucccuuuccacacugaguacucugccaggcccagcauggaugugcauugucauuuccugagcuuuuaaagggcuuacguuagaccagcacggccaggugucugccggguucuccccacccccucucgugccugcugccacuuugauugguugcuaugcugaguccuuuugauauuucuuuuuccuacccagugauugccacuacaugaggcagggaaugcagugacauggaaauagucauaaaacuagaucauguugagaaguacaguuaaguaaguaucggccccuuuccuugcgugguuaguugaucagacccuuuuguguucuuuguaccuucagaauaacacaaccgugugacacaagagggagugacguggguggguggaggggaguagauacuuacuuggaagugguuaaugcuuaauuccuacaaaggagaggcacugugugugcuggaguucaucaacaagaccucaccucacuccucguggccuuccuuggccagcgaggugaacaagggaacaguucugguggccugaagaguugaagccccaggacuagaaggaugacucucacuaccuuagaggcucaggggccacagugggcugcccuguaaaggagagauuaguugcugggauuuaccucagccuuugccuuuuacaguuagucaggugacuugcauugggccaagagaaguagucuuccagaacaucccccuuucucgugcuuuccuccuucuccuggcugcuaaaggaccagagccagggucacaugagacugaugucugagagacagucagagcuuugucucucagaagccaccgaacccagucauggaagaaagugaaaguucugaccaaagcgcucccuguuuuguugaguuuuagaugaagaacuaagggagaaaaaguucugugaccuugcuuuugaauugucuccuuuuaagugaguacaguguuagcugguaguauaggcauauuuauacuggaaaaaagaucuauaauuuuuuuaauuggaauccuaguguaacugcguuguguuauaucuggcagcccucugagcacucccucuucuaaugagugaaagcaagcuguuuuuccucuuuggauuguuggagguguuuguuuuugagacagacuggcugcuaacacacaguuauccugccuuggccuccuuggugcugagguuacugcuauacaccucaccgaggggcuaggaagcgcugucagcgggcagccuccuagaggaaggugagguuugugcguccuggcaggugcacaucucagucggugcacauucagguguuguccgucaaagcgugucagggcugugggaagcagaaaggaagagcagggagacugcguucuccgauaggcaccacuguuucucugaauagucuauaggggccuacacagucucuuuuuaacagaucuuuggggaaggaaaugaucagaaucauugacgauauuauagccuagucucucagaaggcucuggauauacaaaucccauagcugcucauagacaggagcuuuacuuaagccuuacgacccccgggguguacaggaauagcaacugugaucccagcucuuguagguggcaacaggagggucagggcucgcggucauucuugggugcccagggcuacaugagauccuuuauuuuaucuuuuaggauugauuuauuuauuuuaauuuuucuuuuacuuuugaaauuauaauuacauaauuuccuccaucccuucccuuucuuuaaauucucacacauacccuuccuugcucucuuucaaacuuacggccucuuuuucucacuaauuguuuuucuauacauauauguauaucuguauguauguguaugcauauauauguuccuaaauacauaaauacaaccugcucagucuguauaauguuacucauguguauguuucagagcugaucauuugacauagauaaccaguggaggaggggagggcucuuuccuggggaagacgauggcucuugcucuuagcauuccuuaguugcuguagggucaugagggccucgcgggcucccccagccugacccaugcuagcaugucuguuguuguccuuguucaguucaguaagaugcuuucuuaaucuucuuaaaagcacgcugggauccaggagaagggggagauuaccuguuccauucauuaguacuugggaacuuuaagccauuugggguauuucguaauugaguagaguccucauccugcaagccaucuuuucucuaaagauuuucuaauguuuuaaauuaauuuuuaaaaagcauuuugaaaaucaccuugcaauagugcucuguaaaaauuuccuggcuugugagggguucgaguauaacuagaaaaucagaauuuuagaaguaacuuuggagacucuuccccauuucacauuacauuuuccugcucuuugaaacaacucuguaggacucuguaaauaaguggagagaaaacuaacucuuuuccccuggagcgauucuuggggagguaccucuuguccacacgggcccuuagcucagauguuuuccaaauccugcaauuaagaggugccaggccaugggugagggcagugugcaggcauuagcucuacagaaguguccuggaaggucccuggcaucgugaugccuguguaaagggucaguaucccuccugggauuucuaaccauuacucuggaaccuaugaauuucuguacguggggcaccauaucccuaugaguucuuaaauguccuucuguccauauuagacuggcaggaaaagcagggugccuuaguguguaagcuagcauagaggguugggucaguggacgagcgaggcccugagaccccuugccaguccugaggugaggcuacacuaaugagcuaccuuuugcucuucagcuuccuuccacuguauagccugauguguuuugcuacgugaguguacgccauaagcuugucucccuggucuugauccagugucucaucuuugcaccucucucacaacuccuaucagaguuuguuucuaauggaagagguucacaugauaaagaacaaaccggccaguccucacaucaagauagagaugaaaaaugccaccuuggcaugggacuccucccacuccaguauacagaacucgcccaagcugacccccaaaaugaaaaaagacaagagggcuaccaggggcaagaaagagaagucgaggcagcugcaacacacugagcaccaggcggugcuggcagaacagaaaggacaccuccuccuggacagugacgagcggcccagcccggaagaggaagaaggcaagcagauccacacagggagccugcgccugcagaggacacuguacaacauugacuuagaaauugaagagguaagcuaccuacccguacccucucugccacuucagcccugacuccugugucaccccagcuugacccuggcaagacccgcccuuuaagcagaguauuuugacuaugagcaguuuugaaucaagagcagauuggacucugauuccaaagcgagcaacagaacuaauuacuuaugagaugcuugcuuuacugauaaggaggugaagcacucagguggaccuuccaagacccugcucuggguuggcuucuggcugugauggcuguuguaauuaaauucacugcuguaacugugugggcuccuggucaacaucacguugugcagcauagagaacuuggcauauaaaagguauucucaaugcugccuuuucuuuuuccuuuuaaauuuauuugacauaucuguuuguaggugugugcacgugagugcaggagccaguggagggcagaagacagugucagauucucuggagcuggaguuacaagugguucugagcugccugguugacguaggguccuuugaaaaagcaucaagugcucuuaagccacuaagccaucucuccagccucucagggcugcucuuagcaacuguauuguaauaauuuuuaaaaauauaagugaagggugauuuggguauagaauaucauagcucagcuagcauagacaugggcucucagagagucccuuaaaacacagauuuuaggucgaagauuuaagauucaaacuaugacugagaaguagccccauucacacuuuccuucaguagccuuugguuuuuuuuuuaaguaccagcuuuacaccaaguccuguugaaggacugagaacaaacaacagcagaaccuacacagucaaagccucuuucuggaguuuacgucccuaguggacagacacaaagcaagugucagguugugguaagggacgaugcaaaggaugguaacggagcugggacagcagcuguugugcuugcauuuuuaacacauuuucuaaggagaagaccccauucaaaggauguuuuagucaggcuuggcaggacauguccguaguuuggggcaggcugugguagaucacuaugaauuugaagccaaccuggauacauagugauacccuagcuaagaaggugguggggaugggcauggcagguaaacccaguaaguaccagugagagaggggaggagagagaggagagagaggguaguguuugagcggagaacugagagagugagucgugagacugucuaggggagagggucauagcuaaagagcagaagcagagagcaaggcucuccgucuggagugugcugguuccuggaccaggaugagugugggagaugauggccgauggcagauuugcagaagugccuguggauacauaauguccugcuaggcucagaaggguguguggagaaacaaggaaggaaagaaggagaggucuaaggggcugcuccuccugcugcagugcaggaggaagacgggagagugauggagacagggcuggguagaaaugcugcagagcuagaaggaggcacugcugcagcaaguggccauacugaccgcugccuggggcaccgugggcagauccagagguagacccaggagacagcauccagauuucugcucuuagcaggcggucggggguggucaccggaaacugucauguaguuuaucccacauaggccaaucuuagcagcaguuugcuuacuugaugacgauuacugauuucugagguggucccaccgugucacuaaucagcucuuuuagauacuggcuuugcauacucaacggaaaguuacucuuccauuugguaaugugauacuugauucagugaggaacucacccuuccuccugagcucagagcccagugagggaaacagacacaggguuggcuugggauaucuaucgggacacaugauuagcagaugugguagagcugaaacucuggugcgaacugccugccugcagucugggaucacuucugcaccacugcucuagccucccuccuucucuuggggacuugauuaccaucacacagaacugccacacacguggcucuccuuaaaguuaacuguuggccagaacaauggcucaguaguaaagagcacuggcugcucuuccagaggaccuggauucagagcauccgcacccacaggcggcucacagccaagcuccaguuccagcgguucugacaccuucuccuggccuuugcaggcaccaggcacacaagugauaugcaggcauacaugaaggcaaaacacccacacuuauauuaggcagguggaucucugaguucgaggccagccuguucuacacggugaguucuaggacagccuaggcuacacagagaaacccuguuuugaaaaaccaaacaagccgggcgguuguagcgcaugccuuuaauuccagcacuugggagguagaggcaggcggauuucugaguuugaggccagccuggucuacaaagugaguuccaggacagccagggauauacggagaaacccugucuccaaaaaaacaaaaaagaaaaaccaaccaaacaaaauaauaauaaauaaaacaauaaauaaagccaggugugguggcgcacgccuuuaaucccagcacucgggaggcagaggcagguggauuucugaguucaaggccagccuggucuacagagugaguucuaggacagccaggacuacacagagaaacccugucucgaaaaaccaaaauaaauaaauaaauaaauaaauaaaaaugauauuuuaauguauauaauacuacauguaguuccuacuaaaagaaaauaaaaauuacaauuaaguaauuuuaaagaguucugccuugcaaaaauacaauuaaaaaauaaaagcuuauacugcuugcagaguugguaagaggcuaagacuuccuaaaagugauugugugugacagucuuuccagagggcuuccgugucccuguacugauggaccaacugcagguucuuaggaugaguggcugguagucucuugaugucguuccucucucugugcuucgucuagggcaaacugguuggaaucugcggcagugugggaaguggaaaaaccucucucguuucagccauuuuaggccagguaagacguuuguuaugcccuugguauuuucugguccuuuauuaggcuuggcuuagcaaacauuucaggaacgauaagcucaguugcugaagagucaguagaggcguguugguccucguccaccccgcugcuggccacagucucuugggccaccaccaggccagugccgggcuguagggaagcuccaagacaccucuucaggggugggaaaugcagucugagaugugggaaagucagagcugguucagggcucccugggccugugacgaggcugggaucaugggguucucagacucugggacauuuaggcaccacugggagucaaggaagagccaagaaugggguugggggauggggguguugggcuaggaacagcaucuagccuggggcugggggcaaggggagcucuggcuugucccagcggugauuguccuuagcuuggcagaggcaggcuugguggcaguuguggcugggagcacagagaggccuucuacaggagaauuaagcugugguuccauaggcaaacgccuucuccaugcuccccacagcggaucuugaugaaagagacagucugugguucuaaacaguuuauuggcuguucaugguggaaaauggaugcauacuguaucauacucacuucucagggugggccugagaucaaauaccuuuuacagagaggaaugucugggaagggaagcuuaugggcaaagcccucugggccucuagguaccucauuagcauggagaacucuguuuugggccuaugucaccacaggacauacuucuuuuauguaaggagcauggcacauguucuaggcagggaguggggaguugccucaaucucagguguguaccuaccgagucucugggccucugcacgcucuaucuuaccaacaaagguggaaacaaagggacugugaucagcgcuucauuucuccaucuuaacagccuucugucuggaauggugcagugaaugccuggugacuggcuaauagacgcacaccgccaccauuuguucccugugccucuucucauucaggaaguagggaaguaguuacuggauguguguggcaggugugcuaagaaaggaagcagcagggaugagagggaugauccaacaccccacacuguagauucugacgcguacucucgcuugaucuucagccuaaacccugagacuguuacuucuucagggaguucauguccagaagagacucagugaucuagauacacaaguguaucaugaaacagcaagagaaaaguguagcacugugagagagugaggggaaagaguaagcacagauuccuugaguguguagaacccagucaucagaaaagaguaggugccagcauacaagauuucaaacaccuugacuuugaugcagaugaagaugggcaugcaguuggcgccacuucuugccaggugccgccuucugaacuguuggggacagugggaccuguguuuugaagacaguuuccuuguccuguuugguaccagccauuguaguguacuguaguccuccuagagcacaggacugcguucugcuuuaugcuaugcuaugguccgugggcccagcucugggucuguaaaaagcaagagccuaacaggugguuucucauaaucagccagauuugagggccaguuaugaagcuggggcucuugggaguaugaaggucaucuuucacagcacuucugaacauuugccaggugcugcuuuucagggggugucuaggcuguggcuaagcuuaaaccaaguggguuuuggcuuucguggauccaauccuggcagccagacagggaggcugguagugcaggucaguuguccuuucuuuagaguuuaacucuccgcugacaguguugcugugagcagcuaggaauguagcuuucugauuugcacagcaaauugauugccaguuuguaggaaaaugucccugcacacacagugugugaugguguucguaagggcgggcuuauuugucacgcauuccaugcguucauuaaugaaacuuugcuucauagcgugaucauccuuaacucaaacagggucuacuguuggucucaauaagaaucaugauacaaguggugcaucaguugguaucaagccugauagaagacacaucagggggcugcagagauggcuuagcucagcacugacugcucuuucaggggaaccacauugaauucccagcacccacaugacagcucacaacuaucuguaccuccaagauuugacagucucacagacauacauugaugcaaaaacaccaaggcauauaaauuaaaaauaaguaaaugauuuuuaaaaaaaagaaaaaacaaacaaaaaagcuuuuggccugaagagauggcucagcaguuaagagcacuaacugcucucuuccagaaguccugaguucaguucccagcaaccacauggugguucacagccaucuguaauaggaccugaugcccucuucuggugugucugaagacaguaaccauaugcuuucauacauaaaauaauuuuaaaaacagaaaaagaaaagaaaacacaucaaagcuauggcucugcaugcagccucuugauguuggugggaagcucucuaggcuuauuauuauuauuauuauuauuauuauuauuauuauuauuauuauuauuauuuggaugcucuucacaucaguugauauaaccugaaguucuguuuccucucugcuccucacuucacagaagcagcugaucuagucaauauccuggaugaauccuauagauaacuuggccacccucgccuugaggcagguucuggcuacaaauuuuuauggcacccucuccagggaacuuugaaaagaggccuucuugcuuguuguauuguuaguuaggguucucuagaggaacagaacugauagaaugaaugcuuauauauauuuauucacaauauaugaauuacauaacaaacauaauauaugaauauauguacacauguguuuauguuacaugauguauauacauacaaacaaacaaacaaauaauaaaauauguauaaagggauuuuuguuuguuuguuuguuuguuuguuuuguuuuguuuuuuuugagacaggauuucucuguauagcccuggcuguccuggaacucacuuuguagaccaggcuggccucgaacucagaaaucugccugccucugccuccccagugcugggauuaaagguguucaccaccaccaccuggcuguauaaagggauuuuugaauggcuuacagacucuguucauuuuggcuaguccaacaaugucuguguccuaauaggauugucaagaguccagcaguuauccaguccaccaggcuggaugucucagugauuagcaaaauaaugcuucagcaggaggauaaauuaacuugccaacuaacgugaggguaagcauggaaaaaguaagacuguccuucugccauguccuuuuacuugggcuagcaccagaaagucugcccagaucucagugauccagauguagagugggucuccugcccuccaauggucuagguuuagaguaagucuuuccaccucaaaugauccagucaagaaaacccccagcaagugugccaggugcuuggguuucaguuaauuccagauguagcaagcugacaaccaagaucacccauugcaagcucacuucuucucaccuuggcacauacuuacaucuuacgucaugcuuacuuuccacagaaaaacaauaacuagguuguaauuuuucauaacaugauauaacuaucccauguacaaccucaaacuacauauuuuauaguaggugauaucuuugaggaaucuuggucuuuuacugucuuauaacaaaugugguaacucuucauacuaacucaauguuacauuacaugaugaagaaauaaagaacacaaauaucauuuaauauagauauauacugcacaaauacauucuuuuuuuaauaaagauuuauuuauuuauuuauuuauuauauguauauuauaugaguacacugucaucuucaggcacaucagaaaagggcauuggaucccauuacagaugguugugagccaccgugugguugcuggaaauugaacucaguaccucuggaagagcagccagugcucuuaacugcugagccaucucuccagcccacacaaauauguucuuuguguguguguauauaauauuauauauauaucauauauuauauauaucauauaauauagauuauaucauauuauauauauaucauauaauaaagaucauaucauauauaucuuccauuuaauaaugaauggcugcucugcacauccuacucaugacuuguugggucagauacuacccaguuccugauugacagcucaguugcaugauaaugucaugguccauugucaaauguucauuuucuacuaagguuccauagcaggccaauagcagucucuccaagggagaacaguugucuaugaauaaugguagagcuuugcuccaaaauaccaagaggcucuuuugugauucuuuuacaauggcagagcaucucugucugccacugacaccucaaguacuaucaggucugcuggcucauauggccccaguaguagagcaaccugcauggcagccuggaccugcugaagaaccuucuccugucccaggccccacucagguaacagcuuccugggucacuuguuauaugggccugaguaacacacccaagugaggaaugugcugccuccagaguccaaauaggcccacuguugcuuuucuguugcuaugaagagacaccaugaccaagguagcuuauagaggaaacaguuuacugggccuuacaguuuccaugaccaucauggcaggagcacagcccagguaagcaggcauggugguagagcagaagcugagagcucuauguccugauccacaaacuaaagacagagagaguuaauugggaaucuuguaggcuuuugaaaccccagaaccugccuccaguaacauaccaccuccaacaaguccacacuuucuaauucuucccauguaguuccauugacuggggaccaaguauucaaacaugugacccuggggugggaggcauucucauucagaacaccacacccacugaggauuguccuucuuucaugguggugggaggagccaagugcaauaacuuauccaucaccuagggaagaauaucucugcauuuguguuaccaacaaguucaagguguuuucuccuccugcucacuugguacaaucagcauaaugucaucaguauagugggccaaugugauauuuguagaagagacagauaaucaauaucccuucaaacuaaguuaugaaacuaggcuggagaguuaauauauccuuaagguaaaacugaagguauguuguuggcuuugccaacuaaaagcaaauugcucugguaguccuuauggacaguacagagaaaagggcauuugcuggaucaguaguugcauaccaaguagcaggagaugucuggucaagcaaagacacagcugguacagcagcagcagagucacagucacucuccguaauccagcugucuuuugcauagaccaggucagagcauugaaaggagacugggaaccugcgccguucauguucuacaguggcacucguuucugucauuucuucagggauacaguauugguuuuaguucucuguuaucccugguagaggugacuccaauacauuccauuuggccuuuccaaccaaaauagcucucacuccacaggucuuggaaaaaugggauucugccagcuuuuaauuguaucuaucccaauuaugcauucugacacugagaaauaacuacagaugaguuuagggauccacaagcucuacggggacuccaucagucccugaccuccaaagacccacguuaacuagauguucacaaugcuucuuguggucuuucaggaucaguuucacucagaacagguaucgaauaccuggaaagucuaugauuauuuccuuuaaccccuguguauuguuugcuuuguaaaaagccauagaucuucugaggaaggugggagaaagacuaacaguaaaacguuuagauauuuucuucaggucauucuuccaggggaucuagcaguucuucauucacaggguucugggccugcaaacugacucaagucuggagauuaguuccuggaccgagauuuccuauucucccauccaauggaggcuuucuuuguuugaaaauuuuccugcuuauacagaugaaacaaaaacauagauuuauuaucuaccgugggacuuucuggacccgccagcaccauuaauuuuuauuauugcuuaggccuuagcuuaggccaccucucagcuggcuccucuaauuuaaccuuauccuagcucacuacccaccauaugguucuuuacuucucucggucuugguaagucagaacaccucugugucucacuggcaaauucuuccugccucugcuucuuuucccagagaccuuggaagcuuggaaguccugccuagcuacuggccauuguguccauuaacucuuuauuaagcgagucauccgugagguagcuuuguguuuacaaaauacugacacaggugaugagccauaagaauaacaauaucagugucuggccagcacucagcucucugcuggcacagcaaucaacaauugaauaauacaaaggcaaccuucacacgguguacaaaaagcuuaccccaacauuuaucaauuaucaugguaacuuaaggucccugugaauuaucgcacacuaaacguccccuuucccugugcugcccgucacagguuaggcuaugaugcacgucauuuuccuuuuggugagucuauguugccagguggccucuguuacuccuggcccaauaagcccguuguauuaacgucauccaauugaacuguagcaucuccauucugucacaaagaaaucaguguugacaaaggccuucagaugugcgggugucuccucaccccucaaauuggggugcagagagcccacugaaguggaugccuccauggguggaaagaaaggcuuuggggagaucaaacugccaaggcuaucuugggugaggaggagagggcagaaagaagagcaaaaaugucagaaaagcagauuuuauaugauggucagcagagugggaggcuuugagcugauauaggcuguucagaaugaccugacugguaaccagaugcccuucccugagguaguugaccuuugagaacagauuaaggaaguuuccucagaguuuaagagaaguugcucuguuuauccaauaacaguccuguuuuggacguugucaccagcacugccuuuugaggggcacuuugaagggugugggggauuggguuuuacacggccuauccagucuaguguugcaauuucccaagccgucaaaucccuucaucaacacuaaaugaagggauaucagauauuucuagcucuucuucagcaggccaucuuuuuaauuaauuauuuuauuuauuuacauuccauucauugcucccaucccagcucucccccacaguuucucaucccauccccccucccccuugccucagagagggugcucccccuuccccuccccuucccugggccucaagucucaaggauuggguguaucccugcugaggccagaccaagcaguccucuguuauauauauguggaaggugggaggggugggcuuggaucagcccauguaugcucccugguugguggcucagucucugggagcucccagggguccagguuagcugagacauaggucuuccuaugggguugcccuccgcuucagcuccuucaguucuuccccuaauuuuuuuaggggccccugacuucauuccaaugguuggguuuaaguaucuuuagcaggcuaucuuaagacaaauccuucaccuaaccaauugaaggaauuuuuggcuguuuggguucaggaaucaccccacaaacuaaucagacacugaucucagucaaacagggauaguuuauuuucagaccccuucccaccccucaccuccacacugguccaucaaggacauaggccagacuugggagcugagacugcaagccugacuguuucccagaggcaacuuauaaagcaaaccccacgaccauaaagagucguacacagaugcuggaagugcugcuggacaguugcagacguuggcucagguccaggcuuauuguagcaaagucuacaaagcaguucuaagugaccuuuauugugacuggcucuaaaggaaggcgagagccuggucuacaaagugagcuccaagacagccagggcuacacagagaaacccugucuggaaaaaacaaaaaacaaaaaacaacaacaacaacaacaaaaaagccaggugguggggcgcaugccuuuaaucccagcacuugggaggcagaggcagguggauuucugagaucaaggccagccuggucuacaaagugaguucuaggaaggugaggaucuggggaauuuccaagaacaccaaagcaaagaacuuaacaaaauaugcaguuaauguuuaacugggcacgagaaagguccucuguaacaauguaagauggcuggcugcaaacauaaaacaaaauggcuacaguaauguuggaaaggcaguggcuaccuaggucuuaacauggcacccuuuaaaaacuuucauauuaaaccuagaguuucagucagucaguccacauugaaaaacucaaccugauccaauuuuauguuccccauuaucccauucguauaaaaaucuauuuccacacauauuucccagacuucuacuugaaugaauugguuaaaucauuaagcucuucaguaguguagggcaccuccucauggacuacacuuucucuccuuuacaccuccuggcaucuucuucagggaaugucacugggcauccuacagacacuguaggaucaauucccucugcaaaggugaaaggacaguauugcugcugguagagauggggaugcauccucugcuaaggcuggggagauagauccugcagaaucugaggguucgaaguccucagccacaguagggucccuccacaccuccaucaaaguuacaggguccucuccuuaccuuuaaccauggacagccagccaccacaacugaggcuuggaguuuugguucaaugcagcaaaauuauaauaaggguugcaauuuaauuuucuaucauccuauggaacagauucuccuugcauacuuagaaaccuguagaccagugccucucagccuuccuaaugcugugacccuauaauuuaguuccucauguuguggugaccccaacuguaaaauuauuuuguugcuacuucauaacuguaauuuugcuacuguuaugaauuguaauguaaauaucugguaugcaggauuucugauacucagccuucaauggggucccaacucacaggcugaaagcugcugcuuuagacuguuuauuugaucuccagcugauccuuuguauucauuuuuuuucuuugcccuggaucccaagaugcuacaacgagguuaauucuucucacugggcucauucuuuuccuuuguugucaguuuacccagauaugcuagaagcaaccagccagcaucauucuuuuucuaauuuuuccacaaauuaucaaaaguuuuauauauugagucacuaaauuccuugcuucuuauaguaggugaaucaggauaaucgaguguaucuaucuugauaaauucuucuaagaguucacaccauagaucuguggggauuucuaugcuucuuggagaggcuucaguaacuguagauauuagcaaacuggaaagccgacuccagguacuuaaaauuucauccuuauaagucuguuucucuugaaccauucaugguaccacaaucuguuuuaguuuugguucccuaggugucauuugacuguugauguauucauuuguucacauagugacauuuaucaggugugugugcuggugacauguuuacaccggcuuacagucacgggauuugcuagggaagcuugcaguccgugggaucucacuagauuguucccccaacaggaaggccuuggaucuggugguuauucagucgcagauacugagugucccagcuucuuucugucuguucugagucccagagaaauagugcuaaucacugaaagaaagccucagcaccaggaugaucaacuuggugacaagagugagggcgagcaggcgagaagggaaaacaucuuuucuccauuccuugcaugugggcuggcaccagaguguggcccacuuugggguggauccuuccauagcaaaugaucugaugaagaaaaugucaaacagaugugcucaggugcuugggugguaguuauuccagauauauagucaacuugauagucaggaccagccaucagaguuauacuuuuauagugacauuaauuuacaguuagagaguaugcaacagcuguggguugcugauugcagggugugugagcagucaauaaguaaguauaacauccguguucucuguugcuguagcugucuuaagaacaaaaaacgugugaucuggaguuaaguccuagcaacagccaauacucagucuccauugacagugugggugcuguguguuuguuuacggugauauuuugauuuacaccgcuggaugaugucugucucccuagaugacgcuuuuggagggcagcauugccgucagugggaccuuugcuuauguggcccaacaggccuggauucucaaugccacucugagagacaacauucucuuugggaaggaauuugaugaagagagguaagcuauauuuuguuucugucauugauccuuuggcuaugugugagagaaggcagcccaucaguaggcuuuuuuuucuuuguaaucaaguaccuaacuuucugugacuuuguguccuucagauacaacucagugcugaauagcugcugccugcggccugacuuggccauucuccccaacagcgaccugacugagguacaagcuuuccgcccuugauagccacuguagcacagguagcaggaaaggcuuuggaaggcuuuggaaagcuuugcaaagacacgccagaaucccuucguaggacgaccuccucggacagaagcacacagggagggagcacuguuuucacugagccauuaccaguaaaacuuuuguugaucagcgcaaggaugucagccuugcuuguuuuaguuuuuuuguuuguuuguuuguuuuucgagacaggguuucucuguguagcucuggcuguccuggaacucacuuuguagaccaggcuggccucgaacucagaaauccgccugccucugccuccugagugcugggauuaaaggcaugcaccaccaugcccggcuuuguuuuagguauuuauauaccuaaguacuaauguauuucauaugccaugcaaaucuuaagcauaucucauuuggauuccaaauuguuuuguuuuguuuuugcuacgcuuaauuauguuuuuuagcagagcauagugaugcaugcauucgucucagaacuugugaaguagaggcaggcagaagcauccuggucuacauaucggugcuagggcuauauugugagacgcccugagagguggggugguggaaagaaagaauuguguagauauuuuuuaaacugcgagucaaacaagugcgugcugagcugcuuucccagguuccacggccuucgcuagacagaaagagccuuaggaugcucucuccccucuguccugagccugcucuggagcacugucucaggaccugcugugugcuuccuugcugguguuucucuccugcaaccuguccuguggccucuggucuggcacuuuuguuuagcugacuucaguuaaacccucaaaucagauuugguuaugguuccuacguucucaacucuugguccccagaucagugguaucagugccacuugggaacuuguuagcaaugccuuguuaggguauaccucugagcagucucucauaauaaccucugcagguaauucagaaacauacagaaugugagaaccucugaucaucagcauuuuuugucuuuuguuuuuauucuaaagauaacacuuuaaaaagcaacagaaaaccagguagcguuuggcaauugauuaauuuguucagauaguggcauuugucaggugugcaugcuagugacacauuccccaguugcccaguauuuagauauaaaggaguaggacaguaguuuguaugcauaagaagcuuuuaguuaagggagccagagacccagauaaauuggcacagaauaagaagggcccucauuuguggguagaauuagaagaggguggaggagugucccagaagagaugaugcaggcuucaugucgacaaagcaugaugccauguggguucauauuuuacauguuauuuuaagucucaggauacccaugguuguuaguguuuagauucuuucaagguucuuaaagaguuuuaggcaagggugccuuuuguuuugaggcauucuuucuggagaagagggugaccuggggcggugucaaagggugaccuggggcagugucaaagccacauggauaucugauuggcacauugauaguuguagggugacuuccucagccccuagaaguuucacacaggcaguuugugaaggcuuuggaaauggagaugaaagaugacuggggugccuguuaagcgcucuucuagauuuaagauagaggcuuuccuuuuggguucauagauuggagagcgaggagccaaccugagugguggacagcgccagagaaucagccuugcuagagccuuguacagugauagaagcaucuacauccuggaugacccccucagugccuuagaugcccaugugggcaaccacaucuucaacagugcuauccggaagcgccucaagucuaagacgguucuguuuguuacacaccaguuacagguaugguacauugucuccuaggcugcucaugugggcucaguaaugaagagggcuugggccagagguuccuagaguuaacuguuuucauuuccucaccaaauagccaacguagcaguccuuuguguggccgucugaaucggggguccuuggaacacacugguucugcagcagaccuacaaauuaaagggcugagaagagcagauagaaguggacuuuggaagggaguuagugguaggaagcacugagguggcaucugucgaugagaacaacaagcgcaguuuguacuuucuccccaucagucauggcaggcauuagaaacccacuugggauuaucgcugucugagcugacagccuaaguuuggggccuaguuucucuuuuuuguaaguucuauauacuucugcacacagugaaaggauuugaguuaauuuauuugagacacugauugucucuugcuuuguagacuagguuggcucacccaccucuuccuccugaguaugggaucaaacgccuaugcuauaccacacucagccaggauauaaaauguccugggaagcuuuuguagcuccaccacccaauguuguagagauuaucuaguccuguccugggguuuccacccugccuuuggcuauuuaguuccuggauaaaagacacacucaacccuuauauuuacaauaagccuuaaucagcacaagaacugggcacguauacccucuaugccacuagagucuaauccguauugguguugauaaccccgaguuauuacuuacuauguuucaucuccaauuggccagcccucaggauggcauuuucaugacucgccugccccaugguggcuucucucucuucuucuaccuucucuuccuccuauuguucucccccacccuaaagcccgggaacccuaaaccccuccugugucucaucugcucagcuauuggcuguccacaucuuuauucaccaaucagaaauaacuugaggguaaggucuguguguggacucucuuguuucugggacaaccaggucuugggaacccucacuuagcauuauaauagauggcaaaagacgaaaccuuaacaccagaagacauaagaaauucuaucugaccugugucauagggcgcaguaagguaaagcaaaggcucucagucuugagacuguagacugcugauucguuguuuggcggggguagucugcuguaugcauucaggucuugguccacuguaccccagugguaucuuauuuugacaaccugaaauagucucauguugucaaaugggcagccaaagcaucucugguugagacauaccgaguuaagauuggagguuugaauguauuugcgggaauaucagcaauuuguguuuccucgccauugucuccaguaucuggucgauugugaugaggugaucuucaugaaggaaggcuguaucacagagagagguacccaugaggagcugaugaacuuaaauggggauuacgcuacgauuuuuaauaaccuguugcugggagagacacccccaguugagguaaggcuuacugcguuuauaugucucauuucuacacaggcaggcaugauggcauggaagccagaagagcccaguuuaacucuguuugccuauggguucccacaaccacacuuuugugcuguguucaccugcuccuucuccuguggaagagcaggaugaggagcgggugagggcuggagagguucgcuccuuaaaccgacuaaagcagugugaggcucucuguggacauacaaguaaacaaggggucagucagggaggggaguuacauacuguguguguuuggaaauaauucauggugucuuggauccugauuuggcgcugagguuauuggguuaaauacuuuagauaccauauuauuagacauuuuauuagaguuauauggccaaauacgauccuuucccacucucagagaggagaaaaugggcucaagugagcuaagcagcuugcugacaggacaguucaguucuccaguuuguuguguuugcguccaccuccccugcagcacccagaggugucggcuuucagcccaucacaggaacuccaagcuagacagacucagcguggagcagucccagaggacaugcuuccuuccugucagugccccucucgccuagggucccggagugaaguaggcugggcuuggagguugcugcaggauguuccccggccucccucuccugucaccucagugguuuguuuuugcaguaucccaugcagugcagcucacuguugcuuaacuggcugguuagaccuugugguagacuuccugccuugcugggauuaccagugacaucccaagagacacugcgguacagauuuaaguuuuccuccuccuccuccuccuccuccucuucuucuucuucuuuuuuuuuuuuuuuuuugguuuuucgagacaggguuucucuguguagcccuggcuguccuggaacucacucuguagaccaggcuggccucaaacucagaaauccgccugccucugccucccaagugcugggauuaaaggcgugugccaccacgcccagcuucagauuuaaguuuuauggucugcuaugacuucuggaaagcuuugcacucuucagauuguugccuugucuuuguaaacuuggagaggaaaaucagagggagagaaacuaaaauacugaauuguccaaggagcaaaaaauagauacugaaccgcuggacuguuuggcuggagagaaugcuuucuggaugucacuuguggggcuaguaggaugguucagcggauggugacacuggcucugcaagccuggccaccugaguucaauucccagaacccacagaguuguccugaccuucacacgucugaaccccgacacacgcaucacagugguugcuuacaguugcugccuuuaguaauacguaauacauuuaucccagaaaguaguccacagaagguaauaucauuucagacagugcauuuacucauggacuauaugaaauauauuuagagccuuaucuucugucccagauuuagcucuauauagauuucauauuuuuaaauuuucacuguguguuuagaaagucuaguuggcaagccugcuggggguaugcuauaucauguaaaauggaauucagugaccuauauggaggaaauuuucuaaaaauauaacagggccuuggcaaauguaacaggaaagcauuuaaugguuuuaugggggucauuuguuuguuugaugaauggucacugauucccucugggccuuguucugggugguacugaguaggggaccuucagugagaacaccucugccuuugguggauguuagguguuguagggcagaccggugcuuuucugcucucacagguaacuaaucagauacugcagugugcugacagaguacugagggcacaugugagcuuuuugcaggggauguaggucaccuuacacaaacugaacacauccggguagggacagcuuugacuaagauugaaaggaggaggggaagagggcacagcagcgggaaguugaacuguggcuaaggaaugaugugaagucccguggcugcugaguagagccaugggaagccacgaaacgggaaaggacccgacagcccaccagugcagagugcaaaagcaagcagacaaguuugggguucugugguugcagagggagaaaguggcaggucagagaugcaggaauggaugacugcaaugugacuuuaucaccuggacaaauuagaggacaauguaauaaacucuuuguuuugagagguuaggucucgaccagcuuaguggacaauaaacaggauaggaauguggauugcaaaaaauuuaagagauuguuaguacaggaaauuaguguagauuauuguaggacguugucuuaagaaagcaggugugugccgggcgugguggcacacgccuuuaaucccagcauuugggaggcagaggcaggcggauuucugaguucgaggccagccuggucuacaaagugaguuccaggacagccagggcuacacagagaaacccugucucgaaaaaccaaaaaaaaaaaaaaaaaaaaaaaaaaaaaaaaccaagaaagcaggugugugggcacagugucugccugugaucccaccacucaggagacugagauagaucagggucaguguaggccugacacagaugcuuaguaucaaaaaauaaauaagaacuuggaugugucacaguuuuguuauuacucaauaaaugcuucucuaguguggguccuguagacauucaucugaaugaacaucuuaugacuggaauuuuuuuucuuauguuauuagauuaauucgaaaaaggaagcuacugguucacaaaaaucacaagacaagggcccuaagccagggucagugaagaaggagaaggcggugaagucggaggaagguaaggacauuuuugacagguuuaucaggaaaaaugccacauggagauaaugcuuccugucacuguguuacauuucuagaauaacaaaguuccgagauaauuuaggugugggaccuugggugugcucaaacaagggaaguuagcugaccucugauccuuugccuuuucuucaugcaaggaauggaguccgcuguggguaauuagugcugaaucauccugagucagccugcugacccucccucccuuccucccucccuucuggucaccucuguacuuacuuugguguccugagcaagaacugauugucuuagcugaaggacagguccagugucuagcagaagucucuggauugagggucaggauccuaggggagucucucccgccacagagcagaucaaggugguauuucuugagaugugcagagcauuguucuugguuucuguuuaaaugcugugcauugggcauccugggguucuaggacuguaucugguuaucaaaugcagccuuugguguaguggggaauuuuuauaugucugaagcuauuuuuccaugucuaaaaggcauuuuuuuuacuauguuuauuacaguuggagucacaguuaaagcucgaguuaauaaagccgaguucuuuguuuucagagucugugcuagaccaguaggcuuauugccugguccuggcaguguuugcagagaauucuacacaaguuccaggcggcaguuuucuuucuuggacuucuuaccagauuggggucugagagacuguuuguaugauauaggcauuuucauggcugugagucugaagcauacaucaccuuugaaaucagaagaaaaugcaguuuguuuaaugaucucuuuacugaaucaccuccuuaccuuauaacuggaauuuuuaggauuaaagccuggguucuauagcaccaauaaaugguucagccaacaguccugaguuuaccagguaaugaugaaaaucaagagagaacauuuauucaaugugacugccuuuggaagggguacggauaacgggguccagugaccccaaguucacuuguaguggccugacaugagcuuuaggauuaaauagaggaauaccugggcacaugguuugcacaauaaagcaauucuagucagagugcuucuugcccguccugguucucaggugaucugccuguuuuuacaagaugguccaggguacaacccugcuuguuggauaauuacuguccugggugggaacuaccugccuccuugugagguuugugacuuauguuauguaugggucugggguuguucagagauucaccagucugaccaagaauaauuuuaacaaagaggcuuuuuauuuagauacuagccugcugggacuauagcauccagcgcugggauucccagggugcagcaucaagucacaagaaaucagagggcuggagagauggcucagugguuaagagcacugacugcucuuccagagauccagaguucaauuccccgcaaccacaugguggcucacaaccauuuguaaugggacccaaugcccucuucuggugugucugaagacagcuacaguguacucauuuacauaaacaaagaaauaaauaauuuaaagaaaaaagaaaagaaaguuaguuauacaggcaaagaaaguuacauugcauuuaugugcaggcacacauccugcaagugaaaggccacauucuguuuaaguuuaagcacacacuuuugcagaagccagguuaaccuucugcauaacaauuuuguuagaaagauaagaauagcccuuaacauucuaggaagcuuccucccuuuggcccaguguagcuuuuagguuagagcugagugauaaagagaaaaggcaaggaaaggaccugacugcuucugggugugcuguaggagcaaguuuauuauagauaaaaaagagaccgccagaggcagacaugucugagagaguccagaguggucgugacucugaaccaagugagagggaaugaggagagggacaggagagggaagagaggggagccaggagcacccaggaggccgaagcuacaaaaggggugaauaacaaaaaugccuggauuagacugggaagaaccucugggggaugggcagccucacuccugggcuugagaguucagggucgagaguggggugugccaucuguacccuguaacagguaagggacugagggguacagaacuuggaggccaggucugcuuugauguauuaaauaggcaccucagccacuucccuggguuugaaaacuuaccaagagguaauuuuguuuuauagacuucuuaagcacagugauugaaacguaaaacaucauauuagcuauugcaugaagguuuaggaaaguggccuacuguuucgcuggccuggccugcaaacuaugacacuguccucagugaggucccugugagaccucaucuuguagauggugcugaaaaaauguucagugaaugaauguuuuugauggagaggaggcaguucuaaucuaguguccuuugaggcuaaagguuguuauucugcugcuguauacauacaugccuuagcgugagaggaacaguccuauaaagaggaaauucccuagacaggucaaagcaauagaguucaucugggaaaaacagauucaccguuggacaguaccagacccagguucugaaacuugugccaacaaugugcaguuguucagaguagaguacaguguauguaacuggcucuaacuuacccaguuccucacugucuggcuuaugcaugucuucccacugcccaccaaagcuggagucugugacuaaacucaguguuaaaugggucuuugggcagaguguagugcuucagucacauccacagcuucccgcaaaguuuucuggcauauuauucccgucuaaggucauguaucuuuuccucuuucccagggcagcuugugcagguggaggagaaagggcaagguucugugccuuggucagucuacugggucuacauccaggcugcagggggccccuuggcuuuccuggucaucaugguccucuucaugcugaaugugggcagcacugccuucagcaccugguggcuuagcuacuggaucaagcaaggaagcggggugagauuacacauugcugagaguuaugugucugauaauguggccuugccucccuagucccugacuguuuuagagaaacuccuaaaaagaacccuuagaaacaucaugggauacccuaguaaugugcguaacuuuguucuguguaucaguuaaaagauaauuuaaggagaaaaagcaguggacaaagauguucucagguuggggaauggauaaauaauauagucucacagaacagaaaaaaaguccccgggcaacucuggggcuauagagcuagucaguaauuagugcaguagccagcuccuuguguccacccacuagagaaagaagugcccagcaagacugccuugcguuugccaugagcaguccccuggucauucucugugucucucuccuugagcugaaagugaccuaguugucucaggaaucuuacuccaugguaacuuacauccaaacagaacagcacaguguaucaagggaacagaagcuucgugagugacagcaugaaggacaaccccuucaugcaguacuacgccagcaucuacgcccucuccauggcagucaugcugaucuugaaagccauucgaggaguugucuucgucaagguaucaccgugggugggcuguggugcacgcccuuccccaggucacaggagaggcuugguguggcagauguguacaguaggguggccccacugaagaauguggacccuguuagucaccgugacuucugacuacuuguacuuucccagcguugggaauggauguccugcacaguggucaccuacaggaguaggaagcaagccuuccuuggguacccgggucucugggccugauuauugugucucuguuccccagggcacacugagagccuccucccggcuccaugaugagcuauuccgaaggauccuuaggagccccaugaaguuuuuugauacuaccccaacaggaaggauucucaacagguuuuccaaagacauggaugaagguaucucucacugguccugucuuacacucuggaguacaaccagugcucgcugccucuggccuuucugggugccaaaccccucaaccccucucuuaucccccuaacugcccaguacaaagagaguaugcagcuuugucucuccuaagacagagaacagagucuggccuuugcagcaguguuguggauauauuuaaucuuaaucagaggcuucuaccugccuuugaucauucaguucccagauaaaagacacacaacuuuauuauuauuuaagccuuuauagcacucaugcugggcaggcaucuacccaccuauacuauuagaaucauuccuauugauaaccccaaguuauuacuuacuauguuccgucugggcuccucuuaacuccaauaggcagcccucauggccaugacguuaagacuuuuaccccauggugucuucucucuccucucuuuccuugcagucucaucugaccccaagcccaggauccccaaaccuggcuuauguuucuucuguucaauuauuggcuguuggcaucuuuaaccaguaauuuuaaaucaaggagcaaggucacauuguaugugugauucucucauuccucaagggucccaagcaaccaggcuuugggggccaguacuuaucauuacaauauguaucaaaacacaucagcaguauuuugccugaguucucuuucugccaaucuaacuugaacacaaggacagagaguugagcgagcagaggggcuuuggaagggauaucugcagucccagagcacagcuucuggugggcuucuugugugcagcacugucugugccagcaccagaacucauugcaucuggcagugaacagcacugggugcuuuauguaccugcccuaauucacacaacagcucugugaggcaucuguuguuucacccauccaguacagaagaagguuauauccagaaagauuaaguaguuugcccaagaucauacagcuauugggugaccagguugggaauugggcucagauuuguucccucaaaguuaguuuuaucuauuuccugcacaguggucaaccucaggaggagcuuguuugaggggucaguaagccaguggaaggcuauggcccgagguaaaaggaaccaggagcaggcucgguaccagaacuggugcauaacauguuccaacuucuggacacauguuaggcucauugugcacauuugcacagacacaugcaucucagacaugcaaacacacauaugcacauauacacacauguacaugcaugcacauacagagacacaagacacauacucucaaacaugcauaccuguacacacagaggcacagaacacacaugcauguacauacagauacacacacaaacacacacacacacacacacacacacacacacacacacacacacaaagauaaaagagcuagaccuguugguucaguccuugcacuggagucugagguggaaggauugugguuuucaugaagauaccuucgcccaaagaaggggguggagggaaagagcuaaaaagaggagaugcuacuguugaagguucuguagucuuuaaugauuacguauuuuucaguuuuuccuguggugguaagaagauagauuaucuuuguuuuccccaaguauguuauuauguugacauauaauacuuuauaguggagaacuguuuagcaagaguaggagaaacugacccaaaaagagaagguggaagaggaagaccacucacaggaaagugagagcaauuggguuuguuuuuccuucauaaaauguugacguuaauauacagaccucaggaguuucauaaaguuuucaaaaaacaaaaacagagccgggcaugguggcacacaccuuuaaucccagcacucaggaggcagaggcaggcagauuucuaaguucgaggccagccuggucuacaaagugaguuccaggacagccagagcuauacagagaaacccugccucgagaaaaacaacaacaaaaaaaacaaaaacccaaaagccuauuaagcuccauuuuucuuguuugugggauccaagagucugaaacuuguucucuuguggucugugcaguggaugugcggcugccguuccaggcugagauguuuauucagaauguaauccugguguucuucuguguuggaaugauugcuggagucuucccaugguuccucguggcgguggggccucuccucauccucuucucacuucuccacauugucuccagguaaguaggguguguucagggagagagggggccauggcugcugucuuccugcugugacucagaacccauucucucccaggguccugauucgugagcuaaagcgguuggacaauaucacgcagucuccuuuccucucccacaucacgucuagcauucagggccuggccaccauccaugccuacaacaaaaggcaggaguuuuuacacaggucagugcugcugggggccaaagguuucggaggguaacuggcgucucuaaguuagaaugaccucaaggggccauucagggccaaagcuugggauggaaaagcucauccccaaaaguauuacugaugcaguggaacugucucugacugaaacucagccacuugcuaagaccuuuucugagaaaacuagaagauagaaucacagcccaggagacaaacguggauauaugacaugcuuccuuugagaauguauguguguauguuuagauaucuccgaaaggauguguaagaaaaaguagcugucuguggaaagaggaacuggguacccagaaauugguaagaaaagacugacuuuuuguagugagcuuucuaaaacgucaagggcuguguaguuuguauagcacuugcucuacgagcaugaggacugggggccuucgaacccaugcaauugccagaugggcauggcagcucaccugugauuucagccuugaaaggcuaagacacaagaucccaacagugagcuggugagguagacuagccgugugggccagcucuaaguuugguugagagaccuugccuuaguaaauaagguggaaguuuccucaugccuucacaagcacacguguacacacaugccacucugcacgcggacacacgaaaaaacucuuuaaauucucccucccccucccccucccccucuguguguguguguguguguguguguguguaauaaauuuaaugaauguauguacccugcaugugugcagaaacccugggaggccaggagagggcauuaaguacucuggaacuguauauagcuacaugugguugugagcugccuuguguggagucccuuugcaaggacaguacucugagcuaucucuccagccccuaggcuuuuugcuuuuuuaaaagacauggucucggugaguaugucuuuaaucccaguucuuggaaggcagaggcaggaggaucauugugaauuugaggcuagccugguucacaaaucaaguccaacaacagccaaggcuacacagagaaaccauagcugggguguggggguauggagaggaagacguggucucacuauguugcccuggcugguuugaaacucuguauuuaguccaggcuggccucaaacucacagaggcccaccugccucugcuuccuaaauaccgagauagaaggugugcaccuccacaucuuguccucccuaacauuucuaguguggguuuuaguguuuuccaaaggguaacuaacacucgaucacccuguguguguccuccugugugugcagcccauguuucugaagcugccagguaauucugugguugaagaucugaaaguacuugcccuggacucugauccacuggcggguugacagcagcccaugcgggggggguguguggcucuguuuauccuuuugccauuuccucuuccucacagguaucaggagcuccuggaugacaaccaggcucccuuuuuccuguucaccugugcaaugagguggcuggcagugcggcuggaccucaucagcauugcccugauuaccaccacuggccugaugauuguucucaugcauggacagaucccuucagccuaugcggggcuugccaucuccuacgcugugcaggucaguugugggcacuugacgagggaagaggguuggggaggagaauuagaauuaaaauaaucugcuauguguauuaaauacauguguuuguucguuuuaagagucucacuuuuuaaccuuggcucuccuagaacucacuaauguagaccaaccuagccuugaacucagaaauaaaucugccugccucagccuucugaguguugggauuaaagcuguaugccaccaugccuagcacagaaauauucaauaccaguaguugggaggcagagacaaugggaucccgaugauuugagaccagacuugcauacauagcaaguuccaggacagccaaguaggacccugucucagaaaaaggaaagaaaagaaauacacauuauccucuaaggaaacacaugaaagugugccuguaggugugcucaccgccguuucaucgcugggaccuucauacuuuccugaguaguguaccagcuuccauuugcugcucacugugcuuucuguuuagaauccuuuuucucccaaugugauaaauaagcagaagccgcucaucccgagggaugauugaaggaccucaaauagcuccaaacgagucugugaauuugaccacugacuauuuaaagguguuugacaucaguccacacaaguaauuucuaucaauuuuuugggagugagggggguuggagacaggguuucucuguguagcccuggcuguccuggaacucacuuugcagaccaggcuggccucgaacucagaaauccgccugccucugccucccgagugcugggauuaaaggcgugcggcaccacgcccggcuucuaucaaauuuuaaaaguguuauuggagcuguauuauauuuuagagaggcaugagcugaaauacuuaacuauaucaugguaguguuaggguucugcuccacagaauggaguggaaccguugggaauguacgugaagcagcauugacuauaaauggauuauguauucagggaacauucuggcucccaggaguuauuauacuaucauacuguugugugauauuuuuuuucuuugagacaggguuucucuguguagcucuagcuguccuggaauucacucuguagaccaggcuagccucaaacuuagaaguccaccugccucugccucccaagugcugggauuaaaggcguaagccaccaccacccggccuguuaugugauuuuuggcuguuuuguuuguuuuuaaacauauugcaaagauaaaaauaaggcaaaugaacuccaaagagggugucuuugugcaugcccaggcuucugucuagacucaccagcuggcugugugccacacagucuucuaaggugcacagggcugugcugucucuuacagcacuuccuggaaguguuuucccuacuugcuuacagguuggacuguccguguguucugguugccaguaacaggcugagggugguucagcgguuacacagcuuaagacauguguuacuggaaaccaagagcacaaaagcauggugcaccagugugacucggugcuguguucuaugaggguauugggugugguguuaagugcaagacaaccacugaggcuggagacuucaugcugcaugugugggcgcugguuggaucuguguggcggcugcagguuuaggaagcgcccucugccugcucgcccuguacugacacggcuucucucuucgcuccugucucuuacuuucaguuaacuggacuauuccaguucaccgucagacuggcaucggagacagaagcacgguucacuuccguggagaggaucaaccacuauaucaaggucaggaugcugcaggccuuucuggcuccuuuuggaguucuuuuguucuuucuguccugaaugugggugaggagccucacuuucucuaccugucucauccccacuucugaggcucagcagucucaaccuuaagaguuccugaagaacuggcugcuuucuagaguuaaacgugucacacucagaaaccuuguuuuucaguuaagcuaauguaacauuguuggggcgggccagaggcucacauguccgguuucgagccuggaaggcaucuuggaaucuggaagagaagagggaaccuaggcugguugagaaauaaugaaaccaagacaugcuagucugcucaagguucaaauuuuuaauggcggacaugcuuuauaaaagaggggggaaaguccauucccgccaauucauccuuggagcggguguaaucucuagaauagcucuggggggccucucaucagguagcaguaucuugaagaagaacaguggcaguggcagaacaauagggugaucuaggcaggaaggcuccacccuacauaaucuccuuaguggcagcaaggucagguucuagauagccugcuucaggcuuaugggagacuacauaacauuuuccuuauacucauuaaaaccauacaccauuuucuauacuuaauuuuuuuuuuuuacuuuuauuugagauuguguuuuaguuacaguauuucugccucccucucuuccguccacccccccuacucccuuuaugccccuccccacucucucucaaguucacggucccuuucuccaucaauuguaauugcaugcguauauauuuuuuccccaaauacagcuuugcguuauguauguagcuguauugucagggaagaggcacccagguaaguuccagcucagggcucucucuugggcccugucucugaaguauaaaccauacgucauuuucauucuuaaucuggucuaguugaguucauacagugucgcuuguauguauguauguauguauguauguauguauguauguauguuuucagggcugccugacuggcuggcaguacgggaagaguaccagcugcgugcucuucccugggagggccuccucccccacuuccagcuuuuucagcugccguagugcuucgugcaggccugaggcuuucagugccuuuccuguggaguuuggccugugcacugguguccuccuuguucagcucauguuuggggagccauguuacugagaccuuauggggguugcuucugaaauuacuaggagacacaaucucacagccaaguuucugguccucuggcugcuacagccucccugccccucuucuacaauguuccccagccuuagguuuggaaggaaguauuuuguagcugcauccucagggaacgggcauucgggucaguuucagcucagggggcucugggcccugcuucugaaguaaauuaaagaauaaaguaaaauauguuauuugaauauauagucuggacuaauuccuugacuaaggauggccgccaggaucccuugcugaaccuuugauggagauuaguauaggaugaaauuuaaaguggaaauucuuccuaaccuggagaaaauaaucgauaacccaaaugaucuccacugagaccuguuaaguuuacucaacaaccuuuaaauacaauaacugagcagcuauuccuaacacugugcuaucuaaccacuucccagccacacaccugaguuauugcagugugaguugcccugacuugcucugcuacauauguguucucauggcggauucucuggcugacucuuccucacaccugaucucaugaucuccuuucucccccugccuccuggcccuucuccuggauccuuacaagcuucucucuagcucuucucccuggguccccgacugggauugggaguuuagccuuucucucuccucugccuaguuauuggcucuucagccuuuuauuaaccagucagagauaauuagggaguguucuuuaauccuacaacgaacaggagauucuucaaauauucauuaccuugccugugucuugacuguaacgaaaucaagggcacagaaaucugcaucugaauacacagagcaggagaccaacugacuagugugggucuccucuccuagacuaaagugcugaggccagagccggcucgguguuaaagcugcgugguuaacucuagucuguucuacccacagaaaugaauaggcuuggcuguuacugagacuauugguucuucccacccucccccugcagccucucagucuugccuugagguuugucuugcucaaguccucccugcaacucuucaagcaguuuuauguagaaagaaguauugcagggcuaguggagacugcauguuucucaagaucaccucuucuguaagccacccugaggaucacugcauuugcaccauuacucacagggaagcaaacaccgcucguggucuacaaggcugauggucagguggauuugcagaacucuucccauugagaacuguacguucuagcagauguagcuucacuaaugugagaacgaacaucauugauuaucagaagacaucauuuacguauuuacauugauacaggcucuuucuguguagcucaggcuagccaggaagucaugaucuccugccuuagccucccaaguguggguuuagagguucacauaugugaagccauaugugguuuacuuagaagauuuuuaaaaaauaugcauuuuauguauuuauuugguuaguuaguuaguauuuguauaugugugugugugguacauauguccacauguagaggucagaguauaaccuguggggauugagucccucuuucuaaucugucgguuccagggauucacuucaggcuguggagcauggccgcaagcaccuuccccugcuaaaccgucuugcuagccuccgucagauauguuuucuuucuuucuuuucuuccuuuuuuuuuuuuuuuuugagauaagguuuuuucuuuguguagcccugcuguccaaaaacucuggaacucacucuguaguccaggcaguccuugaacucagagaucugccugccucugccuccagagugcugggauuaaagguuguaugcacuaccaccaccugacuuuaucagguuuuucuuucuuucuuucuuuuuuaagauuuauuuauuuauuuauuuauuuuuaugugagugcacuguagcuguacagcugguugugggccuucaugugguuguugggaauugaauuuuuaggaccucugcuugcuccaguuggccccacuugcuccagucaucucuguucucucagucucugcuugcucccgcccaaaaagauuuauuuauuauuguaaauaaguaaacuguagcugucuucugacauaccagaagaggguaucagaucucauuauggaugguugugagccaccaugugguugcugggauuugaacucaggaccuucggaagagcagucagugcuuuuacgcacugagccaucucuccagucccagcuguuucugaaacuuaacaaaugauuauucucauaaaaaguucagguagcuuugugauguaccugauaacagcuguucugcauguucagcuggugcgacuuugugcaguguuguggucugugcugagcacacguguauaauguaacacugaggaacauugcucuugaugagucuuuugcuggaagagagcaggauacuagcuagacaguggagggagaguggacgcugcucaaacagugauuguuuugaagauugcuuuccugaugccagucugcaacccagauuccuaucccagcacagucauuccauuccucuacacacacacaaacucaguacacacacucacacguacacauucaugcacacucacacauacacauucaggacacacacagacucagacauacacacucacacacaaacacacacacucacaugcauacucccuugugcuuuucaccuuagugguaugaagucaaugacuauuugccagagaaguuuuaaaacacugagggaugacugcuaaaaccaaucacacaggacguucuaacagccuuuuaauguaggcaugcguucccagggccaguccugcacaguuuggaaaugaggaacuaaaaagcagaaauggcuugaguggguugcaaugccaugcguagcggguacagcaggucauaaugcuaugggugguacgugugggucacauggccauggguggcaaagcuagaauugcagucuguaguucuuagauuggccaacauauuuagauguucaauaaauguuaaauaccuuacuucaguuuuaauucaggccagugauguaguucuguuucaaguggaauauuuucagaagauuccagugaaacuuguugagggaugggaaggccucauguuccacccgaaggucuuccuucuguccauggcagcaguguugugcaagcacgcaguugcagaccgugguaguagccauguucgugucucagucugauuggugggcugugaacauuuacugucaaaauauccuuuuauagcaggguucagugguggcagccuggcaccuuggcugccacgcuugcccucucugagaagcuuugcuacaacacaggaaucugaagcacucgcucgcucucuccucagacucucucuuuggaagcaccugccagaaucaagaacaaggcuccuccccaugacuggccccaggagggagaaguaaccuuugagaaugcagaaaugagauaccgggaaaaucucccucugguccuuaagaaaguguccuucaccaucaagcccaaggaaaagauaggcauugugggacgaacagggucagguaaggacugcuccggucucuggagaaauguuggaagugauccagacuuaaucuuuggucauggcagcuugucaaagaucacuuucaucuuuacaaaccaaauuccugauacacaagucauuauugucucaggccccuugaaaccaguuuucuaagcuugccuucagccuugcucuugggacaggcagagcuuucagugugacuugcucucagucacagucucagaacagaauacuugagcauguggcaaaguacaggagaagaaagcaccggaacauaguaaguaccacagauaagcaagguccccgcaggccuaccuagcugcugcauuguuuguugauuccagauauggcaaaguuaaccaagauuagucaucauagaucaccccguccacucgagacagucacaucuccuuaugucaugucucauuucuaaagaaaacagccaccauaucauaauauggcauaacuuaacuaucccacauacaacugcaagcuagguauauauuuuagaauagguggcagugucucucgaaugcuuuaucucucagugucuuuuaacuuaaauauacuaauagccacuaauauuaucucagucuauuauguuauauuauauguaaagaaaauacaaagaucugcuuauuguauguguauaugcacaaacagucuuaacaaaauagauuagaaacacucaugucagauacaguuuuguuuuagcaucuggucauguguccuuagcugguaugacuaccuuucucuacuaaccagucuguauucccugcucccccagacagcaacucagcagguuuugguucuuuuaguugaugagugacauauaccuucaucucugaagggucugagcccuuugucauccuacuuagauuggguuauaguuuuccauugacuuuagucagggcaugggaacaccccaaaggaucuccugccuccagacauaauuguccuucccuccauugugaagaauuaaccaaauaucccucuauagucugggucagucaccguuccuuaacacuguugccccaguggccaggggaaagcccaagcuuccagguuaauagaaagcuuguugugucuccaggaacacucuccuaucuaaagcuaaaaauucuacucuagcagaacuuuuggaaacagggucacuagggguguuaaugaguagaaacauucuuuuuccuaccccccugauuccuggaccugugaaacaaaacaaaacaaaacaaaacuguaacacacacacacacacacacucacacacacacacacacacacacacacacacacacacacgucuaugaugaugaaucaaagcauauaucgccuucuggagaacccuguuaccucucuuccaggcaacugccaccugaugacacuguaucuacaaaaggccauucccuuaagucuggacagaugggucaguaguuaagaauacaguugcauuuucagaacaccaggguucgaucaggguucaauucuuaucacccacagcucacaacugucgauaauuccagcuccaggggaucuggugccuuuuucugaccucugugggcaccaggcacauacaugguacacauauacaugcuaguaaaacauucauaaacauaagauacauaaaauuauuauuuuuaaagauuuauuuauuauaugaaaguacacuguagcugucuucaggcaccccagaagagggcaucagaucucauuauggaugguugugagccaccaugugguugcugggaguuggacucaggaccuuuggaagagcagucagugcucuuaaccacugagccaucucaccagccccuauuauuauuauuauuauuauuauuauuauuauuuauuauaguauagaguagaguuuauucagagcauggggaagggaguuaagagaguaguagaggcagagagacuaaagucaauggaaaaggagagaguagagacauagaagcuggccaugaccauguggagagagugggggaggguaauggggagagggggugagcaguauuauuuuuaagaggccauucucuacuguucuuucaagccagcuucuuauuaauggcagggaacguggaaagauggauuucaugaccauggacccacugucacacuucucagguuguacagugaguuccuuggucagaagcaaugcuguguaaaauacuguaccaguggauaaggcggucuguaguucaugaaugguuguuuuggaagagcauuaugugcagagaaagaaaaccaaugugcagaaacuaucuguuucaguaaaacuagaucauugcccuuuccaggagaaagugcuccaguguagucagguggucaacuuuugacauuaagugacugacucauaaauccccuagacaguggugucaugucaguggcucaguguuggucucagaugcuggccaaucugccacucagcaacagcugcagccaggucauccuuagcacgugaaaguccauguuguccaacucaugcguaaccuuuaucucugccaccauggucacuuuauuaaugggcccacugggaaaagacaaggauggccagggagauaaacugacugucuauagagugguauagaguggucauccuguuugcuucauuauugaacuccucugcugaugucacuuuuuuuuuuuuugcuacaaaucaagaguuuuuauuuuuauuuaaaguugguaacuaauauuggccacagaauugugacuuagaacauccuuaaccucucccaauuuucuuuuuuuauuagcuauuuuccuuauauacauuucaaaugcuauccugaaaguccccuauaccccccccccacccugcuucccuucccacccacucccauuucuuggcccugguguuccccuguacuggggcauauaaaguuugcaagaccaaggggccucucuucccaaugauggccgacuaggccaucuucugcuacauuugcagcuagagacaggagcccuugggguuaguucauauuguuguuccaccuauagggucgcagaccccuucagcucugaugucaccuuuugaugagcaucuacaugggacauaaguaucuucauauccuuugcccauuuggagaaauccccagauguuuuuccucaccaaauuuuccaaucagguucuuuccaggucccugaugacucagccauuccauuggcugcagccuaugauucaguaauuaaucacacucccuccauuucuccuuccaagcaaaauccaugacuauguauauuaaccaaaguucugcccacuguaaaaaugucccuucauuggugucuaucuuaguaacagcucuauugcugugauaagaugcauaaccaaagaaccuuacaaaagaaaacauuuaacuggugguuugcuuauaguuucagaucaugaucaugauggcagggaacagggugggaagcaggcaggaugaagcuggagcaauagcugagggccagucucauuaaaacugccauagugucucagcauuguccuggaacgggauuauaaugcuguggcugaucacuccugguaguucuuguaugauguacagaaccaucaguaaaccaggcccuagucuugucuuccuuagucaguccaucauagggcacaccccacaaaguuauaggugucggcuugagagcagaagguauuguaaugggaguggaagccauaggcuuuugggcaauucuuuucgagacugggugucucuguguaacagcccuggcuuuccuggaacuugguuuguagaccagacuugguuuggagccugcccagccuggaaugggcugaagugggauccagaguuggacguagauuaucaacagcugauaaucucuggccuuuaaacucucugucugugcuauaugcugaagcugauuguuuauaaaaaaaaaauccuaaaaacuuucuugauuauucugugguuaaaaaccacuggcuugggcgauuaacacuuguugcauagcagcgaggaauuaaguaaaaaaauuauugcuauugcucccuucccugucuauccaggaagccagaagccucucuggcuacccugguuaacucuuugugaaccgagaggaaggaaaggaaaagaaauaaaaugcuuuauauaggcaaauaugcacagacacauacauucaugcacccacacucuggccaggcucgacugucugucucaaucaacuccacaacuguccauguaugcuuacauacacacacacacaggcaucuacacagguaugagaagacagacuuacacguuuggguggauggauggguggggcagcgcuccccaagccaaaccaucuguauuagucaggguucucuagagucacagaauuuauggauagucucuagauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcagaagguggagcccagauuaaagguguguuccaccacaccuuuaaucccagaugaaaggcguagcccagauuaaagguguguuccuuaaacucggagauuaaaucuucuggaauccauagccacuauggcucaagaucuucaaaccaagauccagauaaggaucuccaagccuccagauaagggucacuggugagccuuccaauucuggauuguaguucauuccaaauauugucaaguugacaaccaggaauagccacuacaccauccauccaaaaacuuucuuuucucuggccuuuuuauacuuucuuagacaaaaaguuucuuagaaaauuaccucagagccgggcgugguggcgcacgccuuuagucacaucucucuagcaaagcaacuaaggccaucauuuaaagcuuucuuucuaaaauuauuugaaucaaaucaggaguucuuuuuuuuuuuuuuuuuuuuaaagauuuauuuauucaucauauguaaguacacuguagcuguccucagauacuccagaagagggcaucagauuucguuacagaugguugugagccaccaugugguugcugggauuugaacucgggaccuucggaagagcagucggcgcucuuaaccacugagccaucucgccagcccaaaucaggaguucuaaagagucauuaauucaucuaaauagcuugaauucaugaaaguuuaucuuuauguugauuuguagaaaaucugauuaauagggugggcuaauguccagggauuauuagauuaauaaugacaggaaaggcauaucagcugcaaaaagcaauccugagcugaagucucuuugggaccuugccauuaauugacccaucacagacaugaaaaaaacaaugggccaccuuucaggaaggcuacuugcuagccuuaguccaucuuagaugguuccugacaguuaauuuucuacucaggccccauagauggccaaggacuguuuccaagagagaacaauugucuauagaugaugguagagccuugcuccaacauaccaagaggcuccuuugugauucauguacaauggcagaacaucucugucugccacugacaccucaaguacuaucaggucugcuggcucauauggucccaguaguagagcaaccugcauggcagccuguaccugcugaagagccuucuccugucccaagccccacucagguaacagcuuccugggucacuuguuauaugggccugaguaacacacccaagugaggaaugugcugccuccagaguccaaauaggcccacuguugcuuuucuguugcuaugaagagacaccaugaccaaggcagcuuauggaagaagcaguuuacugggguuuacauuuucagaggcugucaugacuaucauaacuaucagggcaggagcacggcccaggugggcaggcauggugguaaaguaggaacugagagcucuauauucugauccacaaacacaaggcagagagcuguaguaagcuuaucccugacuagcuuacaaauaaaugacucagaguauggcaauauuauuuggcuuugacaauuacugggaugaacccuucuaaccuucuaacuucuucuaacugcuggccuggcugccuccccagcauggaguguaccucagauaugugcuguuucuccuggccaugugcucaucauccaucuccccucuuggcggcuuccucucucuccuccuuccuuuuccucucuucucucucucccauccaggccauuccaaacccaccuaccucuaaucccuccagaaauuggcuguaaccaauuuuauuuaaccaauaguuuuaaaucuaggaacaagguuugcauaacaaaaguuuguaaacacaagaaaugcaagaaguggcuuauaagcuuagaccuucagauauagaauuuagcauuacaauagguagcaacagaacaaaccucaacaaagagcuaacugggaaaccccaaagccugccuccagugacauaccaccuccaacaaguccacacuuucuaauucuucccauauaguuccauugacuggggaccaaguauucaaacaugugacccuggggugggaggcauucucauucagaacaccacacccacugaggauuguccuucuuucaugguggugggaggagccaaguguaauaacuuauccuucaccuagggaagaauaucucugcauuuguguuaccaacaaguucaagguguuuucuccuccugcucacuugguacaaucagcauaaugucaucaguauagugggccaaugugauauuuguagaagagacagauaaucaauaucccuucaaacuaaguuaugaaacugggcuggagaguuaauauauccuuaagguaaaacugaagguauauuguuggcuuugccaacuaaaagcaaaugauucuguuagucuuuauggacagguacugaguaaaggcauuugcuggaucaguaguugccuaccaaguagcaggagaugcuaguguagucaaguuaggacacagcaucuggugcagcaucugcaguugggaucacucuugauuaaaauugucaguguucauccucuggaaucugucuucugcucaggcugaucagaacacuagagggagauacgugguggccaccaccacuggaucuuuccaacugcucucauucuuccagugaguggauauuggcuuugguguacuguuuucccuaguaaagguaauuccaguggcuuccacuuagccuauauaagcauaauaguccucaauuuacauggaaccaauguggggcuuuuccaaacuucuaaguguauuuauuuaaauuagacuuucugagacugggaaaucgcuacaagauagcuuuauggacucccuggacauacuacuacaaaucaguccugagccagaauucugcuaaucacuucacuaccuggcuuaggaaguuaggauuccugcacaaaacaucaugaccaagaagcaagggggaggaaaggguuuauucagcuuacacuuccauacugcuggucaccacuaaaggaagucaggacaggaacucacauaggguaggaggcaggaguggaugcagaagccauggaggaugcugcuuacuggcuuccuuccccuggcuugcucagcuugcuuucuuauagaacccagaauuaccagcccagggauggcaccaccuacaaugagcccucccacccuugaucacuaauugagaaaaugccuuacagcuggaucucauggaggcauuuccucaagggaggcuccuuucucugugauaacuccgccugugucaaguugacacacaaaaccagccagugcacugccauaaacuccuacuuuaacuagagggacaaaauguuucuuggugccuuccagaugcuaguuugaaccaguauccaauugaccccagaaaguuugauaguuuauuuugccacaauguacaguuauccuuguaaaggucauaggucccucugggaaaggaugggggaagguaacgguaaacuucaagaucucuccucagaggaccuguccaucucuuauucgagggguuuugggucugcaaaguggcucaaaucuagauauugguucacaggccacaauuccuuauugcuaugauccaguguagucuuucuuccauuuguuuaagaguuuuucugcuuauacagaccaaagaaaaacgcagcaggcuucuuaucuauaucauacuugggaauaccaugauugauuagcuaguaccauagguccauauggcucaugcuaccauaaaaaucacuuugccugaucugccaacaggucaggccauuguggacguggcuuugcuuggcugccuuucaugacaacuauacucacugugucucugacagucagugguguuaccuggccccugccacucaggggcucaauuaaacccauggaauuuaauucauccaguucaguagccgcauuccaacccuaaagucugccacaaggaaaggaaaugaugaaggccuuuggcuguccaggugguuagagugauugauugauugauugauugauugaggagaccaggaaauaaaagagagagacugaccuuuacagaagcauguuguuauuuggucugaacaaugaaggaugguggucucuugugucuugucaggaguggagaucacagaguagaugcagaggacuuggugcuccauagucuguaaaggggaguuuggggguagaagauaccaucugcagguuuguuucccugcagucucagugcuuuaaauaccaauggagguauuugaucuucucacuggaaacuuccuguauccugaacugccuguagauguuauuucuacucugagguuucuggguuauuagccaggcccauagggcaucaaaagaaagaggaauaccguguucaucuggcuguuuccugccaggcagagacaaaguuggguuguugggaucaguguucaggauaucgggaugagagaagguuguguugacuucauguagcauguaguaagagaguuucaacuuguuggcugugguggcuuagugguuguccucaugucuuccuggagaaacuuuugaaaacagucuauuagacaaagggcuaaaagaguaauauaagaccagacuuuaggcuacccugccggggacuuaggguagccauuguccuaauguggaacugauaaggacggucauuugauccaggaggaacuuaagguuuaaaaaacaggguagaauguucugcgaagccucguugugucuggauaagggcgugggaucccauccugagcaguccucagaucuacuucucuuuaccuuuggaguaccacaacacccaaagaaucacguugaucccgaaggauguuaaguggaucugaaauuucucuacuuuguuuuuaaagagcuaaugagacagaaaguucauuaaugcaaaggagcucuuacuucagcaguuuuaguucugaguuccagaacuagucaggguucucuagaauaucaagacuuaaagaauaaauucauaauaaagagucuguguagaaaggagauuuauuaaaaugacuugcaagcuucaguccagcuaguccaacaauggcugguugugaacagaaagugcaaaauucaguaguuguucuguccgugagguuggaugucucagcuggucuucaguguaugcuggaauccugaagaaguaggcucucaugcuagugaaggaauggacuugcuaacggggcaauggcaagcaagcaaagagagcacuuccuucuuccauguccuuauauacuauauacuauauacuauauacuauauacuauauacuauauacuauauacuauauacuauauacuacauaggcuuccagcacaaggaauggcuagauuagaucuguuuugaagguguguuuucccaccucaagaucuggauuaaagaucuugugguuccuaccucaaaguuuuggauuagaaauggaucuuccuccuuuaagcaaaaaucgcucacaggugagcccuccauuuugcaguuuuaucuccaauuuaucuccaucacagccccagaguuggaugguccaucagucuccucucagaagucacccaaacugcuguuaaggguuuggaggcagagaccauucuuaacuauuuugugguuggcagaagggucaauguagaaggaacaacagugagugugccucagaggaagguugauccaaggagccaugauaaagcuaauaaaugaaccacacaaugacaguauucauccuugaaauguguuaugccagugagguggcuaaauuuggcuuugguuuguucuuauuuuucucacuuuuugaguugcaucaugaagccauuuguguaauuucuaauuuuuuuaaauguaggcauuuugaaguaaaaauuucccuuguaggacuauucagugucccagagguugcuauguuacauuuuauuuucauuuaauuucagugaguuuguuucuuccauuacuucuuuuuaagugcugaaaucaccaacuauuaauggauugauguuuaucugugucuuuagcuccaguaguggguuuuuuuuuuuaaugaaauuaggugucagguguuuggugugcauguuuaggauagugaugucaucuugguuagcuguucccuugauuaggaugaaguguccuccccuccccccucccuccauuucugguuaguuuuaguuugaagucuauuuggucagaauuaaaaucgugauguccuauugcuccucguccuguuuacuuaauguucuucugucaucuuuuuacucugaggcagugauguuuaaagcuuaaguuguguuucuuuuuuuuuuaaaggauuuauuuauuauuauacguaaguacacuguagcugacuucagacgcaccagaagagggcgucagaucucauuacgggugguugugagcuaccaugugguugcugggauuugaacucaggaccuuuggaagagcagucagugcucuuaccugcugagccaucucgccagcccccugaguuguguuucucguaggcggcagauagauggauuuuguuucuucaggagaacagacccuuugaucuagaugcaguuuuauccggagaccugauucucugucuucugucucacuuguucuacuuguaaggcuuucuguugcauucccuaguuuggcuuugggguuuuccaguuccaucuucauuucagccugaguccucuucaccauuucugucuccagauugaauuccauucucaaguucuggaucgucuccaucaucuccaucagccuucuguguuuuuuucuggcuuuacuggggcguuuguucuccuugauuucauucuuugacgggggggggggggggggguguugauugcuccuuaaguucugugucccucaggucaucuggguaauucucacuggcaagcauugcuacagggcugguagguuuuguggagaagauacugacucgaucgcuccuguuguugguauucauauagugaugagaucuggccuuguagacccuuuguuauuuuguucugaguuuguuacagauggacagggucagggagaagaggagauauuggggugaguucagucuagagguuggaaauugcuugaauggaaugaaauggggugggcagaggagacuggccugguucgaaggcuggguuuccuguucccagccaggaguguggggguggagaggucugugcugaauaugauuugggagaauccuguagugugggggauccugacuccagacuaggccacugcucugguuguaggacccaggcuagauuggcugggcuacagaaaagauguggcugaggugguccuggaagaggcuauaggaugccuggguauggaggggggagguagagguggcacaaaagcaauagguuauuuaaacaguucacacuguggauuucuggcaugcugcaugcuucuacgagagccgucagcagcucagauuguaaagccuauuccagcagguacuuuaaauuuuuauccuuauaauucuauuucucuggaaccauuccucguaccaaaucuguaguaguuaggguucucuaguggaacagagaugauagaauagauaucuguguguacuaagaguggcauaagccauggucuagcuaauccaucgauggccgagaugacagaaaggccaagaaucugguaguuguucaguccacaaggcuguaugucucaaauggccgucagucuacauggaauuccccaggaaguagguucuaauacaggaaaggacaguguacucccauaaauacaucuuuaaaaaauagcaggauaggugaacuugccauggagagggaaggcaagcaggcaaaaagcaaagcuuccuucuuccauuuuuucaugugggcugccaccaagagguguggcccagauuuaagugggucuuugcaccuccaaggauccaaucgagaaaaccccucuccuaggugcuuaacugccuaguugauucacauguagucacaucgacguuagccaucacaauaagccaguuucuccuuccagaaguuacucagagcugcucuuccgccucuucuugcuccccagggaaguccucuuuggggauggcccucuuccgucugguggagcuaucuggaggcugcaucaagauugauggaauaagaaucagugacaucggccuggccgaccuccgaagcaaacuggccaucauuccucaggagccagugcuguucaguggcacugucaggugaggccuggcuaggacuggaugauggcagagccaccaccugggguggaaaucccauggccuuggggccuguguuucccaugagucugugauuccuaucgcagugacgaggcagcuucugcuauauaugcuguguaauuaaccaaguaucucagcaaggcucugccacagcaguccagagaucagagaaauuuuggcucagauuucugucccaugaccucuuaacagguuaccacucuuuuuuuuuuuuuuuuuuuuucccccgagacaggguuucucuguguagcccuggcuguccuggaacucacucuguagaccaggcuggccucaaacccagaaaucagccugucucugccucccgaguacugggauuaaaggagugcaccaccaugcccggcuaaugcuuucuaacuauauauucuauuucccuucuuucagagagccaacccuaccugcucaacccuuauucucuaucuaaccucagugguucuacaaauaguaguauuccuauugaagguuaaauagcuaucauccacuuauacaagaauacauacuauauuuaucuuuuugggucugagauaccucacucaggaugauuuuuuuauaguucuauccauuuaccagcaaaucauaguuucauuuuucaaacagcagaauaauagucuacuguguaaauuaucauauuuuuauuaucucuuccucuauuuauggacauauaggcuguuuccaauuauuggcuauuauaaauagaggaacaaugaacgugguugagaaaauaucucuguaguagaacgcagaguccuuuugguguaugccuaacaguauaacuagaucuugaauuaaaucuauucucagcuuccugggaauugcuacacugauuucuguagugguuguacaaauuuacacucccaccagcaauggauuaauguuccccuuuuuucauauccugcuggcuugaacugucauuuguuuuauugaucuuagccauucugauugauggaagaugaaaucucaaaguaguugugauuugcauuuuccuggugacuaaggacguugagcauuucuuuaagugguccucuaccacuuguguuuccucuuuugagaacuuuagaucugugucccauuuuuuuuaaauuggguuauuuucuuguuguugggauuuuuguuaauauauuuuagauauuaauccucucucaaauguguaauuggcaaaauccuuuccccauucuguagccugcagguuuguuuggaugaugcucugcuuucccaugcgcgaagcuuuucaguuuuaugagguccuguuauucacuguugauccuagugccugugcuaccagugccuucuucagagucuuucccuguguuacugaguucaagccuguuucacacucucucugucuuguuugagguuacuguugcagugauaaaacaccaugaccaaaaaagcaaguuagggaggaaaggcuuuauugaguuuaugguuccacagcacugcucaucauugaaggaggucagggcaggaacucagaacagggcagaagcuaaggagaggccauggaggaguggugcuuacuguuuugauccauauggcuugcccagccuacuuucugauucuagucagaaccaugugcccgggggugacuucauccucaaugggcugagcccucccacaucacuaacuaagaaaaugcccacaagcuugccuacagcccugguauauggaagcauuuucucaauuuagguucccccuucucugauacucuagcuugugucaaguugacauaaaacuaacuaggacauucuuaauacuaucuggucuuauguugaaguucuugauccccuauagaguugaauuuuguauagggugauaaauguggaucuauuuacauucuucuauauggagccauccaguuuaaucagcacugucuuuucuccacuguguauuuuuggcuuuguuguuaaaaaccagguguucacauacauguggacuuaugucugggucuucaauuagauuccauuuaucacuaugucugucuuaaugccaauaccuuguuguuuuuauuauuacagcucuguaguacaacuugacuuuggggauggugauacugccugggguucuuuuauuauucagaauuguuuuuuagccauccugggguuuuuguguuccauaugaaggugaaaauuuuuuuucaguuucugagaagaauuauguuggaauuuugauggagauugcauugaaucgguagauugcguuuggugagauggccauuuuuacuauguuaauccuauugauccaugagcaugggagauuguuacaucucauagccccucaguuacuuucuucaguaucuuaaaaguuuuuauuauauaagucugucacuugcaugguuagaauuaucucaaacacacaugcacacauucacacgcacaaacacauauauauuuugaggcuaucgggaagguaguguuucuuugauuucuuugucauuuguauauaggaaagcacugguuuuaugugguaauuuuguauucugauacuuugcugaaaguauuuaucagcuauagaaacuuacugguuaaaucuuaggguuauuuauguauaaaaucauaucaccuacaaauagagauacuuugacuucuuccuuuccugcuuguuuccccuugaucuucuccaguugucuuauuggucuaagacuucacauguuauauugaauagauaucuagaauauacaaagaacuaaaacaaaaaacagaacaaaaacccaaacccaacaccaagaaaacaaacaacucauuucaaaacaaugggacuugaagcuggucaugacggcucaccccuucaaucccaguacuuaagaggcagagguagguggaucucuggguuccaggccugucucaaaacaaaacauaauaaaaauggggcaaggaacuaaagaguucucugaagucaaaauugaaauagcugagaaacuuacucauccauguucacugcugcaaacagccuucauauccaucaggugauaaauggaggugauacauuugcacaacagaauauuauucagcuguucagaaaaaaugaaauugccgggcgugguggcucacaccuuuaaucccagcacuuuggaggcagaggcaggcggauuucugaguucgaggccagccuggucuacagagugaguuccaggacagccaagacuauacagagaaacccugucuugaaaaaaaacaaaaacaaaaaaaaaaaaaaaaaaagaaaaagugaaauugagcuagaaagagauaguucagugguuaggaauacugacugcucuuccagaggaccugggucugauuccaagcacccacaugguggcauauaacuguguucaacuucaagggauucaaugcccucuucuggccuucaucggcaccagcauguacacaguucacuaacaugcaacacccaucaaguaaaauaacuuaaaaaaauuuauauaguggguaugggggacuuuugggauagcauugaagauguaaaugaggaaaauaccuaauuaaaaaaaaaacgaaaaaaaaauuauaugaaauuuuauagguaaauggauagagcugaaauuagucauucugggugaggugaccuagacuuaggaaggcagaugccauagacauuuuucucauuugagucuucaaauggguguguuccacuggaagcagccacagagaucaggagcuucagugggcguguagagggaggggagaagaagugagugcaguaggguagcaagugacaggggagucaugaaacagggaaggguaacuaggagggagaugaccacuaguuaacaaauacgaagccacuguagaacccucuuaaaauauaugcauacacauaugcaaaaugucuacauggaauuacccuguaacagggcaaaaugccccugcuggacuccagaggcuaacaaauaagaagccaauuccaggaauggaguaugucuuuuggagauguuggcacacucccccaaaagaagcacuacagacuugccaacgcucaugaguucccucagaacuugacuguaugacacuacugccgaggacaccacacacuugagucacagaacaugcuacuggagaagccaaggaaucaccagucucacccauucgugaacucugugagcuacaacaaugacuuaccugguuagacacgcccaaggugcaguagacccucauagcauggaguaaccagcaaguuucuuuuuuuuuuuuuuuuuuuuuuuuuuaaagauuuauuuauuuuuauuauauguaaguacacuguaguugucuucagacacuccagaagagggagucagaucucauuacggaugguugugagccaccauguaguugcugggauuugaacuucggaccuucagaagagcaguugggugcucuuacccacugagccaucucaccagcccccaaccagcaaguuucugauugcugcucuucagggagaaaccuacacauggcaucuuuauugguuccaagaaccuguggcuaaacaugucaaaggucccagaggagcaucuaggacuauuacuguccuaaauggacauaauauuaaacugacuuguaaugacuuaucauuagaccuggagauuaacccagcuccuaucccucaucaaagaagauugugguuaaugcagacaccaugcagagacccacaaauggucaaagugcagagaauaaaagacuauagagugcucagcccuaaaugggaaacaucucuaucacugccccucuuccagggcucagggaucauugcagacuuagaaggggaagaaagacuguaacagccacgggaugaguacaggaaacgauguuuucugggcauagcaggguaguuacacauacgaauucacagcaauugaaacagcauacacaagaccuggguaagcucaagccagauaaaguuccaguguggagaggggaggugggcacugcugggagaccauuuuccaguggaagcuauacauucaagaguauaugggcgacacaauaguacuugaugcuuuuuuuaaguauauaguuggcugggcuauugaagggguuggaucugggaggagucaggguaaacagcaugaauauaaucaaaauacuuccaugagauucucagauuucaugaacaagugaggaaaagaaagaaggcauuuucuacauucguacauagagagggauauagcugaaggaaaccacauuugcaggugucagaggugauuaaaauacacugguguuucuuuguguuuucauaucuguaguuacaaauuuuuuaaagcuaacuuauggugaguaauaaaaauaauaaacuuuauguuuuagaaaacagggauccccaaucucagguguccugugacucuuuggggggcggaggggagcugugaccuucagacuucacauucaguuuucugugugugugcuguuuaaccacagccagccauugaaaugugguuuguugucgggcggcugaggugcgcaccuuucuuuaaucugagaacuugggaggcagaggcaggcgaguuucugaguuucagaccagccuggucaggccagcaaagugaguucuacuacagcagggauacauagagaaacccugucucaaaaaaaaaaaaaugugguuugauaaacauuggccucugagcaguuucuauuauacuucucccuagaucaaaccuggacccuuucaaccaguacacggaagaccagaucugggaugcucuagagagaacgcacaugaaggaauguguaaguggaauggagagagacugugcuggcaucacaggcugggaaugugggugugcuacauucuguucuggcucccucccacuccagggugucuguggaagaauacagagacauccuaagcaggagcucacaggcauuucacaugcaucccaaagucagugucucauaucgugaugugcucaacugauaaaggggcuugccaccaagucucuaaccaccugaauucaguuucaguaucacauggacaaaagagaaaaccaacucccacaguugugucugacugccauacuuacaguaucucacacacacacacacacgcacacacaaacacacacacacacacacacacgacuauacauacucauaugcauaacgcacauauacacacaguaacacauaugcauauguacagguacacauacuuucacauacacaaacauacacacaaauaaauguaauaaacaaaaauuuaaaguugaucucucagccccaccuccuacacugcuuauggccaaauuggccccauacucuccauugacuaagaauauauuaaggguagcuagucagaacuuaauaaauucuauauacacaaaagaucuacaauuuauugcugauucuauaauguucaguguaccauagaucauagaugucauggagcaacccaguagacccuugccaguagccagucugcagaugggcacugcuggucuugagugaaagacuauagucugaacacuauaaccaguaccccugucaguuagaugagccuugcuuccauuuuacauagaguagccucagucucauaugaagaagagauuccaugauguuuagcaaaagaaaagauugccagugugguccaggcuuuggauuuugggagugggacucugucuuagucuuagucugucuuaguccggguuucuauuccugcacaaacaucaugaagaagcaaguugaagccgggcgugguggcgcacgccuuuaaucccagcacucgggaggcagaggcaggcggauuucugaguucgaggcuagccuggucuacagagugaguuccaggacagccagagcuacacagagaaacucugucuugaaaaaacaacaacaaaaaaaagaagcaaguuggggaggaaaggguuuauucagcuuacacuuccacauuacuauucauuacagcaaaggaaggcaggacaggagcucacacaggguaggaacuuggaggcaggagcugauacaaaguccauggaggggugcugcuuacuggcuugccuccccuggcuugcucagcuugcuuucuuauagaauccaagacuaccagcccagggaugguaccaccaacaaugggcuaggcccucccugcuugaucacuaauugagaaaaugccuuacagcuggaucucauggaggcauuuccuuaaugagauccuuucucugugauaacuccagcugggucaaguugacacaaacuugcuaguacaacugacuccuggucaacuugacacacaaacacaucacuaguaagccucaacccuuacuuucuuauucaucccuaagaucuaaauaacuuuaaaagucccacagucuuuacaaauucuuacauuaaaauuucaaccccuuuaaaauauccaaucucuuuugaaauucaaagucuucuuuuuaauagucuaaagucucuuaacugugagccccacuaaaauacauucuuccuucaagaggggaaauaucaggacacagucagaaucaaaagcagacuccaacuguucaaugucugggaucuauucacgaucuucugggcuccuccaagggccuggauggaggccuggcuugugaaauuucagagggaauauuaaagacuccauugcuguuuugauugugaugauucugugguucugguuagcuggggcugaagaaucagcugugauuaacaagauaccagaacuacuaaagcgaaaccugugcaccagugggacuauugaugccgguucuccagccuguucuucuccagcucuguacuuuguagcacacaccuugucuuugaagcuccagcugccuguacuccgcugcugcugugcuugguggucaucucauggcacuggcauugcuaaaacacugcugucuucugcugcaacuaggcuucaccaauagccucucauuggcucucuuaauggugccaagccucaacucuuuugcaugaccccuucaauucugggccaucaauuucagcugaggcugcaccuucacuauuggccuuccauggccucacggugcccagugcugaaccucggcugcucuuuauuaugccuucaaaaccaguaucaccugggugacucuuacacauuaccaaguccagcugcagcacaugguacaaccuuggcuaucucuggaacacagcugcuuugagcucucagaaaacacuucccagaagauuucacuucagugauacuggucucuucuuaaucauugcaauuucuuagcuucagauaacagacaucaauagucccaguaauccaaagguuucacuuuaguaguacugguaucuuguuaaucauagcagauugauucuucaguccuagcuaaccaaaaccacagaaucuucacaaucaaacagcaaugauccugauaagagucuuuaaucuucccucugaaauuucacaagccagcccuccaucuucagcacuguucucaacauuuucuaagcuccuacagaauggcccauagagcucuuaacacccaaaguuccaaaguccuuccacauccuccccaaaauauggucagguugucacuggaguaccccacuaugcugguaccaauuugucuuuguuaggguuucuauuccugcacaaaacaucaugaccaagaagcaaguuggggaggaaaggauuuauucagcuuacucuuccacauugcuguucaucacuaaaggaagucaggauaaggacuccacaagguggaggaccuugaaggcagaguggauacagaagccauggaggaaugaaugcugccuacuggcuugcucagcuugcuuucuuauagaacccaagacuaccagccaggggcuggcaccacccagugggcuaggcccucccuucuugaucacuaauugagaaacugccuuacagcuggaucucauuuccucaagggagacucuuuucucugugauaacuccagguugugucaaguugacacacaaaaccagccaguacaaccuccaucucuuguaaaauuauauuuuuagagccaaaccuaaggacccacuauccaauaggaucuuaccuuucugagauauuuucaugggauggaaacuaacagaauuacauauugcaaauaugaacugcccuagauaauauagguccuuauacaugugugaccagaguaauucuuuuucaucuguuucagaauaauuucuuucuuuucuugcaugggggaggagggagguggaggaguauuuguguguguguguguguuuguguguguguguguguuaagauagugucucauuuauagcccaugcugaugugaauuuccaguauuugugccuuagccuccuaaguauuagauuauugugugagccaccacgcccggcgagaaugauuuuuuuaacguggauucugaaagguuugguuuguaucuuuauacuucuaacuucuggucucuuucuagauugcccagcuaccucugaaacuugagucugaaguaauggagaacggggacaacuucucuguuggggaacggcagcuguugugcauagcaagagcccugcugcgucacuguaaggugagcugcauagugggugcugugaccuauguggucaguggugaggagcuggagcccuggggugcagcucugccuagacaccagacucugagguucuuugucucugagccuggugacacuuuuuaaccagcaguucuacauucagucuuagcaccacuuggcauacuguuucgagggaucuuuguuucaacuuuuuuuuuucuucaagcuuuugcauauguauaaauuauauuuugaauacauuccucauuaugcccccuuaauuuguuuguugguuggcugguugguuuuuuucugauuuuuagaaacagaguuucuuuguguagcccuggcugccuuggaacucacucuguagaucaggcuagccuggaauuuauagaaaucugccugccucugccucccaagugcuggggcuaaagguguacaccaccauggcagggcuuugcguuguuucuuaacuucccccaagccuuuggaauucaaggacaacuguguuucuggcuaaggauagaauugcagagacaucagauuaaagacugcuggagacugucaucagauggaacccucuggcaaacaggaaaggagaaguccagaaaaacuaaucuacacaugaaggucauggagaaagugggcauguuugaguagaucgcuauuccugcacaaaacaucaugaccaagaagcaaguuggggaggaaaggauuuauucagcuuacucuuccacauugcuguucaucacuaaaggaagucaggauaaggacuccacaagguggaggaccuugaaggcagaguggauacagaagccauggaggaaugaaugcugccuacuggcuugcucagcuugcuuucuuguagaacccaagacuaccagccaggggcuggcaccacccagugggcuaggcccucccuucuugaucacuaauugagaaacugccuuacagcuggaucucauuuccucaagggagacucuuuucucugugauaacuccagguugugucaaguugacacacaaaaccagccaguacaaaaaauuauauuuuuagaaccaaaccuaaggacccacuauccaauaggaucuuaccuuucugagauauuuucaugggauggaaacuaacagaauuacauauugcaaacaggccgagagcacaugcacugcagugacucacacacaaguauagaguagcuauacacuugguauguaguagguuauaugaauucuaagcaaagggcauuuucacguccaugugaaacaguacaucguacaggauuuaaauacugaaaugcuucuuaggaaacugaggaggacaagaaugcuuggggaaguaacuggaucugucuguccucugcucccuggcagauucugauuuuagaugaagcuacagccgcuauggacacagagacagacuuacugauccaggagaccauccgggaagcauuugcggacugcaccaugcugaccauugcccaucgccugcacacaguucugggcucugacaggaucauggugcuggcccagggacagguauuacguuccucaggagcucucacucggcauggggcauggugugggaggaaaggaagcuggggaggggcuaccugucaucuucauguucccgggcauucaccaagcagccauagcaacuuaguucugguaugugaugaucuauauaucccuaugccccagggaugcucuuacucuccuguggcacaugagcagugacacaggccgagagcacaugcacugcagugacucacacacaagaguugcccagaggccgggcgugguggcacaugccuuuaauuccagcugaggcagguggauuucugaguucaaggccagccuggucuacagagugaguuccaggucagccagggcuauacagagaaacccugucucgaaaaacaaaaacaaaacaaaacaaaaaaaaaaagaguacacaaauauaaaggcaaaacuaaaauuaaaggucauacacauacuauugccacccagaccagcagcacccugacaugaggccagccuguaacacagugucaccccugcagcacucugacaugaugcuugucauguugaucccgugcuuccuuuuucucucugccaguuaggcauccugguuucuuccucuucugacuggagucagucaacuugcccucaccuugagcuguagucuauaauauagaaccauacugauggauuucuuuauuccacagaugggagagagaacuaggauguuugugaaggaagcauccaugcauucucuccaaccucucccuugcucccuggauccugggggcaguucaguccucuguucuguccccggggcacuauugcucagcaguggauccucuaaguccaugagaccaucccacaaucacacccugacacgucuccuccuuugcaggugguggaguuugacaccccaucgguccuucugucuaaugacaguucaagauucuaugccauguuugcugcugcagagaacaagguggcugucaagggcugaguccucccguccucgaagucucuuccucagagcauugccauucucuuccugguuugggccccucauccuguccugcugaaacuucgccuuucccaguuuuaucucucacacaaccauucaggauuagcuguguguuucacuuuuaaggaaagucauauuuugauuauuguauuuauucccuauucacuuaaaugaaauuuaguuuuuguucuuaauugcacucuuaagagguucagggaaccauuacuauaaauguuaucaguggccuauaaugaagcuuuauauguguagcuaugucuauauauaauucuguacauagccuauauuuacaguaaaauguaagcgguuuauuuucuauuaaagugagcacugugcuaacagcagugcacacucauuucuaucguuuuuguacagcugacugcacuacaggucauuuugcucuuagcuguagcaaaggcagauuccgucucuagcuggucguuucacggugcugggcucucuaggcguccaggggagacacgcggcagcagugggcccuccauggccugccccuugggcuccccagugggaacccaguauagugggcugcaggaggccuugcagagcaccgugaauucucagggcuccugcuuuccugucuuggugucagcugcuguuuauguuagagcagugggcaaagccagcccccaccccacccccauucccucucaggaaugagaaccucugcauuccucagagggagagcuucuuucugccuuccuucuucugcugccauuucuaagcaagauccagucugcucccaguguuccaugcuucagguuccugaggcuggucgccacagaguugucgaguucccuggccagcugguucccagccccaggguccacugcugcuguuguagguggcauuuucauuugccugaccccaaggcuccagagcucagcaacagggcucaggauggugggguccguucuuccucacuuuagucuccucugcaaagucugcacccaccccucagcagcucuugcuaaucagugucucacacugguguagaaguuuuuuguacuguaaagagaccuaccucagguugcugauugcugugugguuuggugcgcucuugcagacccccuugugcucuggggcucguagcuugggugggugugguugccacugucaccagucgaguggucagcgucgcaugucgugaccaacuagacauucugucgccuuagcauguuugcuaaauaccuuauaaaagcaaaaauaugaaaaagugaauaaaauuauuuuggauuuguaaagc

SEQ ID NO: 8156 - RNA, 10659 nt, Mus musculus
ucccugcaacuacaccuucgcguuuugacugugaguccuuuuuguccccuacugcgugccgugugacuucccggcggacgugcuggcugcgaagcaagauggcagccacugcggcggugccuggcgcugcggccggccgagcgagcaaacgcggcggcggcggcucgggcggcgggggaacccaaggugcggaggaggagccgccgccgccccuccaggcaguucuaguggccgauagcuucaaccgccgcuucuuccccaucuccaaggaccagccucgggugagcacccggcucgcgagcagucugccggccucgaggguagcggggccgcagguugccacugcagcugguuagugaagcgugcucuggaaguuacccucaaguugagcuuaucugguuaggaaaagguggagagaccgacugaaaccucggaggcuguccgaucagaugaguaacuagcacacauggauucucgcagggcuauacacccagccuugggaaggauggagagggcuguguguagaaucaaugcuugaaagaaggcuuccccgggggauuuaguagcacaagaggggccuccacugucuuuaaccuugcaggacaugggcaauuuaaagaaauugcuuuagauaaaggcaaugguaauauauuccuaaaggaaaaaaggcuagcucucagcaggcuguuuuccucccaucugcugaaaggggaccccaguggguugccaucagucuaggaauuaccuagacauaggaaauaggcauugcgcuugcagacuacugggucgcucagcaauccauaguucauucaaauagggauuugccuuugacuuaagaauuccuaauagccgggcgugguggcgcacgccuuuaaucccagcacucgggaggcagaggcaggcggauuucugaguucgaggccagccuggucuacaaagugagguccaggacagccaggacuauacagagaaacccugucucaaaaaaccacaaaaaaaaaaaaaaaaaaaaaagaauuccuaaggcuaacgacuguucauuuuugacaaguguuugaaugauuucugugacucuuaguggcaauagaacaauagaaggaaauucuaugaagaagaccuuagugcuuagaguucuagagcuaugacuuagggccaacauuuguccuuaaugccagcacugggcuccuagaacauguuugugucugauaccaugccuacuaggcucaaauuccagagccuuagacugacccuuagagccuguuugcuuuagaauaaaaggauaaagucgauuauagugucugcaaaccaaaguauaccaaaguauaauccugacuugaagaucucagacuuuuucuuuccugcccuauagguccucuugccccuggccaacguugcgcuaauugacuauacucuggaguuccugacugccacggguguacaggaaacauuugucuuuugcugcuggaaagcugcucagaucaaagaacacuuacaguaaggcuucauaauuuuuccuuuccaggauucuccgucuuuuuucaguucuuccaggauagaguugaugugaggaggagaacacugaaucuguucugagcuccugugagguuuaguguucucgucacgugucccgagguaaacugcugcagcuuccuuugccuugaggucccagggaccaaaauuaaaggcuugccugugauuuugagucuuucuuucuuuuuuuaauauauauuuuuuauuacguauuuuccucaauuacauuuccaaugcuaucccaaaaguccuccauacccugccccccacuucccuacccacccacucccacuuuuuggcccuggcguuccccuguacuggggcauauaaaguuugcaaguccaaugggccucucuuuccagugauagccaacuaggccaucuuuugauaauuucugagucuuucaaaguuuguuccugugaguuuugcuuuuuguuugauggcuccagaguguauguuauuggaagggcaucuuuauuuuuccaccaaauuuccaaauacugucuguauuuggaacaagcuccuccccucuguguccuccgcccaccuuaguuucaagcccacaguaaguucuuaagagaugcuuguuaaaauuuggaagaguuagucugggaauuuaugaguuugggaaauaaagacuaauauauacccaacauguuuuccauguuacgguguuuaaaguugauagagacucagaacaagaaagaugacaugaaaaaaaaaauauauguucccagaauacuuuuauacccuagaucucauaagcucuugaauucaaacucauauuugaagacaggagucaaguuauagaaaggaaauggccauauuucucaaacacauaaaacuaaugacacuagacgcugaaaccauucauuaugguucauaggacucuuugaaaccagggacgcuggcaggagcccaggaaagccacagaggaguauaaacgcuggauggagguugaaggccaggucugugaccaucuguuuaauuuacuguuccucucaucacuuuccuacaggaaauccaaguggugccauccuacgucccccaacguuguucggauaaucacaucagagcuauaccgaucacuaggagacguccuccgugacgucgaugccaaggccuuggugcgcucugacuuucucuugauauauggagaugucaucucaaauaucaauaucugcagagcccuggaggaacacaggucaggcuggggaagacugcaggacaagacuuagggaccagcagaguccuaagacuaacugugccucugguucuuaauagguuaagaaggaagcuagaaaaaaaugucucugugaugacaauggucuucaaagagucgucacccagccacccuacacgcugccaugaggacaacguggugauggcuguggacagcgccaccaacaggguucuucacuuccagaagacccaaggccuccggcgcuuuuccuuuccauugguaacugggugucuggggaaggaacucggguaggagaaggcggagcugcgaggagagaggugagcucaagccucugccugccacuucucccuucagagccuguuccagggcaguggagacggaguggagauucgauaugauuuguuggacugucacaucagcaucugcucuccucaggugaacucuccagaacagggcuguguagccagaguagagcucucgggggucuguaauugcucccuuucaaggccaggguaugcaucuuuucccucuuuuucugacuuguuguauaguagagagguaccauuaccugacucccaguaugcugggaaccaaaucuaggguuuugucccacagccauuucuggguuucauagcucucugggcuuguuacuuguaaaguacuuaaccuuagcgugcucuguuuuccucacagguagcucagcucuucacagacaauuuugacuaccaaacucgagaugauuuuguacgaggcauauuaaugaaugaggaggugagaagagcuuccgaaaccucuaguagaaaggguuuaucuuacucugguagccuuugguucccuuuuguguuucauuaagccugagaacgaaagcucuggucguuugacuaugucagugagaggcgcugaaaaggcuuagaaaggugacaugcuugggguucgucuuccugccucgcuugauuggguaaccaccccuucucauuuagguccuaggaaaccagauucacuugcaugugacaacuagggaauauggugcccgggucuccaaccuacacauguacucagcuguuugugcugacgucauccgccgaugggucuacccucucacuccagaaguaaacuucacugacagcaccacccagagcuacacucauucccgacacaacaucuaccgagggccugaagucagccugggccauggcagcguccuggaggaaaaugugcuuuugggagcuggcacugucaucggcagcaacugcuccaucaccaacagugucaucggcccuaacugccauauuggugagcacagguggggaacccagcagcgguccuauagauacggggcugcagugugucuccagaagcuagggaggaugccgagggacaauccuaugaacaggaaacuagaguggcuaucauaaggaaggagcagaggcauggagaggugguucagugugcauugcucuugcagaggacucagauucuguucccaggauucauagcucauaacucaagugcaggaggagccagugaccucuucugaccuccucaggcaccaaacaugugcuuugugugcauacauaauuugggcaaaacacucacacacauaacguuaaauugacuaaaucuugggccaaaggaacaagaaaaagaaagaguccucgugcuugcuggugcacacagaccgagugcugggauuaaaggccuaagccaccacacacacccacuguugcccacacuuacagucccagcaccaggagauggagguaggaggauuacaaguuugagaccauccuagaacuguauaucgaaauuugucuuaaacaaaauggcaggagggcaggacaaaggaagucaguuggcuacaguuguauaugaucccauccacucuggagcauagauugccucagggcuguauggccagcuugguuuuuuugagacaggguuucucuacauaguccuggcuaucuugaaacucuguagaccaggcuggccuugaacuaacagagccgccugagugcugggauuaaaagugagcaccaccacagcucuaccuagucugugugugacucuuacauucugaaauguccuguguucacauuuggaggcaaguggaguuaguguguacuaaugaccuuuguccagucguaacagcuuacagaaggcuucugcaugugcuaguucuccugucccaguaacaucuaauguaaggcaauguugggaccuaaaugcuaguugugggcucuuuuuuuuguuuuguuuuguuuuguuuuuagagauuuauuuauguaugugaguacacuguugcucucuucagauacaccagaagagggcaucagaucccauuauagaugguugugagucaccaugugguugcugggaauugaacucaggaccucuggaagagcagucagugcucuuaacugcugagccgucucuccagcccucuuuuuuuuuuuuucuuaguguauuuauuauuguuuuaugugcauugguguucugccugcaugucuuuguggggcuguuagauccccuggaacugaaccuacagacugcugugagcugccauguggguacugggaauugaacccccguccuuuggaagggcagccaguguucuuaaccgcugagccaucuuuccagcucucuccauguuuuuuuuuuuuugcucuccuauaaucuuuguauuccucuugacaucucacuuugguugaagaauaugagacuaauaauaguaguagaccuuaaaaggacaacaguaggauucauauuccguaauacacagagagguggagucauuggguucuccuuguaggugugaacaugauuguaauaagguuuaugguucauucugagaaauccugaggguucucagauugagccauacauauaguguaaaauuauuguaaauuuaguagaggauggucacuuugcucuuggggcuaaccuuggaagggacugaauguuucuaaugucagcagguagaauaucagcuagaugggagcugggcuggggcuggugucaaucagccuguccucugugaaggacucuuucggaugugggacccugagugaccggaaguccuccucauucugagccaggugauaaugugguacuggaccaggccuaccuguggcagggaguucgaguggcugcuggagcacaaauacaccaaucucugcucugugacagagcugaggucaaggagcgagucaaacugaagccauacuguguucucacuucccagguaaggcuuauucagacucugcacaaccccaaaauugaauagugauugugccaagucaaaggggaccauauuucccccuguaaacaagacugcaguaagagccccaguuucucuaaccuucagcuuagcuuaguauaaaaccagagcaaaacaaaaaacauuguucugauugucaagacacaguucucagccgggcggugguggcgcacgccuuuaaucccagcacuugggaggcagagacaggcggauuucugaguucgaggccagucuggucuacagagugaguuccaggacagccagggcuacacagagaaacccugucucgaaaaaccaaaaaaaaacaaaaaaccacaguucuccucagugcacgaugaagucugggcuacuugauucuuuuuuuccucuaaggugguagugggcccagacaucacgcugccggagggcucggugaucucuuugcauccuccagaugcagaggaagaugaagaugauggccaguuuagugaugauucuggagcugaccaagaaaaggagaaagugaagcugaaaggugugaggcucaacagguguggggcaucugugcgucugucugucugucccauagacaagcauguucccuucuagagagagaugcugcugcugggccuucucaaagucagugccuuuuccagguuacaauccagcagaaguuggccuugaaggccagggauaccucuggaaagcugagggugugaacucgaaagaagaugaggagcuacggcagagucucuggggugagcuugaccuuacaccugccugccuucuacuuacucugaauagucuuaagaacuuugaaugccuuggaauccaauuauuauuggaccuucaguucauucugacaggacacacugcuagcugucgguaucuuuuuguuaaaacucugugugugugugugugugugugugugugugugugugugugugugugugucuauguauucaggaaguagagguaagaggguaacuugcuggagugggugcucuccuuccaccaugugggucccagagacugguagcaagugccuuuacagcugagcuucgccggcgauccccuccuuuccuacacccccuuuuaaaugacaggcucucauggagcccacccuagccuugaguuugccuuguagcugagaaugacuucgagcuuccugaucgucuuguguccauuuccuugguguauauagugcacagcacaccugauuuuugugugguggugaagaucaaagccaggccuuuguacaugccagucacgcacucuacccacugagugggaucacuugcuccuccuuucuguguucuuaggacucaugaucaagacggaggaggaaagugagacugaaagugagggaaguguggauccugaggagcuggacagccgagcaggcuccccucagcuggaugacaucagaggugugaacaccguggggacgucuguucucugcuucuagcagcuagcccccggcucaguuccucccagaaaggcuuugggguaaagucagagcuagagccuuagagcaacgcauucuggaaagcuauguuugcuuuuuccuuucaguuuuccagaacgagguccugggaacgcugcagcggggcagagaggagaacaucuccugugaaaaucuaguccuggagaucaacucucucaaguaagaccaacccuuccugcguccuccugcucccugcuugcuccccugcauugcugcaggagcagaccuucccucccaagcauugcuucccuagaaggagccugggcagaaggccaggaguguuuggagcaaggagaacauuaacacccagccucagcuuagauuucugucacggucuuucuggucuuagggcagugaaccccuggagcagugcuggauccucuacaucugcuguagcaaaauggccucccaguaugaggauacaguucaugguggcaggaguuggaugcagcugucacauggcaucugcagugaauccuggugcucagcuccuccuggguguuuugguuuuuuuucagccugagaccccaguccagagaacagugacacccacaccuagaaugagucuucccaccucaacccaauuuggaaacuugacacauguguccagccagagauuugucuacuagggugaauuuagauccugucaaauggaccaucacuauuaaccauaauucacacucaucuccccacaggcaugccuacaacauuagccuaaaggaagugaugcagguccugacccuuguaguccuggaguucccccugcaacaagucgauggccugcuugacccaaaccgcuacugugccuugcugcuuccuguaagcaaagacugagguugugugugaaggauugaguggagacugcuaaacaucuuuguacugcuugucucaaaaggagauaggaguaggaaggcuugcucuuggguauauguugcuucugggucuuuucuccuugucuuugaaaaugguugguuucuagaggagcauuaaguuguccagaguccaguaccuuuuuuuuuuguuuuuuuuuuuuuuuuguuuuuugagacaggguuucucuguauagcccuggcuguccuggaacucacucuguagaccaggcuggccucaaacucagaaaucugccugccucugccucccaagugcugggauuaaaggcgugcaccaccacgcauggcuuccaguaauauuuaauacugaauguucuuugagaauccugaauuaagagcauuccaggcaccccaaaaggacauucagaaauagugcauuuggcuguuagggaacauaaucuguaguccaacucuuccaggaaguugaggcagcagaguuccuggaacccaggacuuagagaccagccagggugacauagcaaaauucugucucaaagaucaaauagucuaaaacaacgugaagaacagaccugguguuacagagcccacagugauuagacccagagcaagauuaaccucuagguugggaauaggaauuuugugacagucaacagcauuuaucugacccccuuuucccuuuccugagaaaugucaucuuuuccccauccuugugugggaacaguucccaaaugauccaugucaccugcgucaucucccgcuuguccguccaugccgucacuguugauugccuuuguuguucagcuguggggcaugcuaaggaguaugauacauugccacuaucaccaccccccuuuuuuuccauagcugcucaaagccuggagcccuguuuuaaggaacuacauaaagcgugcagcugaccacuuggaagcauuggcagccauugaggacuucuucuuggaacaugaaacucucguuacuuccauggccaaggugaauuccaucucaagcuuuguaugcugugcuugcccugaaacaggccuccaugacccccacagacacaaaacugagguuaacuugagccuagcauaguguguguucacugcaccgucuguccuuaggguuuacuuacugcuggaguaaugcagugcagagcaggcugaugcuagugaggcagccauggggcaggaggcggccugaggaugcacuaaacagacacucggcaggagguccgugagccaugcacuccugguacugcagagagugguccacuccuuucuuuguuuuugggggacagugaugauacaguuuuugguuuuucccaaauuggccuuaaacuuguuaaguaguucaguucggauucuugacccuccgccuccaccucccaagugcuggaauuacaagcauguaccacuaugcccacucucuugucugucuugaagaggcuucuucauaugugguaggaagaugauaaggucgucucuuacauuauccaucauccuugcuuagauagagggauccugagacuccccuuugcugacucuguagguccugauggcuuucuaccagcuggagaucuuggcugaggaaacaaucuugagcugguucagccaaagagacacaacugacgaaggccagcaguuacggaagaaucaacagguacgcugcccucugcucccuggaucccgaguccuccacuggaaacucuaggacucuguggccagaacuguuuaucugcuaacaggaacagugggaaugcgugguucucuccuagcagcuguccccucugcuuccuugcagcugcagagguucauccaguggcugagagaggcagaagaagagucauccgaagaugacugauggugacugccagauccgugcaucucauuggcuguccucguaacaagagagcugacagaaagcuagcuacagaagcaugaguggccacggcagacugagaauuauuggaacggaaguugcaacuacaguauucuuccuacugcuggcagccaugugcugcucguccugacugaaguuaggaugagggaaguuagacugcguuaggggaacucuagacagacccugcaguugggggugggccagaguaaguacuuuguguuccagcuuucccuuggggaacaguaaagagcagcugguccucucuguuguuuguacuuguuaauauuacaaaggggaguggacugggcuucuccuuguggucagccagguaagaaaguacacgcacucacuuagcugcuuuuagccaaccccuggaggagagggagaaggguugagguggccacaagguggugcc

SEQ ID NO: 8157 - RNA, 10659 nt, Mus musculus
ggcaccaccuuguggccaccucaacccuucucccucuccuccagggguuggcuaaaagcagcuaagugagugcguguacuuucuuaccuggcugaccacaaggagaagcccaguccacuccccuuuguaauauuaacaaguacaaacaacagagaggaccagcugcucuuuacuguuccccaagggaaagcuggaacacaaaguacuuacucuggcccacccccaacugcagggucugucuagaguuccccuaacgcagucuaacuucccucauccuaacuucagucaggacgagcagcacauggcugccagcaguaggaagaauacuguaguugcaacuuccguuccaauaauucucagucugccguggccacucaugcuucuguagcuagcuuucugucagcucucuuguuacgaggacagccaaugagaugcacggaucuggcagucaccaucagucaucuucggaugacucuucuucugccucucucagccacuggaugaaccucugcagcugcaaggaagcagaggggacagcugcuaggagagaaccacgcauucccacuguuccuguuagcagauaaacaguucuggccacagaguccuagaguuuccaguggaggacucgggauccagggagcagagggcagcguaccuguugauucuuccguaacugcuggccuucgucaguugugucucuuuggcugaaccagcucaagauuguuuccucagccaagaucuccagcugguagaaagccaucaggaccuacagagucagcaaaggggagucucaggaucccucuaucuaagcaaggaugauggauaauguaagagacgaccuuaucaucuuccuaccacauaugaagaagccucuucaagacagacaagagagugggcauagugguacaugcuuguaauuccagcacuugggagguggaggcggagggucaagaauccgaacugaacuacuuaacaaguuuaaggccaauuugggaaaaaccaaaaacuguaucaucacugucccccaaaaacaaagaaaggaguggaccacucucugcaguaccaggagugcauggcucacggaccuccugccgagugucuguuuagugcauccucaggccgccuccugccccauggcugccucacuagcaucagccugcucugcacugcauuacuccagcaguaaguaaacccuaaggacagacggugcagugaacacacacuaugcuaggcucaaguuaaccucaguuuugugucugugggggucauggaggccuguuucagggcaagcacagcauacaaagcuugagauggaauucaccuuggccauggaaguaacgagaguuucauguuccaagaagaaguccucaauggcugccaaugcuuccaaguggucagcugcacgcuuuauguaguuccuuaaaacagggcuccaggcuuugagcagcuauggaaaaaaagggggguggugauaguggcaauguaucauacuccuuagcaugccccacagcugaacaacaaaggcaaucaacagugacggcauggacggacaagcgggagaugacgcaggugacauggaucauuugggaacuguucccacacaaggauggggaaaagaugacauuucucaggaaagggaaaagggggucagauaaaugcuguugacugucacaaaauuccuauucccaaccuagagguuaaucuugcucugggucuaaucacugugggcucuguaacaccaggucuguucuucacguuguuuuagacuauuugaucuuugagacagaauuuugcuaugucacccuggcuggucucuaaguccuggguuccaggaacucugcugccucaacuuccuggaagaguuggacuacagauuauguucccuaacagccaaaugcacuauuucugaauguccuuuuggggugccuggaaugcucuuaauucaggauucucaaagaacauucaguauuaaauauuacuggaagccaugcgugguggugcacgccuuuaaucccagcacuugggaggcagaggcaggcagauuucugaguuugaggccagccuggucuacagagugaguuccaggacagccagggcuauacagagaaacccugucucaaaaaacaaaaaaaaaaaaaaaacaaaaaaaaaagguacuggacucuggacaacuuaaugcuccucuagaaaccaaccauuuucaaagacaaggagaaaagacccagaagcaacauauacccaagagcaagccuuccuacuccuaucuccuuuugagacaagcaguacaaagauguuuagcagucuccacucaauccuucacacacaaccucagucuuugcuuacaggaagcagcaaggcacaguagcgguuugggucaagcaggccaucgacuuguugcagggggaacuccaggacuacaagggucaggaccugcaucacuuccuuuaggcuaauguuguaggcaugccuguggggagaugagugugaauuaugguuaauagugaugguccauuugacaggaucuaaauucacccuaguagacaaaucucuggcuggacacaugugucaaguuuccaaauuggguugaggugggaagacucauucuaggugugggugucacuguucucuggacuggggucucaggcugaaaaaaaaccaaaacacccaggaggagcugagcaccaggauucacugcagaugccaugugacagcugcauccaacuccugccaccaugaacuguauccucauacugggaggccauuuugcuacagcagauguagaggauccagcacugcuccagggguucacugcccuaagaccagaaagaccgugacagaaaucuaagcugaggcuggguguuaauguucuccuugcuccaaacacuccuggccuucugcccaggcuccuucuagggaagcaaugcuugggagggaaggucugcuccugcagcaaugcaggggagcaagcagggagcaggaggacgcaggaaggguuggucuuacuugagagaguugaucuccaggacuagauuuucacaggagauguucuccucucugccccgcugcagcguucccaggaccucguucuggaaaacugaaaggaaaaagcaaacauagcuuuccagaaugcguugcucuaaggcucuagcucugacuuuaccccaaagccuuucugggaggaacugagccgggggcuagcugcuagaagcagagaacagacguccccacgguguucacaccucugaugucauccagcugaggggagccugcucggcuguccagcuccucaggauccacacuucccucacuuucagucucacuuuccuccuccgucuugaucaugaguccuaagaacacagaaaggaggagcaagugaucccacucaguggguagagugcgugacuggcauguacaaaggccuggcuuugaucuucaccaccacacaaaaaucaggugugcugugcacuauauacaccaaggaaauggacacaagacgaucaggaagcucgaagucauucucagcuacaaggcaaacucaaggcuagggugggcuccaugagagccugucauuuaaaaggggguguaggaaaggaggggaucgccggcgaagcucagcuguaaaggcacuugcuaccagucucugggacccacaugguggaaggagagcacccacuccagcaaguuacccucuuaccucuacuuccugaauacauagacacacacacacacacacacacacacacacacacacacacacacacacagaguuuuaacaaaaagauaccgacagcuagcaguguguccugucagaaugaacugaagguccaauaauaauuggauuccaaggcauucaaaguucuuaagacuauucagaguaaguagaaggcaggcagguguaaggucaagcucaccccagagacucugccguagcuccucaucuucuuucgaguucacacccucagcuuuccagagguaucccuggccuucaaggccaacuucugcuggauuguaaccuggaaaaggcacugacuuugagaaggcccagcagcagcaucucucucuagaagggaacaugcuugucuaugggacagacagacagacgcacagaugccccacaccuguugagccucacaccuuucagcuucacuuucuccuuuucuuggucagcuccagaaucaucacuaaacuggccaucaucuucaucuuccucugcaucuggaggaugcaaagagaucaccgagcccuccggcagcgugaugucugggcccacuaccaccuuagaggaaaaaaagaaucaaguagcccagacuucaucgugcacugaggagaacugugguuuuuuguuuuuuuuugguuuuucgagacaggguuucucuguguagcccuggcuguccuggaacucacucuguagaccagacuggccucgaacucagaaauccgccugucucugccucccaagugcugggauuaaaggcgugcgccaccaccgcccggcugagaacugugucuugacaaucagaacaauguuuuuuguuuugcucugguuuuauacuaagcuaagcugaagguuagagaaacuggggcucuuacugcagucuuguuuacagggggaaauaugguccccuuugacuuggcacaaucacuauucaauuuugggguugugcagagucugaauaagccuuaccugggaagugagaacacaguauggcuucaguuugacucgcuccuugaccucagcucugucacagagcagagauugguguauuugugcuccagcagccacucgaacucccugccacagguaggccugguccaguaccacauuaucaccuggcucagaaugaggaggacuuccggucacucagggucccacauccgaaagaguccuucacagaggacaggcugauugacaccagccccagcccagcucccaucuagcugauauucuaccugcugacauuagaaacauucagucccuuccaagguuagccccaagagcaaagugaccauccucuacuaaauuuacaauaauuuuacacuauauguauggcucaaucugagaacccucaggauuucucagaaugaaccauaaaccuuauuacaaucauguucacaccuacaaggagaacccaaugacuccaccucucuguguauuacggaauaugaauccuacuguuguccuuuuaaggucuacuacuauuauuagucucauauucuucaaccaaagugagaugucaagaggaauacaaagauuauaggagagcaaaaaaaaaaaaacauggagagagcuggaaagauggcucagcgguuaagaacacuggcugcccuuccaaaggacggggguucaauucccaguacccacauggcagcucacagcagucuguagguucaguuccaggggaucuaacagccccacaaagacaugcaggcagaacaccaaugcacauaaaacaauaauaaauacacuaagaaaaaaaaaaaaagagggcuggagagacggcucagcaguuaagagcacugacugcucuuccagagguccugaguucaauucccagcaaccacauggugacucacaaccaucuauaaugggaucugaugcccucuucugguguaucugaagagagcaacaguguacucacauacauaaauaaaucucuaaaaacaaaacaaaacaaaacaaaaaaaagagcccacaacuagcauuuaggucccaacauugccuuacauuagauguuacugggacaggagaacuagcacaugcagaagccuucuguaagcuguuacgacuggacaaaggucauuaguacacacuaacuccacuugccuccaaaugugaacacaggacauuucagaauguaagagucacacacagacuagguagagcugugguggugcucacuuuuaaucccagcacucaggcggcucuguuaguucaaggccagccuggucuacagaguuucaagauagccaggacuauguagagaaacccugucucaaaaaaaccaagcuggccauacagcccugaggcaaucuaugcuccagaguggaugggaucauauacaacuguagccaacugacuuccuuuguccugcccuccugccauuuuguuuaagacaaauuucgauauacaguucuaggauggucucaaacuuguaauccuccuaccuccaucuccuggugcugggacuguaagugugggcaacagugggugugugugguggcuuaggccuuuaaucccagcacucggucugugugcaccagcaagcacgaggacucuuucuuuuucuuguuccuuuggcccaagauuuagucaauuuaacguuaugugugugaguguuuugcccaaauuauguaugcacacaaagcacauguuuggugccugaggaggucagaagaggucacuggcuccuccugcacuugaguuaugagcuaugaauccugggaacagaaucugaguccucugcaagagcaaugcacacugaaccaccucuccaugccucugcuccuuccuuaugauagccacucuaguuuccuguucauaggauugucccucggcauccucccuagcuucuggagacacacugcagccccguaucuauaggaccgcugcuggguuccccaccugugcucaccaauauggcaguuagggccgaugacacuguuggugauggagcaguugcugccgaugacagugccagcucccaaaagcacauuuuccuccaggacgcugccauggcccaggcugacuucaggcccucgguagauguugugucgggaaugaguguagcucuggguggugcugucagugaaguuuacuucuggagugagaggguagacccaucggcggaugacgucagcacaaacagcugaguacauguguagguuggagacccgggcaccauauucccuaguugucacaugcaagugaaucugguuuccuaggaccuaaaugagaaggggugguuacccaaucaagcgaggcaggaagacgaaccccaagcaugucaccuuucuaagccuuuucagcgccucucacugacauagucaaacgaccagagcuuucguucucaggcuuaaugaaacacaaaagggaaccaaaggcuaccagaguaagauaaacccuuucuacuagagguuucggaagcucuucucaccuccucauucauuaauaugccucguacaaaaucaucucgaguuugguagucaaaauugucugugaagagcugagcuaccugugaggaaaacagagcacgcuaagguuaaguacuuuacaaguaacaagcccagagagcuaugaaacccagaaauggcugugggacaaaacccuagauuugguucccagcauacugggagucagguaaugguaccucucuacuauacaacaagucagaaaaagagggaaaagaugcauacccuggccuugaaagggagcaauuacagacccccgagagcucuacucuggcuacacagcccuguucuggagaguucaccugaggagagcagaugcugaugugacaguccaacaaaucauaucgaaucuccacuccgucuccacugcccuggaacaggcucugaagggagaaguggcaggcagaggcuugagcucaccucucuccucgcagcuccgccuucuccuacccgaguuccuuccccagacacccaguuaccaauggaaaggaaaagcgccggaggccuugggucuucuggaagugaagaacccuguugguggcgcuguccacagccaucaccacguuguccucauggcagcguguaggguggcugggugacgacucuuugaagaccauugucaucacagagacauuuuuuucuagcuuccuucuuaaccuauuaagaaccagaggcacaguuagucuuaggacucugcuggucccuaagucuuguccugcagucuuccccagccugaccuguguuccuccagggcucugcagauauugauauuugagaugacaucuccauauaucaagagaaagucagagcgcaccaaggccuuggcaucgacgucacggaggacgucuccuagugaucgguauagcucugaugugauuauccgaacaacguugggggacguaggauggcaccacuuggauuuccuguaggaaagugaugagaggaacaguaaauuaaacagauggucacagaccuggccuucaaccuccauccagcguuuauacuccucuguggcuuuccugggcuccugccagcgucccugguuucaaagaguccuaugaaccauaaugaaugguuucagcgucuagugucauuaguuuuauguguuugagaaauauggccauuuccuuucuauaacuugacuccugucuucaaauaugaguuugaauucaagagcuuaugagaucuaggguauaaaaguauucugggaacauauauuuuuuuuuucaugucaucuuucuuguucugagucucuaucaacuuuaaacaccguaacauggaaaacauguuggguauauauuagucuuuauuucccaaacucauaaauucccagacuaacucuuccaaauuuuaacaagcaucucuuaagaacuuacugugggcuugaaacuaaggugggcggaggacacagaggggaggagcuuguuccaaauacagacaguauuuggaaauuugguggaaaaauaaagaugcccuuccaauaacauacacucuggagccaucaaacaaaaagcaaaacucacaggaacaaacuuugaaagacucagaaauuaucaaaagauggccuaguuggcuaucacuggaaagagaggcccauuggacuugcaaacuuuauaugccccaguacaggggaacgccagggccaaaaagugggaguggguggguagggaaguggggggcaggguauggaggacuuuugggauagcauuggaaauguaauugaggaaaauacguaauaaaaaauauauauuaaaaaaagaaagaaagacucaaaaucacaggcaagccuuuaauuuuggucccugggaccucaaggcaaaggaagcugcagcaguuuaccucgggacacgugacgagaacacuaaaccucacaggagcucagaacagauucaguguucuccuccucacaucaacucuauccuggaagaacugaaaaaagacggagaauccuggaaaggaaaaauuaugaagccuuacuguaaguguucuuugaucugagcagcuuuccagcagcaaaagacaaauguuuccuguacacccguggcagucaggaacuccagaguauagucaauuagcgcaacguuggccaggggcaagaggaccuauagggcaggaaagaaaaagucugagaucuucaagucaggauuauacuuugguauacuuugguuugcagacacuauaaucgacuuuauccuuuuauucuaaagcaaacaggcucuaagggucagucuaaggcucuggaauuugagccuaguaggcaugguaucagacacaaacauguucuaggagcccagugcuggcauuaaggacaaauguuggcccuaagucauagcucuagaacucuaagcacuaaggucuucuucauagaauuuccuucuauuguucuauugccacuaagagucacagaaaucauucaaacacuugucaaaaaugaacagucguuagccuuaggaauucuuuuuuuuuuuuuuuuuuuuuugugguuuuuugagacaggguuucucuguauaguccuggcuguccuggaccucacuuuguagaccaggcuggccucgaacucagaaauccgccugccucugccucccgagugcugggauuaaaggcgugcgccaccacgcccggcuauuaggaauucuuaagucaaaggcaaaucccuauuugaaugaacuauggauugcugagcgacccaguagucugcaagcgcaaugccuauuuccuaugucuagguaauuccuagacugauggcaacccacugggguccccuuucagcagaugggaggaaaacagccugcugagagcuagccuuuuuuccuuuaggaauauauuaccauugccuuuaucuaaagcaauuucuuuaaauugcccauguccugcaagguuaaagacaguggaggccccucuugugcuacuaaaucccccggggaagccuucuuucaagcauugauucuacacacagcccucuccauccuucccaaggcuggguguauagcccugcgagaauccaugugugcuaguuacucaucugaucggacagccuccgagguuucagucggucucuccaccuuuuccuaaccagauaagcucaacuugaggguaacuuccagagcacgcuucacuaaccagcugcaguggcaaccugcggccccgcuacccucgaggccggcagacugcucgcgagccgggugcucacccgaggcugguccuuggagauggggaagaagcggcgguugaagcuaucggccacuagaacugccuggaggggcggcggcggcuccuccuccgcaccuuggguucccccgccgcccgagccgccgccgccgcguuugcucgcucggccggccgcagcgccaggcaccgccgcaguggcugccaucuugcuucgcagccagcacguccgccgggaagucacacggcacgcaguaggggacaaaaaggacucacagucaaaacgcgaagguguaguugcaggga

SEQ ID NO: 8158 - RNA, 7006 nt, Mus musculus
gcgugcaccaccaccgcccggcuaugacagaacuuuuuaaggacccuucuaguaaggguaauagagaaggcuucucugaauuaugaagcuaaauuggcuuaaagaggaagaaagguuaugagagcacauuaaaacagagauggccaauucuacauggagaagugccuaugaagaaaucagaaaagugugucuguaagaacaacaggagguaagugucaauauuuugaaaaauuaaaaaaggaauaguaagggcuagaaaguggcucagcaguuaacagcucuuguccuuacagaggaccuagguucaacuccuggcacuugcugagcauaacuccaguuccagaaagcacaugauacacaaacaagcaugugagcaaaacauucauucacaugaaaucuaaagaaaaaugauaauagagcaguaaaaggugacuuaggcgauucuugcugcugguauuaauaaguguuauuaauaagaccagccaguguccaguguaaggucuggggccucagagguaaaggccuggagguacagacaggagaccacgcagaaauccgcuuaugaacaaguuccugcauacacaugccauugccccuggagaagccagccaggugauuagccucugcucugcaagaaacaggcaguugagucuuugauuaauaguagggaggaaaucaccaaagaacauguucaauaaggucaugagaaaccaggcauggagcaugucuguaaaauagagaucuguguauaaugucuacuaaugucaccguggaacaaagcacuuaaauugaagcagcucauggauguccucaguuaaacagccaguuuaagacaaguccaggcuaugugacaaguccaggcuugucucagaaaaagccacaaguuuccaaacugaccgagccuguggguuccuggcaugaugagagucccaggagauuucaacgugucaaagccgcuggagucaucagauaugugaggaugggauauuaacuugaauguaaagaauuaaggaaaaugcuuguuuuagaacaccauagcuacacaguugcuugacccccuaguccaaaacaacucguggggaaaaaaaaagauguccuuugaauauugacauuuuuccuuuucuugagccucccacaggaagacucugcccuuuuaucacccuauagugaaacuuacuuauuaguaacucuuguacauaaacuuccaaccugcauuuuagugccuuaaaugcagcagaagcacagauccaaacauuagaagaauccuccaaaaaaaaaaaaaaaaagccaagagcaaaauacacaaaaucaaggaaucucugguaaaguaggguagaauuaugcaaacucaaaagagaaaacacuguccauaaagaaaaugucauagaggggaagaguuggaagcuaaggaguucccauccugguauacuuguuuuuagucucugagcaugcauaaauaacaauauauuggguagguaaaaucugguauacuggauaaguaaguagcuagaaagguuguaauaauagaaaaucaagggacagacaagguaacccuuugucaugggaaacacccugggauggacuggggguggggcucccauacgucccaauaucaaauuugauugaaucauucccugucagcuucagagaaacucauccacagagcaauuaaaagauuuaaugagagcugggcaugguggcgcacaccuuuaaucccagguggauuucugaguucgaagccagccuggucuacagagugaguuccaggacagccagggcuacacagagaaacccugucugaaaaaaaaacaaaaaaaaagaaacaacaacaacaaaaaaagauuuaaugacuguuaaaaagaacacugcucuggaaaaucaaggacaagaaagcuucgguagauaaaacaagaaauucaggaaaccaaaccaaaaaccaaguauuuugguaagcugcuauaaauguuuagagaccaaagcuaaaaguacaaauaaauggcguugaaauugaagguuuaguugacacaggaacagauguaacaaguuucaccaaaaucuuggcauccacauuggccucuucaggagcuaaguaugaacacuaaagucuaaguguuuaucucagggaaaaccaaguucaagguggguuaagaguguagggccagaggacagauagaaaaauuaaagccauguguggccaaaauagccaugaauuuauaggaaugugauuugucacagcauggaaaacacagauuaacauuccccaaucucagaaacaaaccauaauauuaauaaugcuucuaaaaguauauucaaagauauuaucaagaacagucacagaccauuuagguuguccauaagcagggcauaauaacuguuggucuuuuaaagggaccaacugcccuaccuuuaaaaugauuaacugacagcagggcgugguggcgcacaccuuuaaucccagcacccaggaggcagaggcaggcagauuucugaguucaaagccagccuguucuacaaagugaguuccaggacagccagggcuacacagagaaacccugucucgaaaaaccaaaaaaaaaaaaacaaaaaaaaacaacugacaaaccuguguggguggaauaauggccucugaugucagaaaaagugggagaguggagcaaaauacacaaaaucaaggaaucucugguaaaguaggauaggauuaugcaaacucaaaagagaaaacacuguccauaaagaaaaugucauagaggggaagaguuggagucuaaggaguuccccagccugguauacuuguuuuuagucucuccaagcaugcauaaauaacaauauauuggauagguaaauauuggauaaguaaguggcuagaaagguuguaauauagaaaaccuuguaaugaagugaaauugucaaaaauugaaauuaauagcagcgaaaaggauaccaagagucaacccagaggaagugaacguaggauuaucacagagaggcgcacgggaagaaggugaagggacauucaguuuaaaggcuugagacuuggagagagggacguuacuucuaggaugcuggcugaggaggacggucagcuggaugcuuucucugccucugagcuagcaggcuuucaccucaguaucuggcucccaagucuucacugguaaaauugagugauagagauuuuguuuaaaaacaacaacaaauaccuucaaauuuaugaaggaaaauuauuuucaacucaauuguauuuuuuucuaagugugugugugugugugcgcgcgcucacggguuugugugaagguguuggggagcacacgaguggcagcaugccuguggaggucuccuaccauauggauccuggggaucaaacuagacugccaggucuagccuugcaccaaccucaaccucaaucauauucuagacauacagcucaaagaaucugggccuuagugguauaaaucaugccuacauccacaagacccaauaaacaaacaaacaaaucccuuucuagguguagcacaaaccugugauccuuggcaggacuuccaguuuuaagagcagccugagcuacaugcagucucagcuacagaaacaccaaaaccaaaauugcaucuaucuuucuuucuuccuuucuuucuuucuuucuuucuuucuuucuuucuuucuuucuuuauuuauuuauuuauuuauuuuuaagagcagccugagcuaaaugcagucucagcuacagaaacaccaaaaccaaaauugcauuuuucuuuuuuuuuuuuuugauugauugauuuauuuauuauauguaaguacacuguagcugucuucagacguaccagaagagggcaucagaucucauuaugggugguugugagccaccaugugguugcugggauuugaacuucggaccuucggaagagcagucgggugcucuuacccagugagccaucucaccagccccaaaauugcauuuuucaugcuuucaaagagaccugucaaaggaugcagugagccucacuaaaauagaaauaaaguguccaagaaaaaagauccagcuuggaggagaagugccccuggggaugcagagaagucccagaugacagcuagauagagacagcaggcaguguucaccagagcaaacaaagcugguuuaccuaauagauuggacuggugaacaagauguguccugaaaaacugcauugugugcaaacaauuauugguuuaaaaaauaaauaaauaaagccaggcagugguggcgcacaccuuuaaucccagcacuugggaagcagaggcaggcggauuucugaguuccaggccaaccuggucuacagagugaguucuaagacagccagggcuacacagagaaacacugucuugaaaaaccaaaaauaaaauacaaacaaaccaagagaaaaaaaaaaaaaaagcaaaagaaacaaguaauauaccaagcuuagcaguacuuuuacugucaguguuaaguacucucgacuuaacaaucauggcuucaauauuuuaagaaaguaaaagugggaaguuaaugggcaaugucuagaauguguaaaucaagaaauaagccaggcaucacaugccuguaaccccagccacuccaggaguguacaggcaggagaguagaaaauucagggucauccuggacucuguuuuuaauauuagggcgggagaaacagcucaacaguuaagagggcuugcuguuccuacagaguuuagugucuggcaucucagcagguggaucacagcuucccgaaacuuuuuuuuuuaagauauauauugucacugucuucagacaucacugucuucagacauaccagaagagggcauuagaucccauuacagaugguuguuagccaccaugugguugcugggaauugaacucaggaccucuggaagaggucuuaaccacuuaguucucucuccagcuccugugacucuaauuccaagagacugacacccucuccuggucaucucagauaccuauaaucugugcaggggguaaaaacaaaccuugaaaaguuuuaaugcauuuuauuuaugcacagacauuauuuggagaaaaagauuaaaugaaggauauaaacugaaaacauguaacugcuacugaaugcuuucugcuuauaauaaaaaaauugguuaugauguaaugagaaaaagucuagagagguauauagaugucagauuauuaagggccuugugugucauguugaggguauaugaaagucauauuggguaaugugaagagguuucugggcagaagaggugacugaaaugcaggcauguaaucagagagagaacucagaagcuugaggcaggagaauugucaggaguuucaaagccacaccugacauacauuguuacagcugagaagcugaaccaccaacugacuauagguaguuuugacaucuacugucccaaucauacaggguuucucuguuuagcccuggcuguucuggaacuugcucuguagacuggcuggccuccaacucagagauuugccuaccuauccaguguuuggacuaaaguaauguuccaccacaccuggcugcuugcauucuuucuuaacucaaauuuuuucuuuucucuuucuuuuguccuuuuuuuccucuucuuuuccuuucuuucuuucuuucuuuuucuucucuguauuucucccucucucuaagagaggaguucccuccauaguccugcuguccugaagcucucuguaggccaggcuggcuuaaacucacugaaagacaccugccucucucuccugagugcuggaauuaaagguaagcgcuaccacacccacucaguccauuucucaaacuacuuguucauagagacgcugagauuauagggauaaaaacuugaacuugcucagcccucaaggaacucaguacgguccgguggcagcaacugugcugucagcagaauccaaaaauccgaguugaagccacccggcauccagggauccaguuaggucuucaaauccauucucuucugcagucggugacacuucucuuccaucccuccccuccugcccgggacccugcacacgguuccgccagucccaccgggcugagacuuccagguccagcugccugaacccggagcacaggggacccagcgccgcccugugggugggcgggcagucggccgcaagcagccagcgcggcucggaggcggggcggggccgcacugggcucggcccagagccgggagggcccaggccaccggaagagucgcgaucgccagcggagcgccgggaguggggagcggaagcgguggcgggcggcgcugggacccgggagcggccggagaacaagggagcuggcggcccggccggcggcugaguggggcugagcagcgggccgcgccgagcgccgagcucugccggagaggcccggccccgcugcccaagcaggccgcgcgccgcggggccgaggccggagccaugggcgagaccaagaucaucuaccaccuggacggccaggagacgccguaccuggugaagcugccccugcccgccgagcgcgucaccuuggcggacuuuaagggcguucugcagcggcccagcuauaaguucuucuucaagucuauggacgacgauuuugggugaggauggcccccgccccgccucccgggagcccgggucgcuccgcugcuaggggccaacacagccaguuccgacuccccugacugcacugguuucuagccccgcuuccagcaagggagcgacucggugacuugggacacacuugacuuugagggacucccagucaccucuuggaggccuugccccccugguccagcgagacgucccucccuaagcaaucgguuccuaccauucaagcccccucaccuccccacgguccagcggccccccccagagacauacauccuuuccacuccaguccaaagccagaauucucaguccuuccaggugccaccauuuaagcauaaaguuggaguauauugacacccggccugccuucccggucuucugagcucugcaacucagagccuu

SEQ ID NO: 8159 - RNA, 12981 nt, Mus musculus
cggggcgggguggggcgggagcacugcagugaaagccgaggcagcagacaggcgagcugggggcgggcggacaucuugggauccgagaguggccaggccggccuugugggggcugcugacuccaggugagcugggaggcuugacuuagagguccuuaucaggcgacgagggugcugugguagccugccuugcccugcacggugcuggguggaaaacugcccgcaccggggaguggccucagccuucagacccgggagggaguagacaaccgggcgggggugccuugggcgcgauugcagcaagggcggggagcaacgccuuccagugacccgccaggcgucuccgggaagagacuagggcuggaauccuagagcgggagacgccgcgcggcgccccaucccuagaauccugacaaccgcucaaccccgggguuuccuauuuccccaucccccaggacauugacauccccuggugccacucccuuggacagugacaggucucucucgaacacugagagauuccauccuccugguuuacccccacggcucuuguaccucagaccugugacagcccccgcaucccguggugacaucucccgggccuagaugucuucuccucccucagcugagaaaaacuccaccagcccccuaugcuucacuaacagaagaguaggcccugucucucagcuuucucuuuuucuugucuaucucuuuucgcuguuuuucgcuccucccaagcuccuaugaccuuugccauaggagaccuuuagggacucccacagcuguauuuggugcuuuggggucauccuggucuuuugcuagcaauuccagcuaacccuuuccuuaacuaaauauugcauuuucguccaggacacacacacaccgcccccccccccgaggucacacacaccaucccccacccgagguugauaccuguggacuugguccuuugcucagcgcucaaccuccauuuugcauuuucuuucucaccuucuuuggacuugucacugggcuucaaggguuaacuuuucaguuucaaaaagucuguuaaacuaaccucagugaaauuaauaucuggacuaauccagaaaucuagaaccagauuaaccccguuacucaaauauucuaccuuaauuuugaccaaaauaauuugggcagucgaggcauucuguuaucccugcccauugcuugguaaacaccaggccagaagugacugacuuggcagauuuggagacacaauuuagauggcaggauuaaugcuacuacauacagaccuaauuuuugucacacuuagaaauuuugaaaagacaguaaccagaaauaacuguaaaaggggcucagcauugaagaguucuuacugcuuuuccagaaaaccugaguucaggucccggcacaugucauuuggcucaguaccacccuaacucaggcuugagggguggagggcaguguucagucuaacaccuagcuuccacacauacagcacacuggcauguaccugugugucgguaaaaaugaaaucuuuuaaagaacuuauuaagcgggccucuguuccuuugucugcuuaucucucugccugggaaagaugugccugcuucagccaccuuccuggcucuguguuagagccuaagggccucuucccucccagccccaccucacccugcacacccuuuccuggaauguguagacuucuagagggucaugcuccguugccuucuuggaaggguaaugcuugcucuaaagguuaugccugguggcaggcccaggcucaagccaacuagaguaaucccucccgccacgccauuccugcaucugcaggcaggccuucucugugacucacuggaagcagcaggagugagagugcacaguagggggcugagcucggccuugugguuacuuuccucagcccucagaaaaggcuggauaaaaauggccuaaauccccgggccucacacucuuaaagugcuguccccuauccaguguggaaaaacaggaacuggagccucgggagggcugcggaggacuugggagucacuugcuagaggacugagucaggaaacaaggcgggccuguacagccccauuggcguggacggguucuaaagauuuccccuuucccuaauccccccuccccuuuccuaccuaggucuguucucagagcaaugggucacagagacugagcugccaccaugaucggaggcuuauucaucuauaaucacaagggggaggugcuuaucucccgggucuacagagaugacaucggguaagucccuugacugagcaugcuguguuucaaccucccuguugccucagccugagcaugcaauauagccugguucccauugggcacuggccuagcugcuaggcuccaggccucggaaugacaccuccacccccuaggguuaggaaucccugcccuuccugcucccugugucuuugggguaggucugguggcugaagaccaggugcuuuugccuggucuuccuuuuagaagggagcacucucuccaguggguguaguuaguguguguguguggagauacuaauccaucuaaaucuugcuuucaaauccuucucauauugagagccuucccuagauccccuuaaaaccucucuguagucugcugacucagcuguuuucaguucuccugggcccucccugguugugaaccggcuuacugugcucugcgggucaugcugccuuuguagcucaucuggguggagcuggacagcuccuaagaccuccuaaagucucacuucucacucugccucacacucuggcugcuugcuaagagauccuccacugucuagccugaggcuaggcucuucuguuucuuccugccuugguuuucuuucucaaaagagcuugagauaaauagucucagaauagaccuaugguagcucuccuaccuucuugccucccuggcuaaugggcuagcuugguguggcuguauccauuuuuuggugguaaagcuaaccuagacuuaguuuguggcagugccuagccuaagugaaccuggcugguuccacuccuuccugcuacucccagccuggaugguccugguuuaugccacagcugggccacauggcacccugcaugccuuagcgugcucucuaccuguugccugucuugucugcuucucccucaugguaugugcugcccaccuugguguguugugugucgucuaacccucucucuccuugcugucaaucuccuccuugcugacgucauuucucucaucccaucucauuggcugauguagcaauagguaagcagccugugaagcugccgcucagguacaggggguccugcccccccaaauuguuuuccuucaucauuuuucauccccuucagaagucagaccuuagaaaagaaguggguggcacagucuauagccccucucacccuuuagaguagacucuuccaaggucauacuaguuuuauucaacucccugaagaguuagcuuuccccacugauggacccaacagagaucucuuucucugcaggccuggaacuuccuggaaagcuagaguggggacagcugggguguaucugggaaagcaagucaggcccaggagucaguuuauuaacacuacaggcacucuucccguuauuaucauuugaguuccccuuuagguagcaagccagugcagaaccuucucccaggacccugcaggugguauaagaagggagcccuagugguuuaggccuugacuuaugaauauaugucagauuucagugguguggaggguggggcagccagcaucuguaggugauccucagggggugaggucugccuaaauacugaauugccucuuugcaucuuuucccuuaggaggaaugcuguggaugccuuucgggucaaugucauucaugcacggcagcaggugcgcagcccugucacaaacaucgcucgcaccagcuucuuccauguuaagcgguccaacaucuggcuggccgcagucaccaagcagaaugucaaugcugccauggucuucgaauuccucuacaagaugugugauguaauggcugcuuacuuuggcaaaaucagcgaggagaacaucaagaacaauuuugugcucauauacgagcugcuggauggugagacauuggaggauuaaaugccacuguggggaggggccuaacugagagggucuuguuuuagaguagaauaugaaaauaggccagcacgaaguuuuagucuuugcuggggcuaggaaccugacugugggguuugguggccaagccaccuguauuagccuaaaaucuucacaaacugaacucaacucuuaucucaacacucccucagagccuggagaagaggaaguccuguaggucccuugguuguccucuuuccucuuguaguaucugugacgacuucccuuucaccaccaucuguuuucuggagaaaaggagggcucaggguuuuuuuaauccucuuacccacucacugaccaugugacucuuucaugauuuuucuuuuuuacauuugaagaaaaaaguuguauuuucguaugaagaacaaauccuaagcugagugcucuaagcuagaagacuuggcuguaggugauucuguacagcaccaggaccuguucuauguucuaggcagggauauccgggccagaggagggacuggaaggaaggaaucuuuuguuuucuccagaaacuaguaauucccuucuuuuuuuguuuuuuuguuuuguguuauugaaacaggguuucucuguguagccuugcuguacuagaacgggcucuguagaccaggcuggccuugaacucggccaccugccucugccuccugauuucuaggauuaaaggcauauaccucacugccaggcuguaauucccuucuuuuuacagagauucuggacuuuggcuacccacagaacucagagacaggugcacugaaaaccuucaucacccagcaggguaucaagagucagguacuugaguuaauuguauagcacacaggguggaccccaaacuccuuuccuuccuauugaucccuggccuuguucuagcugacucaugagcuugcccuugacaggaagugcuggccucagcccuccuaccaugacugcaggccuuuuuugcucuggguagcuagcucuccuaccccagaagcugccaacucagcaucucuauuaccaggaauacagcucaguugguuucuucuacacgggggacaggggugugucugcucuucaggccuuguguuccucagaaaagcacgugggcucuccucucagacuugagccuuaucgcuuucucccuuuguuugcuuaccaugcugcuuccuguuguguuggccccuugcuggcucugcggcuucuagcaucagguaaguuguucccucacuucucccacugcagcuucacucuguucugcagauccugcccuguaaggguugugaggaaggagggagagugacgugauacagugggcagaggguaaugggacggggaaagggaugaggucauuggccaccuuuaucccauauagacgaaggaagaacagucccagaucaccagccaggugaccgggcagauuggcuggcggcgagaaggcaucaaguaucgccggaaugaacucuuccuagauguucuggagagugugaaccugcuuauguccccacaggguaagugucuucucaugaugagaccggggauuggggguggguagguccuggccugucggcguggcucagcugcucccuguuucucuguucugucaccagggcaggugcugagugcccaugugucaggccggguggugaugaagaguuaccugaguggcaugccugagugcaaguuuggaaugaaugacaagauugucauagaaaagcagggcaaaggcacagcugaugaaacaagcaagagguaccggugucugggagcucaagggacacaaggaugagcaagccuuugagaauccagugaggccuagugaacccagauucccuuuggaguucauuucuggaauuguuaacugucuuuccaagucauccuuggccaguuagucuugugauugacgauaaggcauggagggacugucuuuguccuuggagagcacgcuuuuuuuguuugauccccagcaacaaaguucucaggugauaaggaacccagaggcucucccacaccucaaacugcagggcagggauuuccaagucagaaagcuguguucuggaagcuucccauaaucuguguggcuagccugcucuggcauggucuguuaaucugacauguaccuauuugagcucugcuuccguuuacagugguaagcagucgaucgccauugaugacugcaccuuccaccagugugugcgacucagcaaguuugacucugagcggagcaucagcuucaucccucccgacggagaguuugaacucaugaggugccauggggguguggaggaggcagggggugcaucuggaagagaguagggcuggcccugugcuaucacauguguucucuccuccaaagauaccguacuaccaaggacaucauccuuccuuuccgggugaucccauuggugcgggagguggggcgcaccaaacuggaggucaagguggucaucaaguccaacuucaagcccucacuucuggcccagaagauugaggugaggacuggagacuuggagagugaaacaccuaucucggggaagaaaaggcagauagaugauccaggucuccccagagcucacugacgggugugucacuccuaggugaggaucccgacuccauugaacacaagcgggguacaggugaucugcaugaaggggaaggccaaguacaaggccagcgagaacgccauuguauggaagugagucuucaggaggccacaggcaggcucaaggcgucauaguguaccuuccgguuaaguuugaccuguccucuguguggguuauagggugagaaaagagugcaugcuuguccaggagccuguguguguguguguguguuugugugugugugugugugugugugugugugcuccaucucucaugcacuugaggagcacgugugucuaguuuucaagauauucccguuggcccuugucgacuugugucuaaagcguacagucugggugagggagaaacugcagcuccggguacugaaggaguaacuacugcagccuccugcugcccauucccucuguguuccuaggaucaagcgcauggcaggcaugaaggaaucccagaucagcgcagagauugagcuccugcccaccaacgauaagaagaaaugggcucggccccccauuuccaugaacuuugagguaggcagaggagggguauagcgcaauggcugggugugaugggagacucucugaucauuuugauuagacucuacuucuuaggaauaagagaacugggccuagguugggaaaugucuugaauugauagacccauccccuuuuaauagaaauugguguuuaaacugaccaaaagcuuuugacuauuugauuugucacaaaauaguuuuugagaaacauuugcuuugugugaauaagacacaucauuuucuccacuuuauuuucaaguccacagcauuggcagggauaaguauguucagugguaguucucugggauaaguaguucagagauagugcucuggcaaccuaaggauuagagcaauaguuuuauccucacaacugggcucagcuucagauguguccugauuccuaguaacucucuucacgugguagucuccuagugaauucccuccacaccagucauucaagaacaccugugguagauagggugggugaaccauggaauuugccagaguacugugauagaagggccauauuccuaacuggagcuguccucugcucaggugccauucgcgccuucuggccucaaggugcgcuacuugaagguauucgaaccgaagcugaacuacagcgaccaugaugucaucaaaugggugcgauacauuggccgcaguggcauuuaugaaacccgcugcuagcugccuaguugcagcuggcccaccucccuacccacccuucccacagguccaaguaccccuagugaccacucaccagugucguuccuccguccugcucugcugccuuuccuuuccaauagccccugaguauaagucugaaccagccacaccacaguggaacuggucagguagugccuggcuuccugggagggugguuuuugaggcuucucuuccgucugucuguccuggcuuagcgccaggcccugaguuuugugaccaaagccaggugcucuccucuucucucuaccccuguggccacaccucugcagugggaagguugacuaccccucaccucagagcuuccccaaaggccaguaacagauccccagucuuuaguccccacucugcuuugggauaguaugagcuucguuuuguacacgugugacuuuguccaguuacaaacccaauaaacaauagaguggaguugcuggcuaaauguuaauggggcccgcagagggucugacgggacuauuauuacuccaugcaguucuggcuguccuggaaccuguguguaggcucaggagaucuacuuccugagugcugagauuaaaguguacaccaccaugccagacuuuguuuuguuugggucuugcugcuuguagcucuggcugaccuagaaaucacuauguagaccagacugcccguaaauuuuaggugaucccugugccucugcuucucaagugcugauacugcagauaugugcuuugagauggguuucauugugugagcugagguggcuggacucaggguccucccgccuccaucucucaagugcaguguuguaagugugcagguuucccaguuaguacaaagaggcaagauuuguauuaguuuuguuuuguuuuguuuuuuuaaggauuuauaucaguacacuguagcuguuuucagacacaccaaaagagggcaucagaucccuuuagaggugguugugagccacuauguggcugcuggaaaaugaacucaggaccucuggaagaacagucagugcucuuuaacugcugagccaucucuccaagaucuuguauuaguucuugcaggaaagauauuuuccccaugcaucuuaucaaacccuggcaaaaaccuccauucuuccagaguuccuaaggggauugauugucccaaagaucuuguauguuagaauaaauaaagaauaggguugcccucaccaguuggaccuuaugagguuucagcuuuuuuaaacaaacaaacaaaaacuagaguaaauuuaaagcauaagaauauagcuaaucgaggcuggagagauggcucagugguuaagagcacugacugcucuuccagagguccugaguucaauucccagcacccacaugguggcucacaaccaucugcaaugugaucugacgcccucuucuggagugucugaagacagcuaugguguacucauauacauaaaacaaauaaaucuuaaaaaaaaaaaaaaagaauauagcuaauccccauguccugucaccagcuucaacaucagucaauucauggccaacgcuaguauguguuaacgcaaaggacucaaugugauugcaucgggauccagccaugaugucagauccccugcaucugggauuauaggcaacucauaguuaccugauguaggugcuaagaacuagacuugguucucuguaagaaaagugcaugcucguaaccacugagcuauuucuccagccccuaauugugcuuuuuuuugggggguggugaggggggacuggcuugguuugguguuuuauuuuccuuuugaggaggcacagcguuauuguauaaaagcugagccagagaguuuaaaauagggauacacgaucuagcacacacacaagagucuccaguucauauguaagcccucuccaaaguuacccauauacaucuagucccucuucaacuucaaaugugcuuggccucuucauaccagucaauucccuuuagggucugccacugucacaaaacaacccuuugcagaacacaugacaccacauagcccuagacugcacucccuuagucugacuucccaggucggucuccucgguggaggcuucugcugguggugucuugagcaucucaggcauugacucaggugggggggggggcacuuucuucuaggagauuuccuugauagagucaguucucucuccguggcuguugccagcuguaccacggguaccaagguucaccugacagcagugugggggugggguggggugguggcugauggagucacacugacaguucgauguauaguaggaaagucagcaucucgggucucaaccuggagaagguagcaacugagaagaccacacucccuggcuuucuggauggccugggucagcgucuugugccgcuucauacagacccccuguguaugaggcauggaagaugauaccagugugggcacaaacucuucaagagcuucacauccuaaagucaacgugaaacuugugaugccggcagauggggcaaggauucccagcagcacuggcggcaagcguuugugguugcagcaguagucagcccaagcagggcgagagccauagcuguucugguauugugaauccagguauuuccaagguucauuuucauaaggggaaccggaaagugaggacagagcaucuucuucaggauggccucagagcaagagucuggaggggaaccugaacuacaaaagaacuuuguaaaaguguaggaaacagccuuagcagcgugugccaucuugaugccugccguauggccugccagaagaaccguguuugguuaauuuuaucuucauuuaaugccugagggauuuaccugcaucacauguaugcagagaacuccccaaugccacaggggcaucggguuccccuggaaguggaguugcagagaguugugagcagucauuugaaugcugagaaccacacaccaaucccuugaaagagcagcaaguguucuuaacugcugaaccaucugucuccagccucuagguuucaaugguguguguguguguguguguguguguguguguguguacagauagaggucagauguucguguugaguguauucuucaacugccucuaguuucaagacaguaucucacuggcccuggaaaaaugauuuugcucagcggaccagcuccuaaguccuggugaucuuaccuugccuaccagcacugggguuuagggugugggaguaaagaugugccucacgucucaggacuggagacagaauaacuaacauaaagcagccugggaaacaggcagaaaggccuggcuggcccuaugauuuggcacaaccaauguuuuuagagucucugaucuauauuuaaaaaaaaaaaaaauccugcccuuuuuuccccugauauuccagagaguuucagucuuucccguuguuuuucuaccauugucuccaccccaaacccuguauccuccuggggcuggagaacccucucugauuuccugauacauuggcucaguugcauagcuacuaaugucucaacucuaaaguaaacuggaagcgccuaaguacauuuuauacagaaaauagaccacagugacuuacagauacaucugacuuuacuuggguacaagggaucaaacucaggucuuaaugcugagaacagaacaagcacuucucagaguccuuucuccagccccuggccugaauuuacuguaaacugguuauuagaucuagagguucaauugcuguuuuguuuaugcggaaguuaguacaguccagaauggccucgaacucccaaauugccugcccuagucuccuaaauguauuauacacauauggguguacucaguagcuuacugagaccagagaauugaguacucaguagcuuacugagaccagagaauugaaacaagguuucaaauggccccagaauggccuggaacucauuuuguagcaguggggugaccuugauuuuuuuuuuuuuuucuccuuagguuuuucucuuuaacccuaguuguccuggaauucuguagaucaggguggccuugaacucagagaucugccuuuuucugccuccugagugccgggauuaaaggcugguuccaucuaaguccagcaaccuugaauucuugaucauucuaucccugccuccugaauguuggaguuauuggcaugcaccgcacccaguuuuaugagguaccggggaucaaacacaaagccucaggguagacaagcauuuuaccaacuaaucuauaaccucaggcaugcugauagcuuuuuuaaacuuuaacaccaagacuggcagcuccccauugcaauaaugcuuaagcuggaugaaugggcagucgaguguugucacaugccuuuaauuccagcacuuuggcgacaggcaggagguucaguucuuaaguuagcuuaggcucucuagagagauugucucggaaauauaaacggguguaauuugagcgcauuggaauaaaguugucuaauuuugcaaauugagugugugugugagguguaucuuuuacagacacuugagaucugcuuugucuguagacccaggauaaacaaugaacuuauaaaagggcuuguucagguuuucuggcagugggugaugugccuugggguggcagaacuucauucucaaugacccaguugaacaccuaugaagugugaaggaacugaggacagagcaaagaggcaagcagaagugugcuccucacccagcugauucaacuagcaggacuaauugaaacugauccacucuggaccgagaguuggcgugagucagcaaaacgccaaaggugggcgagcagcagcaugcgccugcggggaagguauccaagcuguaaagcgacccccucccacguuagcccgugucuaggcauuucuccccucgcaacaccucccgugcuccccacuacgauaagccucgggcgauccugccacgccccucgauacaaccuccacuuuccagaaggcagcgaaaacccgcacaggugguagacguagacgggaaacuggaaccgcgca

SEQ ID NO: 8160 - RNA, 5298 nt, Mus musculus
guaugcugcacaaagguggacuuggcaagguuuauucuaagaacacagaguccguuccacccaugaugcugagcacguccuagaaggaagggguggguuucagugaguuuuccugcuuggcugaaugcucuuagggaaggacucgggggacagccagagcugcagcaggacgacagcguggcacagguggagggcggcagagcugaaggacguggauggguacguauuccaggagagcucaaugagucccagcaccagcaaccugggaaugagaaacgggucccagccauuucaaggucagcacgcccuacgccauccacccauccaccccaugcccuucugugguuucagcugugaggagaccccgagcccuucuccaacccuuccagguugucccagcuaguaccugagcaggugugugagccagcgugcaggcauggcccacaggagguagggcaguguguggaaauaccagacauaaaacugguaguggagcgagcggcuaaagcagaugccaaugaaguuggaggugaagaggauggaaacaaucugugaugugaugguuaaggcuuuggguagaaauggagggcaguaggggugggguggggguaaggguuuaaaguucugggguaagagcacccuauucugccuuccaugcacgcuucagauaagcuuucuagccucucuggaucugguccucgguuuaguagggagagagggaugcaugagacuguaaagccugaggagucugaaucccuuacauucuaaccuuaauccuuccuucuguaaaauuaauaugcguacuuccccugacucagguggacuuugcaugggagggaauguggacucuuaggacgauaccaagagugcacgguuuuacaaugcuggacuuacgguuaagcugggcugagauguguagggugcucagugcaguguuugcugcagaggacaggaccuaugacugggcucgggccucuuccugugguagcuugcuaucucaggccaacagacuaagacucuaucugcacuuggagagaucaaaacuugucuuuccgugauuuaaaggauaugguuaggugugagggcuugggguggaacuuuccuuuuggaaggauccuucagcagugccagaauacuuuccccuguucugaagagaagucauucggacauuuaucaaggccccguugugugccaaauccuagauuagccaccaugaacuuaacacuuccuccaagcagcuccgaagagcugagcucuccacuccgucccaugaaccuucccaugauauuaacccuguuucuuaccugugccaccuacagagggcaaacagcaagaggaggcuaaggugggcagccaacagggcuagauggaaggcacgaugcaggaagaugguuucaggcaggaagcgccaguuuacuguccauuggaaaagaaacugacgaccaaggucaaaggagcgggauagguagccaaugggguucuccagcaggaagggcaaucccagcaccaccugggaaugggugaagccagcagagcugcuuaggcuugccacagccuucaggguagucacuuaggagagcauagugagagaggaagccucaaaagcuccuuuauuuccacaaggaguagccggaaagccuccccacucucacccccugcuagagccugacaccacagaggcacaggaggggguugaucacacugccuuucucaagaguucgccaaaucgugggcggcucaguuguuaagagcauucguugcucuuccggaggugcugaguuuaacccccagcaaccacaugguagcucauggcuaucuguaauggggucugaucuuuuucugucaugcaggcacacaugcaaauugagcucucauucacauaaacaaacaaacaaacaaacaaaccuuuaaaaaaaucuugaaaaaauuuucaccugauuguguguguguguuugaagggggaaggagguauuuagagagagagucucacuauguaguccuggcuggccuggcauuuguuauguagaccagggugcccugaacucagagaccucccaagugcuaggguuaaagauguguaccaccaugccuagcuaguugaucaggucuuaagcaagcagcuuuaggaaggcucugagaggccugccaaguucaguagccgugggaucuaaaguggcugcccagugaaagcaacaacuccaaacucuugucuguuggcuuuugagaaagcccuaagagauuuaaggagauccgucucuucgguaaggggaggcccuuucucaccaguaagggcaggauagacaguuaccugaagagcagcacagauggccagcuuggggagggcaccacggaagccaaacugaguaagaagaaggaauagcaaucccggggcgaagagcagcacauucaucuucaccgagacagccaggcugaaauggacaaaggacaggaaaaguccagggucagcuccaggacugggugccccuuggaacgacaccccaccucccccacagaucuucuccucagguuauuaagugccaggauguggucucuauccagaacuguuagaggagcacagauggccugagaggaggcugggaagaagggaauaauaccugucccucuguccagacuaaauggacauguacagauugacauacuuaagggccaaccccaacauggaugccaucugggauaaacauaggaagaaagcaugaggaaaggaacuuucuacagacccuugacuuguucagggcggccagagugaccuacaguaacuaaccacucucuuuuuucccccuaagucaggguuucucuguguagcccuggcuguccuggaacucacucuguagacaaggcuggccuugaacucagaaauccgcuugccucugccucccaagugcugggauuaaaggcaugcgccaccacugccuggcuaucuaaccacucuugauguccucuccugcagaacauugggaagauauggaaaugugacuggggggugggggggcagaaggaaaaggcucugaccugaaacagcagcagccccagcuccagcacugugccaggaaaagguugaugcucaggaagagcaaggccauagcuacugggucauugaagagccgcaguacaaagauggaauggacacgguaagaggcacaacacaugaagaaaaagacgaagggagguaccuaaagggugggcaccaacgucagcuccccaaaccugagccacccccaccacccacuucaggccagggccaguugguccuguggcaucaacucaccuuggaggucuggugguauaucaagaaaacaagcaccaaggugacaagguagaguacagcaaagauguucugggccauagggauaucagugccccggucaguagcauagaauagccccguaaagauguacaaaaacccagcuggguagcuggaagaugaaaggaaauaugagccuagggcaggacuaucagccugguacccacccagcccuucacaaugccuucagacuuccuauccucacucacacaagagguccggugucacccugcagcuguguguagucauaugugccauugaugaaacccuccaccugggccauguaggccuuccagucaaucucugugucuggaagaagauaacauggucucguuccuucugaguccagaacuugccuacuucuaaaccccaugccuucagaccaccaaagcccagagauucuaccucauucccagguuucucccauuaucgucccugauguaaccacaccuacggcauucucugggugaacccauauauuucgucuguguguuaugugugcaugcauaugaaggucaggaguugacacuggugucuuccucugucauuuauauaacagagucuagcuagucaguuugcuucaaggaucccuuguccugccucuccagugccgugaucauagaugggucaccaugccugccuggcauuuaugccuaaugcuaggaaugugaacuaugggucucacauuugcaugguaaauaccacgugcuaagcuaucuccuuaggcccaugaaugugggugucuuaaacucaaauguguaaaacugauuuuaugaucuuucuuccuacuccaaauuuacucuuuccuguauucuucaaguaguacuucucuccuuuucaguuuguguguguguguguguguguguguguguguguguuuacaagacaggguuucucuguauagcucuggcuaucuggcuguccuggaacucuguagacuaggcuggccuuaaacucacagagauccacuugcuucugucucccaagugcugggauaaaggcgugugccaccaccacccagcuucuuaguucuugaaacagucuuguucucuuucucugucuuguguguguucauaugcacauguguggauucacacauaagugaguguacaugcaugugaguaugaguguggagguuagagguuaauggugauucucuuucuggaauguuccucacucucauuuuaagaacagggucuuuauaagccaguugugaugguguccaccuuuaaucucaacaacacucaggagccagaagaaggcagauuucugugagcuugaggccacuguggucuacauagcaaagccaaucagggcuacuuagugagacucuguuuuguuuuguuuuuuuaaaaaaagacugauccuggaagacaccaguaccuaauggacuuaaaaggucacaaaaugcacucuuuaaaaggacuuucaagaccuaagaauuaaaagcaugaaaaaucagaucugcggugggaagugacugucuaaggcuacagacaagcaucaggaacagcagcagcaacagcacauuaauucuggccagaacuucguggcugcuuaugcuuucuuagcaggcugaauguuaaacgcaggagguaaucucuggguaaccucccucccauaugggagagagauuaugaucgcuguucuggaaaaugggcuugggucagguaaaggauauggguuugaucggugaaugaaagcucuguaaucuaguuuggguaucccucccucccuccgguucucuccccuucagugaacucacaugccacccugugaaugacccagaaggugaugcccaccucugcuaugcagaggcaggaggccaccagcaauguguagcgcgguucccgcagcaguagguagcguucuugccaggcacgcuguagccauuguuuccagauuccugccggcuggccgacagaagccggcuggccgcguuuccgcagcccagcagccaucuugacagugcacca

SEQ ID NO: 8161 - RNA, 5298 nt, Mus musculus
uggugcacugucaagauggcugcugggcugcggaaacgcggccagccggcuucugucggccagccggcaggaaucuggaaacaauggcuacagcgugccuggcaagaacgcuaccuacugcugcgggaaccgcgcuacacauugcugguggccuccugccucugcauagcagaggugggcaucaccuucugggucauucacaggguggcaugugaguucacugaaggggagagaaccggagggagggagggauacccaaacuagauuacagagcuuucauucaccgaucaaacccauauccuuuaccugacccaagcccauuuuccagaacagcgaucauaaucucucucccauaugggagggagguuacccagagauuaccuccugcguuuaacauucagccugcuaagaaagcauaagcagccacgaaguucuggccagaauuaaugugcuguugcugcugcuguuccugaugcuugucuguagccuuagacagucacuucccaccgcagaucugauuuuucaugcuuuuaauucuuaggucuugaaaguccuuuuaaagagugcauuuugugaccuuuuaaguccauuagguacuggugucuuccaggaucagucuuuuuuuaaaaaaacaaaacaaaacagagucucacuaaguagcccugauuggcuuugcuauguagaccacaguggccucaagcucacagaaaucugccuucuucuggcuccugaguguuguugagauuaaagguggacaccaucacaacuggcuuauaaagacccuguucuuaaaaugagagugaggaacauuccagaaagagaaucaccauuaaccucuaaccuccacacucauacucacaugcauguacacucacuuaugugugaauccacacaugugcauaugaacacacacaagacagagaaagagaacaagacuguuucaagaacuaagaagcuggguggugguggcacacgccuuuaucccagcacuugggagacagaagcaaguggaucucugugaguuuaaggccagccuagucuacagaguuccaggacagccagauagccagagcuauacagagaaacccugucuuguaaacacacacacacacacacacacacacacacacacaaacugaaaaggagagaaguacuacuugaagaauacaggaaagaguaaauuuggaguaggaagaaagaucauaaaaucaguuuuacacauuugaguuuaagacacccacauucaugggccuaaggagauagcuuagcacgugguauuuaccaugcaaaugugagacccauaguucacauuccuagcauuaggcauaaaugccaggcaggcauggugacccaucuaugaucacggcacuggagaggcaggacaagggauccuugaagcaaacugacuagcuagacucuguuauauaaaugacagaggaagacaccagugucaacuccugaccuucauaugcaugcacacauaacacacagacgaaauauauggguucacccagagaaugccguaggugugguuacaucagggacgauaaugggagaaaccugggaaugagguagaaucucugggcuuugguggucugaaggcaugggguuuagaaguaggcaaguucuggacucagaaggaacgagaccauguuaucuucuuccagacacagagauugacuggaaggccuacauggcccagguggaggguuucaucaauggcacauaugacuacacacagcugcagggugacaccggaccucuugugugagugaggauaggaagucugaaggcauugugaagggcuggguggguaccaggcugauaguccugcccuaggcucauauuuccuuucaucuuccagcuacccagcuggguuuuuguacaucuuuacggggcuauucuaugcuacugaccggggcacugauaucccuauggcccagaacaucuuugcuguacucuaccuugucaccuuggugcuuguuuucuugauauaccaccagaccuccaaggugaguugaugccacaggaccaacuggcccuggccugaagugggugguggggguggcucagguuuggggagcugacguuggugcccacccuuuagguaccucccuucgucuuuuucuucauguguugugccucuuaccguguccauuccaucuuuguacugcggcucuucaaugacccaguagcuauggccuugcucuuccugagcaucaaccuuuuccuggcacagugcuggagcuggggcugcugcuguuucaggucagagccuuuuccuucugcccccccaccccccagucacauuuccauaucuucccaauguucugcaggagaggacaucaagagugguuagauagccaggcagugguggcgcaugccuuuaaucccagcacuugggaggcagaggcaagcggauuucugaguucaaggccagccuugucuacagagugaguuccaggacagccagggcuacacagagaaacccugacuuagggggaaaaaagagagugguuaguuacuguaggucacucuggccgcccugaacaagucaagggucuguagaaaguuccuuuccucaugcuuucuuccuauguuuaucccagauggcauccauguugggguuggcccuuaaguaugucaaucuguacauguccauuuagucuggacagagggacagguauuauucccuucuucccagccuccucucaggccaucugugcuccucuaacaguucuggauagagaccacauccuggcacuuaauaaccugaggagaagaucugugggggagguggggugucguuccaaggggcacccaguccuggagcugacccuggacuuuuccuguccuuuguccauuucagccuggcugucucggugaagaugaaugugcugcucuucgccccgggauugcuauuccuucuucuuacucaguuuggcuuccguggugcccuccccaagcuggccaucugugcugcucuucagguaacugucuauccugcccuuacuggugagaaagggccuccccuuaccgaagagacggaucuccuuaaaucucuuagggcuuucucaaaagccaacagacaagaguuuggaguuguugcuuucacugggcagccacuuuagaucccacggcuacugaacuuggcaggccucucagagccuuccuaaagcugcuugcuuaagaccugaucaacuagcuaggcauggugguacacaucuuuaacccuagcacuugggaggucucugaguucagggcacccuggucuacauaacaaaugccaggccagccaggacuacauagugagacucucucucuaaauaccuccuucccccuucaaacacacacacacaaucaggugaaaauuuuuucaagauuuuuuuaaagguuuguuuguuuguuuguuuguuuaugugaaugagagcucaauuugcaugugugccugcaugacagaaaaagaucagaccccauuacagauagccaugagcuaccaugugguugcuggggguuaaacucagcaccuccggaagagcaacgaaugcucuuaacaacugagccgcccacgauuuggcgaacucuugagaaaggcagugugaucaacccccuccugugccucuguggugucaggcucuagcagggggugagaguggggaggcuuuccggcuacuccuuguggaaauaaaggagcuuuugaggcuuccucucucacuaugcucuccuaagugacuacccugaaggcuguggcaagccuaagcagcucugcuggcuucacccauucccagguggugcugggauugcccuuccugcuggagaaccccauuggcuaccuaucccgcuccuuugaccuuggucgucaguuucuuuuccaauggacaguaaacuggcgcuuccugccugaaaccaucuuccugcaucgugccuuccaucuagcccuguuggcugcccaccuuagccuccucuugcuguuugcccucuguagguggcacagguaagaaacaggguuaauaucaugggaagguucaugggacggaguggagagcucagcucuucggagcugcuuggaggaaguguuaaguucaugguggcuaaucuaggauuuggcacacaacggggccuugauaaauguccgaaugacuucucuucagaacaggggaaaguauucuggcacugcugaaggauccuuccaaaaggaaaguuccaccccaagcccucacaccuaaccauauccuuuaaaucacggaaagacaaguuuugaucucuccaagugcagauagagucuuagucuguuggccugagauagcaagcuaccacaggaagaggcccgagcccagucauagguccuguccucugcagcaaacacugcacugagcacccuacacaucucagcccagcuuaaccguaaguccagcauuguaaaaccgugcacucuugguaucguccuaagaguccacauucccucccaugcaaaguccaccugagucaggggaaguacgcauauuaauuuuacagaaggaaggauuaagguuagaauguaagggauucagacuccucaggcuuuacagucucaugcaucccucucucccuacuaaaccgaggaccagauccagagaggcuagaaagcuuaucugaagcgugcauggaaggcagaauagggugcucuuaccccagaacuuuaaacccuuacccccaccccaccccuacugcccuccauuucuacccaaagccuuaaccaucacaucacagauuguuuccauccucuucaccuccaacuucauuggcaucugcuuuagccgcucgcuccacuaccaguuuuaugucugguauuuccacacacugcccuaccuccugugggccaugccugcacgcuggcucacacaccugcucagguacuagcugggacaaccuggaaggguuggagaagggcucggggucuccucacagcugaaaccacagaagggcaugggguggauggguggauggcguagggcgugcugaccuugaaauggcugggacccguuucucauucccagguugcuggugcugggacucauugagcucuccuggaauacguacccauccacguccuucagcucugccgcccuccaccugugccacgcugucguccugcugcagcucuggcugucccccgaguccuucccuaagagcauucagccaagcaggaaaacucacugaaacccaccccuuccuucuaggacgugcucagcaucauggguggaacggacucuguguucuuagaauaaaccuugccaaguccaccuuugugcagcauac

SEQ ID NO: 8162 - RNA, 2075 nt, Mus musculus
  misc_feature (1316)..(1316): n is a, c, g, or u
uccuuccgccggcuccccugcugagcuagggccgguccggcagcuagccucugcccgugccccgccgcagucccuagcccgcccggugcccgccauguccgagauccuacccuacggugaggacaagaugggccgcuucggcgcagaccccgaagguuccgaccucucuuucagcugccgccugcaggacaccaacuccuucuucgcuggcaaccaggccaagcggccccccaagcugggccagaucggccgagccaagagagguacgcggcccgggcccggagucgccgccugacccagaaacccuucgccuggcguccccaggcugccguuccccgucaaguggcagcugcucuugccgcagaccagcgcagccagcugcguacccgcccgggguggggagggucccugcuguggaguugucccauucuuucccucucccgggaauacugugucccggauucgaagcucuccacuucuggaaaaagagccccggcuccuggucaagggggaggggccgcuuaggguauuuggggcugcuuggcacugggaacacaagguggugggccaauuccuugggcugagaugaguagguggauguuacuggagggcaccgaggccagggguucggucgucuugauuguuuguauugggaggggacucaggaaggcacuaucaaaacagggauucagguagaggaaaggguuacaccaggugacaguuucaucugagcucaguucgaggaggggguugugucgaaggcagagguuucuggucggcuuagauggaggaaggcucaggugacgggaggguucgcauugggagucuucggaagagggguguucccacauagggagguuugggugccaggcuugguagcagguaggguccgcgggagaguucggguagggagggcauaggguuuugagccgugucgcggaaacacaggcaguagaguagaucugcgcggggcuugaggacaccggccccacugucgccgccgccccccgagaccgcgcggcugaugcgcuuucucccugcgcaguggugaucgaggaugaccggauagacgacgugcugaaggggaugggggagaagccuccguccggaguguagacgcgccggcucuggcggcgggcuccgggcccagccccgcagcggccaggagcacgggccggcgaugcggcugccggcgcacccccgcccggggccgaggugccuacgggcgggggcugcagggccacgccgccacggggucaguguugcuaccgccgcugccaggcgcuccggagcuguccgcuucagcaccacgccgncgccgguagugguggugcggaccagcccggagcccgccgacgcacucaugcacuuuagaaccucgggccgcagcuccaccccgcacaccggaaccgacacagagacccacggcccccagcccgcccccucccgcacggcuccccugccccgccccuccuccgaucaaucuggucugcagcccgggcagcugcggcgucggacugcgcggccagggagguuuggcugcauauuugcaugagcuuccuacccaccucagccuagcccuccgggcaauuccucaacuguaccccugucuggcgugaccccagccucuuucuaagggacuuccucagcacauuuguauuuuuauauccgauucuuuguuuacuggcuccgcucaugguuugugcccuucccccacagccuccgccaugcucuucugcgccuggcagauagaacagguguugagacugggaugggacaagcccccaacaugguaacuaaccacauggccagucugcccaauucugaccccaggaggcucacugggagacuccucccucccaagguaucaucuuuuaagggcccagaucugauuuuaccuuggaccccuucaugcuaccccugggaacccaaauggggacugcucaguaccuuuggaugacaccuguggaccggaagauguucucaacccaggguuguccuuuguaaaaauguuucuccauccucaauguaacaggagugugugaauaaacacagaccuccgugugugagugugu

SEQ ID NO: 8163 - RNA, 951 nt, Mus musculus
acauuuuuccaaguuuuuauuucaaaacaauguauuccuacaaaauaacuugaaauauaucccaacagcuuuucauauccucuucaucuggacucaucagcuucuugauaaaccuuuuagggcacaauuuccaauucaucuccaacauacuaauugguaugugacuguugauuauauauauauauauauauacauauacacacauauauacauauacacacauauguauacaugaaauauacauacuaaauauuuauauaccauacauaugguaugugccugauauauguaugcauguauguacguauguauguauucuuaucugugauagaagucauagaaacagaaaccgguagacauuuccuacagaggacuauacggcuauagaacaggcagagcagcaaugggcuguucaaucucucuccaaaggcugaagaagucauuggcaguggaaauggaugguuaugccuagaauccaagaucuacacgcaucagcagcucaugucuguaaugaaguuauucucugcuagaaaguaaguucgaggcuaaccugggauaauaaauaaguaaauuucaucuucacuuugggggaaaugguuugcgguuacuauuccacaguaguaguggcauaauuacaccgaagucacacagacucggucaagacuugaagaguuuugagcucauagaaaucuccuacagaggacuaaagcaagcaugaacauguauggacguccugucuucaggaugaccuucucaucguaccaugcauccaguuguggugaagcuacaggaucggagagcuaggcaucucugcagucagaccacccuugcacgcacagagacacccuaacucaacaguagccguucgggcuggaagccggaacaguaauucccguccugcuccagagggcgggacucgggauccgcagggcgcuuccggucuggaggaca

SEQ ID NO: 8164 - RNA, 11767 nt, Mus musculus
uggccuucugggaaaaggggcggugcgagcaggugcgcgcgcagcaggccggcaguaguggcggagauggaggaggguggacgagacaagacacccgugcagucccaacagcccuccgcgacaacccccagcggcgcggacgagaagucgaguggcaaggagcgaagggaugccggggaaaaagacaaagagcaggagcuggugaggcgcagccuggggagcccgaggaggaggccuugggcugagucacugcuggcucgaaggccucgggcccgacuccguacugcccaccgcaccggggagacucaggauggggcgacccuuucuuuauacccugcccgccccauuacgcacugucacucccugaggcccucaccaucacaucgcgguucuuugguuauuuccuagaauggcuuccaagcagagucugccugguuccuaagguagacagccuuuccuauagggcugcuucccuaucccacgcccucuucuuguccauagacauucacacucuucaccugucccgggguaagugggaggagaaugugauucggguccccacuuuugaugagcuucuuccccuaacccuccagucugaggaggacaaacagcuucaagaugaacuggagaugcucguggagcgacucggggugagucaagauguuacuacagggggaguauaguugauguuucucauuuguuuacucuauuucauuuugaggcaacaauuagauaccacauauuagauauuacgauaauuugagggaagaguuacaaaggguauuuaaauggggucaugggucucaggucauuuacagggguugaggcaucaugaaauaggagccaguuaugucuuugaccaaagcauugguuaaguauguaugggucgugauguggagaaaugugacuccuuuuggucugagcauuaacauccccuauuaggagaaagauacaucucuauaucgaccagcucuggaggaacugagaagacaaauucguucuucuacaacuuccaugacuucaguacccaagccucucaaauuucugcguccacacuauggcaaauugaaggaaaucuaugagaacauggccccuggggagaauaagguaauucagaauauggcugggaccuguccaguugaauaauuccuuuuuuaaugcuaagucacugaaagccuaguggaccccaucuagcuggaaaguucaucacagugagacugauucuccaguggaaagccugagaaugcuucucagcuccuuagaaguuucugcuucauuauaucuuaagauuuucuuagcacgauguguuucugacuuaauuuaaaauuuuuauagugugugcauauaugugugugccugaaugcaugugcuuguaugcaugugcauaugcauaagugucacgccuaugcaugccuaaagacccucggucuuuauaguugguuuugggaugucuuuuugauuuugguuuuuggagguuuuugggaugucuuaauaggugcugggauuugaacucugaucuucaugagcgugcaggaaguccuccuaaguguugauccuuuucuccagccccucuagcugaccucaaacucggcuguguggccuagacggaacuuuauuuuaugaccuuccuccuccuccugccucuaucuggagugcugggguuagaggcauaagccaguaugccuggcuuucuaaggcuuauauuuaaugucccuucucucucuucugucccauguacauucaucccuuuuaugucuuuuuuuuuuaagauuuauuuauuauuauaucuaaguacacuguagcugucuccagaugcaccagaagagggcgucagaucucauuacggaugguugugagccccuuuuaugucuuaaaaacccucaguugagucacauuuguccuguuggugcaacugugacccagaagucuuuacuuugcaguguauuuugaguagccuccuaauuggcuugcuuuuguccuugacucccacaucaucugccuaucauacugcaguuacagugaucuuucuagaucauuuaauuuauaguuauuuagguagaauauuuaaauuauaaauaaauaauaguagauaaaaguaauauuuuuuuaauaaaauuaaaauucaguuuuguauuuauguggaugaauguuuugccuccguaccuguauguauguauguauguguauccugugcgugugaugucugcacaggccagaggcugggaacauguucccuggaacuggaguuaggcuguugugaacaccacguggguacugggaacugaagucaggucaucugcaagagcagcauguuuuuguaacuguugagccuguuuuucagaccccuagauuaugcugcuauuauuauuaccaccuuuuaguaguuuauuauugcaauuaaaauuuaugcugggugggucuagaauguugaggccaaacuaggcaauaugauguaaugagacugugguguaaugggaaacacacuacaacccaaacccagaugcaucuggcuuuuuuuuuuuuuuuuuuuuuuuuuuugguuuuucgagacagaguuucucuguauaacucuggcuguccuagaacucaucuguagaccaggcuggccucggacucagaaauccaccugccucugccucccgagugcugggauuaaaggcgugcgccaccacugcccggcagaagcaucuuucuuugauucccccauuguuuauuacucuugaguuagguuagcuucagagggagcuagcaacaccaacuuuaggguuuuuuuuuuuuuuuuuuuuugaggcuuagcauggaacuuuucuguauagagacuaguauauauugaauuuuauaggugaauuuuguggacaguaaucuugauucuguaauggcacaugcuguuuuccuaguguuuugcagcugacaucaucucuguuuuggccaugaccaugaguggugagcgggagugccucaaguaucggcucgugggcucccaggaagaacuggcgucauggggccaugaauacgucagguaaggcauuuucuuuauggacaugagaagggacuuggggucauuauucuguuuguuugggaaacugaauguauugaaucccccagacacugaauuccuugacucccagcaacaugcuucccuaaugagcaagucuaucuauccauagacaucuggcaggagagguggccaaggaguggcaggagcuggaugaugcagagaaagcacagcgggaaccacugcuuaccuugguaaaggaaaucguccccuacaacauggcucacaaugcagagcacgaggcuugugaccugcucauggaaauugagcagguggacaugcuagagaaggacauugaugagaacgccuacgccaaggucugccucuaucucaccaggugagugaguacaggagagcagguagcacucgucuuccagggagucuuaggguuccucuugaaggaagagacuuugugacuccuuaguaauccuagaacaugcuacauugccuucuguauaguaggcauucaguguguauacuugggaagggauuuaaauaaguuacaugaguugcacguccugaaauuguacuacuuuugacuuuguaguugugugaauuauguaccagaaccugagaacucugcccuccugcgcugcgccuugggcguguuccgaaaguuuagccguuucccugaagcucugagauuggcacugaugcucaaugacauggaacugguagaagacauuuucacuuccugcaaagauguguauguagagaaauuggcaaaaggaaagaugagucuguguaugugcuuuguguaaaaaucagagacguagcaguuucugaugcgacacagaggcuuuucugucucauaguggcuaagagugagcaggugugaccgcuucccccacagggugguccagaagcagauggcauucaugcugggucggcauggaguguuccuggagcugagugaagauguagaggaauaugaagaccucacagaaaucauguccaauguccagcucaacagcaacuucuuggcuuuagcucgggaggugagggucuccucuugguccugaaggguuuuggccgaaguucugucauucuaccucccugacuaauaccuuucaauagacucccugguuaaaguugcuauucagugggagaacagaagggacagcuagguaggggaguacuggggaagcaguugugacccucuggcuuuuuuucagcuggacaucauggagcccaaggugccugaugacaucuacaaaacccaccuagagaauaacagugaguagcucugugggcauuggagggacuguuaauuguucuaauuguauugggaauaacagcuuagacaacccauuucuaaagcacuucaaauucuuauggagacauagauuaauuuaaaguuggagacugggcuagcaagauggcucagugguuaagagcgccgacugcucuuccaaagaucccgaguucaaauuccagcaaccacaugguggcucacaaccauccguaacgaaaucugaugcccucuuuuggaguaucugaggacagcuacaguauacuuauauauaauaaauaaauaaaucuuuuuuuuuuuuaauuaaaaaaaauaaaaauaaagucagagacugaccugggugguagagggcacacccuuuugaucccaacacuuggcagaggcagaggcgaguagaucuuuaaauuugaggccagccuggucuacaaagcaaguucuaguacagcuagggcuacacagaaaaacccuaucuuaaaaacaaaaaacaauuuuuuaaaauuuuauuuuauuuuuuaaaucagagacuuucucccaugcuguguuccuuucauguccuagcucaacugccuucccucucuuauacaggguuugguggcaguggcucucaaguggauucugcacgaaugaaccuagccuccucuuuuguaaauggcuuugugaaugcagccuuuggucaagauaaacuacugacugaugauggcaacaaauggcuuuacaagaacaaggaccaugguauaguuucauucgcccucccuuccucccuccccaccccccucuuuuucuuuccuuguuuauuugucauauagucagauguuaccugagaggcauccacaguacaguuuccagaggagcccuuuauaaguuucuuugggguggacccuucuaaagcugacagucuuccuugucguagggaugcuaagugcugcugcgucucuuggcaugauucugcugugggauguggaugguggccucacccagauugacaaguaucuguacuccucugaggacuacaucaagguuagucugggcaaagcuuauucaucggggacuuuuucuucucauguccuaguaccuccuuuuuauuaaugaggugucuuaguuacuuucuguugcugugaagaggcaccgugacaaggcagcuuaaacaaaaauuauuuaauuugaggcuucuauacagcuucaggggguaguccaugaccaucaugguggggaacauggcagcaggcaggcauggugcuggagcaaaaccugagagcuccaaucugcaaguuagaggcagagacagagacugggccucaaagcccaccccuaaugacacacuuucuccaauaaggccuaaucuccuaaucauacacagaaggaccaagaauucaaauauaugugcuuaugggaaccguucucauucaaaccaucacaggaggcaugcccaguuucuuacuccagauacagugccacagaaaggcccauaguguacuugguaguuaagaggguagguagcuuaaagagccugcuugcucuuugcagucaggagcucuccuugccugugguaucgugaauucuggaguccggaaugagugugauccugcccuggcacugcuuucagacuauguucuccauaacagcaauaccaugagacuuggcuccaucuuuggguaaggcuucccacuguucuuuguuuguugauuuuguuuuuuucugagacaagguuuuucuguguagccuuggcuguuuuagaccucacucuauagaccgggucucugaccuagaacucagagauuggcccacugcccuguuugcuuauuuauuuauuuuuaaaaucuuauuuucuccgagauugcuucucuuuuuguuaauaccuaucuuauaaacucuggaguagauauugccaaagacugucaugugcuguugaguaaucuggcuccuggugaauguguuagugacucguucuguuuuuguucuuccuuucuugcuguguuccugaguauaugugggggacuuuaucuucugacuuuuuaggcuagguuuggccuaugcuggcucuaaucgggaagauguucuaacacugcugcuaccuguaaugggagauuccaaguccagcauggaggugaguuguugaugucuaauggaaaagguaggggugguguguugggguugugggacuccucaauaaaaucucuuagacuuucaauuucaagcugugugugauggcucaugucuguaaucucagugcuugagggacugaggcaggaaaaauuucaugaguuccagccuaggcuacagaacagucccuuuacucucaccuuucccaucccccuaccaaagaagggacaggaggagacaggcuggaauuugaagcuuaguguuguacugcugaguucuucuagacucugaaaccccagucuagccccuuagacuguaaggaggaaaccugauggaggugaggacuaacagcuaagaaaggggcacguccugguggaagcacauggaaaggcacaaacuccaccuuagcagcaagcaaggaagcaaagaggaggaggaccaggguaccacuauucccacccuucucucccgccuuagaucuugccccacuguccuuuucucuccuuuuuuuuuuuuuuuuuuuuuugguuuuuucgagacaggguuucucuguguagcccuggcuguccuggaacucacuuuguagaccaggcuggccuugaacucagaaauacgccugccucugccuccuaagugcugggguuaaaggcgugugccaccgacgccuggcucccacuguccuuuucaagguaacuccccucauguuuucaaaugcuuccuaaugggcccaccccuuaguuuccaccccuucccaagauucccaagagccaccaucuuacacacgguuuggggacauucuagauagaagcuacagcaaugauucugacuuuuuagucauuagcuaaucuuacguuuucuugcuuaugcagagucugauuuaauugccaaaagcuauaaggacuguuuaggagcacgcaaagccaggacuguugagguugcaaucaagccuccaugcuggcaggacagaguccuuuaccuuuaccugugugcuguguguguuugcgugcuaaauaaguaauguaauaacacuuuaaaagaguaugcaaauugguuagcacagugccugacauaugcaaguacucacugauuuuacagaaauuaauugccuguaaggaaguauaacuuacagugcaucagaagaauuagguuuaugaaugaaguuaccuaaguaagcauuuuaauaucuuaaccgugguuggguaugguggcacacacuuugaauccagcacccaaaagcaaagguaggcagaucucugauuuccaggcuaaucuagacuacauagugagagccugucucaaacagaaaggaaaaugucaguguguguaauguugacuuucuuauuucuagguggcaggugugacggcucuagcuugugggaugauagcagugggguccugcaauggagaugucacuuccaccauccuucagaccaucauggagaaaucugagacugagcucaaggauaccuaugcucguuggcuuccucuuggccugggccucaaucacuugggugagaaauguuuaucaaaggccugacagaauuggauacaauuggaggguuuacguaucaugcugagcuggauacaagccaauguccuuugacucuuuacucucuauuagggaaaggcgaagcuauugaggccauccuggcugccuuggagguggugucagagccauuccgcaguuuugccaauacccugguggauguaugugccuaugcaggucugugccuuacuauccagcaacucuacuucucuguugguucuuuuuuucucagguuguuucuuuuuugucuuucauucugcucuucggaguuuuaaggcuucuuguauuuacagaguaaguuuuuucuugaugcuuucucguuuucuuuccuugcucucgcugucccacugcaggcucugggaaugugcugaagguucagcagcuccuccacaucuguagugagcacuuugacucuaaggaaaaggaggaagacaaagacaagaaggaaaagaaggacaaggacaagaaggaagccccugcugacaugggagcacaucaggugugggccagcaggcacucugaaaaagauagcauguugauaugagaggcagaacaaaguugagcuuuguuuuuggccucugcuccuccccugaguacugcuacaaguuagaauagcaggacugaguuuuguccaugagggacaaggaguucccugcaggauagcucuucuuagaugagccuugggugacucgguuuuuguucuggagcuuacuguaguuuugugccucuugaauugcagggaguagcuguucugggcauugcacuuauugcuaugggggaagagauuggugcagagauggcauugcgaacuuuuggucacuuggugaguagcccagaguagacuggaauauggggguaguaggugcuggggguuaaaccuagggccuuaugcauacauggaagugauucaccaccacacuacacuuuaguccugccuaauucugguuuugguggcuauuauuugccauacgugcuuguguguaaaugcauagaggugucagucuucaccuucugccuucucugaaacagggucucugucuuaaucaacacucuugcugugaagaaacaccaugaccaaagcaacacuuuuuuauuuauuuuauguaugaguacacucacugaagacagugacagugucuggugagaagagggcauuugaucccauuauagauaguugugagccaccaugugguugcugggaauugaacucaggaagaagagucugugcucuuaaccauggagccaucucucucuccauaaggcagcucuuaugaaggagaacauguaauuggggcuggcuuacaguucagagguuuaguccguugucaugggagaaaguaugaugacaugcagacagacauggugcuagagcagugguucucaaccuuccuacugcucucacccuuucauacaguuucucaugcuguggugacuucuaacuauaaaaugauuuucauugcuacuucauaacuauaauuuugcuacuguucugaauuauaauauaaaugucuaauguuuucugauggccuuaggggacuccuaugaaaggguuuuucaacucccagaaaggguugagacccaaagguugagaaccacuaugcuagccaacugacaguucuguguccagaccugcgggaagcagucaggcaguaggccuagguuuggcuucugauacuccaaagcccaucccuagugacacacuuccuucaacaaggccauaccucaacauccuuuucaaauaaugccauucccuaauaaccaagcuuuaugggggcuauuucuguucaaaccaccauagucucuuauauuucuccugauuagcugguccgagagcuuccagagcacuaggacugcagaugaccucauguuugcacagcggacaguuuuacccagugaacuaucucugcccaaacuuguuucuaccucuuuucccaaacuauuuuauuuauuuuuaucaccagcugagauauggggagccuacccuccgucgcgcuguaccuuuagcacuggcacuaauuucuguuucaaauccacgacucaacauccuggauacgcuaagcaaauucucucaugaugcugauccagaaguuuccuauaacuccaucuuugcuaugggcauggugggcagugguaaguacuugaaaaagauguugaacagacuagaagauucaagguucuuuuucuaagccucuguaauguuucuuguuucuagguaccaauaaugcccgucuggcugcaauguugcgccaguuagcucaauaucaugccaaggaccccaauaaccucuucauggugcgcuuggcacagguaaagaauaggugucuccuuuuucaaguguggcaguagaaauauauguggugguguaggagggccuaggagagauacgacuggguaugggauuuuuguuugccugagaaggaacaugucuccucagauaugacuucuuguuuauuaacacuucugguuuguuuguuuguuuuguuuugcagggcuugacacauuuagggaagggcacacuuacccucugccccuaucacagugaucggcagcucaugagucaaguagcgguggcagggcuacucacggugcuuguuucuuuccuggauguucgaaacagugaguuccugucagaaacaguacaugugugcacagugugccuugauuugcccuuaccagggccaccguagcaauuuaggauuaaaauccuaaguuaacuuuucuagguucauugggcuuguuggggggcgggggucauuaaaccuuaacuucucacacuuuugaucuggcccaaaagcuuucaagaugaauuuacuccuaagugacuaggagaaguuauuuucaggucuuaggggugugagcaaagagugguagaagccccuuggguuaauaguggguguacaaggaacagagcuugcucuuagguaauaguucagugggucagggcugcgauagauuccugaaguccaggcuaggcuuggcucguugucuacaacucguguuugugcucuccucccucagucauccuaggcaagucucacuauguccuguaugggcugguagccgccaugcagccucggaugcugguuacauuugaugaggagcugcgaccauugccaguuucuguccgugugggucagguaaggaauuggguaguuuaaaaaggaggacucagccggguggugguggcgcacaccuuuaauuccagcacuugggaggcagaggcaggcaaauuucugaguuugaggccagccuggucuacagagugaguuccagggcagccagggcuacacagagaaacccugucucgggggggggggggggggggcucaggguauaccaaaagaacuuggacaauguauauuuaauccuauuucacaaagugguguggacauugauggggauuguggauauugcuucucccguuucuggaaucuguacuucauuauuuucaucccacaggcaguggauguggugggccaggcugggaagccaaaaacaaucacaggguuccagacucauacaacgccaguguugcuggcccauggggagcgggcagaguuggccacugaggaguuucuuccugucacccccauucuggaaggcuuuguuauucuucggaagaaccccaacuaugaucuuugaaaaaguggcuucuagagacccuggcugcagcggaauuuuuuguuuuuagcaggcuguccugccugcuaugagggguggauacuguuccagaucuuugggggaauuguuaccuccuguuguuuuguuacugaguaagauaacuuuguugaauaaagaccuuuauccccaaggu

SEQ ID NO: 8165 - RNA, 1398 nt, Mus musculus
cuuuuuuuuuuccaauguucaguuuccuuuaaugacccccaucuccuuugaaggguaggugcaggcagcuaggcaacaggcaagacuuguucacuugaagaucuugccuugauugacagcuuugcccacgugcuggaagguccccucccaggaaaaguacucgaacuagggucugggucuccucgcucccaggauccaguuuccgcuauguauacaucucauaguccaccugccaaucuggacucagcgcaaaggcaagcucuuggccucggaagacccaaacaccagaaauggagcugcuguuguugguuccaaagaggauaacacuagcaaaggcauucuuccucaguuuguccaaucgcugaaacaucccagugaugagguugcaacucaugaaggucggggugagcucuucaaggaagcaguacucagcauaccacagggaccagccaucuuuaucaaagugcuuccaaaaauauggcagugccacagagagggugucauuggaguacuuacgcuuaaacucauccaacacaaagguacucuugggcaggugagcaaaagguccuuggccuugggcucagcagccagugccugcucacacucauccaucucuuccucaggagcuggggcagcugccuuuuuuccuccuucuucucagccugggguuuguuucuccucucgugaacccuuuucuuuccuugggguaucuuuuuuaggcuggcucucugcaaacuucuuagcaucaaaccaggccaucuucucacacagcuucaccucccccgagauagcccugaacuggggcugguuaaugcagguaaggaaccaccgguugguauuggggaaggccuggcgaaaagaaggcucuaagaccuguuuauagagccacaacaggguacagacaacugugauaucagccacucgcucacccaccagaaaaguucgagucuucaagugaguguccagcagccccaggaugcgcuucaccuccucuuuugcauuuucaguggucuguuuguuguggugcauaucgcccuaacgcccaagguggggaacacccagguacuagcuggaggaaggcugucacugucagcaaagcugacccacugcaccaccugagcugcugccucuggcguacuuccucacagcuccucagugcuuacauaauaggcaauggcaucgcucucaaacacacagaauacaucagcacccucaaaugcuggaaccuugccggcaggaaauuuccggagaaauuaggggguacgguugguuuggccaaaguggaaguggagugguguggagagcauguggaccugagccccgcuguacugagcagcguugagggccuucaaggcccuccaguuuucagguuauaugugcagggucccagccaccauu

SEQ ID NO: 8166 - RNA, 10201 nt, Mus musculus
cugcucugggugggcacggccccgcgcuuacgucaccggcccuguuccccucucccgggagcggcagcagacgcgcugcucccacccccuccccuucucacaagcuguccccucccugguggugaccgcggcccgacccucugcaaggcgauggcccgggucccgagcgcgggcuagcgugccugggugccuugccaugggcuguauuggcucucggcgcucagccggucaggguaagagguggaggccggagcauggauagggagucgggcuacauagcugccagguggggccgugggugguaggggcggugaggagggggcugguauaaggagagggaggagccugcgucaggaaggcggguugggccagaggagcguacggcgagggggcuagccgacucugacuuguuccuguggccugccugcuacugggauuuuccgugguguacucaccuucugccuuuugccuguauuccugcugcugagaguggcugcgggggcacagccugggagccgcaggccaaccugcggcccccaccuucccgggcuccaggcaacuagccuuuuguauauacauacuucauugccuacaccuaccucucugaucucagugucuuaggaguggcucuuugcugugaaccugccucuccuaccugggugcucucauccucaggagucaguuugcaaaugcuggccaaguaccccaccgaacgcuaguuuuugccuaacacuugcucagagcgucucccagcugguugauuaaagggucggaagccccagguggagcaucugugagcaaauugauaaccucucacgcucacagauaauuuuauuccuauuaccccccccccaaacaaaacaaaacaaacaaacaaaacaaaucacacuuauuccgagcagaaaaaguccaggucuuccuauagccgcugagcccugcucaggccuucuuuuccaugaaaacauguauguggucgggggcgguggggugaggagagaagcacuuuagcucuaggucagccagccuaccuccugugucaaggaauuaguucggaauggguccugggaucuccaagcagguggucaaucacacaaagcauuaguaugguugauguuugaggucuuuuacaaguaaacucuggcugaaauguggacuucccuuaaauucugggauuuguagucccagaaauaaccucguggguuaugaauuuaagaaguggcaaggcagccgggcgugguggcgcacgccuuuagucccagcacucuggaggcagaggcagguggauuucugaggccagccuggucuacaaagugaguuccaggacagccagggcuacacagagaaacccugucucgaaaaaaaaaaaaaaagaagaaguggcagggcgcucugacuccuggucugcacggaguucaggaagucauccucuccuguagucagggaagagugugacugaccucaggacuggccuugaguaccagguaggcgucuggcauagccaguaaccuguuuucuuucugguugguagcauuucuggggaccaccaacuggcugaggcccagggacagagacgucugcuccagcuaaaagguuaguugugauguacguggccaguuggcacuguguaagcuaagaugagccucagccccacaagccagagaacuuggcgaggucccuggcacucccacuuccucaaagcuaugagacaggaguguucuccuuaugugacuaggcauaaguuccaaguggggaggggacuggcucagcauccggagccaaaacaagaauagaacugggagcugggccugaagcaguucaggcuuugggcucucugcaucaacacagccagcaugccuaugauuucugugcugggcaaaauguuucuguggcagcgcgaagggccuggaggacgauggacuugucagacaagucgcagaggugagagcagagaucauggaugugaucugggaagcgaugggaaacugagcaaaaaggaacaccagguguggagaggaaacucucucugguuuagauauugggaagcagacugaaagggagagacucggguuggggccauuagguaaugacuuacaagggugaaacuuagaaaaaucauggguuuguugggagugauagcccaguugagauuggugagaggaaagaauccuggggagaaggagagugagagggggccagugcuggugggcaaauuucaugcacuuuucaaggguugagaugcgggcggagaggucagggguuacucauauuuggguaugaguaacguaaguucugauggcaaaauaguuguagaggaagguguccuuagggaugccacagucaguugugggauaggggguuucaggagaguuaugugcgugaacucagauugucugcgagaugggggagggguaauaaaaaaugacacggcagcacggugaaaauggcagucuugguagaagugggaaugcagaugaacaccguucccucccgacuccucaguggcuucggacccugccugggcuguggaguggaucgaacucccucgaggucucucucuguccucccugggaucugcucgaacucuccgaggcuggagucgguccccccguccuucuuccguggacagccaggacuugccagaggugcugcgccuuuucugugcauguuuggcggcgggggguggggguggggguggcguucacauugaggguucgugugaccccuccccguuccugccucaccauccugcuucgggcucuuuuuuccugcuagcggaggcgcuauccggcaggccgcccccgcgccggucugcucugcucggcguggugccagcgggcuggcuugcuagcgccuucggugcugacgucagcgcaucccaggccguaucccgggagacccuguugcauggugauggguugccagggagauauacaccuuuuucuuugggccagggccgcagcugcgcggagcgucgcugggcauggauggccccggcugggggaagagaggggagggagggagagccggccaggaaacacccgccagguuccccuucccacaggccuggccagaggcuaucggcgccaaucuggaggcccugucagucagguacugaaggagagggacggaggaugggccugaggucaaggggcagguggaggccgcuugugccaauuggaaccaaccauaauggaggagaauuagguaaugcugggaagggggugugugcuucaguuauauucagcauaggaaaacauuugcuggggcuuaucaagggaccguuaagucagguacaggauggaguuaggaguccauauggauuuaacucugacccugccaucuccugcuuccuccggaguacaaggcagucaguacagaacaugggaggggccgugcgugagaauugagggugugaaaaaaaauaaaaauauggguugaagcauuauuacuaagagacacuuguggccuugaguuacagggagcguuguguaagauucuuuuugaaccuuuugauggccuucuuggucuaaaaagcugguuccuuucccuugaggcaggcaggauggugaaagaauuuggugguauuggcagaaaugagugcuggacuucgagaaaggccaggaaaaggcagaagcuuccuuguggcaaaguccuuaagugccugaauaacagaggaagagccugaaaagagacguucuuucuuuuaaaaauuaaaaacauauaucuuuaauuaauuauauguguggguaugcccauugagccuggagguguuugaccuccuggagcuagauuaacaacagcgaccugauguggaugcuggaaccaaacuuggauccuaugugaaagcagcaaaugcucuuaaucucagaggaauauuuucaucucucuaaaaaguuuucuuuuccccuaaaacacacacacacacacacacacacacacacacacacaccaaaaaaacauuuuagauuuauuuaguaauugugcaaguuuugaaaugaagccauuuugaugcacuuuacccuugggaaaguguacuuuauaccuugucuuauucacuuggcccaugcauuuacuuauuagcaggcauuguuuaaacacugggcugcugcagugaucauacacuaaauuccucaaagaggcaaagaccaaugaaggaaaaccauauuuauaccuggcaaguagacuccauuaaugguucauugauagaauauauagugauucauuggagacucuagugacaagguagaccacuauuugaguagcaagaaggccucucugaggggaugauacuucagucacaacuggaaagaugagaaggccagccauggaaagugaugagcaugaaagaacagaaaagauuauauacagacuuccuggcugaaaacguacaggagguuagagggaccugugcugaccuggggaggggcucagggaggcuuaagggaagcaguggugggacuagugucaaggcaagcuuccaugcaugaacaggagggauucuuuguugucagagauauauuuguuuugagauagggucuuacauagcucaggcugcccucuauuuccuaguagccaaagaugaccuuaaacuucugaccuucugccuucaccucccaaguacuagcauccugugucaguugucacaagacuugguuuauguggugcuagggaccaaacagugcuuucuuuuuguuguuguuguuuuuuuguuuuuugagacaggguuucucuguauagcccuggcuguccuggaacucacuuuguagaccuggcuggccuugaacucagaaaucugucugccucugucucccaagugcugggauuaaaggcgugcgccaccacugcccggccaaacagugcuuucuugaaugguaggcaagcacuauaccaacugagcuacagucccuggcacccuugcuagauuuuaggaccagauaugugcaggcaaagcccagggaagaguugauggugauccugagaacuggagaaugguuuugacuaaaucugaaguuagaaaacaaaccuggaugugaggaagagaauguauugccuuggcuuuggugaugcugaguguguggcucuggcaggcagucuagaaagaucuggacauauaucuaaagacacacggaggagcgggggaaaaacuuuaaggccaugucugccuuagcugucucccuucuccuuuccuuccuccccugucuuuuuugguuuuguuuuucuuuuugaaggacagaguuucucugugcagcccuggcuguccuggcauuugcucuguagaccaggcugaccucgaacagagacccaccugccucugccucgugagugcuggcauuaaagucaugcgcaccaccaggcccauccuuuucucagaggcucucugcuccacauuucuucuuuucuucauuugucuccuucccuauugggagcugggaagauggagacgcagcucuucuuuuguucucuugggccugagucuccauugcccccuaggaagauaguuuguggacuccagcuucuuagcccuuucugcaugccacugugccacucucccacauauaggacauacaugacaugccauccuagcauucuuccaagcuaccaguggggccuuggcuuaggcaggagcauguuggaaagaagguuguuugugucagggccacuaaccugacuguguuacucaaggugaauguuggagacacagucgcgaugcugcccaagucccggagagcucuaaccauccaggagaucgcugcacuggccagaucgucccugcaugguauguaccccaugucuguuucucugcccacuuuguccauccuuccuucuuuuccucaugucuugugggacugauuacugugggaauauuuccugugggaauucugggggauuucuuuuuugcaaaucaauccuaacccuuccuccuccuacccaaaggacauagagagacuuuguaacccucuccauuuacuuccauacuggcuauucccuaacccuugcccucaacccaacuucucucucccaccuccagguauuucccagguagugaaggaccacgugaccaagcccacagccauggcccagggccguguggcucaccuuauugaauggaagggcuggagcaagccuagugacucaccggcugcucuggaaucagccuuuuccuccuauucagaccucagugagggugaacaagaggcucgcuuugcagcagguagguagcagauuuaucauagggcugcugccucucaucucacuggaucuggcacuggggcuggaguucuuccauacaccucucccugcccagagaccucaaggacaucuccugucugcaaagccaggagauaguuuagcuccuguguaugucagucaacacugugucucucugauaggaguggccgagcaguuugcuauugcagaagccaagcuccgggcauggucuucaguggauggugaugacuccaccgaugauucuuacgacgaggacuuuacugggggaauugacacaggugaggaguguuugaucuugccacuuggggugaacuugccugguaggugugauucacucugagacucccagagcaacuuaagucuuccagacaggaggaaagagacuauccaggcugaccuugacaccucgaggacaaagaucaccagcuauacucaggugggaaaacagcacuuugaaauggaacagcucuuuucuauaggugcugagccugcucucuucucuguguguagugagccuugcaguucucagaauaaagaagaaacagcucagggaacuuggugccucuugcguacccccuacuaccuucuugcuuccaagagaaucugugguacccuugccuuaccucuuugaggaggcuucgguuggcuguggccacacagaugaucuggcagcacgguacccagcaccucacagggcagcaaucccaagcaaacaggaaggccugcugggccuggacuccacaggaugcuggcuccagcucagcaucuuuguauuccagccugugggucuugcuuugggccagugcuugcagaaagggacccugggggccuugcagcugugcucagcugcucuuucaucuuccguuccucggacuguguggccagcuuucccugcagcuucugguggcuggccucacaggaccccugcccccagugccugacucuuugccuuugaagaucaccuacuaguuccuacuccucuggccaauuaacaagguuuucaaggccaagccugcauugaaagcaggcacagagcugcugcugucguccagaggggauugaguugaaugcuuaaggccaagguggaaucaucaguauauuaugauuuugggggggugucuuaauuuuuuuguuuguuuguuuuuuugagacaggguuucucuguauagcccuggcuguccuggaacucacucuguagaccaggcuggccucaaacucagaaauccgccugccucuaccuccugagugcugagauuaaaggugugcgccaccacugcccagccuacgcuuggcuuuuuauuuuguuuuugagaaagggucuuacuagcccaggcuaaccucgaacauuuauugaacgucuguguauaaucuuugaacacauuuuuaaaacugcacagcuuuuucugguggggacagcccuugguaggaugccccacuuagugagcagagcaaaggcaauuuagccuuuacugcuuuggguaaugagcaaccauuauauugauaugauuauauugauauggucuugcauugauugcuugccucuucuugaucuaauacuguaaaguagauauuagaauuucuaauucgccgggcgugguggcgcacgccuuuaaucacagcacuugggaggcagaggcaggcggauuucugaguuugaggccagccuggucuacagagcgaguuccaggacagccagggcuauacagagaaacccugucucgaaaaacaaaaacaaaacaaaccaaacaaaaaaagaauuucuaauucaccaugaaaggagcugcgguaucaaagaucaaagacuuguucagguuacccaguuccuacugacuccccuaaugaccccuccccacagcuauaaggguaggugugggagucugugauuaugugguuuccacauugaccuacugaaauggagccagcaaagcuguuuuuuuuuuuuucuucccuucacagacauggcugggccucuggggucccaccuccaggaccucuucacaggucgucgauucuccaggccugugcgccagggcucuguggagccagagagcgacuguucacagaccguguccccagauacccugugcucuagucugugcagccuggaggauggguuacugggcuccccagccaggaugaccucccagcuguugggugaagagcugcuccuugccaggcugccccccagccgggaaagugccuuccgcagccuggguccuuuggaggcccaggacucccuuuacaacucaccgcucucagaauccugccuuuccccugccgaggaggagccugauuccuguaaggacugccagcugcucugcccgcugcccacaggcagcugggaaagacagcagcaagucucugauguggccucuucuggggugguauccuuagaugaggaugagguggaccagugauccagacaugcccggugggggcgugucuccccaggcugcugccuggggcagagccucuguggccaaaugugggcucugaagcuuucagagggcuucugggagcacucacuucuccauuguguguuuugcaugaaaguguuuggagaggaggcaggggccaggcuaggggcgcauguccugcuuccacucaugggguuugccggggcuugcccggggccccuggggcauggcuacagcuguggcagacagugacguucauguuucuugaauccaaaaugccacauuuccuccugggaugugaaccugagaggguuguggcugggcugaggagguggaaauggaggaagccuggccacacacccuccccccucccccacgccccucuccucugcuuuucucuucauccgaguccaugugcagugcgugacugaaccaccaccuguggggcuggcuccugcccuccuggagucuacagauugagccauccccuaaggguccccuuugcccagcugggcucugcugugcuucaccccuccauugugucuaaaccuuuuuuuuuuccccuaaagacaggggguuucuggucuguucuuugagccgaucuucuuugggaggcacuggaaaagaugaaagagugugcccuugcccccuucgcugcuccuccacccuggcccuuucccagcauggcaagguugugcgagcacaugcagagacucaguagggcggaacuggaaaaaguaagggcucugcuuguuacagagcugggagggccuuguccuuucaucgaggaccacaagggggcaacccggggagccagauuugugccaaugaauggacagucaugagggaguagcuguccuugggggaggaaagaggguagugcuuuucuuggcugaauggaaggcuguagccacagugauagggggcccugucccaggcagggcguugcugaucagccaguggaggccgcuggcagauugcgaggacacugggguugguaaguggcagcagaaugaaucucagaggcuugggcaacagguaagaggauccaaggugaaaauaugagccaacagcacaaguguucuauacaugaguggcuaauuagguguuuauucuauuuauuguuuuauuaaauuaauauaaaaaucuuuguaaauuucuauauacaucuugucauuggaggcuccaguauaaacccaguuuaguucugcccuuuucucaaagauggggcaggggccauagaaccccaccucaucccgccaggacacuugaugaucccccagcaguuaggguggccuuggguuccaguuucuggucacugcugcuugcagaaggaauacaggccauccguaagggguucacuggcacuugucaucacugucggaggggguacccucucgugggaggccguggcgggaucuuggcccccagagcgcaugcaccucaguggucucugugucacugcugcugguggcacugucccggaaacuggcgagggguggccugacuuuaacacccugugcugugacagagccuucaauggccuuccggagcug

SEQ ID NO: 8167 - RNA, 5358 nt, Mus musculus
agggcacaaagaggaugggcagcguuagguuggagccacuggagaggacaguguccagaaaucuguggagaaagaauaguaccaggaugaagacucauucaagaaacaagagggugcccagcacaggggcuguaaugagaggagguagcaccuagaaagaagguauugcgagcugucgccucccagugaaaggcgcacuucaguguccagaagagggugguauaguggggugacaggcaguaccaaguucaguuggcaguguucuaggggaucagugugaggcuagugccaagcagggccaagggaagacgggaguggcgaggaggugaagccccaggggagggcacaaugcgggcuuuccuuuccccgagagugacaucauggcaaauucccaaaccggacgcacccggcuccggugaugucuagcugguccgagccagcucgcaccagcuuuggggaucuuggugacagucugaggggcugggcaccggguccuggagggcuggugcucugcgggcgggguucugcuccaccugccugcagcgcggacugugcccucggccggcacgcggacuucagggaagggcuagggccgggcuucucugggccaaggaucaagguuccuggcuggguuaggcccccaagcuuuccacgcuuugggauccacagucugaagagggcgccgucgagccgggcgcagcgcgguaccccgucggaggugggacuuaaucuguccccgccuuggacggagucaccgaguuuugagacucgcccacaaggcccgagcaccucggagguggcccuucccggcggaagugaagaagccccgagaaggaggcagcggaaguggcugcgugacugcagcccgugcgcacgcgcccucggccucguugccgcuuuuggggcgguacucugcccugucuuacuuuucuccacgugagggggugcgcgaauccccagugguggccgcgcgcucacauccucugcagcuuucgugcccuucgcgauggcgggcauccuguucgaggauauuuucgaugugaaagacaucgacccagaaggcaagaaauuugaccgagguaagcggugucggggcgguaggagggaaguggccaacaugcccacccaccccaaguggcuggcccgccccacccucucgguaccucccucaggaaacaguuuuuuuuuuuuuuucgugaaugagaaacuugagacagcuuuuucuauuauauuugcggugccuggugcccgguggguggcccuuagcugggugcuggcauaccccugggaaccuuucuaacucccuacacaguuauuaugugcucuaccgugcucugaacuuuauucuuggaaaaaguagauggugccuuaucucuuuuguuaccccaggucuugcagcgaguuaccuaccugccuuccuaaccaauaauuuuguauuagccuaagaacaaguuagcucuuuccgaagcucucugaauuucauucaguugaccgcuugguguauuuauuuucccaacgauccggaaguuguuucuucuuggugucgcuuagccuggaggcaaaugucuuaagacagaugucaguuuugaauacaucccucagauucccucagcagugucuccugcuagaaagaggaagucucaggaccagugagacucuagucuaaaucauccaggcguuuuuaguuagagccuggagacuggccacugcuggaggagcuuugccgcuugcuugggacccugucacuugcugagguuacugccuucuucccucuugugaaucugauucugauugcaguugugggaggcuggugggugugugcauguuagaugauuugaucucuugcauuugaccccaagcuggcaucgauagacuuuguaaucaugucugucaugcacucuuccccaguaucccggcugcacugugagagugaaucuuucaagauggaccucaucuuagauguaaacauucagauuuacccuguggacuuagguaaguauugaauacgggcaauggcaagaggauuuuggucuuaggugucuacuucuuuacccugauguugcugcucuauucaggugacaaguuccgguugguuauagcuaguacuuuguaugaagaugguaccuuggaugauggugaauacaaccccacagaugacaggccuuccaggugagguagcaguaaacaagugacuaagauaagaauauagugcagagaaaguauaauauguagauuauggauauacauauguauaacuauauguuauagaaaauuugauuucuuggauacaauauguauuauauacuaugcacauuacaugacaauguauaacauaaguuauauaauguuauauauuagauauaauauauaacauguauguuauaguauauaauaacauauguuaauacuauauauaaguaacuaugaugagaauguaaugaaguaauauaauauauaauuuauuuauauauuauauauaauguuguacauuacauauaauauauaguacauauuauauauuacauauaauguuauauaacauauguucuauauuauguauauauuauaaagaaagaaaaacguaaguauauaggaaagucuuuacuucuagagauaaaugauugcugucaguggaaucugaauuaccuuaaaggcauugcugcaauuagaguucggacaacuagcugggcagugguggcacacgccuuuaauuccagcauaagcacuugggaggcagaagcaggcagauuucuguucaaggccagccuggucuacagagugaguuccaggacagcuagggcuauacagagaaacccugucucaaaaaaaaaaccaaaaaaacaaaaaacaacaaaaaaaaagaauucagacaacuagaccuggaugugauggcuuuugucuauaauccaggauucaggagacgguucacgaguucaagaaaauguuuggccucauaucaagucugaggcuagccuuggcuacaugagaccuugugucuaaaaaaauugaaaaaaauucagaugacuaguuuuauucauuacugagagcagugaucauaagcuugugaauugcaucuauuuauuuaugugggacagggucuucucacuuuguagagaccugguugaccuggucuguagaucaggcuggccuugcacuuagagucacaucuaccuccucugccucagugcuggaauuaagguuaugugccgccuuugguucaggguuaggucuuuaaggcugaggaaaggauuacauaguaacuuaggucuugugagggagcuuggugugauagaaagacuauggaguaguaggucuggugaccagcacccuuagucccugcacuugggaaacagaagcacaagucugucugacugugaguuugaggccaguuggaauagggcuaaaaggccacgacucaaccugaguuuucaguucaaagccuucugucuccucaucaaugaaauacagauggucauguguaccucacagaauuucugugggggccaaggaaggucaugguucugcauguguaccucaucagucuccauuucuaaaguucccguagacucuuacuaugaagagugaccagucuguuguuuguagggcugaccaguuugaguaugucauguaugggaaaguguacaggaucgaaggggaugagaccuccacugaagcagccacacgccuguaaguaacacugucuaggaaaagucuuuucccucccugcucugagguugggccaggcuuuuacuucuguguugccgcccucuccccacccccaccccccuuuguuucuaguauuccaaaccuagguggaagaauuugucuugggaacaguuuccagccuguaugugggucacucagcggcaccauagucaggguuuucaagacccuguaguccagaggaggcacgagcuaucuugcuuugugaaggacaacagagcaucuugcuggagaacacgugcacuaugcauaaucaggccuuuuuuguuuguuuguuuguuuguuuguuuguuuguuuugguuaaguauguauugcuucucuguagcccaacccuuggaucuuugguuucccugccugaauuuuuuuuccccuuuucuuuaaaaugauguuuaaaaagugugguugucagaaacuugaagcacagaaaaagaacaaaaugagaagaagaacaauagucaccuagggaaucuuuuagauaaagaguuugaguagcugcugugguggcagauaucuguaauucagcauuggagagacagaggcagguggauuucugugcauuccaggccagccuggucuacagagugaguuccaggccagccaggguuacauagugagacccuguuauuuuaaaaacagaaacaaacaaagaguuuaaauaguuuuuuuuuaaguguuuacuuuucucuuuaagacccuuuacaauauuuuucuuauuaguugaaagcuccccaaacuuuuuuuuuuuuuuugagacaagguagccuggacugggacugacccaggcugccuuuggacucaggagauccacuuuauugccuccugcugcugggauuaaaggcaugagccguucucuuggcuccuuagcauuuucaaaaauguauuuauuguauguguguguguaucaugugcaggcaugaguccaccaaggucagaagaggaauuaaagugguuaugagaugcuguguggugcugggaagugaacccagguuuucugcauuuugcaagaacaccuagugaucuuccgguugagccaucucugcagcuccuaccuaaacagucuaguagcuguauaacguugcagagaauggugacaucuucauuuguaugucuccuagcucuggacuuaaugcacaugucuacaugcauucauuucucuccuaaucuuugguucccggugacagaauacuaggccuuuuuaaaccaugggugggagcugcugggaagcagcugcuguagaguuuaggcucaggacaagggccuucucuuucagcucugcguacguguccuaugggggccugcucaugaggcuucagggugaugccaacaaccugcauggauuugagguggacuccagaguuuaucugcugaugaagaagcuggccuucugaacuucgugggaaaccagacuugcugcuuagucacucaugucauggacacuguucaaggcuguguagaagcugucgguguuagccuguaaaaggggcggaacucuguccacuguggggacgucuucaguuugucugaaugcaguggaaaaccgacucucccucucggaaggccgagagggagaacuuagcaugaaccugaaguuguauaugauuuuuuuuauuaaaguuuucuuuuucagacucuuc

SEQ ID NO: 8168 - RNA, 5358 nt, Mus musculus
gaagagucugaaaaagaaaacuuuaauaaaaaaaaucauauacaacuucagguucaugcuaaguucucccucucggccuuccgagagggagagucgguuuuccacugcauucagacaaacugaagacguccccacaguggacagaguuccgccccuuuuacaggcuaacaccgacagcuucuacacagccuugaacaguguccaugacaugagugacuaagcagcaagucugguuucccacgaaguucagaaggccagcuucuucaucagcagauaaacucuggaguccaccucaaauccaugcagguuguuggcaucacccugaagccucaugagcaggcccccauaggacacguacgcagagcugaaagagaaggcccuuguccugagccuaaacucuacagcagcugcuucccagcagcucccacccaugguuuaaaaaggccuaguauucugucaccgggaaccaaagauuaggagagaaaugaaugcauguagacaugugcauuaaguccagagcuaggagacauacaaaugaagaugucaccauucucugcaacguuauacagcuacuagacuguuuagguaggagcugcagagauggcucaaccggaagaucacuagguguucuugcaaaaugcagaaaaccuggguucacuucccagcaccacacagcaucucauaaccacuuuaauuccucuucugaccuugguggacucaugccugcacaugauacacacacacauacaauaaauacauuuuugaaaaugcuaaggagccaagagaacggcucaugccuuuaaucccagcagcaggaggcaauaaaguggaucuccugaguccaaaggcagccugggucagucccaguccaggcuaccuugucucaaaaaaaaaaaaaaaguuuggggagcuuucaacuaauaagaaaaauauuguaaagggucuuaaagagaaaaguaaacacuuaaaaaaaaacuauuuaaacucuuuguuuguuucuguuuuuaaaauaacagggucucacuauguaacccuggcuggccuggaacucacucuguagaccaggcuggccuggaaugcacagaaauccaccugccucugucucuccaaugcugaauuacagauaucugccaccacagcagcuacucaaacucuuuaucuaaaagauucccuaggugacuauuguucuucuucucauuuuguucuuuuucugugcuucaaguuucugacaaccacacuuuuuaaacaucauuuuaaagaaaaggggaaaaaaaauucaggcagggaaaccaaagauccaaggguugggcuacagagaagcaauacauacuuaaccaaaacaaacaaacaaacaaacaaacaaacaaacaaaaaaggccugauuaugcauagugcacguguucuccagcaagaugcucuguuguccuucacaaagcaagauagcucgugccuccucuggacuacagggucuugaaaacccugacuauggugccgcugagugacccacauacaggcuggaaacuguucccaagacaaauucuuccaccuagguuuggaauacuagaaacaaagggggguggggguggggagagggcggcaacacagaaguaaaagccuggcccaaccucagagcagggagggaaaagacuuuuccuagacaguguuacuuacaggcguguggcugcuucaguggaggucucauccccuucgauccuguacacuuucccauacaugacauacucaaacuggucagcccuacaaacaacagacuggucacucuucauaguaagagucuacgggaacuuuagaaauggagacugaugagguacacaugcagaaccaugaccuuccuuggcccccacagaaauucugugagguacacaugaccaucuguauuucauugaugaggagacagaaggcuuugaacugaaaacucagguugagucguggccuuuuagcccuauuccaacuggccucaaacucacagucagacagacuugugcuucuguuucccaagugcagggacuaagggugcuggucaccagaccuacuacuccauagucuuucuaucacaccaagcucccucacaagaccuaaguuacuauguaauccuuuccucagccuuaaagaccuaacccugaaccaaaggcggcacauaaccuuaauuccagcacugaggcagaggagguagaugugacucuaagugcaaggccagccugaucuacagaccaggucaaccaggucucuacaaagugagaagacccugucccacauaaauaaauagaugcaauucacaagcuuaugaucacugcucucaguaaugaauaaaacuagucaucugaauuuuuuucaauuuuuuuagacacaaggucucauguagccaaggcuagccucagacuugauaugaggccaaacauuuucuugaacucgugaaccgucuccugaauccuggauuauagacaaaagccaucacauccaggucuaguugucugaauucuuuuuuuuuguuguuuuuuguuuuuuugguuuuuuuuuugagacaggguuucucuguauagcccuagcuguccuggaacucacucuguagaccaggcuggccuugaacagaaaucugccugcuucugccucccaagugcuuaugcuggaauuaaaggcgugugccaccacugcccagcuaguuguccgaacucuaauugcagcaaugccuuuaagguaauucagauuccacugacagcaaucauuuaucucuagaaguaaagacuuuccuauauacuuacguuuuucuuucuuuauaauauauacauaauauagaacauauguuauauaacauuauauguaauauauaauauguacuauauauuauauguaauguacaacauuauauauaauauauaaauaaauuauauauuauauuacuucauuacauucucaucauaguuacuuauauauaguauuaacauauguuauuauauacuauaacauacauguuauauauuauaucuaauauauaacauuauauaacuuauguuauacauugucauguaaugugcauaguauauaauacauauuguauccaagaaaucaaauuuucuauaacauauaguuauacauauguauauccauaaucuacauauuauacuuucucugcacuauauucuuaucuuagucacuuguuuacugcuaccucaccuggaaggccugucaucugugggguuguauucaccaucauccaagguaccaucuucauacaaaguacuagcuauaaccaaccggaacuugucaccugaauagagcagcaacaucaggguaaagaaguagacaccuaagaccaaaauccucuugccauugcccguauucaauacuuaccuaaguccacaggguaaaucugaauguuuacaucuaagaugagguccaucuugaaagauucacucucacagugcagccgggauacuggggaagagugcaugacagacaugauuacaaagucuaucgaugccagcuuggggucaaaugcaagagaucaaaucaucuaacaugcacacacccaccagccucccacaacugcaaucagaaucagauucacaagagggaagaaggcaguaaccucagcaagugacagggucccaagcaagcggcaaagcuccuccagcaguggccagucuccaggcucuaacuaaaaacgccuggaugauuuagacuagagucucacugguccugagacuuccucuuucuagcaggagacacugcugagggaaucugagggauguauucaaaacugacaucugucuuaagacauuugccuccaggcuaagcgacaccaagaagaaacaacuuccggaucguugggaaaauaaauacaccaagcggucaacugaaugaaauucagagagcuucggaaagagcuaacuuguucuuaggcuaauacaaaauuauugguuaggaaggcagguagguaacucgcugcaagaccugggguaacaaaagagauaaggcaccaucuacuuuuuccaagaauaaaguucagagcacgguagagcacauaauaacuguguagggaguuagaaagguucccagggguaugccagcacccagcuaagggccacccaccgggcaccaggcaccgcaaauauaauagaaaaagcugucucaaguuucucauucacgaaaaaaaaaaaaaaacuguuuccugagggagguaccgagaggguggggcgggccagccacuuggggugggugggcauguuggccacuucccuccuaccgccccgacaccgcuuaccucggucaaauuucuugccuucugggucgaugucuuucacaucgaaaauauccucgaacaggaugcccgccaucgcgaagggcacgaaagcugcagaggaugugagcgcgcggccaccacuggggauucgcgcacccccucacguggagaaaaguaagacagggcagaguaccgccccaaaagcggcaacgaggccgagggcgcgugcgcacgggcugcagucacgcagccacuuccgcugccuccuucucggggcuucuucacuuccgccgggaagggccaccuccgaggugcucgggccuugugggcgagucucaaaacucggugacuccguccaaggcggggacagauuaagucccaccuccgacgggguaccgcgcugcgcccggcucgacggcgcccucuucagacuguggaucccaaagcguggaaagcuugggggccuaacccagccaggaaccuugauccuuggcccagagaagcccggcccuagcccuucccugaaguccgcgugccggccgagggcacaguccgcgcugcaggcagguggagcagaaccccgcccgcagagcaccagcccuccaggacccggugcccagccccucagacugucaccaagauccccaaagcuggugcgagcuggcucggaccagcuagacaucaccggagccgggugcguccgguuugggaauuugccaugaugucacucucggggaaaggaaagcccgcauugugcccuccccuggggcuucaccuccucgccacucccgucuucccuuggcccugcuuggcacuagccucacacugauccccuagaacacugccaacugaacuugguacugccugucaccccacuauaccacccucuucuggacacugaagugcgccuuucacugggaggcgacagcucgcaauaccuucuuucuaggugcuaccuccucucauuacagccccugugcugggcacccucuuguuucuugaaugagucuucauccugguacuauucuuucuccacagauuucuggacacuguccucuccaguggcuccaaccuaacgcugcccauccucuuugugcccu

SEQ ID NO: 8169 - RNA, 9269 nt, Mus musculus
cgcccgccuccccagcugucugcuccgcgucaugccgagccucccggccccgccggccccgcggcugcuccucgggcugcugcugcucggcucgcggccggccaguggcacuggcccugagcccccagcacugcccauccguuccgagaaggagccgcugccuguccggggagcggcagguaggugggcuccagggggaggugcgggaggggagucugacuccuggcaagucuacauccacagggagagggccccgggcgcagguggcuucgcgcagcgggagggugggaggggaaagcagaggcggcgaggugcacggugccaagggaccaugggccuggcgggcagagcccggagcaggcauuacggcacgagcaaccggacagcggccgccagccaagcccguccccgcaggcugcuccuucggcgggaaggucuaugccuuggacgagacguggcacccggaccugggggagccuuuuggggugaugcgcugcgugcugugcgccugugaagcggugaguggauaacgcagcugccugcccuacucuagaggguagcggaacgcugguguccuaaguaguagacucggagaugcucaggggaaggcugguccgcaaaucggaggaaaccgcuuucaagucugcgguguugacaguuauugaucgcccacaaugugacuggcuuuuagccaacuuccccccucccguuacaguauugcuagauaaaugacauuauuaguucuacuuugcagacagggacgccgaggcucagagaaguuaagaaacuuuggacgggccauguaacuuguaaauagcagaauugacugucugcagcccuggggucugaugguuucauucccuuaauuuuccuauguucucugccaucagccucagugggcucgccgugggagggguccuggcagggucagcugcaagaacaucaaaccucagugccccacccuggccugcaggcagccgcgccagcugccaggacacugcugccagaccugcccgcagggugaggcccgcugugcccggaguuaggaggguggaaggcucuacacuagguccuguacgacuugcaucgcggaggaggacugguccuccugguaccuuucugaagccagccgucuuauuccuuaccccggaugcagagcgcagcaaucuagauccacagcccgcuggccuggucuucgaguauccaagggauccagagcaucgcaguuacagugaucgaggggaacccggcguuggggagcggacccgugcugauggccacacagguaggcugggguggaggugggccugaugaaguuugagucccgcggcaaggcuugacagugcucaggccaucuucucuucucgaagacuuuguggcgcugcugacaggaccgaggucgcaggcgguagcucgugcucgagucucuuugcugcgcucaaguuuacgcuucucugucuccuaccagcggugagaccgggaaaagggcaaggacuaggaguaguaaagggggcaauaaagaggagccuguaggcuauagauccagucucacuggaccucucuucacaggcuggaccgucccagcaggguucguuucacagaucccacaggcaacauccuguuugaacacccugcaacccccacccaggauggccuggugagaugaugccauuuaagagugcuuauccaaaaucggcacuugcugagagcaugcuuugcauugccuccuuugguucucacaacagcccagugggagaaaggcccugacauuaugaugcccauuuuacagaggagggaacugaggcucagaauagcagaaugugauuuguucaaggucauuuggcuaguaagugguaagccaggacuuaaaaucaaggcucauggguccuucuuaagagggucuggggucucccuuccaugcuccuuccucauuagaccugggucuuuuagguggcuuguccugcauaauuacaguaggcauucuucccucuucucucaaggucugugggguguggcgggcagugccucggcugucugugaggcuccugagggcagagcagcuucggguagcccuugugacauccacucacccuucaggagaagucugggggccucucauuuggcagggugcucucgcugcagguaaggggagugagcaguucucagaugucaagagcugagccuucaauaacccaaggguggguggacugaagagaggauuuucuuauggcugucauggucuaacacuccccagagaccuucagugccauccugacccuggaagacccacugcagcgggguguggggggcauagcccugcucacccucagugacacagaagauuccuugcauuuuuugcugcucuuccggggucugcugggaggugagugauggggaagauguaugugagggcguagggcgggugcucaccuuucagaaaugcucacaugugcagugcuugcaggacuagcucaggcucccuugaagcuucagauucuccaccagggacagcuacuucgggagcuccaggccaacaccuccgcucagguaagggaaaggaaggccugugucuugccgagguuuacucugaccucuugcuguugcccaccccacucugcucuguucacaggagccagguuuugcugaggugcugcccagccuuacagaccaagagauggacugguuggagcugggggagcugcagaugguccuagagaaggcgggugggccagagcuacgcaucaguggauacaucaccaccaggcagagcugugauggugaggaaggguggggcuuggcacuguggguacacauaacucagaggcacaaacgugugcugaggaagagcccaaaauacauaugggggucuugggugucugggugugggcaagccugcugccaccugucuuguccccugcaguccuucaaaguguccuuuguggggcugaugcccugaucccaguccagacgggugcugcugggucagccagcuucauauugcuaggaaauggcucccuuaucuaucagguaagagucagcagcuguaggaggcagggaggccagcagggcaaggccuugaccuucagggggaaaggcucucggucuuggcuggcaauccaauugccuuuccccaacccugcccaccaggugcaagugguagguacagguagcgaggugguggccaugacacuggagaccaagccucagcggaagaaccagcgcacuguccugugccacauggcuggacuccagccgggaggacacauggugagggcuccaggcagaguugugccagggcugccaauacaugggcugcgggaagccagguugguugaguagggguguguaguacuguucacacacacauggguucucucaaugaguucuuuauucauuugacacguuuugguaaaccuuaggcuagaaaccuuguucucagcaagcucauagugaaauagggaacaccacucacgggaacagugcaauagcccaugagauaguacuaauugaacuuuuggggucugucaggcacgaacgugguugccuccuuuguguacauuuugccuuucccaguacccuuugauaaaggagaaguaaagacucgcagaugaguaacucuucaaggguugugguaugucuaggaugcggcagaggagguucuugacacucgaccuacaaaguucuuguccaguguuauugggaugaggaaggauauacgugugguggaggcauaagauaugggaagcccuuggcaucugaaagugagagggcucauccuucuuugaccccuaggcuguggguaugugcucugggcugggugcccgaggggcucauaugcugcuacagaacgagcuguuccugaauguugguaccaaggacuucccagauggagagcuucgggggcaugugacugcccuaugcuacagugggcacagugcccgcuaugacagugagugccucauggucuaccugcccaccuauguccucugaccugccauccaagcauccaaagaauuagccagagauccagagcuugagcugucugaucucugguuggcauuuagagagguggggauguguagggugaagcuacuggccaaccaucccuguugccauugugcaaggaagcuaagacuugcuauuccccaagcccuagaucugggguggggcaggaugagauuaagagcacaaucucaggugucaucucucaucuguuuggauuuaggauugccugugccucuggcaggggcacuagugcugcccccugugcggagucaggcagcagggcacgccuggcucuccuuggauacacauugucacuuacacuaugaaguucuauuggcugggcuugguggcucagagcaaggaacugucacugcccaccuccuugggccuccugggaugccagggccccagcggcugcugaagggauucuauggcucagagguaaagucauagagaugggaagaagcuuagaaauuuucugccuuuuuagcuugaagggccauguggaccugugguugugguagagagagcagguggccugguauuacagagcaggcuuggccggcuguaggugucugacagaccuggguguaagucugauucaggcuuuacuaugcauuuucuuuuguguccucuguccuaaaugauuuccaggacagaggucccaagccacaaaaguaguaggugggauggaccacauccucuuaaguggugugagcugcagucgcagagaccuagucucacagcucuucuccaaugugagaaggccuuaaucaugggucuguuucuuuaucugaaaauuggagaccaugggcugugucuuaaagugucccaaaguguccuuguggggcuggagggguggcucagcaguguggcugcucuucugggggauccaguuucaguucccagcacccacuugguagcucacaaccaucuguaacuucaguuacagggaauccaaugcccucuucuggccucuauggacaccaggcaaaaugcuaauacacauaaauaaaaugauauaaaaacccugaugugccuuguuucuacuccuuacuuggucugucugcaggcucagggcgugguaaaagaucuggagccugugcugcugcggcaccuggcacagggcacugccucccugcucaucaccaccaagaguagccccagaggagaacuacgugggcagguaugugaggacagugcaguugcuugugugcuccgaucccugaggugguaguauuaaguucuugccagugauaaacaugaagccacacagcugcauagggaggucgucaaccuaacgcccuggcuuugcaacugggacgagucuugaagggcagagucuccuccugggcacuccugacaacagccagcagugguugauagagacaugaaggagaacccagccggccuguuucccucucuucccaggugcacauugccagucagugugaggcgggaggccugcgucuggccucagaaggagugcagaugcccuuggcuccaaauggagaggcggcuacgucacccaugcugccugcuggcccuggcccugaagccccaguaccagccaaacauggcagcccugggagaccccgagauccuaacacauguuucuucgaggggcagcagcggccccacggggcucgcugggcacccaacuaugacccacucugcucccucugcaucugccagguaggauguuuggguaagggacaguuggcuacagggucuggggcaaggggcccaacacaccuucaaagccuuggccccuuucuacagagacgaacagugaucugugacccuguaguaugcccaccaccaagcuguccccacccggugcaggcacuggaccagugcugucccguguguccaggugaauguccugcaggggaggaaagguaguggaggggcguucauggaaaaggaauguucuagggagggaagcaaaggcgacucucugccucacccuuuucuuugucuccacagagaaacaacgcaguagagaccuccccagccuaccaaaucuggagccaggagaggguaagagaggacuauggguccagggaugggaagauccaaagaagccauuggguuggagcaagagggcaauagaguguguguaugggggaagcugaggugcacagacucuaagcacgucugauaguucucuuuagugucuacuggcucuuggcuuaggcuaguaugggacuggccugaggcuugguuguaugcccaacuggugagaccaauccuaauggcagcugggaauucuuuccuucuaggcugcuauuuugauggugaccggagcuggagggcagcggguacccgauggcacccuguugugccccccuuuggccuaauuaagugugcugucugcaccugcaagguauggcugccuaaucuucccugcuaucauaacccagucaggucuacagauagagauggggacuuccuggagagcaagccuguccuugaugaggaggucucaggaugguauugugaggggcagucccugggguuuggagagcagguuuccugugggagggguuaaaaagccgacagguacaagcuuuggcugugucagcugacugaguucacgugacccucagugauuucugaacuuuccccaagcuccccauuccuccccugugugcaaauaugccauccuauauacaaugaggacuggauucagauauauagggcaaacucaggccucugagcauuggccacacauauauuugacuugaggugggaaaggagagagaaagcagugugacgguuguacgucccuccgccugacacccucucucaaugggugccugccuacagggggccacgggagaggugcacugugagaaggugcaguguccucgccuggccugugcucagccuguccgugccaaccccaccgacugcugcaaacaguguccaggugagaggccuggucauugaggccucacucuaggggcuggguaggcccugaccuguuugggggugcaugauggggauggaacggagcuucucagaaacuucucacucgcugggcacugcucauacccacccuggagucagcacccuaaaaacagugggaagguucugcauguaugcaguaagcugacuggggcuccaggcccaucaaccuagcuguucaucuaccuacccagccauucaucuacccauccauccauccuuccauccaucaucaucuauccacuccaucuguaauccaucuagccacccacccauccacucacucaucuauccaccuauccauccauccuuccauccaucauuaucuauccacuccaucuguaauccaucuagccacccacccauccacucacucaucuauccaccuaucuauccauccauccaucuucccaccuaucauuaucaucuauccacuccauuuguaaucuaucuagccacccacccauccacccauccaccuaucuaccuaugugucugucugucuguucauccaucaucaucauuuauuuacuccaucuguaauccauccaucuauccaccugcucauccauccacccaccuauccauccaccuacccauccaucaucaucauuaucuaucuauuuuaucugugauccauccauccaccuacccauccaucuacccauccauccuucaucauccaucuacccauccauccuucaucaucucgccacuccaucuaucuaccuacccauccauccauccauccauccauccaucuacccauucaucaucaucuaucuacuuuaucugugauccauccauccauccauccauccauccauccauccauuuacccacccacccauccauucaucauuauuaucuauccacuccaucuguaccacauccaucuauccaccuacccauccaucaauccauaaucauuuaucuacuccaucuguaauuaauccauuuauucacucauccaucucccaccuauccauccaaauuuaucacuuaucaagaaccagaaacuacuaggcuaggggaauucaaagaaaaguuaaaguugguugacccuuauugucuaacuuugucuucuuuccccaguagggucagggacuaaugccaagcugggagaccccaugcaggcugaugggccucgggggugucgcuuugcugggcagugguucccagagaaucagagcuggcacccaucagugccccccuuuggggagaugagcuguauuaccugcagaugugggguaagugaaggacuugugugauguggcuaguacugccuggccuagaguaggaaaaccuucucagggagaguccuggagauggcuuuuccugaagaggcuaaagacuagaguguccuguaaggaaccucaguaucucuccauucugcaccaggcagggguaccccacugugagcgggacgauuguucaccgccgcuauccuguggcucagggaaggagagucgaugcuguucccacugcacagcccaaagguguaagugaaggaagccacagauggugugggcuggcugugugacucugggagggaagggugccccauggagguaggaacuaugagucugauucauaagugcaaucccagccuaccucuccaggcuucucacuuacuguuguuucuuuacaaaugagacuucugaagcucagaggaauuaagcaaccacacugcaggugguguaugcugacuuucuuggacaacuugguccuuucugggacuggagcagagaugugcugccugccccccacccccacucccgugucuucuuccagaccucucugcuucccaucuccuucugucuucagcagccucugagacuagaacccuuccagagcuggagaaagaagcggagcacuccuagggagcauccagaaggccauaugaccaagaggaugggccugagcugggagaaggaguggugcugaggaccccgacucuccugugggaacccagugccuuucgugccucugcucugcuucuucuccucccccacuaccucugggaaccacaagucuacaaggggaaagacugcugggucagaccaaggccauauccaugcgaacuccugcccuguuuucuuuuggccucugucccacaagcuuaacucuuuucuucuguacagaacaccacuggcuuauugggauucuuuaauuuauccucacucagcaccaaggguucccucacaccauuccugcuaccccugagcugagcagagucauuauuagagauuuuuuuuuguauuuauuaaaacaucuuuuuuucagucuuu

SEQ ID NO: 8170 - RNA, 1175 nt, Mus musculus
gcacacagaagagccaugggaagcuuugaaggacaccugcugucaggaucuggccuccuccuguacucaaucuauuauucaucucuaauguccuuggcccugcuucggaaacagaggaugccuaagcaccucuugcucccaaggaagaugcuggguagcaggcuguuuuuuccgguauccuaugaagcaguggugaaggugguuauggcugcuuuugccauucuuugugaauacuacuacccccuaggggucaaccgucugaugaugauagacuggaaggacccucggcggcuguuuguuuucaaggacaccuggcagcauguaaccauguuuggguucuuuauucucaguggcauagcagacauugugagccaggcaaaacaggcaaguuggagugugaaguuggagcgcgcagcugaagcccuggcuuucuaugugguggcacugcuaaugauagcccauauugaaaacaaaagcgucuuggagauucgagugcaucuucuguuuguguugccugccuucuugcuugcucugauucuuacuguugagaucugggucccugacaaugccccacucuggguccucaagagcuggauggcacugguguuaagcaccuggauguugcagaucugugagauguauauaccuuucacuggacagcccuggagggcagacaacccaacggaccuggcauuccuaaccauuuucuucugcuggcaccuggucuuagggcuuaccuugcugauuaccaucuauggccucugcagucucuggcaccaucacuauucuuccuggacaaagacucucggggcuagguaccagcggugucuuacggaauccaguagugaagaauuagaaaagcucaaugcggaagcuguggcacaggauggagguguguaggaacagcagccgucucgagugugcaaucacauuuuggaguccacagcacagcucuccaucccaggaucuagcuuccuuauccucaaauaaaccuuguagcucugaggauaacuccuuauuuaucacuucguuccauccaggucagucucccaucugguuccuuaucucuacgguuucuggucuuucauauggacagaacaaaauggugcuuuccuguaauggguuuugguaaauuuucuuauuaaaaaaauaaaagaacuaaagaaagaaaaaac

SEQ ID NO: 8171 - RNA, 858 nt, Mus musculus
ugaccugagcuccucccugcgccggcgaaucaguucuucaucuaaucgguguauacaggucccuucacuuuugauuuucucaaaauguuucuucacuucuucucuccauucagccugagugaggaaaguuuaauuuugugaauguuguaguuuccuucccugacggguccauaggaccgugugcaaggcauuuccuucugugccucugcaugcuuuccccaaacuuccuacaagagcuccggcaggggagugccagaagugccaaaucaaaccccaaacauccccaccccacccucuguccugacacagugcugucucuuuuccaguuucuccacagcaguggccaucagaacagcacaggguacagugaucuggacaaaagugaucagcugacggcaagggaguauggaggcagaaagaaaguccugcugacggagguucacaggucugggagguucugagucaucuucacguccgcugucacacuggcuuugcuuaggacaaaaacccaagagaagcucagaagcccagcaucccagagagacacagccccugcuugcacuguuaggagucccaugagaaugucaaguacacaaccaugacacauacggacaggucagaccuacauaggccccugggaggcccugugagcucugcuuaguugauucugugggccacguucucgugguuucuucaaccucccuggcuccuacaauuccuccucccuuucucacuaggauucccuaagcuccgucuaauguuuggcugugggucucugcaucugccccuacccuaacauuuauuuuugcauuuaauuuuuagucaauaaauauauguaauaaacugucucuucugaca

SEQ ID NO: 8172 - RNA, 477 nt, Mus musculus
cccagcuaggcauggcgauggcgaagcgguucuuugaauccuacaaugagguccccgaugguacccagugucaucgcaagaccuacaucaccacugccuuaggcggcauuugcggcauaaucggcuccgcuuacagcgucacacucaaccccacagacuccacccuggaagcaguggccagagucggccgguacacacucacugcagcugcuaucagagcgauguuuggccuuaccaccugugucagugcccagguccgagagaagccagaugacccccugaacuacuucauuggcaacggcgcaggaggccugacauugggagugcgcacucacagcuaugggaccgcagccaugggcugugucuacaugggcacugcagcugcccuguucaagaucggcaagcuggaaggcugggaguuguucccuacccccaaggugugaaccaaaccccuguggcaaauuaacacuguauguc

SEQ ID NO: 8173 - RNA, 477 nt, Mus musculus
gacauacaguguuaauuugccacagggguuugguucacaccuuggggguagggaacaacucccagccuuccagcuugccgaucuugaacagggcagcugcagugcccauguagacacagcccauggcugcggucccauagcugugagugcgcacucccaaugucaggccuccugcgccguugccaaugaaguaguucagggggucaucuggcuucucucggaccugggcacugacacaggugguaaggccaaacaucgcucugauagcagcugcagugaguguguaccggccgacucuggccacugcuuccaggguggagucugugggguugagugugacgcuguaagcggagccgauuaugccgcaaaugccgccuaaggcaguggugauguaggucuugcgaugacacuggguaccaucggggaccucauuguaggauucaaagaaccgcuucgccaucgccaugccuagcuggg

SEQ ID NO: 8174 - RNA, 104293 nt, Mus musculus
gggacgggcagggcgcgcacucucggcggugcacacgccgcuccaacucucaggcgcgcggggugcguccgcccgccgccgccgccccggcaccgggaggcagagcaagcgcuuuguccgcacgcccgcucgggacucugcccggaggaggcagccgcgccgaguccccgccuccgccucugcccccgggcgggccgggccggccgcgguggggggagccaggcugagggcgagggugggggcgggggcgggcgcaggaggagagaggagggcagcggaggcggcgggagcgccgggugccgggccgggggagccgcgggcucucgggaagacgcggaugaugaacaagcuguacauugggaaccugagccccgccgucaccgccgacgaccuccggcagcucuucggggacaggaagcugccccuggcgggacagguccuacucaaguccggcuacgccuucguggacuaccccgaccagaacugggccauccgcgccaucgagacccucucgggugagcacucggcgcagcccacgccgcgccucgccggcucgggacggcggcagcggggaggccgagccccaugggccgcgcccgccgcgacucccgagcccucacgcucacuuucacgcaccagccccgcgacucucgcggcgggcuggcuccgggauggccggcugcccugcccccaccgcgggggcuaacacagacccuugggccucagagucgaggcgacccugugccccuccgaggguccccaggcucgcuggcucccuaggagcgccccuggagugcccagcugcucuccagagcuucccccgcccccaccuuugcagagucccccguuuuucuuuuucuagacccuucuaguacccccuuugccagggacccccccaaauccagcaucucuccuccuagccagaccuuccuucuucccaugccucgugccaaagaccucucgcccucugucgucucccaagccgcacucuccuuuugagacccccucuugucuucuggccccccacuuucggcaucuccucgacuucaccuacugaacccuucgaggucuugggguuuuuccccaccuggcccuugucggaccgcacaucucccucgguccuuucccgaagcucaguucccucucucuggucucggaagcgcuccuauuuuucccugaauuuuuuguccgauuuuauugagaagaacucggggcugggggcuuuccgccucccgucuccccgccuccugcucggccaggagcaccuuuuuacgagguacccugucucaacucggugggggcccgggcugagaaccgggaaagaggcgaccggggggcccgcgagcgcgcuggagcccggacgggagucggagcgcgacacucgcccgcgcgcgcgcucccagcucgcaucccgcacacgcacgcggcgggccacgcucccgggggccugggacccccggccccgcaagggaacccccuucuuugggaaaccugugcggcggggcaagcuggcgagaccuuugggucaccccaaagcaggcguccgcagagccagggacuccugugcguguccccgggaccgcugucagggagggcagggggcgagcgccugggagccuccgggucccgggauggcgggauggggugcugggggccggagagaccgaggcgcgccagccuugcagcuugaguuucaaaugagcucaucuuuucaaauuggcgccgcucuuuauuaaauguguuuuuccgguaaugccacccacagcuauaccuggggucggaaccgggcuugcgcccgucccuccucgcucguuacccggggcguccacuuuucaucacaguuggcgcuaaguucgcccagcugcggccggguggagaccccuugaaggcuccagaaggaggagcccgagcgcggaguagugugcgagccccuccuugacccccgcggguuugacucugggagguucugagugcuuuaaauuucuguuuuaaagguaaaguggaauugcaugggaaaaucauggaaguugacuacucagucucuaaaaagcuaagguaaauauauuuugccuaguucuuuuuuucuuuaccccuucugugguugggcuuccauacgcauaacuaaagaaauacgcucagcuuaaaaaaaagugccuauaucguuuuuaaagggguuuuuguugguuuuguuauuggacauucauagcuuuaaaaguuauuauuguuauuauuauuuacuuuuguucuauaagguguuuucugugcuugcaaacuggugccuaauuaggggucgagauggagaacacuagguggauucaguuggcugugaccgauuaaguuuaucauaaauugccuuucacuccccacggccaucucuaaccccaacacaauagcaaacuuccugugagauguuaagaguaaauauuuacuguugucagcugaauugcuuaacuaaaccaugcgauuaauuuuuuuugcauaguuuagugaugaauuauaaaauaauucaguaaauacggaggguuuuuuggacaguauuagaaguagcauguuuguauuggauugagggagaagccagacuuuaguaacugaagcgcugggcuuggauccugagcacuuuguugucacuguugcuuuagagaaacguugggggauaaacaaugucucggggaagucgauaguuagcuauuguuaaugaaggaguaacgcgcucuguggggguuggguuuccccagugauucucuacggaagaaugaaggagaacaucuuugucuaaagcuccuuguguacuuuaaauugggagucuuucuucuuucuauccccacccaccacguguccuaacuuaguuuucuaucccauuaaccaacguuucuuugccguucuucauuaagcaucugaauuggggaggcaaagucugauuuuuuuuccaccuccuuagucugaaguagaugcucaaguucuaucaggauuaagaacauuuuaaaacaaauuaauuuuauaaauacuuggauguguuggagggucuuaaaaaacauugugugcccaguucuacgcacaucauaauguaacagaaucuguuuggaaaaugguugugccccauuagaaagcuguuuuaauacuuuuguuuuugaaaaguuaggaauucugauuuucagucugggcuguuauacugaacagauucucaggcugaaaauguguagcugguucucuguaaagugucuuaugcuuauauuuuccuucaguggcauuauuuuuuuaaguugggauguguaaggggauguuuucugggaugcuaaaugcauucuguaaguuuaaaccauucgucucuuaacaguugaagauuugaugaauaauguuaggaccacugagaauccuuaaggcaguaugcaucuauaaauauuucauuuuuguuggcugucuugcucuugugaaucuguuuggagauuaaaauuaacaaaagucacuaauuuuuuaauugagguuauuugauaucccauuauuccacaaugcaguguauaucauuuaauuuugaaaauaagugaaguacuaguuuauuuaaagucaucgugaucaccuaaaauuuaacaaaaagaccacuuuguuuuuuuguuuuuaaauguaggaguuguuugcuuuuuggcugaaaugucacguaauucugcuuaugauuucaaaaguagucaugucacaaguuuuagcauaaauuaaauagucuagggcgucuauaggaauaaacgauuucuuugaacauguugacauuaucaaauaacuuggaggaaucugagagcaggcugugugauugacuacaccugaagacaguuaacauuccaaaugcauggguagccugcuggagagagugcucucucucucucuuucucaguuuaaaaaucaaaaguuaccucuugcugugcuaaaggggagaaggcuaaacugguuggaauugauuagcugagguccuucugggaugagacaucauuaauucuucauaauucugggcacaacuaugccuuauggcuuaaaaaacaacagcaaaaaccaaacaaacaaaaaacaggguacugugacauuuaagaccaaagcuuucauguuaugcagugauuauuuuuguguucuuuuauuguuuuuugaugcaaauugacaaguuggaaguaaauuugugaacuaugaggguaagugcuguauguguuuuuuugaguuuuguagagaaaacaaguuauucucucuuguuugccuccuugaaaaaaaugauucaacaauugagugauaauuuuuuuuaauauugugcuuguuucuuugauuucuuagggaaaucacaucuauaucccaaauacuuuuuuuuuuaagcuaaugauaguuuguaagaugcuuuagucuuuguggaauuauugguaugcuauuugcuuaccacugggucuucaguuuaaucacauagcaucauuuuauacugguggcuacaaaauagacagacuagacacuagucacccuggagaggauucuuuuucuuugugcuacauauguuucauccuuuguaagugcaaaguauugucugucuggcaaggcaugccauuguuugucccacguacauucuccuugauuucagucugcugaauauaauuuuuuuuucuguauucauauaguaaguaccuguaggucaaagauuuuuaagaggaaaaaaaaagauaacuuuaaaagugcuguuaaaaguuauggaaacuuucuugauagaaauuuuacuauggguacugcugaaaguuuaucuaagaagccaugucugcacacggguacacauacugcauaaguuguguugaccuaagacaugcuaacuuaaugugcuuuugucccuaaaguugaaugauucugggaaaaaaagaacuuaaaaaagcaggcaguaucugcccacuucuaggaaguagcugaaugaugguagauaggguucuacugggacaguuagauccugcgagguggagcagggaaagcugugaaucugucuuucaugaguuaaaaaucaguaacugucuucucuccaaugcaaaugaauuugggcuccuauaggaaugcuaaagaaaacaguaucccaauuguauuuugcuuguauguacuacauuguguauggcugaauuaaauaccaaccccccccaaacccacccaacuuccagcccucccuauaacaaaggcuuuuucugcauuaauuuuaauuuucuagaaacaagaaagaccuuauuaguuuuaaaucuuauuuaguagccuucuauuucaagacuuuguugaauuagaaaauaauucauuauauauguggauagauuaauacaaugucacaugaauauuaaacugcaaagucacagauuuagcuuuaaaauggcaguagcacauuuuaaaaaagauaacuuuuuuucccuuuauuuucuaaagaacacacauuuuccugaucucuagaaauuuaaaucuuauuuaguagccuucuauuucaagacuuuguugaauuagaaaauaauucauuauauauguggauagauuaauacaaugucacaugaauauuaaacuguaaagucacagauuuagcuuuaaaauggcaguagcacauuuuaaaaaagauaacuuuuuuuccccuuauuuucuaaagaacacacauuuuccugaucucuagaaauuuaaaucuuauuuaguagccuucuauuucaagacuuuguugaauuagaaaauaauucauuauauauguggauagauuaauacaaugucacaugaauauuaaacuguaaagucacagauuuagcuuuaaaauggcaguagcacauuuuaaaaaagauaacuuuuuuuucccuuauuuucuaaagaacacacauuuuccugaucucuagaaauaaguguuuggguuagaauagaaaugcuaaagaaaaaaauuacuugguauuuagacaacaauguagucuugaaauguuuguaagaggcuagcacuuaacuuuuuauauauuguuaaacauuagaaacaaaugaggucuacaaauaaaauaaaagagaauugauacauaguccauuugcuacauugugcuuucuaauaauaacauuuauuugcaacaauagauaauaaaauggccacuaagaagucccuuaagaguuaugugucuuguuguguuaagcugagguugucauuucauagaugaggggaaauuaauaauauuuggagaaagcuuuuuauauaucauggucugaaguauauuuucuuuaagaaaugauuuuaccuuuuaaaauacauuuaaaagauuagaagauucaaaacuaauuacaugugaaaauuauuucaucuuuuuaaaugugugugugguuuguguguagauugcuuuaaguuucuuagugcauucaagaagaauguuaaugauguuguauuguguauaaaagaacagagaccagggcaaauuugucacaagacagaaaagcaguaaaaaaacaaacaaaaaaaaaaaccaaaccaaaccaaaacaaaaacaaaacuuuuagaacuauuuauaaauguuugauauuuucuaaauauuugcuaucuacaacugaaucacuauucuaugucucaguuggucacuuguuaccaaacuaaauugucaucccucugauugagcagugugugugcguucugggggggcaguaguuuuacacagaucaaguagcaagacaaagaggagaucuuuaauugagcaacuguuacucugaguuucaguucagacaaaaucacuagaugauugaaacucacaaaggaaggcacacauaaugccaucuuccccgagugaugcccagcuuuuacaggugccagcgaggacacagacaccugcagaagacucuucagugccaaaacuaccuucuuagaguucucucaaauucaauuccaugaaggcuuugcucuccccaacaccccuacacacacacacacacacacacacacacacacuuucauuuuauuuuuaagacacagccucucucuguggagccccagcuguuaccgaacccaugaaccucuuugcuucagccuccugagugcugggaucauaggcacacacuccugagugcugggaucauaggcacacacuucugugcccagcuuuuaaaguguguuacugcaugugaauguucgcuuagaaaugcuguacuugggaggaugcuuuguuauuuuuguacaacuaauuauggaucaguuuuuauuagaagaggcguagaauuggaagcugcuuagaaaauuauaaauauaauuuaagauauaaauuuaaagaaugcauuuaaacaucgugaguguauuuucaguugguuucuuuuuuuuuuuuuugagacuguugagccuuggcuaaacuaacuuuuaaaaaaauguguugcuuugaaacuucuagucaaaagcguaguaucucaaaaacuacgucugacuucuuaauuugagggacagaagaguugugcuuaagaaggcaugccuaaauaauugauuggucuguuuuguuuuguuuuguuuuugcagucacugggaaguacaaauuagucugggggaauauucaacaauauaauaaacacauaaaagcaagcaaauagcauauaucuaccaguaaagacaacucuccccuucuucuuauuuauugcauuaaaccauuugaagcuuuuugcucuauaauuugacuuggugcuuacaaacuuauaauuuucguuugauggcguggguucuauuuuaggcagcaaauggcggaguguccugaauuauuuuuaagguuuuacuuguccuguuuugauuauggauuuuagucugguugcuucacaaaauacgggaaagaaauuauuuuuuuuuuauuacagaaaaccuuagguucugucgcuuucacugucaaagaagagaaaaaaauuauaauaaugugucuucaaucuaguucagaguuggguggcauguugaugcuggauaaggagagcagaaacaggugcuucuguggaaagggccaucauguccacaagccaacccuaaguccaugguuagacaucgccucccgaauagugauagccagcccccuuccuccaccccuaccccgacccccaagcaauaauuuuguauuguugcuuauucuugcaccuucuaauuguuuaggucucuuauguuuuuauuuccuaaaaugcaaacacuuaguuacaguuuuccuggucuguuaaagugggcguuuuaaguucagugcuuuaccuagcaaauagaaacacuugugugaacuuuugcaaccaaagggauguuugcaauuuaucucauugcuguguauuuacuuaauacauauggaagugugaauugacuuaacaauucuuaaagauuuuuuugugaucugguacuguuaugaacacgguacuagagagcauugugguaagguguagcucuugugacugcaucuuaaguucauacaguaauaaagcuauuauggccucuacgacagaaauuuuacuuuuuuaaagugagauuuggaaaggggggggggaugaguucuuuucucaucugaggaagcuuagucuuagagaaauggagucauuugucuaaggcagauaaauagauucacuagcagggaagaacccaggccagagguccaucacaauucacacuuaaucagggagggcccagaucccaucaggaaugauagaacuuguuugucaagugcccaaacuugcaacugcuucauucuuacccugguccaaaugaucugaucuucugcgcuacacuauuuuuauaagaaacauaauuagagauaggcacaauuuuuuauuauuuuauuuuuugguuuuucaaggcaggguuccugugugugacagcacugaguguccuggaacucacuuuguacaccaggcuggccucaaacucacugagauccacccaccucugccucugagugcugggauuaaaggcauagagacaagcaagucauuuuaaaagcagcauugauccuugcuuuauuucugcuugccguagacaagagaguggggcauuuauccagggagguguuuggugguuuuguuuggcugcuacuuauacuguuuuguuuuuuagugguuacauucuuuguauuaagaaauagacagugcuaaaaaggacauuccucacuggggacaguggcacacacaccuuugaucccaggcuagccuggucuacauagcaaauuuaaggggagccagggcuacauagagagacccugucugucucaguaggccauaaaaccaaaauaggacagcgggcucaacauuugagccacaaauuaggcacugacuuugguucuggucaacguuguaucaccuuucugcaaaguugaagaauucaccuggugggcuucuccaagcucagccuguugcaggaggcagugcuguguuuugacuuguuuccuuggugggagcugccagucuuucuuccucugcuucauuuucugugugaagaaggacuuugaccccugcuuugaguauaaaugaagguaugccaugaauggagucaaguucuuaaugacauacucaggaacugagcuggugugcagugcccuucaucucugaacuguaauguucuccugaacucaccauuugguuuccuuuuguugacucucaugguagugguggugggacagaggguggaauuaucgagaaaaaaaaaaguaggugaaggguuaauuucuaacuucuuaugcgggucuucaaguuguacagcucagggcuugauguggcauuuucuguguaguugugacucagaggaugggacaggaagagaguaacuaauaauuacagagugguagcugcaucuugugcauuuguggcuguuucuuuaguaacaugaaacucauuuucuucuauagagggaggugguacuuuuuuuaaaauuaacuuuuuauugauucuuugagaguuucacaauacguaccccacucugacucaucucccccccuugcaaaccuccccccauaaaaaauaaacaaaaaauaagcaaaacaaagcauagaaaacaugucaucauggacgccauaguaugucacaguguguccccacaguauagcccucuguucacagcagaugcuguugcaaugagucacuagucugguuugaggucucuggcuucugugaugcuaucaguauuggauccucaccuggucucuuccggguuaucccuuuguugcgugcgcugugucacguauauccuucagcaggaccgucaggacagcccucucacaggccccgcccucucacagccccaacaguggaggugguacuguuuuuuuguuuuuuggguuuuuguuguuguuguuguuguuuuugguuuuucgagacaggguuucucuguauagcccugguuguccuggaacucacuuuguagaccaggcuggccucgaacucggaaauccgccugccucugccucccgagugcugggauuaaaggcgugugccaccacgccugguggugguacauuuuuaaccguaagauaauauuaugaaauguguuaaauuguaaaggauaauuucuuuccucagucaagcuccugaagguagcuuaagguaucagaagagacucucucuguguguguguguguguguguguguguguguguguguguguguguguguguuugugugugugucuguguguuuucaaggcaggguuucuuagugcagcccugguuauccuagacucaguucauagaucaggcuggucuagaacucaagaagccugccuggcauuaaaggugugcaucaccacaccuggcuuagaggaugcauuuuuaauacauaucuucuuuuacccuuuucuuauugagaaagcaaaaaaacggaguggccuuccugugugcagguagcuuccuaucagccacuauugaaugagaugcuggccgugcugcacugcugugugggucuuugucuccccuuggaaccuuuuccuuuagcuccuugucucugauguuaacaacccuacuuugaaaaauggauguuuuucuucauauuguauaugcucagaguuccgaagugcaguucucuguguauuucuuugucagcugucgaugaugaaagauuaacagagaaagagcguuuaguccucucaucgauuaagaaagaaaggagggagggaggagaugccacagaagcagccccuggguggcugaagccuggggugccgcugaguccucugggauuuccagagcacagccagggcugggcagcucuguaaccuuucuuuccuugacgauggaaaccuccuggugugacuggucugcucaugcauuuuguucuuuaagccccugcacugaccguguccucucccccugcuuucccuuugcaguggugcuaaggaagccggcucgcaggccugguguguaugcuagccucagugcccccccccccccccccccccccccgccagcuaagguuuggggcagcccaggaggcacgugugugcuugcucaguguguuggaaugcaugaucucuguggcacacacuucccugaccugugcagcugacacaccagcuucuauggguguggggccacgcacugcagaguuucuguaaaugguugaaagauugggggaaagaguuucuucucccuggugaagguuuuuccucauuaagugcaguugucugcauucuuugcaaaaggaagacaucucucucauuuccuucuuaauuauugaaggauagaaaagaaucuggaccuagaacucaucugacuucugcauccagcuaaugccuugaagccuggacucugacgaugugcuugaugggacaccugagaaggagggaaucgaguaucuuuagaaguacacacccuauucucccuuuuagggaauuaaaaaaaaaaaggcuaauggcuuaagauuuuuacauuuuagcugcuuuuauucuuaaaauuuuauacauuuugucuguuccucaugaaauacccaagaugacagaaauaggacugagaguuuguaaaagggcauuuuguuuuugguguuaaagaggccugggaacaucugguugcaucuuagacuuuugaccuggaaaaguuaguucuuuuguccauugauuuucauauaaaugguuugacauguuuuauuacuauuucaguaaugcuaccaaaauugauuuguagcuuuaguaggguuuuugguggugguguuuguuguuuguuuuuauuuuuguagacaggguuucucuguguagcccugaguguucugaacucacucuguagaccaggcuggccucgaacucagagauccgccugccucugccuccccagugcugggauuaaaggcugcuacugcugcagguguguggguuagcuuacuugugaugauaaggucacaguguuauuucugccuaccugacagauuucaaggcuaagcucugaguuugacuuuccauggcagugguuuguagcacugccccacgcacagagccugugacugaggaucgcugaguuuguuuauggggccaaggaguagcuguguguucuggacaacuccaugcuugcggcugugcucagggcugcuguagacucuguaguugccucucaaauuugguuuagaaagaggugugguauuaagaaaaaagccuaccggugugugaggucuggaugaucuuaagccagguuuugauugguuuacagagcacccagcccuucuccugguccccugggcaccuucccucuuguguaguggcccucuggccucugucacuuucacuuuagaaacugcuuugccaguugcauggcaggcuuccaaaucuauggauuuuccuguagucgacaauaguuuccuuuaggaacuucuaggcaagcagcccuuuacagauccacuggagucaccuauguguggugacaugggacccuuaccuaaaagggacaagcuuucacuuuaggcuuucaugcucucuuaccaguugaagcugcacaggaguaacauaaucuugaaaacauuaaacggguuagauugacagccagucagauggggugggaguugucauacucuuuccauaucacauggaguuuauucagaaaaaggguauuacccuuaaaaacggcuaaaaauaauaagguagcugcuuagcaaguggaaggggauuguggggguguguggaggacaguugggugaauguaaacaaaguccauuacauccacguauguaagaacaggaaagcguccuaaugaaauccauguguuauguguaacuaauaucuguuaauaaaagcauucucuuaagaaaggccagcaagaaggcucagcaggcaaaagcacgugucaaucaagccugauagucugaacucagccucgagaaucaacuccugcacgcuguccuccggccuccuugugccugcuguggcacacccgugcucagacucacacaaacacaaagaauuaaauaaaaacaaguuuaaaaccuaauuaaagauugcaaacagaguacaaaggaagucaugguuacauuuaucauguaaauuuuauuuuauccuuggggagucgagugcaccccagcaugugggugagacuggaagggcuuccuucugccuuguggguuggaguguuaaacucaggcuaccaggcgugcaccuucacuccugagccauguuauuggcccaugauuauauuauugaugacuaaaauguuuugaauaaacuauaaaguagccuuuaaaucauagugguggcaagauaucaguggucauaccguguaaaauaauccccccuuucuuacaccguucuuuuuucuaaucacuuauuuuauaggucccaguaauaacuaauuaccugagaguaauuauaggucaaauacgaauuuuugaaacauuugucgguucuccuuauuuuuaacucuuugaggauuuugcacauacucuuccaaacuccucagauccaccucccuuucucccuguccuccuuucaguuuuuaaaaacguacagcuaaauaaaaucuucaaacccaguuugcacucccccccccuucaucagcgugagacuccuccuccagcagccauuggcuggcagcagcucccuagugggugagcuaggugggaugggagcuugcaccccucuccuccacuccaugcuggaauguucauugguuugaucuuagcaggcaagcucagcugugagcucaugaucuacccugugcuacccugcuuauaaacccucucugaaucuucugggguauguaaauucuaguuucuccuauuggcuuugucuauuggcaaaaccuggaaggagaaaaaaaauaauuaaaaccaccaauucuuuaguuacuuuuaccugaagcuagggacuguuagggagccugcagggcuuaggaaccccaugggugaugcccagcauggugcucugcuucuuccugcugccucuugccuuccaggaucagugaccucauacauauauacauccaccuuuugcaauaagaugagagcucacagguuccauucucagguaucucuagacaacugcagcagcagcagcagcaggugguggcggcagggggguuucuagacugugcagaagagagcuccagccgccuguggccacugggaaguguagggccaguguuugcaaauacaauuuccaagagaaagauuaaacaguuuuuaaugcagaauccuuauuuauaguuauauuuuauauguauuuugccuguauauauguauguguaccacgggcaugccugaugcucauggagguucaaauagggcauuggauccccugaaaguuggaguuacaguugguugugagccacucugugggugcugggaccugaaccugcaauccucuggcagagcagcuggugcucuuaucuguugagcaucucuuuagcuucuaaaccccgaaucuuuaaauuuugcuaacaguucaaaaaauguuuguaaacauugaggauccagaaagacacagguagagguuaaagaagacucagggguuaauaacauuugcuacucucuaccaugugagugucuguauccauaaagugaaugcauacacaggagcugaagacacuguggagagagagagugugugugagugugugucugugugugugacugugagugagugagugauggagugugugaguguaugugaguaugcaagcaugugugagugagaguaagagugacugugugugugugugagugaauacaugagugugugugucucugugagugagugugacugacuguguaugugugaguuaugugugugaguggcuguguaugucugacugugagagugagugagugaaggaagggguucugagacaagacagucucuguguggccccagcuguccugaaacucacacaaaggucugccugccucugcuucccugagugcuggugugcagcaccacacccuacccacugcccacuaucauucuucguccacgagugauaaauaagaggaaaauccuucucucaaagggcuggauguguuguguccuccacauuccucugugugugccuguggggaccagcgguugacaucggccguuuccucaaccacucccccuccugucacuuugucuugagacagaguguuucauuaaaccugaagccugccauacugccugucugcucacugccgggcuuauugaauaccuguuuuguggagccaucuaaaaucuuuuuaaauauaggaaguauauauacugacuauguauauugucuuaagugcauguauuacacaaugcaggcucauaugauaaaauauagcccucuauuuccacuuaaucggcaaaauaauuugauuccacuuucugauccagacaaggcaacccuagcaagugcuguaauucaugugcuagggaaaggugagucucugugucuggcaagcacuuuacacuuuuguuuuacauuucuuugugaguguguguaugugggcaugcaguagaggucaggggacagccuucaggagugcuuucucuccuccuccuaccuagguucugaggauggaacucaggacauugggcuggcuggcaagccuuuacagugugcuuugaauaaggaaugcccuccacagucgggcacauggacacuuccccagaugguggcauccucugaaaagguguaggugcuagagccuugcuugcuucaggauaaaaagccuuugcuaccuggggcugaucuuugagaugaaaaaagcuugcagacuucuaguuugugcuugcugacuucuaguuugugcuugcugacuucuaguuugugcuugcugacuucuaguuugugcuugcugacuucuaguuugcugccucugcuuugugcuuguggcugagggugcgagagcuuagcaccccguccccacugcaaugccugucaccuacuuccaugugucccaccugccugccaccuacuuccauguguccccaccgugauggauucuuaacccccuggaacuacaaaccaagauaagcccuucuuuaacuugcuuuuggucaugguguuuuagcacagcagcagaaaaguagcugcuauaaccauugagccaucuugcuagcucagauaaacacuucugaaaauauguuucagguaaaugucuacuauaaggcgacguagaacguuuuaauuuuuuucuuagaaugacuggccugagauguguaauuaccccgccccugcuuuccugugugcugggguaacaguugugcuccccacuccuugaaaaggcagauggguuugaaaguaaaauagaccaguaaagaaauauguuaaugaaaagcaggguguuuaaauagguuugaaaguguucugguuaggguuguuacuuuuuguguguuuaaauugaggcauuugaagacuguuuagauucugaucuuuggcucugggugcaauaaauacgcauuaaagccaaaguagaaauuguugacuuaagagacauuuaaaaaaaauaaaaauaaaaaccgcucugagggcuaggauguagcucguugguagggugcuugcccggcgucaggaagcucugauucagucuccaguacugcguaaaccuggugcaguggguccccugucaucccagcauugcauggggagccaucagaaguugauccuccguguagugagucagagccagccuguuugugucaaugcagauacuacucugacaacuagaaguaccacuuuaaaacggugucuuguacuauaauucacaagcaugaaagagcuggucacagucuccagccagcauaggucagauaccaguuuggaauuucaggauccaagugguuucacaaagauggccaacccugauuugcagggcagggugaugaagagaggggggacuggagaggacuggucuuuggcuacauuuuucuuccuccuccucuucuuguuuuuguuuuugauuuuuaagauuuuauuuauuuuauauaugugaguacacuguugcuguacuucagacacaccaggagagggcaucaggucacaauacagaugguugugagccaccaugugguuccuagggauugaacucaggaccucuggaagagcagccagugcucuuaaccuccaagcuaucucucuggcccacauuucuuuuucuuaaagacagggucucacuauguuauccuggcuggccugcguaaaucaggcuggccuagagcucauggaaaucugccucuggaauguuggaguuuuuuguuugccagagcaaaugaugggauuuaaugcacauauaucaccauucccagccugggcuggucuucuaaacagaaacacuuuuuuuuaucacugugcagaccaagcuggccuagaaggcauguagaccgggcuagccuugaacucauaagauugaccugcaucagccucccuaguuuuacagggcagcgugcacucuuaaagguccacacagacagacaaauugacagcagcucgagcugcugcugcugcugucauuggaaggcuuggugguggcuccugacagcacauccugcuuuuuaguucuguugggaucaugacagcaggcuuccccaacaugaggacagaggagagugaugucaccagcugccuuccaugaccuugguguuguuuuugcauacccucccuuuauuagacaugagacacuaagucuaggccacacacucgggauguuggacaacuuugggagcugugguggauguugaagucaaucaggaagcaacaaguagaugcgggcuuucugugugacuuucacugacaggcaaggaugccaacacaguagcuucacaguuagcgccuuucagagugaaacuggacucuggagaaugauggucgaaccuguuguuggcuacugagugguguugacuccguacaccuacagguuaaggaagccauccacucucuccauuucggagacuacagagugaagcacaggauuuuagugccucuggugaggauacauuuuuacucucucaaccucaguuuuagauuuuuguuguuguuacuguuuuaaccucuuucucuucucugaagaguaauuucagucagacaacucuugguagacacaacuguucccucccugccucgccugaaagagcuaaaguuuuuaaauaccuaauugaagacacaaaaaacacuuuucuacuaucaauacagauguuugcuacauuucugccagcagcagagagcccuuuuugcuauuuuuguaacugggugaggucugauuucuccagaauuacgccauacugugguuagccguggccuacaagagggaaauagauuuacucuuuaaaaucauggguuuucuaagaaaugugccauuuacuauccaaacacgagcaucuuucuccagcagaacacaguggucacugugauauuagacacaugcaguucucuccacccccuagaaaucgaaagccauggguccguagaucuuuggccccuaccuuuaucacacacuagaaacacacugcagacacgucuauugggaccugucguguuugaagagauuugagaguauuuagagauugucuuucaugucgagcaugucucuguuaggcaguggaagccagggccuacagcauucuaagcaaauguagccaccgagccguaucucuaguauaagcauaucagguggcuuguucuguauuuuaccaaacggacgccaguuucucagcuuugcauuuaggcugcucugagcuacuugccuuacucagugaguauaauaacagucaugauuaaaacuccucuuuaagcucaucccuggcuaucugcaaugugcuuauuccuggaauacauguaacguaagaaaaacguuucuggggacauaaguuauguggcaugggaaguuuuuucuuccuuuuaaaaauaaaaguuacuuauuuauugucuuaguuaugguucccauugcuguggggaggcaccaugaccaaaagcaacuuggagagaaaaggauuuaucucacucucccauaucacaguucaucguugaaggaagucagaacaagagcucaagcagggcaggguccugggcaggagcugaugcagaggccauggagggaugcugcuuacuggcuugcuccucauggcuuacucagccugcuuucuuacagaacccaggaccaccaacccagguugguaccauccacaauggucuggucccuaccccaucaaucacuaauuaggaaaagguccuacagauuugucuaugaccugaucuuacagaggauuuucucaacugaggcucccuccucucauaugacuuuagaguauguuaaguuggcauaaaacuggccagcacauguauguauauauguguacacaugugaguuuuuguguaucaggugcuccaaguaucucugggagccugugugugugugugugugugugugugugugugugugcgcgcgcgugccuguguguaugucagguccucuggaccuggaguuaaugagaauucaugacaaccucauguggguucugggaaccaagccucuguccccuaagagagaaaugauugcuuuuaacuacugaacggucuucagcccugguccuuuccauuguguguagagugggucuuagaauccuagucccuuuaguguuaucuacuucagaaagaaagguacuuuuuaaaauuuauuuuaaaaaaugcaaugcuaaauuuucugcaaaguuuacguauuccacugaaccaguguauauucccaaucguucuucuuacucccuucucuccuuguuugagacuggacaggaguucacuaucuagaccaaccaaccuggccuugaggcuuguagauccuccugccucugcugcuaagugcuggcaucaaaucucugcaucaucaggcccggcuucuggccugugaucugaguaguuugcugauuccucuacaguuuaaaauguugacuaugugugugcgugaucaagaccagaggucagccuuggaugucauuccucaagagcugugcauuuugccuuuugagauagggcuugucacauguuagucugaaugccugcauauguuugugccugcaacuguaaguaggagggcaaccuuggauggaagauagucucuucuggucugcagcucugagagggcuggacugguggccacugagccuccggaaagcaguuugcuuuacucucuagcccgggaguuacaagcacucaccacuacacuuagacuuguacaagguggcccucugugaaguaaccuaaguguggacuuugagaaaugccuuugcguuaggaccagcuaauacuugagccucaguuuguguucccagcuccuaggagccacaggaaguagguuccauuucccauguguccuucagcacaaauaucugaaccaccacucugaaaacauaagcaauucaagaaaguuagguuucccugaguuggauggauacgguucacuuauacaguuugcaucgucaguugaaacuaguugaaaaggaaggcagugauaauuccuguucagaugcauuaaaacacuacuuucaaugacauacuccagcccggguguuugucagacuuggcuguguuaaacuccuaccacgcuuucucuuugaguaaaaauaugacguguuucuggugugagugcuguacaaaugcucuggaaauguguuuaguuagcuuguucucuggugugguuuaaagugccuucuuugugauggugggauauugauuuucucauugugucgguguccugccucaggcuccugagugcuggggugucaaguaugagccaccagccccacucugugagauugagucuaaagguuugcauucaugggacuaagaugaccuuauggcaagagaggcuugcagggcuugaaaucuuagucuguauccuccacaucagcuugcuagagcaagcguuauaccaguuaacaucuaaaguuauuugagcucuaauggagagguuguauuaguugcuuuuuuuguuguuguugcuaugauuaaaaacauuaugaccaaggcaauuuaugaaagaauauuuacuugggcuugugguuucagagcguugggaguccauggugguggaucaaagacaucacaacaggaauagcugauugcucacaucucaaaccacacacagcacgcagagagcucacuggggaugguaggaguuguuugaaaccaguggcacgccuccuucagcaagcccuagcagcuuaauccuucccaaacaguucuaccaacuggagaccaaguauugaagcauaggugucuaugggggccuuuuucauucaaaccaccacagagguauuuaugagugcuuuccuugggaaacaguuucauucuaggcaucgagucucagccaggucauuucuuuuagagacucaaacauuguggcuggugcuuuagucugcuggugggaauaaaggggcuucucuaccucauggugauguuguauuguguugaaauaacccauucauccccacugggcccccuccuguuuucacgucucugugugugcuccacuguguuugguagucucuugugcagcuugcagaggcuacaccacuggggaacagaacucccccucuggaacgcuucuaaaugccuguagcccguuaaggcugggaugggacacuguucagaacaaaagauacucaaaaccuguggauacccccaggaugcaguuccuguuucccacauacauccucuucaucauuuacugccaaaccuucagcaagggauuucugaaugggaagcauuggauuaguacuggaaaguccaaagguaggaaaaacagagagccugucagccuagaauucaaacuagcaugcaucauuagcaugaucauucccgaaauggcuggggacaagguccagucagcucguggggcaggcaguaaauugcagaggcauuguaaaagucguugugaacgcagggaaauuggcagcucccuucagccccauagucuccuugaacgcccaucuaaaaggucuuguccuacaucaagugucuucuggcccugaguggcucucuccagaucucaguuaugcucucagucauaggccuaugugucuguuuacagcccgagcaggaaggaaugaggcacucaugguguguguuccucaagacuggcugugggcggggauccccaaggauggaaauacauuguaucugcuuuauuacaguuuaauuuugguaccauucuuagggaaaaguauacucuaauaaagcuguuacccuuuuaaauugacagguaagcagaaaaugcuuuuguucaguuuuagucucuuguagcccaggcuagccuugacuuuucuguauaguuucagagaagaaccuugaacucaagccucuacuuccccauugcugggauugcaggcuugcaucaaucaccacacagggaaaaccccauuucucugccaacacugcugaaaaccaaucugaaaccuuagcacgccuuuccaaaguguagguuaauuuuuuuauuggauauuuccuuuauuuacauuucaaauguuuucaccuuuccaggucucccuuucagaaacucccuaucccauuccuccucccccugccucuaugagggugcucacccacccacccacccacucccgucuuccugccuuggcauuccccuacacugggacaucgaacacccucaggcccaagggccauuccucucacugauguccaacaaggccauccucugccacaaaugcagcuggagccaagggucccuccauggaaccucuuugcuugguggcccaguccccaggagcuccagggguguagguuaaucuuuuaaggagguaaauuaggauaacaaugaugcucuuuaaacagagaaggcugaguugaagguucucaguguggccugugggccaggcacaucuguacuaggcggcggcgggggauuccuuagaauuguaaaguuggaguugggguggaaaauauaaaugcaaagaguauacugaaucagagcugcugauggcguauaagugcaucuggacggacauccuaaguauguagggagugaccuuagcccaccugaucuuggggggcugggcucuggcacagcuuuguguagguaacagccaguacugauauggguggccagaaguuuagaacacacuuccaguuguccucugaaguguccaccuccugaaaguuuaguaaagaaaagcuuaaaguuguuuguuuaguugggucuugcugagcaggcauaauaucacacuauaaacauaccccaagagaaagcacccuagaaaaguagcuugggguggggacuggagugauggcucagugguuaccaaggacccaguuugguucccaggacucacauggaaucucaugacuaucugaaacuccagcuauaggggauuucacacccgcuucugggcaccaggcaugaacguagugcacagacaucucuguaggcaaaguacuaacagaaacauaggaaucuuagaaauaguuaaguguauguggguauauaucugggagugcucgugcgugcacacacacacagagacacccccccccccccuugugugugaguguacagaggugaggggucaacguugggugucuuccucuguugcuuccuucccucauuuuuugagacaggcuuucucaggaaaccuggugcucagugaucuagcaggauagaauggcuggccagcaaacucuggggaucugaggguacaacugagguugcccugcccagcuuuuauguggggugauggauuggaacucagcuccucacacuuuuauuuagugagccauguccccagccccaaagcagggguagagagauugcucaguggguaaacacauuugucuuaaaggccugaggaccugagauuaaacccagaauccacacagauagucagaugccuacugggagcuguaaccccagugcuccugggaggcagaugggaggcagagacaggagacuuuaugggaauuugcuggcuucuacugugguguacagagugggaagacaacagagaaccuggccgggcucaagguggaaagcuagggcugacaccugagguugucccugauuuccauauguaugcugggaugcaggugugccugggaggaagggagggagggaaggaggaagggagagagagagagagagacagagagagagagacacagagagagagagagguagagagagagagagagaaugaauuauacagguauuguaaagcagugguauuuccccauagucacagggucacauuucagugcuaacuuccuuauuaaggcuccaacauagaguaaaucauagagugggccuggaacaugugaugaaguaaacgccacaguaauuguaggcaucugcaguaauuuacaauaugaauguugcaccaccccucagaacaccccccccccccacacacacacacacacacagaggucucagcagugagggaaaaaaugugggucaucucagcaacagauucugagucuaguguuuaauauacugugcuuggagaauuuggauaggaaagauuuggagagccugggcuucucagacugucucaggaggucuggaagaauggcuucuccacaguuuacuucugggugggggauccagcaguggcugcuagagacaggaagaacaagggguuucuggaaagugugugugacaugaguguguguggaggccagagguuggguugaugugaagugucuucuuuaggcuuuuuuuuuucuuaguauuuaaagauuacacauaucgugugugugugugugugugugugugugagagagagagagagagagagagagagagagagagagugugugugugugugugugcucgcgauaccugccugccuuaugacaccuaccugccuugcccgaaagguuguaagggcuggggaaguuacugccucucacuguaccaucuaggacgcacucaaaugaccucugugcauguguauaggcaaggggauuugucacagacuaacagagcuggaagacuagagcccagcaggugugugugcuuguacuuggugagagagaaaacaaaugucagauggguugcccacaaagcuggcugcugacagaccuagaauuagggcuuaggcuagcuuccuuccucugggccaaugagaugguuuaguaggcgacuggcauuugaaaucaugcugauaaccugaaccugaguuccagccccuggccccacaugguagaggaugagaaccauauuguuccucugacuuuauaccugaauuguggcgcaugcacacauauaaaguaaauaaaguguaagugggggaaaccacuguuuuuaccagacacgguggcugacuucauaccucuaaucccagcacuuguaagaagaggcugaggcagggcaauuacagcuuguggagaccagccugugcuaaauagugggacaucucagaaagccaaaagaacgguuucugguuaaggaauuuaugcuccucacaucaaguuucagaagcagagcuucugagcuagaagaacaucacaaagaccaagcuagaugauaaugguuuucucuagugguaaucuauuugguaauugccuuggaaugucuacagcacuuugcauaaccugaguuacaguuuaaacugaagcacugaauuguggcaauuuuguagcaguggcucuaagacugucaguguguaucuguaucuggcucuguaucaauagggcacaccugccacgaaaccguugcuacaauaguuugauucaaacaauacuucccuuacugagcaacaugccauuaucaucaaggucccuaauugacaguguguucugaguuaaaugcagacggaguuccagguaagagacaacaccacacuccagaugcuuggcacucacccucaggaccguuccuaacugcccaggcuggagacguuacucucucccgaggaaggguuuucauagaggaaaaacccaccuucccccuguuuccugaggcucccuuggaaccuuuuucuguuuaagcaucuaucugcugcaggagcaagaagggcagguaggauuccuaugucucagcaauacuccagcugcuugcgaucauuuaauugaguguguccuagcugguacacugagaggcagcaacuuccccagcccuuacaaccuuucgggcaaggcaggugggugucacaaggcaggcagguagcacaagcggcagcagaagcugggacugcuggccugggcuggagagcaguaaggcccacggccagguuggaccaggucuucuggccuauuuuccacucaguguuugcccacacucacaaacuguuccaacuuggccacuucgacagaauuuuauuugaaagcucuuuuuuccuaacagcaccucaaaaugaguguuuuguucuggguucccaucuucacucagcugauagaaagcaaggccaggaggagagacugggggucagugccuucacuuagaaggcuucggugaagccaggaggcacccuagucuguauugugugccgagcaggcuuaguuggagacaagacuuguuaaucuuguacuauagcugucaugugggcuuaugucagcugacuucugccuuugugaagcauccgcugauugacagccagagcucuuuugaacaggaguccauggcuaugugugguuagcguauagauuuaugaugggaaggaugagguauaguuggcuuaguauggaaaacagaggccauuuaacaaggacuguugccguggugccagccuuauuugaaccccacaagagcagacuuaaguccaccauuaagaaaggagaaaagaggggcuggugagauggcucaguggguaagagcacccgacugcucuuccgaaggucugaaguucaaaucccagcaaccacaugguggcucacaaccacccauaaugagaucugaugcccucuucuggugcaucugaagacagcuacaguguacuuacauauaauaaauaaauaaauaaauaaauaaauaaaucuuuaaaaaaaaagaaagaaaggagaaaagaaaaaucuucagaggcaaucuacauuugucugacuguaaagccugcauucuuucugcuguacaaaguuucuuaauauaggaaggcauacaguuacgcagcuuggguagucuagagcagauagccuccaguucaagaaggcuuuaagaaaaccgggagggcuuuguuuaacuuccgauaacacuggucaucuggagcaucauugagcacuacuugguaccacucugugggaggcagugagaggcugagguugagggagaagagccuagucuccuuaugggagaagggcaguucuugacuuggagcuguugggagucugacauuaacuguuucuugugggccuguuuauggugucuuuaggaaugccagugguugugaccaaaagcucuucuuguuuuuuguuugcaccuguguguuucuaaagagcagcggcuccuuucuauuuuuaacagcuacuaucaucugauagguuugagagcuuuucuuaccuuccuguuucaguuggcccuucaguaaggcuugaacagcucaaggagcaaagaaugcuacuugcagugacuggcagaggacaugccacuuucgugugcccccacucugucuucuuucugcugaggcuaguguaggaugugguccauggauggauggauagaucggugaaagagcuuaguuucugucuuugaauccccuguguuugggauccaggccagggcccgcauucaugguaaacauucugucacagagucacauccuaccuccaaauccuuggucauagccuugguagugucugugguaaagaaauauauuggcaauuucaucucuuuuuuuuuuucccuuuaccuuucuuucuuucuuucuuucuuucuuucuuccuuucuuuuucucuuugacauuaauuuggugaugucugaauucccuuaaaaaaucaucugcuuuuaacaggacuuguuagaauuugauaagugacuuugccguaaucaugcguucaagcagauggcugaaauggcuuccaugaagaugggucucaguaugaaaccugcaccgguuuaauguugcauggaaauaacgaugcagggucuuucccgcugugaaaugcuccacuuacccaugucguauccacagauacuguacugucuacuucucuucuaaauguuucccauccuuggagaguuuguuccuucuaccucccucuaugucugacuggccaacauucucacuggaggaauuagaaauguguggcugucacuagaaccacagcauaccuguuggaauauauuuuucuguggaaguaucauuauuggagucaaaggccaugcgcuacuauacgcuucucauuaggauacuuaaguacguuuaaaagucauguuuucugaacuguuucauggucugccuuccauucucccagcuuuuuuauagccguauugaugagugacuagggccugaggagagugggugacagaguccucugagaugaacaccucaggcaagcugcuugauugacaucuguugacaucuguuggcaacugcuagccauuccuguuagaugugguugaauugagggaagagaacauuugaccccaucccuuuagucauuuuggaaguugguuuuauuuauuggcccuguuauuuacuucuguuugcuggauauuuucugcccaccugugauaagguccagacaaguucacgcccaccacuugccuuggugacuuaggcugugguccagccccagacagcagcaucuggaccccaguguacacgagcgaugcuaggaacugcuacugcuuuacaaauaccugggcgcgcgcgcaugcccagaguuagcucgcguuucugauggcaaaacugucuuuucuuuuccucaaaacuaauggcaaaaaaaaaaaaguuuuauaauuauucaaaacuuauccuuaauauuaauuauaauuaauaauauaauauacaauguuuauauaauauauuuauauuauuacaaauaauguaucguguauuauaaauuauauaaauaauauaaacauauaauaauaugcaguaauuuaauaauaauauuaaguugguagaacaagggaagugagccucacccucuguguauuacucaguuagaacguagcucuuacgucucugcucuucaaacacaaucuuaacacagaagccugugauuucuucucucucuuccccuucuucugacaggaucucaucauguagcccaggcuagccuggagcuuauguguagcccugacuucaagcacacaucaguucugucucagcccgcggagacaccacucaguuaagacagauuagccugcccacccacccacuuuuuccccuucuucugaacacuuuucaaguguccuauuaauuaauuaauuuccugaguuucucauagcuggugacucacggucacgaaccgguucuauucauagcauaggcagcaaugagcaguuaaacuguaguuuuacauggaagaaaauaaaaccaaaagaagaguccccggugagaaugggguccggagugucuaaagcccccgugaaauggugggaaauucagcaagccagaaagagcaguguauggcauuugucucucucuugucucuuaaaagugugugucuguuuauuucugugugucuuugugcauguguguauuucucuguguuagcuuucaagccugggacaaguggcugaggugccuauuuaacauaucaaggcggacacuggccaccagguucucccucaguccccaccugucacagagcucuccuggcugguauacccuaccccuacccuaaacucuccagcucagggcuugaacugccccucccauaauaauucuaccuuaggccugauugcugcaccugguuccucuuucucccuccccccaucuccccacacggcuuagggccaauggccacucuggacucucucagaugccccugccucuggcucugcucucccacauauguacaaucagccuucuccaccucuauacccaggacuaggcaugcuucuuuuccccuuuucauucaguaugaauaugugacuguguaccugaguuuugugugugucuguguccaugugagucugucccugugguguguguguguguguguguguguguguguguguguguacaugugugugugucuccucugucagcucccagccuggcuucauacuuucccucauuuggacuuccacuccugaaucuugccugaccaucuuaguuauuggucucgaggccacugagcccugccucccccacccccuuucuaucauaauuaguuacaugcucuuacucagugaguuccucucuacuuaaguucaagcagucagacaacagcuaaaaauuaagaacaaccaccuaccaaaaaggugcuguccagcauuaagaaguauuccuaauagugaaguaaacagaaugcucuuucuuaaaaacaaaggacuuuacaacuaaacccaaguugugugcaaaugcccuaggaccaaaccuucucaguuuuuuuuuaaagauuuauuuauuuauuuauuuauuuuauuuauuuuucuuauuucccauuaauuaauuaauuaauucacuuuacaucucaaucccagcccuuauuuauuuauuuuauauaugugaguacgcuguagcuguacagaugguugugagccuucaugugguuguugggauuugaacucagaaccuuuggaagagcagucagugcucuuacccacugagccaucucgccagcccugcuuuucaagguuugaacugagagauguuccucgugauuauguugccugucuucucuucugaauccccaguguugggauacaaaaacaugaacuuuuagggugacuucagugaauauuguaaauguuuuuaaacaugagucuuuaauggauagaaaguagaagccgggcgugguggcgcacgccuuuaaucccagcacuugggaggcagaggcaggaggauuucugaguucgaggccagccuggugaguuccaggacagccagggcuacacagagaaacccugucucgaaaaaccaaaaaaaaaaaaaaaaaaaaaguagaauaccacaaaacugaaaaaauuaaagagaauuauaguacaaaauuagccagguagaaugauuggucagugggaagaaaguagguuuucuuccuugucucucuauuugugauaaaagcuuucuuucuguagaugggcaucauuuacacuaguugcauuuaaagaaacuaugcuuuagguaccacuccaagcuccaugccauguggagccagaagccuagucuaugacacuuggcugagggggacugcucuagagguaaagacguuggaguuucuguguuuggugcagggguagccguggcugcaagaagugacuaagcacacaugauucagcuugccugucugugggacuccugaacaccuggcagcaaagagguuuaaccuaguuuccuagaugagaacuagagggcaggaagggccaggagcaagcccagcgugagcugggugcuggugaccuuuggcauacuuggucagggaugauacucuuuauccuuccaugucggguagccucgaaacugguuuccuuuuuaccuacgaauggaaguucacauagacuagcuuaagcaaagagggcugugaggcuugguuggcugggguuuuguuuuguuuuguuuuguuucugcuauuucuuuccuaucucacuuuuuaaaugaauuuauucccucaucuauuacaucgcaaccacaguuucugcuccuuccucuccucuuagcccaucucuauccacucccccuuuccuucagaaaagggcaggugucccagggcuaucacccaaacacuggcacaucaaguugcagggagaccagacaucuccacagcccaguaggggaauaaggguaccacaagcaggcagaagugucagaaacagccucccucuguuaggagucgcauaaaagcaccaagcaacacaacuauaacauaaaugcagagggucuggguuagacccaugcgaggcuucuugaauuucaguucaaucucuguacgcccaugagcucucaugguagguacuuuaccaaaagcccuuacccaucuccccaggccaacaguaaaguguuuuagaauaugaucucuguaagaggaaauagugaaaggggucccugguaguggggauucugcaaacccggggucugcacagcagcuagaguggggauccauuuguuuguugcugggauuagaggcauugcaucaugcuuaggaguuaucugcaguggucagaugguuugagcgucgagccucaacuccaugguuuuauaacaugggcagguuaucagggcucuuuuugcuuccuagucuucaucuuuaaaaauaucuacuguauauuuuuuuaagauuuauuuugguuauguauccgcauuuugccuuacugugugcauggugccugcagaggccagagagaggaccugaugauucuucuggccuuugaaguaaccacacgcauguguucauacacacagacagauggauggacaguuacauacacagggaaaucaaaauaaauacuuagggaaaaauccuggugaaauauauuauaugugcauguuuauagccgcaugcguaugacccuuggaggucaggacagguauuggaaccucugggauuggaguuaaaagauggcugugagccaccauguggaugcugggaagugaaccaaguccuuuggaagagcagcaagugcucuuagcuucugagccaucucuccagcccuuucuuuccuaugaaauaacguauugccauguaaccccaggcugcccuccaagauccuccugccucagcuuuccuaagucugggauuacacauauaguauuggcuuauuuuuuucuucuguuauuaauucaauaaagugaguuuaggugugaggguauaaagaauuuuuaacuuaaaaagaaagcgcaaguacaucauuuuuccuaguagugucagguuuagaacauacaaauuucauaacaggcugcuauuaggauuccuggggccucacaggcauggccugugucuaauacaccuuuguacccccaggggacaggauucugggacuagucauaauuccauugccugucuguauccuguuguccucuauccauucaaaggguaaagcaaagccaggacgaauaguuccaugggucucaaguccagccaggaaagcuguuucugaagacaaucgaggagguuugggcagcuggcaccgggccguuagcagaggucccucaacagcaccaguggcaggggugugaaccugaccugucagccugauccaagguccagcggcgaacgcuucaggagagagaacucuuccccaagagugacugauccuuggugaaauaacuugagugcuuucugcuuugugguuagggacuauauaaacauugaggaguggggugggguuuagggaguagauguuuccuauuggcucuguuugagauguuagugaugcucaguuugcauggggaaggacuccagguguuuucccuaugugacugacgagauccccucaguggagcgucaugguuccagagcagguacagaaauggauacggagcggcuccacuccugcugaucucaaguucccgagacucccgaggucugagcucucucagccuuagcaguuccucugucugguggcaugguccacuugccccauaguaccccaguguuccuauuaccugguuuuucacaugcuccuuccuguagcugcagcucccuccacugugaccaugauaaaugugccuuaaaucuaaauaaacgauaccuuuuauugcuaccuuuuuguccauaaacugucauacuuuaccuaguuuuucugugacauauuuuugguuuguuuguuugguugguugguuuugguuuugguuuugguuuuucgagacaggguuucucuguauagcccuggcuguccuggaacucacuuuguaggccaggucaaaaaaaaaaaaaaaaaaaaaaaaaagccaggcuuggcuuuuaaaggcgcacaccuuuaaucccagcacuggggaggccagccuggucuacaaagugaguuccaggauagccagggcuacacagaaaaacccugccucggaaaaaaaaaaaaaaaaagagagagagagagaauuauuuuauguauaugaacagucucugcauauacaccugcauuccagaagagggcaucagagcccauuauagaugguugugaguuaccaugugguugcuggaaauugaacucagaaccucuggaagugcuuuuaaccacugaacugucucuccagccccuuacuaugacaucuuuuuuuuuuuuuuuuuuaagauuuauuuauuuauuauauguaaguacacuguagcuguccucagacacuccagaagagggagucagaucuuguuacggaugguugugagccaccaugugguugcugggauuugaacuuccgaccuuuggaagagcaguugggugcucuuacccacugagccaucucaccagccccauuacuaugacaucuuaauggaaguaaauuuguacuaaaaauuauuaguacaaaucgagaaagccuguaacuugauaacacuggacuauagucaggugauuaacuauaaccauauaacuuugguagucuacuacaguguuaaauaguucugauucaguuguuccugacacccagaagguguuuuuagcaguuccucuaccccaacccccaaagaagggcuuguuuuacuuggcugagucagggauuaaauauaccaagaucucggggcaaugccuauauucaugguuaugagaacuaugccuuccauuugaucaaauugcaugugacucuuauuuuaaaaauaucuaugcauaugugugaguuccuaaguguaugugugugcaacguguaagugcagugccagaagagggcagaagagggcagcagauccccuggagcauucuauaguuaaaggugguugugccaccaugugggcaggcuggccucaaacucagaaauccauucgccucugccucccaaguucugggauuaaaggugugcgccacuaccacccggcuuccugauuuuuuuuuuuuuuuuuuuuuuuaagauuuauuuauuuauucuauguaaguacacuguagcugucuucagacacuccagaagagggagucagaucucguacggaugguugugagccaccaugugguugcugggauuugaacuccugaccuucggaagagcagucgggugcucuuacccacugagccaucucaccagcccccugauucuuuuuaaagacaauauauggauucugcuaaauucuaaacaaacccaaaaacacaagguaauuaauuucucagacauacugugagcccccacaacaugauccuggaaccuuaguggggcuguccaugggauucuuaaugcuuuaacccacuggccuuauuuugcaaaugaaagcaugcaccuguguacacauacacagccuaugacccuaugagccuaugagaacaguaugaaaacaaucuuagaaacuugugagaugcuuagcauacuuugcucuucagugaccaaacagcuuucucacaagacuuagcgcuugcuguuacacauagggguguacauccgugccuguggcuguuccuuugcaggugcaguucccaugaauucccugcagggagcuagcggguugcacuguuacuaucugaggucuauuguaaucuuuuagccucuuaagcagcaaacuuuaagguaugcuagggaguauuuuacaugaagagcuugcauguuugcugguguuuucccccaggagaggaucuucucugcauuuuaaagacggauaauuagauucucuucccccaacuccccagagacugcuuacgcugccgaucacauuuuuaauuugcagagagauggguacauaguaucuauucacuccuguguuugcuuauguuuuccauaacaaauucauaaguuauacaaagaaacuuagaauagcuggaauuuaacuauuuauuguauuuauuuacucucucuuuauguggugugugcaugugcauguauguuuguguucuuauguguaccacagcuccuuuagaagucagaggacaacuuggggggaauguguuaucuccuuccgucauguggguuccagggcuuggacuuggaucaucaacauuggccugguuuuuuuuggccauuaugacgaggauagagugguuguauaccaacccuccauuugaucucuugggcuguuaauaaauggcaagguuuuguguguauguguguguguguauguguguagaaaauacucaaaggcuuaaaacaaauuuuuauguuugagaucucaaaugcguauucaaauauuuuuuccugagaauuucuaacuugaggauuaccuaagacugccuauaaauguagauaagggcuuuugggaacauggcucagucaguaaagcacagagaucugaauuuaaccuccagaaucuguauaaaauugcuuggcacaguagcaugcacuuguaaucucagcacuggggaggcgaggcacaggcucccugggggcugcugacuggucgggcuagccuaauugguaaguucgggccagugugagauccugccccagaggaggugggcguuguucccggggaggacacugcaaguuggucccuggccuccaaguguacgcaacagacauucagagcauuuuaaguguuuggagcuagagaggcggcucagugguuaagaguaccuguugcucuugcagaggaccuagguuagugcucccagcaccaccugaugguucacagcuauuuguaauuccugcucuaggggguuaacuccuuuucugaucuccaagagcaccaggccuaaugugguauacauacuuacaugcagccgaaaacucaaacacauucaauaagucuaaacauuuuauuaaaaaaaaauucacuauagagauccacagcauaguuaauuuuaaaaugcucaugguuugucaauuuuuaaaaacuacuuauuuucaccuuauguguguugguguuuugccuggauguaugucugugugagggugucagaucuuggaguuacaguugugggcugccaugugugugcuggggauugaaccugggaccucuggaacagcagucagugcucuuaacugcugagccuucucuuuagucccaccucaccagaggcauuuuguauacuuugcucuuuacagucauuuacuuguguguguguccaugugugcacacacauguguggaggucggagaacaacuugggcaacuugauuugcaucuucuaccaugaggaucucagagaucaguucgggucaucaggcucagagacaaaaacauuuaccugccgagccauuuugccaguucuaacuugcuuucuguagcuuugcccuggcuauauuuucuguacacaaauacaguuggaauacgaaacugaauagcugcuuuaaaauacuaucaugaggauacaugaaacauuacuuuucaaugagucaguaagcagauggguaaaaccacacaccuuucaucugugcaguugguucucucucuuuucuuucuuuuuucuuccuuuccuuccccuuucuuucuuuugagacggggauucucugugaagccuuagcuguuuuggaacucacuguguagaccaggcuggccucuaacucacagagaucguccugcuucuaccucccaagugcugggguugucucucucuuuuuauuuggguucugaggcugggaccaagguugccaggauugccugcaagccccugccccuagcucccugcuucauaaagagucuaacagcauacuugaagcauagacugguugguuaccuuaugcuuuuuccaagcuuugcagucuggugugucucuuguaaauuuuuaacuucuuuucuuggaggggauugugucaagucuuacuguguaguccaagcuggccuccaacucguggugagcucccuaccgugaccucucaagccuaggacugauggugccucaguugauggcuacuuaaaauccuuucaggcuucuuugcuuuuuucuguucugugcagucugucagguuuuaaaaagcccuugucaccuguuauaguaagaacaacacagcuguagaaacuucuccucgugugcguuugcuggauggguagccccuccggugugacucacggguccugaggaagauaaguagugcugaccugagucggccacucacuggucagccagcuccgaucaccucugccuccacacccuggcuccacagucaggcauuuaucuuccugucaaguuuccuuggagugagagccugcaggcuuguaacucaagaugcaaaggaaacacuguaacacuuaaaaugcugugcggguggacccuguugcuuuccuuacacaguauggugagccuguguccuuugauuuugccuaucaugacaaagccuguuuucccaggucagggugaauccccagagaagccccaagaaguaggguuuccccuagccaggcuuccucuuaacuguguaguggugccugguaggcaggaguagcagcuucauuucugagugagcuguacacccacaaucucccuucugcugagacagcauuguggaugaaugaggcuaggaaggagaccaucagaagccauguucauggaccuggcacaaaucacuagggcugaccuuacagagggaagaauguaguagccaccauugaaggaaagucugaaaaaauaguucauucguucauucauucauucacaguuuggucaaugucuacuaggcuguauguaagcaugaccccccacacacacacacacccccagugcugacuuuaaaaacuuguggccuccaugcccggcuuauuucguaucucuugagaccuggcuuugucuaugcauacagagaacuggagaauaaauaacgaagcaguggcuuuaaaacugaauguccuccuuuggucaguuggcuccagcauuuaagaguucaugcuuugagaaccuuuguugccccuucauaacuuugugaguuuaaagcuuuaaauaaaaagggcuuauugaucugcgagaagccucagaguguggcccuccaccacuagagggcagcgcggccuuagucacaugaucugaaccugucgcuuugcuggaagcuuccuucucuucuguauucccuuccuaagggauugcuauaugcaucccuuaaaauauaauguaaacaaaaaguauuuaauaucaaaugaucucuugaaauagcuaaauuguuagcuuucuaaaaggguuuaacaugcagucauuuauccucauuaucauguuuuguucuaaguucaugaguccugaggaagccuucacaucagggcucgaggagugaaggcccuccccacacccccuuuugugccucaggacaucucucccuggggagucuucuuacuggcuucuugugggccuguggggaucuguaacagcagcauucucuugggaacaggggguuaaguacaguuuauacuguuuugaugcccccaagcuuguaaacacccuuuuguuuccuguacuuugcagaugaguagagagauguguuucucucaagaaauaauacuuucccuuuuucccaugaaggcacugguguccuuuaagggguagggaaucugauuuuguccacauuuuacaucuuuaauguguaaauuccuggaugugggauuauuguguggaagaguguaaucauaaagggacuugauaguuacuaccaaaucaguuucccaaaagaguauaggaaaacauuuuugcccuaacauauauuccaggacuacacuccccauuucaacgucuucaucuucaugguauuuuauaauuacaaacaguuuucuaaguaguggauccuuuuauuucuacuucagaaguacauuccuagucggugacguauauuaggaaauggcucaaccagguaauguuucaaauggguguucuuuauuccucuguuggaaaugugugaggcacgugugucugguaaggccccaagaagcguggcaagaaggagaucuguuuagcuuggcaucuacaacaguuugcuuaaucacaggguccuuuuuaacgacgacaugguggugcuagcugguggaaacaggacugugguuuggaaggugauggugguaagauguauugggaguuuuuagaaaguagucuauuagggcuggugaaauggcucagcaaguaaagaaaggcacuugcugccaagccugaccauaacaugguggaguaggaaccagcuccaaccagcugcccucugaccugcagacucguguucccagcuccauauaaauaaaugcauguaauaaagcaucgucaaguuucuucuggagcuugugaucauguuuauacaguaaaggaucugcaguagugagacuccauagaaaagccugaaggaacagauaggcaggucugaagacacaaccccaggcagagcuucugggaacugguuggaagugguuugccaaggauggucgaucucgucaucgggcaggguaccacugagccuguggugcugucuacucuccaucuauuuuaggaaggaugaguuugauacuauggugagcuaucaaaucuguagagaauguuuaagauacuuugggcagccauacuuggaagacuccaggaggacaguugugugaugggaaaaccucagagcauagguaggaaaugguauauuccuggucuugguguucaucagggcugcgaccuugaucaaauccaacgucaaacuucucugucugaugucuaagaagauacugugguugacauugacucuucuuucagacuuggaaaauaaaagcaauaaucagaaccuaccaagccaucuaugaaucaugacacaaugaaaagaguuauuuacauguuuauauuacauucauuuauuugguguguguggucugugugugggguguauacaaguggagggcugaggacagguugucaaaguugcuucuccuuccaccacguggauccugggaauugggcucuggucauaagacuugguggcagugccuuuacugaaguagcccugaugaugccagcucuuucaaacuuuuuuuaaaaaaaaaguuaaaaucauucuugggguuugcugccugacuuccauacauuuauauacaaccaauaaaugcaucaaccaauguaauuuaaaaaaaaccaaaagguauucuuaguuuguuuaauauuaaaacaaaacccuaagacaaagacagguggcuggcugguugaguuuggccucccagcccuguuugcugacacauuuucugcacugguauacuuaaaguacuuuuauugcaaggacugaccauaguagcauaugccugugaucuccgaauuucaggcugugguguuauauaguaagauucucuucucuaaaacauaaacucaaaacauaagaaaugccagugggagaaaugugcaguuguuugauuugauuuuaauuuaguaguaaauaauuuaggauguuauuauacuaccuguggggaagggaggccucucaagacacugcuguuuggaacugaguguagccaccauggaaaucaguguggagguuccucaagaaaugcugaaaauagaauggaaugacucagcgaaccacuuaggcuggggugaaucuaagucagugugccaaagagauagcagcgcagcgcaugcguccuucacaguggccaagauagcagcgcagcgcaugcauccuucacaguggccaagguauggggccgcagggaagcccuucagcaggugaguggauuaaaagcuuuggcaaauaugcucaguggauacacauagcacauaugcacaaaauacuccucagccguaaagaggagugaaaugccauaccaggggaaugaaggagcaggagaucaugucaagugagacaagcugggcucagaaagacaaagaccagggguuuucucuccuaugucuacgcuagacucuaaaauauaggaaggucauggaagggggacuguguaaggagagagaagggucuaacuggaggggagagccagggacaagaaaggggagaggaauaagagugugugugugugugugagagagagagagagagagagagagagugugaaagagaggacugucugaugggagaagaggagccaucaguagauaaaaggagaacaguggcagagcagaucugauuagccacacagacgaauuauuuugauguuuauugcuauuuaaauugcacuugauaagagcuccuauuugauaguagcugaaaaugugggccccauugcaguggucaacagcuguggacaguaaguucguuacccaacuauaagaaacugcaucuuccuuuccuuuccuuuccuuuccuuuccuuuccuuuccuuuccuuuccuuuccuuuccuuuccuuuccuuuccuugccugcaucuuucuuccuuccuuccugcaucuuucuuccuuccuuccuuccuuccuuccuuccuuccuuccuuccuuccuuuuaagauuuauuuauuuuauguaaaugaguacacucuuacucuuuucagacacaccagaagaaggcaucagaucccauuacagauggcugugagccaccaugugauugcugggaauugaacucaggacuucuggaagagaaguuggugcucuuaaccgcugagucaucucuccagcccccaaaaugcacauuuucuccaugugucucugccuuugguuugggggaagaaguggagcaagcaggugauguuuuuacagaacugaagcucauguaucuguacccauuacgguugcuccuuacaaagagccugccuuuaggaauagucugcauuuaggcucacagcgucacuuccugauggacaggaauuucacccaagagaucuguuaccauuguagucucaucugucuagaaaucuagaaccagcauguuuucuguucucggguuccacaggacuucuauagucaacaaguuuaaguuaagggugaaaucaggaucuggccgugaacuuguuguugaagccccgacugugggaagcguggcucagcuuccccagucucccagcccugcuccaugcuuccuugcuuuuggaagcaucuucuccaugggucccuauccuucaggcacccacagugaggagggcauggugcaucauaucauacaucagcaucuaggacacugacaagagggcagagagaacaggaaggaagcgaguggucagagcccgagcagggagggggccugugcgccucgccaugcucacgugcucacgccucgccgcgccucgccucaccaugccucgccugcuccucugcugaccugcgcucgcugcuucucacugguguccacagcaagccccucucccacugcugccacguaaacuugagcuuaccgguccaaagaauaugugucucaauuuuauuuuguguguaucccuuguaucacuaaauagauagcuaaaugggggaagcguguguguuuagagcagaaguuagagcaaaucacugcuuuggcagcuuugggccaaaaaaagaaacuaaaacucucuaagugugcuuucuauucugaggccgccacaagauguuuugugcugcaguugauuccucggucaugagaagucguaggaggggcucagcaugacgcuaucucucaaaaaaauauuaauuuggacuugaguuuaaaauuagcaaggggaaggagggggaagaaauaaaucauuggacucaagugauccggaagccaaagaguagacaccucauggugggaggggagacauacauagauaguuccugccaguacagccacaccgucuccggguagcacugugagaccugucaaguagaacccucagugaguuguaacccaggucaccccucguguaggcuggaaccugagucaguaaggcuugugacuaauggcuugucaugucagcugcuuuaucguaacauaaugacacacaggagaggcggucacuaccuauuuuuagggaucuuccuucugggaaucauggugaacguggucugcagaaaaccacuuccgggccuguguuguagaccucccaagacagagccaccuccuggcgaacuaugggugcuccgagaucacacccuccacauacuugagaucugaauuguucaagaguuacagguauuuauauaccugaaugaaauaaccagguccuagcuaugaacccagcagcagaaguugcuacagaugugaauggagaccucacaugguuguuccauuuucugaaagucuacuuugucccuggggugugcaguaagucaggcacuggagcugaggcccugcuuagaguccuuaccgcuuagaggccucucuuagcucccuacauugagagaagacagaagccugccaaaacaccaaggaugauauuuaaaugauugaggcuuuuccugcuaauaacuugucuauguuacauuuuucagucuguuucaauugcuugaucaauaggauuuuuuuuuuuuuuuucuuuaagacugauagccuagguucauguagugggcaggucucaagggaagcaagcaggguguccacaagccacucagagcugcucagugaauacagcuuagccucuggcccuuguuacugcuugagcgccgccuccuuugggauaacuccagacccacccccuccugauugcuuacucuguagucuuauuuaggagcggagugcauggugggaagaacuuaggcaauuacuuguuucacuagauaauuucaugugacccuucuggaaaggcgaagaugcauggauguuuggugugacacaguuguguugucuggcaaagccugucuugcuuaugaucuguauuuuaauuguuaggcuuuaaguaaacccugcuacuuacucucuguaaggugggcgggucuaaugcauccucccaaaagguguuugugggggguuuuguuuguuuguuuguuuguuuguuuguuugagacagagccucaagaagcucagauuugaccucaaaaccaugcauugaugcccuuguauuucagucuuccuugccuguaccuccugagagcugagaugaucagcauccgcuguuuauauggugcugggaccacaccaagggcuucgguguaugguagacagguguucuucugauucacuccauuccuagccccagaaagauacuauuuuuuucgagacaggguuucucuguguagcccugcuguccuggaacucacuuuguagaccaggcuggccuugaacucagaaauccgccugccucugccuccugagugcuagaacuaaaggcgugcgccaccacgcccggcgauacuauuuuuauaauaauaaaaaguaccauuuaaagaccuucaguuacugucaacuguugauuauaaauucgcugcuguuucuguagguuuuugcuguuuuuguuucuuaggguuaagucgcuucagugccauccuggcugugcgugaacgucuaagccugaaggauccuucuaccucagccucucucauguggcugagauaggccuggccuugcuguuucugagaucccucuaaucucccugugguagugacuugucauugugacagaguauuaggcagaggcagccuaagggaggagcggguuauuuugguucagaauaauaaauaaaucuuuaaaaaauuaucuuuuaauaagacauaguaauaucuuuaauaagacugacauaugucuaaguaaaauauauagaaaaucugguuuacccaugggaauguucuacuuuuugacauugccaucugcagaguucacacgugagaaccauucagucaaguggccugugugaguuaggagacauaugaugugagauugccauagggugauucauuguuaaagcugaggucauuauacaauuucuccauuuuauguaaguuagaaaauauacagaaaguguuuaguccgauuuaugauuauguuaucgguacagaaagacucuaacaucacagcuagaguucuugcccaugagaaacacugcuauuugcagcccugaccucauugccgacugguggcuucugaaagacuggcagcccggguguggacucuuaguuacauguguaagugugacauucuaguaagccauccacaucuuuuccagcccuggcuuguggcucuggagacuacugcaugggaucacaggagggaaacuucucugcagaagccagagggcaggguggccugaccucuuaagggugcuuuugccuauuacacuuucuuaucucucuguucuuggugugcacugguugguuuuuauccuugacuggaagagagccccuucccaacauaaugcuuuuauugauuauuugggaauuucacaaaacgcacccugaucauacucacuucccaguccucccagguccuaccccaaccuuuacgacaccgcccucccuccaaaaaagaaaggaacccuaagccuaguuuguguugaucaauauucacuggagcauggucaaacucccaauccuaaccccaaagaaaacaguccuucccuaccugcaucccgccaggagccaucagcugugggcagcuacauuucagcaucccuaucacaacuuuuaugacuucucuuuaacggcuuccuguuucggcugcugcuuugguggugguggugggguaucacagaagcuggcacuagaaaccauguguaacgccaugauuccugcccccgcugacgguaaagggcaaggcagcugcuuuuguaguggaaucaaugccugcaaauucaagacugagaaagaggaagucuuuaauuaaggaaagaaugccucaucagauuagccuguaggcaacucuauaggucauuucaugaacaucuugggggaugggguggaaccccuccuuagcaggugggccuggguucuauuagaaagcaggcagaguacaccaguaaguggcaccccucaauggcuucugcuucaguuccuguagcuagcuucccccuggaguaccugccugagcucccucagugguagaaugugaccaguaugaaucaccuugcuuaauucucaaagcaaacccuacuaggccggccuguccuuguuuuacagagaaggaaaccaaaguggggcaaagucagacugucuuuccacauaaccaaccaguggucacuccugaggucuuaguccgaagcccaugacuuuccuugaguguuguguuauuuuuuugguguuugaaaaguguuugaguugauggacacucuggguacucgaaagacuuugaguaagguuauaugaguuagugugagucucuguagcauguggaagauguugaguggaguuugguuguccagccacauaaagaaggccucagugcccuauuuugccacucagaagugugccuuuuauuuccauggaucaggguggcauggaggacuuacagcgccaaacauaaacuggucacauucucugugggaacgauggugcuugguggccaggugguuuuggaauguauuuggaucacuggcuggaaccauagagaauucugugugcuggacaaggcagguagaauucauuccacagaugcuucugccucuggucagcagagagguguggagcaggugcccaugggugaaauggauagcaggugggggagacaagguaugaccaagaaggggcugaguaagaaggucuguaccagaaaauugaaaaagcucaaaggaggcagauaaaggucgugaagagaggccaggaguugaguuagugugaguaggcacuuagaaguuugacaaaaguuaggaggauaaucaagauggcucccugguccugagcuggggauggugggaaaaagauucugcugcuguuugauuacauguaauggggguauuggucuuuagaagacaggauuuuaaauugaggugcuggagacaauggcugugcccugcuagauuuggacuagacagcugccugaguuuucuugacaccauggcucagugagcuccccagaacaguuuauuuugggagaugauaauuaauuuuuuuuaaacaagggauaugugaauugacuuuucuccagagauaguuuuguacugucuuuucuauaucuuacccagugucauugauuuuccuaacacaaggccugauaccuagagacaguagaagauagaaauagggguuagacuuggagagagggagagaguuccugaggaagcuggcugucuccaccagucacagcuggcacuagggaugccauguuagcccaggagcucaaauguuggaaagguagucccuccacugacaguguucaguuuggugagaaaccucugagcagcacggugaagcggaaagugucccuuuucucguggccuuggguauuuuggugauagugacuaauaggucacacagcauaaugcuuaagugcauucccucucacgagccucagcccuacacuuucucaggugaaugagagaucuuauaucccugucccuucuuuacugaaaaggaaggcuuuacaauauguucuuacuagauucagucuauaggaaauaugugguaucuuaguuagaguuuuauugcugugaagagacaccacgaccaagacaacucuuuuuuuuuuuuuaauuuauuuauuuauuauauguaaguacacuguagcugacuucagacaauccagaagagggcgucagaucuuguuacagaugguugugagccaccaugugguugcugggauuugaacuccagaccuucagaagagcagucgggugcucuuacccacugagccaucucaccagccccaagacaacucuuauaagggacaacauuuaacuggcuggcuuauaaguucaguccauuaucaucauaguaggaaacauggcagugucuaggcagacauggugcuagagaaggagcugaggcugcuacaucuugaucugacguagccaggaagagaguuugucucuuucucgauaggcgaaccuugagcacuaggagcccuugaagucugcuuacaaagugacacacuuccuccaacaaggccacaccucccaauagagccauuuccuaugggccaagcauacucaagccuccacagggagacaaugcauuuugcuuuuuaauuagauuuuacuaacaaaguuaaguuuuccauuaaaaaugacaggaaauagaggcagguagauuucugaguuggaggccagccuggucuacagagugaguuccaggacagccagggcuucacagagaaacccugucucgaaaaacaaaacaaacaaacaaacaaaaaauggcaggaaguaacuuccgcuguuuuggaguaugaacaaggaguuuaacaacgacuauuguggcauaugcagaacaaugaauagaagugcuuuguaaaauguuuaaaguuucauuuauuuuauaucuuuaugugugcacaugugaagaucaggacaauugugggugucaggacucuccuuacacugugugggucuaggaucaggauggaguccaacccauugauuaggcuugguggcaacaauuuuacuuuuuucucaccgacccuagaggugcuuuuuaaaaaaaaaauuuuuuuuuauuuauuugcauuccaaauguugccccccacuuccuggucccccauccccaaguucuuuacccccucccuccuccucuuugcuucugagaggguguuccccuauccacccccaaccccuaccucacgccugccagcauccccuuucccuggggcaucaaguuucuacaggauuauccacaucucucucacugaggccaacaaggcagucuucugcuacauaugugcuaggggccacgaagcagcccuuguaugcucuuugguugguggcuucaucugggggaguucagagggguccaggguugauugacacuguuguuuuucuuaagggguugccaaccccuucagcuccuucaauccuucccccaacucuuccguagggguccccgaccucagaccaaugcuugauugauuguaaguuucugucucugucucagucagcugcugguagagucucucagaggacagucaugccaggcuccugucugcaagcacaacauggcaucaguaauaguguugggguuuggugccugcacaugggaugaauuccacggugggccggugacuaggugaauucaaggugaauucacuucagucucugcuccauuuuuguuccugcauuuccuuuagacaggaacaguucugggucagaaauuuugaagauggguggauggccucaucucucuacuugggggucaugccuaucuacuggagguggucucuuuaauucagcaguguaaauucuuugauaaaaucaaguguauuaagucauugucacuuuagccuugucauccaguaguuguguccuuucacaugcucaguggaggcaggaacucuugaguuuucuauauugagucagcuagugaccgagagcccaggcaugcugcuuuggguauacuuucagcuuucuguaggucuguauacuuguccugguuuaucucaggaacagguugcuucccucugaacuaaacuaguuuauuuucuuggcuugcuaucaggaaccuuuggacauaccauggcuuuucauugcaguagagcauuugccuuuuaguggaagcccacauacagacuuacucugcaucugaucucuggcuggguaggaaaaggacuugaagauuuucccugagacagaagagaugcccacaagaaauaggcuugccguaaggcugcggggccugggaggagguagccagccaggagucaccauaaagucggaggcuagccugucagagggaggaccucuggccagucuucauucacuccuuacaucugucuccaugcuaauagcuuguuugaacucuggaguucauuaucauugcgagugucuaaauaguggggauuaugcauuuaacucccuauucaaccaaggaccucagcuucuuaguguuuuuuuuuuuccucuaugaucuaucuuaaguucagacaacucauaaauagaccaauagacaauagaccaaccuggacuugauauauaaauguuuagaguaaauugcugaucuugguuuggcaagauagcucagugggugaaggugccuggagaccugaguuugagcccuauagccugugugcuggaaggaaagcauagacucccaguucccuggguauccucagaccuaaccaucgggccugcaccacaggacaggugugcacaggcccauauaaagcaaugauaaauuucucaaugagcucaggcuggggaaagagaaguucuuagguuauaacaccuauucuuaaauugcuuugguggcugaccccagggguugugagauuucugagcuugucuuugcaugaagaaccuggagagagaaggacacagcguuggaugaauugggaagggauggcugugaggaggguugagggagaaacgcaugguacagaauucccaaagaaguagucaaaaguuuucuucuacgugaaaagacuugagaagaagugggccgugcgguaguguggagaacagguuuuguucuguugagacagggucuuccacuggaggcuugaccuggaacauguguggacagugcccucagauguggggcaguuguguuucuaucccugagugugcuggugcagucaugagcuaccacccgcuagaggauaccuuuuauuuguucaguuuuuaaugugccauguguguuugagugugccgggccaugaccugugugcagagggcagcuuuggacguccacuucuauacacccucacuugggucaggguuugaacuucauucuccaggcuuguuugacaagugcccuuaauccccuguaaaauccccuugauaaagacagaaagaacuuuugucaaaacuggggaccuccuuaccugcuaaagaaacugaacuagucucuguccagaguuugaaacaauagcgaagaccuuguaaaaacaugauauaauacucuauuuagccagucuucaauccuaggguuugugacaguacuguaacacaaggucagagagaggugagggaucagaguauuaacaguuuagagagcuuuuacauaaacaacagcuuuacaaucuacguguuuaauuaaggauuuauuuauguauauaagugcucuauuugcauguaugucugcgugacagaagagagcaucagauucaauuaaagaugguugugagccacaaagugguugcugggaauugaacucagaaccucugaaagagcagccagugcucuuaacagcugagccauuucuucagccccuaaaaaucuagauuucuuaauuuacuagcuagcuuucuuugggggugggaaggucaggcaggugaaggcaguuuugcucaguagauguucauagaacuucuccuuuaggcuggggccguggcuuguggauaaaucugagcaaguaugagaacuggaguagcaaccccagaacccacauaaagcaggugggccugacagccgcccaugagcccagcccagcagcucagggcaagcuagcuagcuuagacuggcuggaaauggcaagucccaccguccuugagagaaugaggaggaccugaccucagcuuccagacauacaugugugagagcacacauacucaagcauguacacacaugcauacaacacacacacacacacacacacacacacacacacacacacacagagucacaugcagaauaguuugcagaaggcucucccuaaccuugaacccuguaaccuuauaccuuugaagucugcuuuucuucucaggccugcagggcaacuuucuuguccuggcagugcacuuuagaaagaacagugguggcucuguuccuuaggcccccucccuggaagcucaucuaucuugccugauccuaaccuggaacugaauccuacccuuuuugggucauaguucaugggaaaaggucagagaagauugccuuccacuaguccucccuguaagucuaucgagaugcacgcugagggugcagagcacaggcgucucaguaaaccuagguuacuuuauuaagaaguagaauuuuuauuuuuuuuuauuuuuauuuauuuauuuauuuuuugcuggaugaaaaguuuaguacccugcguuugaugaaaagauggaaacugaucccaucucuuagaaacagugacuggcagccugcagccugcagagcacagcuuccucccuccucacugccuucucucacuucuuacagugggaaguuacuaccuuuuacucaaccccuacacacacacacacacacacacaagagagagagagagagagagagagagagagagagagagagagagagagagagagagagagagagagagaggucuuuccccuccccauaaacaggauuccuggagaaaccuucauucuuugcugucucuuauuucaauggaagcaguggggcaggcuacagauuccucucuuuagaauaguuccucuuaucaggacaucagaaacucccaauuuaacugcuguuauaauuuaguguaucuccucccauauuuuuguuuguuuuaauuacacuauuaaggcaugcacauguucaugcaugguguuguagacuuuuaugucaacacuuggaguugaucacggauuugagcuacccuuggacuccugaccucuugggaaaccgcacuaccuagaguguuuccuucaggguaagggcgugcauugguuacagaaagauguugacagaucagaaggaauuuaaagaggagcuggcacuguuggaaaguauagccaaagggcacugaaagagauguuugauggccguuaagaaugaaugugaagggggcuggugagacagauggcucaguggguaaaagcacugacugcucuucugaagguccugaguucaaauaccagcaaucacaugguggcucacaaccaccuguaauaagauaugaugcucucuucuggggugucugaagacagcuacaguguacuuacccauaacaauaaauaaaucuuuggaccggagggagcagagauccugaguucaauucccugcaaccgcauauggcucacaaccaucuguacagcuacaguguacucauauacauaaaauaaguaaauaaaucuuaaaaaaaugaaugugaaggacacaagcaccacaucuuugcaguuaucaaaacaggaauuaaaaaugaaugcugcacaugaaaaugcuauaacauaacccaagacuucacgcacuaaccuaaaauacuaauuaaaaaaaaaucauguaugucugagaguuuuguuggcugcuggcagaagucagaaaacggcauuggauccccuagaacuggaguuagcugugggcugcugugugggugcugggaacugaacccagguccucuacaagaggcgaccagugcuuuuaaccaccaagccaacuaaaacuuagcuccuaaaauuaauuuuuaaaaaccucuaaaagaaaaaacaguguucaauguaaaaaaaaaaucaucuuauuuuuaugguaaaauuuauuagcuugagaauuaaaguccuaaaggaagugggaaaagcuguguaggagccgcucugagcugcugagggcucuuguaguucuaauuuugaaggcugaggucaugccugcucuucccagcauggauuugucaccuaguucugauuacacaguuuugcauaucagggucagaagguggagucugguugcaguuggggggaagccaggcugacucagcacgaugucacagagaaugucaugagcauuuggguguuuuaauucuaucagcgucucucucauggugcccccugcugggaucucagauuauaaacaagauaggaguguagcgauagauaaacugccacacuuggugaagugcagcaguagguugcuuacgcaguucaguugcccuugaaucgucccugcauggguauggaacaaucuuguacauacugccagcggaggggacagacaccagggcugacacauaaaaccuuagguuaaagcugccaagagaagagcauacaggaucagagccuuggcucuggcagccuuauuaagccagcuuuagccacccaaccaccucuauaggccaauuaaacaaauaauuaugaaaaguagaaaaagagguuuauucaguguggccacauuaggaggaagaacagagauccagagagagaacucucccuccggccaucucccuguccuaacaugcaauuuagguuuaaauagcaggcaggaggcaugaaugaauaacuaucaguccuaggaaaggcgugacccaccccaucgcugcaguuagagcaccagucugucagacugaaaucagcucacccuguggcuggaaccagaguccgagucuuugcauuuccuagcaugggacuccugggaaccccgaugucuugggucuauugugacaacagucuuauagccagggacaggaggcagaagugucuuguaggauaccuuuauuccugccuggacaauugcacggucaccuuggcauugucucugcuuuguggcagucaggcaagggagguacccaucaacucagcagaaaccugaagggcaugugguaccugucgggagggagccaucgggagcccacugcugcucuuggaaggaacuuagcuggcaugccaguccuaaugaggacuguucuggauccaaccagaugugggggcaaccuacuuuauaaucugguuauuuugaucuaacaacaguauuuuaauaggugaccugaggguccacugaguaaaacuucugggugcgagcaagccagcuaguuuucagaggagucuuuuuggugugagcaguguaguguggucaggguggaguuaaggaugugugugcccguggcuuagauucaucuguucccacacuguucaccucuagugcuuccuuagucacucacuuuuugagugucaauuuggggacauguuuggaaucuggugaugaccauggagguagaccuggggaugaagcagguuucugagacuuacagcuccgaagcaauguuaugaguguuuagugaccaagagucuucagcuuuuuugaccucauaccuauuguauuuucccaaaagagcccuguaauuaagcucuuuaccaaggucuuggcuucaaauuagacauacacgugauaacagagauaaagaaauaucauaaaacccaagagaacaugaucucccuggccuugggcagaucagucuuuuuccuucuuccuucuucuaaaaggaguugauacuuuugauuuuuguuguuguuguuugguuugguuugguuuuucgagacaggguuucucuguauagcccuggcuguccuggaacucacgcuguagaccaggcuggccucgaacucagaaauccaccugccucugccucccgagugcugggauuaaaggcgugcgccaccacgccuggccucuuacuuaugacuuuuuuaaaaagauuuauuuauuuauuauaguacacuguagcugucuucagacacuccagcagagggcgucagaucuucugacuuacggaugguugugagccaccaugugguugcugggauuugaacucuggaccuuuggaagagcagucagugcucuuacccacugagccaucucaccagcccuuacuuaugauuuuuaagauaggguuuacuuaugugauccuggcuggaaggaguugauacuuuuugucuguugguagaauuuacuaauacauacugagugaagacauuagccugcacaccgacagaugccgauugcccagggccagagagacucuggcaaagagagggcuuuccucuggcugcagaaucuguaaggagaguugugcccccuugugacaaagauguuaagagucagacaguccuaaaguucuugugaugcucgaauacuugacucuuuucucaguaacugaacaaauccuuaaacugcaacauggacauguuacuuaucgccaaguuugcaaauguuccuuuuuuuccaucccauuccaucuauacagagucuguauguuuuuaagggguagacauuuauguuuauuucauuuauuuuguucugauugaauaucuguuaaaucugagcaaaacaccaacaguccagccucucccuugguccacaguguguuauguaggcgggauuagguacgugcugacauuucucuuuuaacucuuccucauuuaaacugguuagugucuuuccccauuguuguugggucccacuuuccccgaaacauacagaaguugggaagguagggcauuugugugcacacacacacaugcauuuauaugcaccacaugaauguaggugccuagagaucagaggucgcugcagccccuagaacugaacuacaagugacccagcguccucugcaaagcaguaagugcucuaaaccacugagccauccuucuagccccaugaauaacuccuaauguacuucugcuuuaaaagcauugaugacugacugcaggauguuaccgcugaaaaauaauggauggcugagcaguucagaacuugcaaguguugacauacuauguuagugucaugaaacuacacacuuccugcuaugugaccacucucgaaaccuccagguauggggaggcuauaggcucgugacaguauacauguguauuugaaauucuaaguuccacuugagauggcagauuucagcauuggaggcaaaugcauguguuuugguuuccucagaguaacaacuucgcuuuguucauuuucaagaaaugccugucacauacccaguucuaagugcccaccauugcuagucucuguuaguagauuuggauuuucagacagaaagcggcucccaacuuccgauuguccccacucuccgagccgucuucccuguacagcaggggucuguguccaugcuuuuguugcauugccuuuuucugugugugaauuugacuccagagucuacauauuuaagcuuuaauaauuguugcugcuucaacagcauaugacagcaggacuuuaugacacgucauacagcccagugcccaugucuccaaucaggucguggcaccuguaguuggauucgcuguuuauuuguacaaccuuugcaaauaucagcaagugggaaacauuuugacaucuuggcauaaugaggaaauaguuuuauccguguggacucccaaaagggucauggggaucccagcucccuucagauuacucggaacugcaggaauuauugaugaaagguaauuggugucucuagagugugaguuugaaucuugcuucuacuuccuauuggcugugacguuaggaggcugcuuggccuugcuguuaacacugccugucacuaacugggugugauaguaacagccacuucccugaaugaauugaccuacccaauaguuaacucacaaguggguuuaaguagcauuccauacuuagguuauuggcugcagaaauguccaaagauccgcuugccauaaguugccucuuuucagaccucuagaaugcucaagacauccaucaucauuacaauuguucccauauagugcccauaugauuauaagacacaucuuagcuaaaaccagacaugcccuuccauacagcccccaguugcaggauauagcuauuguuggcgccuaaccacaacacucauuaguuaacacuugacuacuauugaacuuguuacuauucagagguugcuuuuaacagagauugaccuguccagcccacgggcucuggaagcaagcuuguccuggcauggacuaacuacacagccuuggcagcacagcuauacuuucuuaaagcuugcauuugcucugucggaauugggacugccaguauuuucugagcguauuguaaguguuaaaccaaauaguauacaguaggcagccagaugucuacugccuuccuuaugccagcuuuauuuuucuuaaagcucaucucuucauuuauauaaagccucuaaaugcuguucagacacuguuguccuugcuguccuuuaaaacaguguuuaagaaaaaaaaguaaacguagaaccggaagaauuuuaacguucucuuuccuggaacucacaagguuuuguaaaacuguaacauccuuucuuccacucuugcuggggacucagagcugcucuguuugacagagccgccucucuguugagucugcuuguggguaaacugauugcuauucugucucugaggcccagagacccuguccaguguuucauguugugucugcccaccauggagaagcagaguaaguagccugaaaggugucaguguaaggccagcuccuccugcucaaccucuugccucccaagugcucuggcuugcugcuccuagaauaccccuccuuucuggaauuacuucuauuguucgucuagucagagucuacacuuucccuuguccauaccacuuugagugaauaucucucuucagagaaucucuuucaaaacuuuugaagaaugcucuugaucaaagagguucuucucugaccuuggauuccuuccuugccuccuccggucuccuccccaguucuuugaaucaguguaucaaucguuuacucuuugauggagcagcccugcucccucuuacuugacaguuccacugaauguuggcaccuggaggccaagaguucucuuacuauggucucauuuguuucuaagauuucagccaaaaaucguuagucaacuuuuggucaugcaugucugacuuccugcuaggcacuccguagauuauguagaucuaugugggcccaacauguuuacauguuuaagaugaugucuaagauuuuccccccauuugcugugauaaaauacuccaacaaauguaacucaaaggauaaaggacuuauucugacaguucaggaguagaguccaucguaggaggaagccaaguuugaagcagcuaguuacauugugugcaguuaagucaaaaguagugaaugcaugccacugcuccauacccuucugugagaauagaacuugaggagagguaacagucacaguguaacaaauucaggugaugaaucuuuggaaugggacucaagagaccagcagcaucaaggugcagaucugcgcuuuuugugcagccaaucccaagccccuaaauccucagccaaucauaucuugccacacuaucacugggcaucaucacuuguuuagacugaugugaagauggggggagcggccaccacccugaccucagcuccuuucccuaucucacggguguuccaggagccggaagccaucuuaggacucuucgaagagucucaggagccuggguaccuugcucuccaucccaccuuuuccuucaucagguugacuuccucaucucccacacccuucuccuuuuuauacaguccagaauccucugaccggagaaugcuucugccuacaguuaggauugauuuuuuuuuuccacaucaauuaauguagucagugccaugccucaagcuuacccagagacccauuucucagguuacucuaggcucugucaagucagcaauuagcauuaaccaucacaagacccacuccucgucaacuucacacacaaacacacacacacacacacacacacacacacacacacacacaaucaucuccuaucccuugcuccuauaggcacaugacuguguuauaauguaaaauagauucuguccaacuuuaaaauuccccagucuuugaacucugagcuuuuauacauuaaaaaaaaaaaaaaucuaaguuucuuuaauccaacagaguaaacauucuuauuccagaagaggaaauucaggguauagcaacaaaugaucagaccgaaacccaguagggcaaacgccaaauccugcagccccauguguggcauccgaggcuccugauaaaacagaauagacucauaagggcuugaguaacccccucucccucucugccaucugcagcacacacagccugucuuuugaacuaggucuacacuaugccuggagcuguccuugacucccacaguccuggcaucucugauacccuaaaguuuccauuguaggcuuuaccuucauaacauaaagugaguucugaaggcuugcucgcuugcuuggaacucugacccugccacacacugucaugucucaguugcucuccaaagccguggugcaagacuccaugauccaagcugggugaugauggcacacagccuucaaucccagcacucagaaggcagagguaaguagaucucugugaguucgaggacagccugguauacagguaaauuccaggacagccagggcuacacagagaaacccugucuugaaaaauguacuggcuaguuuugugucaacuugacacagguggaguuaucacagagaaaggagcuucaguugaggaaaugccuccaugagauccaacuguaaggcauuuucucaauuagugaucaagggggaaaggccccuugugggugggaccaucucugggcugguagucuuggguucuauaagagagcaggcugagcaagccaguaaugagcaucccuccauggccucugcaucagcuccugcuucuugaccugcuugaguuccaauccugacuuccuuggugaugaacagcaguauggaaguguaagcugaauaaacccuuuccucuccaacugcuucuuggucaugauguuugugcaggaauagaaacccugacuaagacaaaaaacaaacaaacaaaaacaaaccaaaaccccugucaugugccucucagucugacaucuuccaaaccucccaaaccaauagcacauggcugaccugccagguucugcugccagcuugagauagugccugggcuccaugggccauagcuuuggcuucugcaugcugcccccuggaaaaugcucucuuuggaggaauaggaaauccaccccuucagccauagucuuaguucaagcuuucuucacauauucuguguuuccacaagcuggagccuuugaugcaccuggugagguaucguccuugggaaaucucugcugcccucccucccggugcagcacaggcaaaucuguucagcggugcugaucuuuuuagcaauugcaccgacuuucucggcauugaccugacccguguggagauucucccuaccaaacagauuagcucaauacauuccuuuuugacucaaguucucaggacacugacagaaugaagccagaucaccguagcccaguuccugauagaacuguucuuccuucccucugaaaccacaugagcugaccggccuucacugucuguccuuuaagcagucuugucuccuaaaugcucaccagaacagcucauuaagcucugcuucugcacgacucagaugagccuuaacuaccggggacccccugagugaaccauguagagccggggaucgauacaaaagcaagagggauuugcacgcuggggcaguucugcaccagaaggagaggcaacaaccccagguggcuuguucagcgaguuuuuauacaguuuccagggguggaauagagcaucagcaacuaggcacaaugugauuugcggaacagugcgcccuuuaaacugauuggucuuuagggaaugagguaguaggggcuucccauaucugccccucuguuuuucugagacauguaaucagccucccccuucuggaggggaggggugccuauguguuccaugaccucccucuuccaggaggagaggggucuucauauucuggggccugguggaauuuuccaaaggcccugagcugaccucuucacuuacagcaugcuggggcuuuuguagcauaaagcaccaaacucugccauauuucauccacaaaacaauuccaagggccucugcaccaccaugaggucagauuaguuauuacagccacaaaacccacuccuggugccaauuucuguuucacucuuuuuguugucugggggaaaaaaaauacucugacuaaagcaacucaaccgaggaagaguuuauucugguuuacagggucagggguacaacccucguggcaaggucaagguggcaggauuugaaguaggugguuacaucaucucaaaaucaagacgugggaagcggugaaugccaaugccgcuacugcccagcugcuuucuccauuguauauacagcccagaauccccugcccagggauggaagggucuuaucugcaguuagcauggaucuuagaucaauugauguaucaagauaaugccccacaggcauggcaagauucucaucucccaggugaaucaaaguucugucaagcugagaauuaauuaucucaugugggaaccaugaucccgagguggugggggaggcagagucaccaucccaggaaacagacuccagaguacggaucuaaaguauuaugcugugacaaguauuuuuauauggccuuuggacugauggagaaucaacauaagcucuggaguagccaaugaccccacugucucuauggggaggugccagcugccagcacacaggggacuuccauaaggauggggacgaggggggacugaagggaggggggagcagccacuacccuacucugggcccauucuaaggcugcaugccauaggacauggacacuugcacuauuagggcuguguggaagccucccucacuguccucaugccccaccaaggggccgcagcacccacaaucacagauagaauucacuuucuuucuccacucauuuuuagcaagaaacucccuucugaguaugucugguucuuucaauuuugucaguucaggucuuggagucauuugaauaucuuacuuuuccuugcccucagaaucgaaugcauaccccauaaacugcucacaacugggguguucagaguuugcaucacacgggaccaaugguuuccuguaacugugcucaccucaccuccagagaccacacucagauuaaccuccuggaauccuccagcuuacuuucaauuacucccccaaauuuucaggauccuccauugccuuaaaauagucuauaucuacuuguagaaucuaugguugcauagcaagcccaaauuagcucaaauauaaacucuguauauguacagauucugugggucaagaaugguguaguaagugcugggcgugauggcccacgccuuuaaucccagcacuuggaaggcagaggcaggcagauuucugaguucaaggccaaccuggucuacauagugaguuccaggacagccagggcuacacagagaaacccugucucaaaaaacaaaacaaaacaacaaaacaaauaagcaaacaaaaaagcuauccuagcagucuacauuuugagcuggagagaugacucagcgguuaaaagcacugacuauucuucugaagguccugaguucaaaucccagcaaccacaugguggcucacaaccacccguaaugagaucugacgcccucuucuggagugucugaagauagcuacaguguacuuacauauaauaaauaaauaaaucuuaaaaaaaaaaaaaaagaaugguguaguaagagauuuugucuuugcccuaugucuggaauuucuacugggaagacucaauggcagggguaauugggcaugguagucuccaaaacucauugauacugcccaucguuaaacuucguuucauggcuagcugcugggaagauucagacuuguguuggucuggugacccagcuuccuagucuguggacuuaguucccugaaggcagaggcugggguguggagcucugccugccccagcagaggcuacgcugcagauugagcauggaacccuguuccugcucacccucucugucugaagcucaacccaggggcugcgccguaggacucugguggguuucaguguccacuaaguaugguguccuuuuccaggugcaggccucccugggccugagucaccucugguuuugcuugugggacucgcccuuggguucucccucuccuugauuggcagcugcucccugggaagcuuugcuugauauuuuuuucugcaguucugcacagcaggcuucuacauuucauccuucauccuucucggcucccagaugauaauuuauaacuggcgcuggauaaggauuucuaaaacuucucuuaaguucggcuguuugcccuguuuguuaaaauucuaauucgaguaaggcucauugagauguuugggguuuuugugauccaucuguagccugaaccacaggaggccugugcuggcccucugccccgccuucucuuugcagcaggcuugcucugacugcaguuuggaaucgucuugucuagcugccugccucucagcucacugccucacggcacagcuuugaugaaaggggaaaugaaucaccaguguuggaucagguguugacuuccuguguacaacuuccuguuagugggugcacacagauggaauuuuucgaauacuaauaaaucauugacauugauuugauuugccuacaucuugugauggcccuggcugaggagaggaaggguuuucuugauuacuuagacauucgcucucggaucaagcgacacacaguaaauacaccugugucuuccuuuuggaauggcugcaaagggguucaagcuacuggagcucaagcgucuucucagaugccugagaugggaaucccaaagucaucauugugggagcagagaaaagcgccugggcuggagugcuaagauggcugcccgugaggcagagcaggcugcagagcaggguugagcugcagcugugagugugguggaggccagagaggcugagagcagacugguucaggugacugaaggccuggacaaguggaaagcaguuugagagucaacagaguggcuuucugggguuggggguguguguggggggggagguguguguggggagguugggagcucucugucuguuagguuggguugucaccuguauguuaggugcucuuuuuuuuuuuuuuugguuuuuugugacaggauuucucuguguagcccuggcuguccuggaacucgcucuguagaccaggcuggccucgaacucagaaauccuccugccucuaccucccaagugcugggauuaaaggugugugccaccaugcccggcccuagguguccauuuuaugggagccuugugagggugcugcccccuugccccagcuucaugucucuucaggccugguuuucugauuuaacuuuaacacaccaugugcucauacacuuuaguaacucuguagaggugugcccuucuauaaggggcagccauugucaguguacuguguggcugugcuaggcaggugaggcccuucacaugucugagaaaauguucuugacaaaauccuccgaauugguuauaaaucacauuuuuaucuaggaaguuaccccuaauuaauguuccucaguuuaaaggcaguagauauauuugaaauuuggagaaaacaaauucaguuguuguuguuuuuaaagcaauuuuuauucugucuuaccauagucugcucaucuauuuuucaaaaagauucucugggauuuuuuuuuaauuagguauuuucuucauuuacauuucaaaugcuaucucaaaagccccccauccccugauuuuuuuuguuuuuuaaaggugaauuuaaaucccuauauuugucuuggugcuaggagacugaucccaaggccuugaucauaccaggcagucuggagcuguucagucucaggagauuuuuaugcauucaaauuguguaacuugagcucuagaagcuaauuaaaaaaaaaaaucaagccgggcagugguggcgcacgccuauaaucccagcacuugggaggcagaggcaggcggauuucugaguucgaggccagccuggucacagagugaguuccaggacagccagggcuacacagagaaaaccugucucaaaaaaccuaaaauaaauaaauaaauaaauaaauaaauaaauaaauaaauaaaucaaucaaucaaucaaucaaucaaucaacaugcucuuuucauugcuauaauagauaccugaugcagcuaaguuuauaaagauuaaagguuacuuaccauacagauucaauuugggucuguagcagcuggguucuagugagaacuucagcacaugagaaugguauugaagggaguugcaccaccaaccaugugauuauguuuuggaaaaggaguguaugagcugagcugccaaaguugucacaaggaaaugccucacuuccccaguuacccaaggaccuucuacugggccucacuuccaaagguucccuugccucuguguaagugugugcucugccucccacccuguuggaccgaccagucuguaaucauaagagaucccuggagauucccaagccacagcauccucugagaugucagagauggucuuugauggguaucucccccuggccuuccagaugugcugcuuguguugccuugauaacagacugcucuugcacuuucucuguggccaaggcuagccucagacguggggucuuucucccuuggguuccagagaacugagauuacagguguuugccccuccucacucccuccaugagagaucccuauguggcucauuauaauaaagagccuuuaaaguguucuccucccuguucuucuggagcacaucucccaugcguccuggguuuuugcuggucuuuccccagaucucucccuugugugacaggggaaacucagagaacuaagcacagggacagagugcuuccuccacguggccgugccacagagaagguggcccaccaaugguuagcacaggcccaccccagcuuucccuggcugcccuuugccuuugcaaagagucugguagguacccagugguauuuguuacauggauuggcaacacuuuuaguuaaaacuugaaggucaucuguucugcaaaaucauucacagugcuguuagccucugguaggaauauuggaucggauuguucaggacaccaacccacgguguggugagauggaaccucuucacuagacacgaucugauuggcugaugagaggagcucacaaggcggaguaaugguuugcuuugcauggccuuccuacugccuuggggguuaggacuccaucgagaauucaugucauagucgccgucacgacuauaaugaaaacgacugagggcauaguuucuucuuuggggguaaaaugguauuggcucauuguuuauaguguggaguugggagaaagaggcuuguuuaaaauagccacugucaucaacaaaguggagugucaccucuuggcagcagguacucccguggcugcagacagcugaacacggcuauggucuugccuucugggcugaggaaaggugagaagauaacagaguuggugcagggcagauccagggauggcauagagaaaucccugggucugaugcugaugaugugugcuuccugugacuggugagcucguccaggugccacaguaggccauccucauacauucagauuagaacuuugguucuuuaugguuuuuaucugaacucacugccgcaugcaaauauuuguuuguauccugauuagucguaauuguagauuugaagucggagcccacauaaaggucacuuuucuagaaaucgcuuuucuuuaguuuuucuuuucuuuuuuuuuuuuuuuauuacguauuuuccucaauuacauuuccaaugcuagcccaaaagucccccguagaaauagcuuuucuagaaacagguuuuguuaaguggaaacuucauuacaaguggugcuacauacuuguaaucccagcacucaggaagcugaggcaggaggaucaugacuuugagccagccaaucccaggcaacauaguuaguucaagacuagccugaucuacauucauuccgaaaccgucucagacagcacccaccaccaccaccacacaacaccaccacacaacaccaccacacaacaccaccacacaacacaccacacaacaccaccacaccacacaacaccaccacacaacaccaccacacaacacaccacacaacaccaccacacaacacaccacacaacaccaccacacaacaccaccacaccacaccaccacaccacacaacaccaccacacaacacaccacacaacaccaccacacaaaacaccacacaacacaccacacaacaggacuucaucacagcagaaagagagaggcuagauggcacggugucuucuuccccuguguuucaacccuggacagccaaagcaagcgugcaucuuugggauguacaaagacagauggcagccuuuauaucaaaugccugaugugccugaauucaaaugcaugcugccuuucaggcaaugcaugagugcccuuacuuaccccuaucugggggcucucggaauuugucccaccuauaucugggggaggcucucaaaauugaucuugguccaugaagugugcgugacaaggccugucaaaacuaaagcaggugauuucccacauguccccaccuauagggacguuucugguauaaccuuucccguaggagaguuugguaaaaaucuccagugaggucaauguccagagggaaagccaugcuuuauuucuaagaccuguuauuaaaagggauacacacuacacgggaucuaaugaaagaaacaaaguacauucuugaaauacagaauuuuguuguuggauugacaaugccaacguggugucuuaagagcaaauauuuaaauauagaaagcaaaagcccuaucacucccuagcugagacuugguuacuuauccaaaaagucuugacguugauagcagcgucacugggagugguccgaccucagugagaugcacagaaccauugagauaaacagcaguuuguaguuuggggaaaccuaccugcuaaaaacugagggaugcuuucucugugccuuugagacuuuauuagucugcauccuguuacacuacuccaggggcaguggagaagaugggaaagcuagagcuuuugcacuuuauaaaguaugaguagaggagagcaaugggacguggugucuauaggaaguugugucuggagauucagaagacaguuggcauuuucuugugcagguauccccgccuccuaaucucccccuccuccuucuugucuuaaugcuuucgucugaaaguuuacgcugugcccaccuccaccaaggcccuauguugaaauccugauccucgaaguaaugguucagagugaugaugccccugggacucuuugcuacacaaugacucggcaaaggacccacgcugaaggcuggccucgaaacuguaugccagccacccaguccacagugcuuuguuaccacacagacaagacacuucugcuuacuguuuuguuccauccagucguggcuuucaggaguucugucugauaugcagaugugaguuguaagaguaaggggucacugcauucguaacugcaguuguccacggacagcgaucugccaagggaucacugugauaucuaacuuagucauuauaugauuuguccaugacauugcuccugcucaccauguaggagcguauguguuagugccaaacuguaauugaucuagguuuggggugggacucgacucuugucagggaucuugucucucuuaauaggucagaugaucacagaaguuuuaaagagcacuuucaaaacuaaggaauaggaaacauuuaagaaaugaucaaucaugcugaguuugugagaugcacaaaaccugccuaugugacuggagcaggugagcuugccugagcccuacagucagucagcacaccugcccugcugugcagacaguagguuuuccaaagugcucuaauuuccccccaagaugaggaccccaucucaccugauggaucucagaguuguuauagaaacaaguaguuggguagaauuucucauugaaucccacaggaugcucuuggcuuccucugcuucucuguagcucuacaguuucccuggggaucccugagccuacauuuaaaauggaaccugggaagcaaugaccuagguucuacaaucauguuaacucguucucaacugaaauagcuggcccagcaugaucaacgcuuuuaacaaauucucucaggagaaaauaaauuucccaguucuugguaucugucaucgacauuuauuucaucugaaauucaccuaguugcaccuuuuaucaccuuugggaaucuagaguacagaaauaauggcauucauagagaauccccugagacauccuugugcuggaagcuaagguggggccauguguauuuugaaucuacaagggugccgugauuacaguugaucaggaugcagagucagccaucugaugaccccaggacggacugcccuuguccugguguggaaguggcccuccugcucugcccuacugcaagcaguugacuuacauuuugagucugaaauuccuggguuuuaaagccauaggaaaagugacuguaguuuuauuaagggcaccauuugcuaacuuaagguccuacucugcuuucaguuaaaacaaaagcgaggaaaggucccacugcagccuucacgcucucagagugaaggugugggugggacgaucagucugcaaccuaaacuacagguguagaaugggggauggggggagcauuagucagcauagugccuuucaggaguuauauugauuguagcuugcuuaucaaagacuuuuuaacagcugacauguaagcaaauacuuaacaauauuugccuuuuguggucaguuacuucaggaugauuuuuuuuucuaucuccauccauuuaccugugacuuucaugauuucaauuuaaaagcugagucauacuugacuuucaugauuucaauuuaaaagcugagucauauuuuguuguguaaguguaccacacuuuauccauucaucuagcuugauucaguuucuggcuauuaugaauacaguguacacagugagaaauugucuucuguaguaguauguagaguccuuuguauccccaaauaagaguucguacauuauagguuuuuuccugcgaaaguucuggggcugguguugagucucaguggcugagugcacaggcugccagguccuauaacacccuuguuaguuggcucacaaccaccugugauuucaguuucaaggguucugauucugaccuucgugggcacccacacuaguguauauacccccacacacauacauauacacauauaauuaaagauaauuuacaaaacccggaucagcuucauuaguaguuggauuuuauauuuaucuuauaguaguuaauauuuauauuuggaaauaacauuuuuuuccuuuagaaauauucuauuuucuugaaaauuuugaugacuuuuucuacagaugaauuugguaacagcuuaugcagggaauuucuauguagucaccauaggcaugccccuauuaaaaacuauggcugacaagugagagacuagccuucccaacacagagacagaaaguagcucuugagucuuuugcuucuuuuucuauccuggcacaagacacaaggugcuuuguccuggucauuaacaaagcauauucacacuauaaaaguuacacaacaaccugaccugggggcguaggccuugaaucccagcacucaagaggcagagacaagcagaccuccaugauuuugaggucagccuugucuccaaggaguguuucaggacagccagggcuacauagagaaaccgugucucaaacacccuccauauauuaccuagcaguuugaacaugugaucuuaccauagccaacacgguugaugcuuccagccagcaaaugaccugucuucugagaccaugucaaacccugggaagaagacccauccauguccagagggucaaggccacugcugucugagggaacggcaccuccagcaguacuuucucaucccugcaugugcauggagggagggagaccccaccucacugguuucccuauucuguguucucuguuucucucccuucucugcuuaaaucacagcauuuuccugaggccuugccuggguugaagccaugggggaguguguaacuguguauagccacuguuuguguaauacuggcacaagaaagaaggggaaaagaauggggguccacggugaacaccacaucucuucuccagcguucccccaaaugagugcuugcaccucugcacuaaugggcuuucucaggguuuaacauucuuucagaagauagaaauaaaaagaccaugcuugcuugcuucccaggcuggccgugaguuaugauccuucugcgucaugaguguuaguguaagaaaccuggauccccaugcccggguuguuuuuuugucuuuuuguuuuuuugguuuuuuuuacauuaaaaaccagaagauacuggaaucauuuagagccaucagacuagcaggauguccuaauaaaggcaucuaaagaauaaaacggaacgaaaggucuaaaugacugugauaaggaaaguggguggguaggaagcguucugucuaaggugggaagauuguccguacgcugcuauuagugaagcauggaguuagagucaauauggagagugugagguguauuugggagagacauaagcuuguauuuacagagagcuggaggacacaaguguugacuucugcgaggauugggaggugggagauuuuuuuaaugauguuuuaauauugaauuaugaaaaauuaccuaccagaaauaaaauuuuaaaugaaaauugaaacaaagccugguuuuguuuaagcccauagcauuugugacuuuaccaguuguccuugagccuaggauagggucaguugccagcuuuuuuauauauauauuuugagagaaugaucauagcuucuaacuacuuugguagaaaguuggaaauuuaaggcuguauuugaaucguaguuucuuuaacuuguuauucuuucaggauuuuuuggugccugcuguuuagaauaggaaugucugcauaugcuuugguagcuacaguuggacagugaacuugauuaugaucucacaucugaggcuuuguuuuuugcugauguuugaguguguagagaaaaaaaaucuuagaauggucuggucuugucuuuacaggagcagaagaauccagauucggaacaucccgccucaccugcagugggagguaagccugcgcgcgagugcuuccgugacccgccuuucuuuuacucuaggaauuaaaggccuucagacuuccccccaaaaccucugggucacaggguacgugaagugaguuaaagauuuuaucugucccucccuggcccagugcacucugaccccucacagguggcucccucagguacccggccacugaguaccagcacaccagccaugugguuugaugaccagauuuuuaucuuuuaccauuuuaucuuuuaccauucugauugguugaggccuguagaaacaaaguuguuuguuagaguacauuuuuuguuuuguuuuguuuugaguuauuugcuaugaguaaaguuaagauauauuuucagagcacuaaaaguucugagauugcuaucuuaauauaaaauacaguagaauuuaaagaguggccucacuguuaagaacaaacugcccuggcccacaagaaaccaagagagagagggagagaagggagggagacagacaaagacaagaaagaagaaaaaggaccaagcuggagaguuggcucuuuuuggaggacacaaguucaauuuccaguggucauauuaggcagcuuucaauuaccuauaaccccagauccaauacuucuggacuuuucagacaccuguccuuuuguguguguccucauguaaacacacaugcacacauacacaugugugcacacacccaccacucuuaaaauacaaaauagccaggcauagugcuguaugacuuuaauucuagcacuuaggagacugaggcaggcagaucucuugagucugaggcuagccugaucuacauagggauuuccagggcagccagagcuucugacagccagacccugucucaaaaauaaaucuuaaaaagaacaaacuuuuaaaaagauguaucauuuuuauguguacuuaugugugccagcaugggucuccguacagcgcuuuagugcaggggcacaggagacguuacaggucgugagcugccagguggguguuaggagggaacucagaaccucugcaggagcaguguguccuccuuacuucuaucucuccauccucaagauguuacuuagaagauaaggagauccuggggcagcugaaggaaguaggagcuuuguccucuccugcuucucauuucagcagcuugguucugguuaucuuaggauaauagcuguucauuuaccaaggcuccaacauuaugguaucaccuuagugaauagagaguuagaggaggaagaaaagagagagagagagagagagagagagagagagagagagagagagagagagagagagagccagccagccagccagccagcccgcccgcccuggguccucagauucguugaguuccauuuuuuauggaggaccugaggugcuggcuuaguuacaucacuccuguaguagguuguuucucuuacagagggaaacagaugucguuuuugugacccuuucuuccuguaucuuuacagguguuggaugggcuguuggcugaauaugggacaguggagaacguggagcaagguaagaagugaagagucagccccgagugaggagaguagccuccugaacuucaaggaccuugccugcuguuucuuucagguugggauuguggggagaaguaguaagucccagcacaccucugaagugugcuuccucuagcguauuuauccacugucagaggcagcugucugucgguccuguacucuguauaucuguauaguuuguuguucgaggaguauuaucucagggucccucuguauagucccgguugaccugaacucuauauagaccaggcuagccucuaacucacagauccccaucugccucuugacuccaaaagcugggauuaaagguguggccaccaccucaggcuuacuaaacugcagugcuggacagacaguuggaauggggcaagcuuacugcgucugagaauagcugaguuuucauugaugccccuuagcuagcuggggcucaccaggaggugggaauacagccuaacgucuguuuccugugaggugugaccuccacaccgagguuccuguuacacuuaugaaagugcagguucuaagguucaccacauaccucuggaaacugggggucgauggggggggggugcuucauuccucaugaaugaagaaucugagugguuuugugugcacucagaucugagacccaucaucauaggaacaucgccgcauaugccaggaaacacuuccuuuuccgguaaagccuggagcacugauguuuuaagggggccaaaggcaccugaagcugcucguauauagcucuuuaggccuccuaggaagguagauccuaacaaugaaaacagcaaaggguaguaaagauuauuuuugcauugguccuggccgguucuucaagaccuugauccugugagcugagcuucaccaacgaaccuuacugacucgguuuccacuuguauaaaaugaccagaauuucuccccuuccuguaucaucaaauggucacaccauucaaugcaaaggcauuuauguauuuuguacacaaucauaagggaccauaaagucuccaggaaaagaucauacagagucccaugccugaccaaugguccagucuguccagguaguuagcauaauuguuuugaagcagcacuuccuuggguggucuccccucugcaauuggaaagaacuuuacucuguuucuucaugcugcuugccccugcucagaguugaaagaaaagcacuuagaagaaaacauguuuucuuaaaaaguuuucacuuaaugaacagaagacauucuaggggacagagugggcaagauggcuuuacagguacaaacuugaaaacaguuuuaaaagcaaccucaguagcuggucuggauaugguggcacaugccugaaauuccagucuggggagguggggcuggauuagcagcuggaaaucaguucaggauggugcuaccugaggagggcacgggacaauacguacccuucagugcccgagcacuggagacggcucggcugccagugccucaagccacagagcagacuauugagauguucuuuuguccccaacuuugugggugauuucugacccagcagaagcaaucaguggagucuuaggaacacgaauuuaguaagcagugaaguaaauuacuuaaguggagcucagcuugcucuagaaucaaaggaccaggugacucagaagaugagcuucuuugaagaacaaagacuauuagugagaagugagggcaaaauaagacugggaugccuaguggaugucuuuuuugggagucugagucuacagccuucucugucagucuagaaggcuacagauagucaaccccugagauuggucugacacugagugaggacggccauguaucacaaggccuuguuuugcacgaugccgugggcaucccugaauaagcaucuucagaaagcagcuggcaugcuccugggcagaggccaggacugggaucaaugccaguaguauguagaucacuguucaguuacugcugaugacuggguauguccuaccugucccucaguaccaccuccccaaggcugaagucguuuugagaucacugggcagaguguuuuuaaucccagagucuuugacauuuagggguugccagauuccuuuaagaaucagagucacauuucuuuaccuuuuauugauguagcaaguggaauggucacagaacuaaaaguuuaagaaugaauaauuugugugcauggguguacauuguugcuuuuuccacauguaugucuauguaagcauguugaauccuguggaacuggaugugaacaguuccaguugugagcugcugugugggugcugggaauugaauccagguccucuaaaagagcagccagugcucuuaaccacugcuacuuugaaagucagcuuuauugugauuuucuggaauuaucuuuaaugcuauuaacuuuaaauauccuaaugucauauuuugaagcguggauaugauuaucauucuugcuuuuugugaaaacauauuuuucauuuagguguuuugcuugcaugucugagugucuguguguguguuuacagauaggaccuaccuauguaguccaggcuuacuauacuaccuugauggauagacggaugggaggauggaugagauagauauauagauggauagauauagauauauauugcaugccacagauauauuuuauaaauaugauugacuuuucuuaucaucauauauaauauacauaaauauguguuaugcgcgcacacacacacacacacaaaggaugucuuuacuagaagacuccacuccagccauuuuuggaagucugguuuuucagccuucucuguagcucuagaaagcagaauauaggaaacauucuguguguuuugaguuaacaauuaaaauuaauaauaauaaauaggucuagaaaaacaguuucuuuguuuauuuucauagugucauauucuuccacccauuuuuccucuuuaguuuuaaccuaaggaaguaaauucagaagaauacagaucaaauaguguuuacaacagaggugacucggcagcacuuggggugacagcgcuggauacagcacauucccaaggggcuaacgacgaggcaguccaugcucuguuucuuuccugccacucuaugugacgauuaaaagugaaaauacauaaguacacagagacaauccacaugcacacgcuuacuccgcacucacagaagaugugaaguagagggcagcauauuauauaugcagcugauuacagaguauucugugaguugauuuacaaauccuacagguacacacuaauagacacagagacgcgcguaacuacaguuaagaugaugcagugagccgggcgugguggcacaugccuuuaaucccagcacucgggaggcagaggcagacggauuucugaguucgaggccagccuggucuacagagugaguuccaggacagccagagcuacacagagaaacccugucucgaaagaugacgcaguguuuugcaguucccauccuuccuuggccccggggaugagagcugcuuuuaaauggugauauggcuguugcuuuucuccuagucaacacagauacagaaacugccguugucaacgucaccuauaugacaagagaagaggcaaagcuguaagugugcuugguuucauucccuugaaggguuuauuuggguuugucuuugguguccuuugaauguggcaucuggaaaccuuugccgagaagacagguaccagccaguccacguccucucagucaugccuguacaacuccaagggguucuugcugcuuuuggugugucaguacaaccccauggagcucacaccaggcuguuggugauuguacagagacugccuugaacggugcugagccuuggcaucagcaaagacaggaaccgugucaggaagggaggaccagccuuaugcugcugaaccuauaggcucugcuuugacaaacuuuuaugaggccuuuuuuaccuggagcaugcucuguucuccaugagggaugugcacagcuuuccauccacccucacugauggagaauaaaacaaccguuuuccuaugugugauauuaugaggacucaccucugugacaacagcuggcuuaguuauguggaagugucccacccacgugccuggcguggacucucuacucucauucaugacuccgaugcuccaguaaugauuaauuuugaguuuacuauuaguagauugggaguaaguuuuuuuaaaguaauggcaaaagccaaguuucuuuuguuuuuuuaucuuuugggcuuuuauuuauugggggggggggggguugggagagggggagguguaccaucaugccuagcucagaaggcucuucugguaggagguccuugaagugccucauuggcaguguaacuuagaacuauaacaguguccguacuucauggcuauggaguagcccauacccaucccuaaaguaauaaccucccugcccuugugaagacaucguuugcccauuuucauaccaacagucuucaggagguugguuaauuguucauuguucaagugugggcaucugcugugaagcuuggcagccugcgccaucaccggcuaacgcauccauagcccagugccaccugggcggcaguaucuacacagugcucucucaccuucauugaauucugaagauuuuguuuuguaauaaauuugcaaacucucagcauuacccuaguaggauugcugcagaaauguaaaggcacugucccauuucauguauaauuuuuaaauacaguaaugaauuguuuauaauaguuauuuuuuagauaaucuguaaccuugaggaucaaaggcauaaauaaacucuaaugucuguagaguaaauauugaauaacuauugaaauguugccagacggacccugggcccucuaaucucuggguauuugccccagaggagcagcuuuaacugcugacguauccauggcaacaugugugacuuuugagaguugggcauaauuuacaaacuccaaagggaagcuccacaguaaaaguugcaugaagccauagaaggcugaccucauuuuaaagugugucaagugggaugggcagggaauuauaucaaaauugauaauguagaauguuuauagagugcuagcuggauuuuaaggauuagaaauaauauauucauuuuaauuuaaguaaauaguguauaaaauagauagggaagguauggaauaaagagcuuccgaaaugucucaaauauauuuaaauuuugugauaugauuaaaguaaucgugaagaugugcuacgacuaaaaagaaaguaauaauuuuggacccuuaucuacaguuuucggugagagggaaagaaaagcgaggugcagaauuguaucuaagucuaaauacuaggucuaaauacugcaagaguuuguuucauuuuguuaccugagacuccaggggcugagguaguguuugucuugcucaccucugugucagugcuuggcacaggcaccgcauggcuggcccaugagcaagaugaaucagccuucugcggucuucccuagucucucucugauaagcuuucccacccugcuguguuucagagcuauugagaagcucagugggcaucaguuugaggacuacuccuucaagauuuccuacauccccgaugaagaggugagcucuccuucacccccucaucgugcccgggaacaaggccacggccccgggagcucuucucaggccagacagauugauuucccgcugcggauccugguccccacccaguuuguuggugccaucaucggaaaggagggcuugaccauaaagaacaucacuaagcagacccagucccgguacgugccuccaguguuuccucugcuuccuucugaggggucgccugcaucccgucuaagccauguucugguccuuugcugcuguagugggaagcugagccguugugggacuccgcugcuuucggugggcuaacaacagacucaccucaggcugggggcugugacgaguguucaugcuaaugacauaaccgucaucccugaagggcuaaguuuaugaagagaguacugaggaccuccaaggaagggugguccuuuaugcuaacaucacaggagcugagauguguucugugggggggucauuggaugcuuuuuccuccugccuagucagcugugguguggccaucuccauugccaucuuugggucacagcuacaucaagcaagaaagucuggcuuuguauugugucugauuuucuguuuuaaggagacuggacaggagguagcaguccauggcaaaaugauuugugcaguuguugauuuucauauguucguaagagcacagcacacuguggagaggauacggaccuugagaacagugacuuguguucggguuuuuauaaaauauuuccuguuugaguaucaauugcuucugggaaaaaggaagccacaacgguuuaccuagauuguugugagaaugcaaacagucgggcagagcaaaugcgcucacacugcaaggcaucagauaacaagcagauacucggagcugagcuggggaacugagugagugcucuguaauccagugugcagaccccuuggaggaaugcugaaauaaguuguggccugaugcccauuuuacucuaaaaaccagcuucuccugucccaagcuugcacauuauaaaguaauuuuuauuuaucccuguccugauuccaaaaguuguguaugguggcuuuaaaaggaagcaaguuucagugaagugaaauuaguucucaaaauaugugccagcuugagcaguaggcugaaggcuggguuccuucuaacaggcugugauccguucugcgauucgaaaaguuaaaaacaagcaggacccagaggucugauaaagucaucagacuuuuaggccauuaguuuuaagagccuggaagacagcagacagcaaccgaaaggaaaucaaaaucuuaggaagucagagaaaggauugauucugucccucuguagaugcccugauucguaaagcaugcuggaauuugguucccauauggcuuuuaaaggcugugauuggugcagaggucggcacuguuccauugugcggcucccuacucuuuuuaccuacccuccgcuucuacaggcauuugaaaggcuacaaaaaauaccucauuaaccaaacuggcucuuuccagguuggcuggacgccuugguccagcagcacucccgucagaaaggcacgagccccaccuuacacuaacagcaucagcugcaagugugcuaauggcguuuccuuccucuguccucacuauaucggcuggggcugugcuuucucgugccuaggcccuauccgauacugcugcauuauggcucccaauucuuuuccuauaggguagacauccacagaaaggagaacucuggggcugcagagaagccugucacaauccaugcuaccccagaagggacaucugaagcaugccgcaugauucuugagauuaugcaaaaagaagcugaugagaccaaacuguaaguuuguauguugcccagaccagucagugcuguaagaugaagauaugcguuuaaaagagcgaagcguguuuguuacucaguaaaggaucaaugcuugugauacucagaauuuucucagaugaguguauagagaggucgauaugguuauuaauacauauguaauauuuaucaagauuuuuuuuuugauuauauacccagaaauugggauugcuggauuauaugggauuguuuuuucauuuccuccggccaggccugacagguggacccacuuagccaccagagaguaggaaauagaaguggaguuaucacuguguggcuccuuuuagucagaauucauaagcugagguuggaaaagaacuugaaaaaaaauuggguuuccauucauaaagagugagcuucgugagucuugggcgcuaagucggcagccguccuacugcuugccccucugucuuuucagggcugaggagguuccucugaaaauccuggcccacaauggcuucguuggaagacugauuggcaaagaaggcagaaaccugaagaaaauagaacaugagacagggaccaagauaaccaucucaucguaagcuaccccuucugacugacugugcaggagagagcggugcugguguuccugucuccugcuugucuucagaggggaauacacucagcuguacccugagcaucaugggaagcagagccacaguguagccacauagcccgccgagcacucacuggcgugagggaggcccuggccuccauccccggcaccaugaaauucuuaaaauaaaaauuaguagccgggugugguggcgcaugccuuuaauccuagaacucgggaggcagaggcagguggauuucugaguucgaggccagccuggucuacagagugaguuccaggacagccagggcuauacagagaaacccugucucgaaaaacuaaaaaaaaaaaauuagccaggucugugaucuaggcuuucagaagucggcugaaccaaaaguuaagggcagcguuagcuguacagugaacugaaggggagacuuagugagacucuucucaaagcauaagguaagacuuggggcuggggcuacagcucagggguagaaggcuuuuccuacacgagugaggccuuagguucaagccacagcacccucuuccccucacauauacauacaugugaccaaugucacuaggaagacuuagauaucggggauucugugcaguaguguuaggagauaucagucuuuaucuuuaucaggggggugugugguguggggucuggaauuuaacguugcugucuuccccaccggccagcuugcaggauuugagcauuuauaaccccgagagaaccaucaccgugaggggcaccauugaagccugugccaaugcugagauagagauuaugaagaagcuccgagaggccuuugagaacgacaugcuggccguuaacguaagugcccgguccuuccaucucggcuaguuuucccgaagcugagacaagacaagcucuguaaggauagcuguccuuccgcugauggggaagugccuugggagaugcgaaaaacuucuggcuuccugggauaaaggcaucaaaacaagaaaccaucaggaaaacuguaguuaaacacaagucaaugugagccaaugaaauuguaccauccacaccauaaagggcggugaugcucagggccacuuagaaaaggaagcggucagagcgggguggcucguguguaugcagagcaugcaggugaucaggacugggugcuggacaugaaaaucaaaguaauagggccagcaaaguagguugcccugguuucuaagcucguacaauguugucaugucuucucucuuuaaaaacucaaguauaucguuuauccaggcacacaccuuuaaucucagaaccugaggggcagaagcgggugggugucuaugaguuugaggccagucuggucuacauaaugaguuccagaccaucuggggauacguagggagacccuuuuccauuuguuuguuuguuuguucguuuauucauucauucauucauuuaacuguauccaccgagcuggaggugcucuucugugguaauaucacauauuacauacagcauacauaaggccuagaguucauuaugcagggucagaaacaaaugccaccucagggcacagagaccuugucuagccugggcugcucagggacuaaagcugagggcuauuugaagcaggcauuucaggcugccugugggagagaagaaggggcucacuucucacuggcaucucuuuuuuuuuguuuuguuuuguuuuuguuuuuuuguuuuucgagacaggguuucucuguauagcccuggcuguccuggaacucacuguguagaccagccuggccucaaacucagaaaucccccgccucuggcuccugagugcugagauuaaaggcgugcgccaccaugcccggcugacucacuaacaucucuugcucccugguuggcacucuaguaaaugcugucacccacuugaaugcucugugucacuuguagaagaguauacauucuuucuguuacuuaacucucacuuuguaauugucuaaaaauauuuauucaucagcaaggcucaacucagaagagugaaaaucuuuaauuuuucacuauaauuuucuaagaauggaaagggucagccaauauuaacucauugaccuucauuugaaucuucaucuacuacuucauccccacaucucacagagaagcaaauauugccacaguggccuggugcagccccacucucugacagcagcacucuguauaggggcaucagucuaucccacaccucugcagccccaccugaucacccauaccgcacaguaguuguaggacaggauggggaggagggagagagaggcgcguccuccuguguagauacaucucgccaucuagcucuuguggacuuugcugaacaucucuuuccauggaaucuggauguucucagaagaggcaucagugcgccucacgucaccguaucagaauauggcacuagauauccgugccaaauccaugcucugugagcaaagucaccaaaucaccagguccuaacauacaacucgaggugauggugaaguuugcucuucugcaugcuuacauaaaggggcacuuuccagggugacuuuacccacagagaaacaaacagaaaaucuaagaugauugcuucauguucaggaggccaaggguuggagcgggcuggguaccggccagcuuagagacauuucuccgccuccagcccuagguugagaugugaaguaacaugaucuugaagcugcagcuaagugacaaaaaggcacugucauccaaucagaugugagauuugccugugugccagugcuagugugggcucugacucacccguggguaauuagaaaagacugguuuuuuuuuuuccauucaacaaauauuuauugaguaauagcauagcagacacugaauacagcucuaaacagucgcugaccucaagugaggcaggagcaagguucugagcccugugacuccaucuuguaucuuugaggaaauggaaguacuagacacugaggaaggggagggggacaaacagcagggcacaagaguccagagcugagaugggagaagaauugguggggugggggccaaggcuuagcaggaaagcagcuagugacaucauugauugcaauaagaccuaguuauacccaagguugcccaggaagcuuugaagaaaugcaacugucaggcugagguuuguugccugcucucaguaggagguaaggaaguccuuguaccaggguagagcugacugaaaugcuauugcuaugcagaugaggggguugggggggauggaggcuggccgcagcaagccuggccuccugggcuucucucccuuaucuuuugucuucuuuucuauucccagcaacaagccaaucugaucccagggcuaaaccucagugcacuuggcaucuuuucgacuggacugucugugcuuccuccaccagcagggccccguggaguuccccccaguccucccuaucaccccuuugcuguaaguaacugggugucccccacaccacugugcuuggcaccccccaaccccccuccccccggggggggcagcacagcuacucucuuauguugaggaagggcaaacacuuuuguuugcagucuugaugagugauuguaauuugaauaagaguuuuucugguggggaaaaaauaccaaaccaagcucugaacguguguucucaaacauggggucauaccaccuaggaaggaacugcucacugcuucaguaacucgagguguguuuuauaaaaauaaguuguuaguucaagcaacauucaugaguguuagucauuuaguacaaccuuuguccauaacugaaauauacuuuauagaaagaagacaccauaguguuuguauguaaacagcacacugccugauguuugagccuuaauucucagcagaaugugaaugguaugucuuccgcuugucagucuuauucacaaacaucauucaagauuaguacauuaccaaauggaggcugaagacacugaacacguggcagcuaccuucccccaccuuauucuucucuaaacacaaggacgaauuuugugggcagauuuuguuacuccuguguauaaaccauuucgucggggagaauccagugagugggugagcucuuugcugauuggugcuugcucccagaaacuuuucugagguguuugggaguacugugcuuaacacccuuaaacuaaaggguggagcuaccacuuaacuauaugugcgucuguaauggaggggucguggcugaagcacccggaugugggucacauccuuucccuuugcuuugaagugugauaacuaccuuagcacugaaaaagacacugaaagauguaucacucccuaggauagaggcugcauaaggagccuuguagagcauaucugaaaguuaggaguccuugauaacugaaauuacaguugaaaaugauguaugcaauuuaaacaccauggcuuucucuuagaccagauuggugcugggguguucaagcauaaucagucaaugguggcucauagauagcacuggggagccugagggggaagauuccaaacguuuugggccacccuggguuacaugguuagacccugucucaacaaaagaaauagaugaauaaaaacuaaagaugugauauuuucuuuuggggguuuguccuuuaaugucacgcuaaggaaaaagccccuucuucagccaagaauaaaauguuuuccuuauacuaauuuucaauuguugauugggggaagggguuauaauguauuuuacagcguauuuaucucuccccccccaccccccguuuuuggguuuguuuuuuuuguuuuuguuuuuguuuuuguuuuuguuuuucgagacaggguuucucuguauagcccuggcuguccuggaacucacuuuguagaccaggcuggccucaaacucagaaauucaccugccucugccucccaagugcugggaggguuuuguuuuguuuuguuuuguuuuuugacaaaggguuucucuguguauuccuggcuguccuggaacucacucuguaaacuaggcuggccucaaacucagaaauccaccugccucugccucccaaguacugggauuaaagggcgugagccaccacugcccggcugggaauuuaucuugaucuaaccuuauuauuuuuuccaaguguauagccaguuucucaaagucaguuauugaguaaugugcuagcuuaucagucaguuugaaaucgugcucugcccuuuguuuuagcuuugauucuuugagacagggucucuuguagcccaggcuggucucucgcuaucucugagaauggcuuugagcagccgauccuccugccuccaccuccccgagggugagggcgccaccuugcccaguuccaccugucucacagccugguucuaggcuucacccagucuagucaacugugucuccauggcagucacugcagauucccacuuucugucagccucaacagaaagcuugcuuuuguuguugugguuucccucaaagaaugaauuggaaaaggguagcuuuuacuauuugauuuuuuuuuucauuccuuuuagacaugaucaauccuacucauaaaacaccuuggccugccaacuucuauuuggaaaaaaauuuaaugguacuuugauguauuuaaguuaacuagagaggauauguuaacgagcccauaggggaguuuacugauagccuucuccugaggccccaccucacugagacuacuccuggugugugcagaucaaggaagcuggcaggguuaagaucuuaggcugcagagucggauauagacccggcuucacaauuugcuucugguuccugcuucucaguguccagcccccaaacccugucccuccguuguccuaagagaacccaccgcggauaagcugcugugcacagagacauucagucugggguagaacagugaaccuuccuaaccuuggaaaacugcccaaguccuugcuuuuccuggcucccagaggggacaccuacucucuuuucagccagggaugagucugucaucaggucagagcuguugagacgauugagaauaaugcauaaaccuggucccggccuucgauacuccuuucucacuguucauaccucuggucucugguuucuccuaacucgggugucaggccaucucuugccucuaccuugcagccugcaguucuuccuggaaaguaggcgagcugguggugacuucugugaacuuucacaaaugugugucugcuguauaucugucugccagucagcagagucaaacugggaguuuuuaaugggucaguguaugaaaaagaccaccuacucucucccuugucaguacugggccacaccuagcugucaucuuuguaaaaacacuaccccauauacacugauaaagcuuuuguguguauacacacacacacacacacacacacacacacacacacacucacucacacaaacauauauauauaagacagccuugaccuuuuuaguaggugauugcauccugccuuccuuaggucagugguagauugcuuucuguucaccagaggaaauauuaauuugaaaaucccuuucuauuagacgcugucaacucacaucuuaguguggggagaagggaaacagaacacugguuacaaccuacauuguuguaaauaaauacucauuuauguuaugcccaaguauuagggaccccaaagaccacugaggaaccaauucugauacaaacacacauuauuacuagcuugugagcaagaacucccaccauccccaucacagcggguuagaaugagagccccacgucuagggguauaggguauuuauuguggauacagcaaguuuggggaauuucuauucgggucagcaaguuaauauuuuaaaaacugcaucucuggugagaucugcaggaaccggacacagggacaaaaccaccugacaaacaggauggcuagguuaucuacucucugcaggaugucuucagguaucucuguacauugacccugcuguugggauguuugcuugaguggacuuugugguuuucuuccuggaauuggaguuuaguaccuggucucucacaaaauggaguuucuucaaaacuggagucgguugggcuuuacaauuuacucuccugaaaauagcucauaccuuuugguucuuagauguacgugaggucacguuuacaucuaggccaggucuacaaggcccugggcugccacucuuccaucuuggucacccuggcuuaagacuucucugaaguuauuuuuuccuuuugucucccaaguagaccauaaauccccuugugucccucccucaggucucccacgggguggugcuuagcagcuuuugaggaauggauaacaaauacaaucagauauaggcauagaccccgugggauagacccgugggauagacccgaggaaaguggucccauuuguagagcuagagauucggaccgaagcguagaccuaagccucugcaggaaaugaccuguuguuaaauccagaauucuuucuuucuagcaauuauucagcuccgacuuagggauaaagggaaucugaccucauuguuguuuuacauuaaaaauuucuguccuauggugggacugauuuuggcaguguuccuguuaggacuuuugaggccccggaauaccaucugugccguggaucuguucuuggcuuugcauggguguuagacucacaguucacaguaaccacuuuugcuaugagagccgaguugcuucgggccagaggcaggcagaggccucauuuccccugguuagaaguuugagcagagaagccgcagugguccucuuuccucugugcugaccugccacgccccaggcaugcacagagagagggcuggaauccaugugcuuuccagagagucuccaagaaguagggccaagagagagccuuuuugcccacgugccuucaaauugugaggcuucccuaaggccacuggcccgguagcacccucuugugggcugagacaccucuccugucuuucaguccaaccaaggcaugagccaggaugccacaggugagaggccccucccuagaaccugagaagcauccagggagcucagaacucugguuuuguucuaagggaucauagugugaagcucgaucuggagccgagucuagcuggagaggcggaugguggaagacaugcacaucacucagacaugugugcucagggcccucagcucuccucagacuucaagcuccagccacaccucccugugucaggcagggcuguguaccuggguaccuugugccugucacugccucccuggcggugacagugagaacaggguuuacucgacuuuauguaaaacguacuuaauuacagaguuuggcugacuucaauaagggucccucccauaagaauauggacucagauaugucucacaggaccacuaugagaauaaaaaauuauaaauagauuuauaaauacuguagguauucaauuuaaauaacagcuguuucaacuuugauuuucuuaauagcuagcucugcuucgugaguccacaucugccuuccugcuccacuucucccuccccacaccugcccuccuuccucccaucuguucucuucccuccccacaucuguccuccucuccucccuacaucugcccuucucucuccccacaucugccuuccuccccacccuacaucuacccuuuucccccuuccccacaucugcacacaacgccuuuauccgucugcuuccuuucaguuacuguugcuuucaguuucuccacugaguuucuauuccuucuggaauagaaacuguucugucuccagugaucacauuugcuuguucugaauaacucuuggguuuuauuccaggguucucuguugcuuguaauguacaacuuguaauuuccuauaaaauaggagccacuagcccugucuccacccaagcaggucagagcagugagggugugugcgcugcauucauagggggcaggggucaucuuagaagccagguggcaccuugccauggguuccauggucucaugguaaagggaguugagcagagaguaggaacacaagguacaguuuguagaugugauagugguguuggcucauagacguguugcguggacuccgacucacugaaugucuuguuacugugcagacccacuccggauacuucuccagucuguacccucaucaccauuucggcccauucccacaucaucacuccguaagugccccucauuucugccccagucaccauuccuccccaguuccuucugcucuguggccaguuccauguauccccugaugaccgggccugugaauguucacagugugaauguucucugcuguggcucgaggcugcccgaggagucaugcagcucacaguggaagcaccaagccacccugggagcccccuuaccucugcggccucucaggugaugcucacaguuugagcuaagccuggacuguguagugaguuucaagucagcccaggcugcauacggaguaaaauccuuucuuaaagaacaagaagccuagaguuguggcucagucauuaagagugcacauuacucuaccagaacacuggaguucccagaucccacaucaggugacucagucaucuguaacuccagguucaggggauccagugucuccaguuuuuguaggcaccugcacucauguacacacacacacgcgcacgcacgcacgcaccacacuuuuuaaaacauacuaaggccgggugugguggcacacgccuuuaaucccagcacuugggaggcagaggcaggugaauuucugaguucgaggccagacuggucuacaaagugaguuccaggacagccagggcuauacagagaaacccugucucaaacaaacaaacaaacaaacaaacaaacaaacaaacgaaauguuaauaagcuaaagaaaagccuccaguaggcaggggauguggcucaguugguaaagugcuuaccauacaagcauggaccggaguucaauucuaagcacccacauaaaagccaggugugccaggugcuccuggcacugagggacuggugguaagagaucucuggaucucacgggcuagguaaucuaacuaggucagugagcucuagguuccguaggguacuucauaguaacacuaagguauaaagagcgugauugagggaggauaccagccucagccucuggccucuaacauguaugcacacauaggaacauguacacaggcauacacuauaucacacauuuuuuuuuuuuuuuuuuuuuugcugguguucuucaaucaaagucuagcaagcaaagccacaucauucccacagacaccuauagcaucaaccucugccagccuggccuaagaaccucugacuuucuucagggguuccaggaauagguggcuuacccaccauccuggguacucagcauggagucuggucacagcagggcgaaucaccuuguaaggugguguuccucauuauaggaugggcuggacagcuuccccucuguccuuugaccaggcgugguuaauagcuuuuuauuauuuuguauauuauuguauaugugaaagcucauacccaccacagcacauacagcgagcaccaugugcaagucaggacaacucccucccucccucccucccucccucccucccucccucuuucuuuuagaauaaguuauuuauuuuauguauaugaguacaccauugcucucuucagacacaccagaagagggcaucagaucccauuacagaugguugugagccgccaugugcuugccgggaauugaacucaggaccucuggaagagcagucggugcucuuaaccucugagccaucucuccagccccaggacaguguucaggaauugucuccuuccaccagagauugaacucaugucaucaagcuuacaugacaaacauuuuuuuuuuuaauccacugagucaccacaaaauaacccauuuugguucuuggaggaaggcccaggaaguauauauaucaaaucugugucugagaacccagggacagccagcuacaugugccccacaaacaugggugggugggugcucagagguccuugcaggcucaugcaaucuugcuuagguucaacaucacuccucagauucaucuauagagcaccaggccacacacugacauggcacuuuggccaucuccccagauugcgaggccuucccauguugggucuguuaaccgcacuuggcugggccaugaggugccaggucagaaugauagcuguguauguguucuuuucuaguacccagagcaggagacuguaagucucuucaucccaacccaggcugugggugcuaucaucgggaagaagggggcacacaucaaacagcucgcucgauuugcuggugccuccaucaagguaagauuguuacugccuguccccaugggccaccuccugucagugcuagagaauucucacagcaccuagagauggccauuccugucagcucccauucuucaucuuaguccuuuccuguucaaucaaaccaaaguuagaagaaagaacuaguaaugaccaaaccugauccuccaaggguuggcacuguccccucuucccgagaagauagagaaggcccacaugagcagaaugagcaucuaugccuagcacucagcauguugaugcuccuuagcccaggcuucaaggacuuacagacugugggaacgcaaacugaagaacuuucuggaaagugcugauaagaucauaggcagacaaagcugauagugucuccuguuaagaggccaggacugagccaaagucugggagagggaauuccccuugguuugcaacacugaugugugcagauguggcugcagcccauguucugcccccucaguugucagugauuguuugccacagaucugccucaagcccagcuguugcucugacucagcgcgaggccgugacuccgaaagcccccgugaaacgcuuccggaaaugcuuuucauuguuacgggaaagaauuugcuaccaugagacaacccagaguuaugccaagucucaugacuuggagagagaaugccuacacuuuuccccugagagcuggaguuucucccacagccaagugugacagggaagaaaaccaaaaacaaagcauucugaguugugcauuaugaggacagugguggcccugggaaagauggcaucuugcuguacucucaagcugcauccaucugugcuugcaguuagggguucacauuugcacuggggguuagcuagcccacggugggcugggcaugaugagaguguggggugcuuuaugcccgauggcuuggcacguauaauacccuggccuagaugaugcagacagcaaggaugaggaugaccauagucugcagugcccagagaucuuucuuagugccuaacgcuguagucugagaugguuaaacacaaaacaaaacaaaacucuacagugagacagcuuggaccgaagggcuuugaggguuuccuuuauucaaaccucaguuuacaggaaaaaagcaagacacagagaauaaggcucauugagacaccuaaguggucagccucaaucuuagacagaaauuccacuggccacuaggauccugagguccugaggcagaccagaccacaguaccuucuuggucuccucagcagguggaaugacugccuggagcuaccagauccagaucaacucuguuguugacuucucuuccucuuccuguacagaguuuuuaagucagagugugcuggggguggaaauguaacaagaacccaacgggggcuuggccucuguggcuuucccuagcugcagagggauccacaaccccuuucuugacucuaaagccagaaccaggugacugaagcugccuaguucucacgcuuacugcaacuggaacucggccccucgagucauuucaucagcuuucugucuuugaugguuuucuucacugcuuaagccuuugucuaauuccucuccacaaguccgaagcuuggcugggugaggucuugcucugagaucacgaucuuccuuauuccauuuaguauaaggcuuuucuuuaaacuuuuaucuccuugaacacaauaaauacauagcuccacuacaccuccuggugcuccuauucucuucagacuguacauuuuauauuuuuccuugguuggcuuaugagaguggccacaugacagagucaguacuaggcugucuugaaaucucugccaaugccauuaauccaaaaugcucuaauuuagccucagauagauuuuuuuuucccccuaaaauaccacaggaguggucuccaggccauuuacuguauucuucccucugaaaugucuucaccugggccuccacaguucaaauugcccucagugcugucuucaugcuccuauugguaauggccccguaagcccugcauucaggugcauucagcuccuuuccuaauccagaguagcaacauucacauuccaccaccaaacagccggucucagccacacuccgcucgcgguaccaacuucugucuuaguguugugcucugaagagacacuaugacaacucauaaagcauucagcuggggcuggcuuuacagguucagagguuuaguccauuuccaucauggcaagaaacaugguagcacagccagaugugguggucuggaggucuacauuagauccauugguagcaggaaagacacugggccugaccuaggcuccuaaaaccccaaagcccaccucaguggcacacuuccuccaacaaagccacaccugcuaauccuucuaaacuaaugccacucccuaagcauucaaauguaugaacuucugggcccauucuuauucaaaccaccagauaccuuuaaucaaacuauuggugaggucuuuguauucucacaggauuaaaaagcuugcuggcuccaucuucccaauggggaaggaagugcauaaggagaaagguuugcagagcuguggcuggaaccaaggcagccucuuuuacugacagacauaccugcucugccuuccuaaucuuuacagcuggcucaugugugcugugaguuagagccagggugaccuuuccugcagcuacauagggacuggacaaugcugccgacuaacccuuccuucccucuaggcccuggggguugccagaaccuguaucugcuaggacuuggaugcagggagaggcaguaacuacugaccugcucggaccugcucugggcagccaauggcucagacuugauacugagaauuaaggccaugacuucccuaagaccagggcugaggcagcacaacgucagacagggcauggggcuugaaggcagaagcuuccucaccaauuggugugcgcagggcucugggcauccgcacauuccucuuuccuuugaccgcagauugcuccagcagaagguccagaugucagugagaggauggucaucaucacugguccuccugaagcccaguuuaaggucagugccaaggaccaugugagcccugcaggcucuggguccagggcagacagcucagagguguauucauuucuccugcugcuugugggugucagacuccggccugguugcgcauuucucugugcucugccuucucuccucagaaaggugggucgucagucaguacccauucuguugggcaucuuuggcuuuuccagcugaggggcauuagcaugcaugcggaaaagaagccuuauguaguagaaguucugacagcuccuaaggggauucuagcaacaugggggagagucccuuccucugggagauuaaaacuugaauuucaagaagucagaaaugucuauuaauaugucacagacaaacaaauguggaguacuaugugaaagaauauuauuuugccaugaaagaaugaagugucagugcaugccuagggauggaccuagacaccuaagaguauguaggucgugcuuccacggacaugaagugucugcagcaaccuguagaaaaagaaggggaacuggaggucgcugaggaaugggagcaggaaggggugggaccagcuccugacugcugugguggugguugggggugcagaggcagucuuagggccucauacauaggggguagcaagcucuugaccacugagccauacucuuagcccgcuuccaggguuuuuuuuuuuuuuuuaaguuuaauacagggucccacuagguugcucagguuggccuugcuuuauuuuauuuuauuuuugaccuugaaauuauuucccucagccuccugagauccugggauucucagguaucgguagcugguacuacugauggguaaugggauagagccagaguauuacagagagcaauggucccccagcacugacugcugccaauguacaugccaaaaugaucucuuuacuagcacaugcaggaccgugaguuugauuccuagugccaccgugccagguucagacucacuacaucugucaccaccgcgcucacggccuucaguaacuggagaacuaagcgcgcaguggagagggaguuaugaaaaucuuaaaccaaugcaacaaaacaaauacuuauaggcacugggaauauggaaauaagaauguaguugugguggcucgccaguuggcccaaccuggacacaaauguucccuagaggaggcaaccacagccacgaagcuagcagcccugugcagguugcagagugaggcaauguauggcgccccuggcucugcgggaaccugggcaggugugcucggagggaggacggcauccaucacggagucucccagcgcccccuugcacuggcaaaguggcgcagcccucuuugguggcuagcccagucaccggcuucuucucagcaacggaucuuguucucaggcucagggacggaucuuugggaaacugaaggaagaaaacuucuuuaaucccaaagaagaagugaagcuggaggcccacauccgaguccccucgucgaccgcuggccgggugauuggcaagggcgggaaaaccguaaguuggcuccugauucccugcccuggcugugccugauuucucucagauccucgcugccucuucugcucacucucacaugugagggagggccuuaggcugacaggccuggguucuccugacccaugcucacagugaagugugagauuccauggacagaaggucaucagcacugcucuggcacugaggucucacuuauauacacgcacacuuauauacauccucccuuucacaccuacauacacacagcagaacccaaaguaucugcuggccacuugacaccacucuaccugguuuccaaguccagagacugcagcucuagccuauggucucucuugauggcaguuucaaugacccccccccucccuaccauaagcaauucucugguucuuucaaaagucuggaugucugcuauaggggaguuggcucaacaaagggugagaaaaauuuacuuguaaaguaauuuauguuuuuggucugaagaagguguagguaacacgucaccugaauuccgaaaauggagguauaauucagugauagaaugggcgccagacccucagagaaacauuuuaaucccagacaugaauaggguaucuguugggugcgaguguguucuggaagauggcuuucucauuaggcgaaugggugacuggacaaguacuuguagagcuuggugcaugauggugaaguaacauuguugggugauaggaacugcagugccccagggagcucagauuccagguguagugagucacaugcaaaagaauacagucagccuggacugcaggcagucucuggaucuacagguacaauccaaauccagaguacacacaaccgagugccggaggaguugaagccugagccucuguuagaaccagucacuggauucucuacauccccagcugugcuuggcuguccccaucaugacaaggaucagggacagacaggaccucuguguguuuguaaucccagcccucuggaaauggagaauggagggucagaaguggauggccauccucccccguguagcaaguucaaggccagccuucucucaaaagaaagggagggggacgggaaaaggagggaggaggaaguuggugguuuaugcucugucagacaacagacugcucauggcuaacagccaggaagcaggcuucuaacgugggcugucacugggguccccaugagugucuacagaauuagagcauuuggcuuagaaauggcccauggaagcugggcagugguggugcaugccuuuaaucccagcacuugggaggcagaggcagguugaguucgaggccagccuggucuacaaagugaguuccaggacagccagggcuauacagagaaacccugucucgaaaaaccaaaaaaaaaaaguggcccauggagucagggcuacaccccaauuuucugucagucagccuuaaugagcccaaacccacaccuggccuagcaggacaaaggaaaagaggauugagccuccugccuccuuuacuccccuagacuaagccccucccccuguauccguagccccucccuccacugcccaagaauuagcuuugggaugggggcucgccuggcucacugccuucucugccuucucaggugaacgagcugcagaacuugacaagugcagaaguuaucgugccucgugaccaaacgccagacgagaaugaggaagugaucgucagaauuaucgggcauuuuuuugcuagccagguacuacuauucauucugggaggcccugccuccugcccagcucuucccacuagcucagaguuuguauuugugucgcguggccaccacacacaguguggaaccccucccagcccccugaccucagggacaggaaacuguuggugcagugcccuuggcaugcuuagguugggaguguagcaucccuagccaucccgggcuuccucugagagccacgugucugucaggcaagccccccggcagagcagccagaugccagguuucacuguggaagguuaacacucaggaagggccccuaguuuuuuguugcucucuucccugccucacuagaacacccaugucacugugugccuuugccagagaggccagcacugcaagugucuugauggguuugcgaguggguuuuggaaccaagcaacugugacccucgaagagcucuucucaugcuuguaggcaacuugccaacugcuugcugaccuaaccccugcaguuguugccugggucagucucgcaguucagccugugggcagcuggagcucacagucaagcuccagguguucaggcugugccugggcucucgucucucccuccuucccugauguuucuagugcuuuggaaaggcgaguaggaacauagcagagcucagcugugagaggcagggccuucggucucuuacccccaucgcugaccccugcuacugcuuccuggucggucugcuuacugugaacucuaggcugcuaguuccucccccucccuccugcgagccccugccuuguacccugcaggcuugcggugagguggagaggaauucugcccuugacugccaggccugggggaggugaaauuggccugaguauccaacuuuuccuugcccaagcccuagacccucgguuuccuccgggcccucagaacugggauuguuucuucccugugcccuccccuccccucucucacacucacucacucucucacugcagacugcacaacgcaagaucagggaaauuguacagcaggugaagcagcaggagcagagauacccucagggagucgccccacagcgcagcaagugaggcucccacagcaccagcaagcaaccgaugaauguagcccucccaacaccugacagaugagaccaaacagccagcagaucgggagcaaaccaaagagcaucccgaggagugcgcagucugcagagcagccagggccugcagaccucuacacauccugggauccaggagggcacagggaaggccagguuguccagaaacaccgcuuggccugcccccagcuuccccuggcuucugcaggcauaacagccauccacugcccauccaacucagauucuccucaguucccaggacgcuaucccuuucgguugaacuaacauaggugaacaugcucaaagcaaagcaaaauuccuagccguuucuuuguuguggaaaguugucucuguacauguauguacauaucagaaggggaaggauguuaagaaauguggccuguggguuacacagggugccugcagcguuaauauauuuuagaaauaauauaucaaauaacuccacuaacaacaauuuuuacucagugauuaauuuuguuuucuuuuugaagagaaagcaggcuuuucuagacuuccaagaauaaaguauugggugagguccacugguauagaaaggaacuuugagccacccacacaaaaaauucacuuggagggaaaucuugucaaggacacuuaauggcaguugugggucaccugugucugucaacagaagggauaccgucccugaggaggggcccuaggcccuggucaccuguuucucccacacacccauugcucaguuucacagguuuuuaaacugaugauuuuugguuuguuuuguuuuuguuuuuugcauacugcuauauaguucugucucucuccuuaucucccuccuaaccuuccucugucuucuuuacccaaaauucuuuugagucccuucguucuuuuucugcuccccguaucuaugcaccccuccccuccccccaggcaaagcagugcucugaauaucauaccacacacaaggaacaaaugcgaaccacacagaccagccucagcuuacacucgguuacucaagcgaacaagagucggcgguacuuguccuagcauucggaagaggaaagcaggaucccagcaaauaaaccagccagccaaacaaagaaaaaucccacaaagaaagaauggacucucucuccaucuugguauacaagccaucaacauuuagugaaauucuuucuuucuuuaaaaauuuaaagugcaggaaaauagcaauuuauacgagguuguuggcccagggcguuaaauuuacagauuuuuuuuaaaugagaaaaacacacaaauaaaagcuaccucagguguuuuuuaccucagcaccuugcucuuguguuucccuuagagauuuuguaaaacugauaguuggagcauuuuuuauuuuuuuaauaaaaaugaguugaaaaaaaaaaaagaugagcugccagccccaagcaggcggcagcccaggugugccgcagcucuucugucuuccgcuagccaagagccuacguggccuucuuguggacaaaccuaaaaauguuuauuuuuuaaaaagugacaaagaaaaacagagaauauuggagccguccugaauuucaauaggguacgugccgugagggcuuuugcgcugaaggaugaccacauccugguuaugugaagaaaccaugacacuaccagacugcgaugccgguuuccucuacugcaagcaguguucugugacaaaaaaaaaaaaaaaaaaaaaaaaaaaaaaaaaaaaaggaaaaaaauauauccaagcuaacaagau

SEQ ID NO: 8175 - RNA, 1332 nt, Mus musculus
aagagcacuuucuggaggcuucuaucgccggcuugccagucguagcccaacggacgggagggaacaugggggcccuggcagcuaggcgcuguguugaguggcucuugggccucuacuucgucucgcacauccccaucacgcuguucaucgaccugcaggcggugcugccgcccgaacucuacccgcaggaguucagcaaccuguuguggugguacucaaaggaguucaaagacccucugaugcaggagcccccagugugguucaaguccuuccugcucugugagcuuguguuccagcugccuuucuuucccauugcggcauaugccuucuucaaaggaagcugccgguggauccgaaucccugcaaucaucuaugcagcucacaccauaacgacuuuaauuccaauccucuacacacuccuguuugaggauuucucuaaagccguugcuuucaagggacaaagacccgagaguuuccgugaaugacugacccucguaggugucuacgcccccuauuuaauaaucccccucauacuccuccuguucauguuucagaacccguacuacaaguaugaggagaaaagaaagaaaaaauaagggacggccacuagccugguggggaagaccccacagcacaguugccuuuuggacaacacaggaaaacugccccaaacauguuucagcagcauuugaaacaccaacagcagugcauacaaacaagacaguggugggagacgugccaggccuucaccuuucagcaggggugugaccaaguuacagcaaaauggugccaaagcgcugccacagcacugcuaaaaaggccaggugggaagccgguuagcuccugaccuggaaugcacacaccugaccaaguccucaccucgaccuugauagucaacagaugagcaguauuuugucucuuuagcacuuuuuaacaugguuuccugcccacaccuccaccucugggagaaaaauauauuacagccucacaugaguccaagccagaaauggguuacagggaaggaaggugccuccauuucuaucuugaaacccagccugcucuggguuauucuggugcugguucuaugaacggcucucaugucccuacucuggcaccucacaccacugggcuuccuaguacgcaggcuugugagggugacuggacuguccaguguaugucugcugcuuguuccacugacucuacagaaacaaaacccggugggugcuagacagugcuggcucugcuugcaagccauguugcugugguuguuacuuaugugucugauccaaauaaaggcagcugcugauuuguuguuaaaaaaaaaaaaagcac

SEQ ID NO: 8176 - RNA, 428 nt, Mus musculus
cuuaaucacguuuucaguguaugcggcgugcuaacuggauaucuucuggcauaauuguuucacguuuggcauggauagcauacagguugguaucuucaaaaaggccaaccagaugggccucacuugccuccuucaaagcaccaauagcugcacuuuggaagcgcagaucuguuuugaaguccugaguuucuggcaccagacgcugaaaggggacggaucagaaguucaguggacuucgcauagcgucugauuucacggagugccacaguaccaggccuguaacgaugagguuucuucaccccuccaguagagggcgcacucuugggagcggcuuuuguagccaguuguuuccugggugcuuuaccaccgguggauuugugggcagucggcuuuguacgagccaugguauggacaccuccuuacuuacc

SEQ ID NO: 8177 - RNA, 525 nt, Mus musculus
accauccaggaggaccugccgcccccugcccggacugacgagucggcccggcugucccgagcgccaugucggguucuucuagcgucgccgccaugaagaaggugguccagcaacuccggcuggaggcugggcucaaccgcgugaagguuucccaggcagcugcagacuugaaacaguucugucugcagaaugcucaacaugacccucugcugacuggagugucuucaaguacaaaucccuucagaccccagaaagucugcuccuuuuuguagucagcuaucuugagguuucucaaaccacuuuucaugaaccagugaauauucaagagaacuaaauuugaagucuguacaaaagcuucucuuuaacacgugccauaauacacuaucuucugcucgucaguccuuaacaucuaccucucugaauuucauggauuucugucucacaagguuuaacuauuuuauauacacuggcuguagcauacaauaaagcaucauacaaaaaaaaaaaaaaaaaaaaagaaccauc

SEQ ID NO: 8178 - RNA, 525 nt, Mus musculus
gaugguucuuuuuuuuuuuuuuuuuuuuuguaugaugcuuuauuguaugcuacagccaguguauauaaaauaguuaaaccuugugagacagaaauccaugaaauucagagagguagauguuaaggacugacgagcagaagauaguguauuauggcacguguuaaagagaagcuuuuguacagacuucaaauuuaguucucuugaauauucacugguucaugaaaagugguuugagaaaccucaagauagcugacuacaaaaaggagcagacuuucuggggucugaagggauuuguacuugaagacacuccagucagcagagggucauguugagcauucugcagacagaacuguuucaagucugcagcugccugggaaaccuucacgcgguugagcccagccuccagccggaguugcuggaccaccuucuucauggcggcgacgcuagaagaacccgacauggcgcucgggacagccgggccgacucgucaguccgggcagggggcggcagguccuccuggauggu

SEQ ID NO: 8179 - RNA, 2599 nt, Mus musculus
ccaggccaaggacauuuccgugguagcaggugggaggcccgcacuggcugcagugccgggcaggcggggugccaccacggcagccagcgagcucgcuuaccugcuguugaauuuuucaggguguuucucucucaucauauggaaucugugugcaauugaagcauccuggaaacggaagaaaagaaggcaagaaaagccugguuagugauuguggccaugagguauggugggaagacacacauauaugccccuggaaggcccagauuccagagacuccaaaucauaggggcacagcaccgcguccaggcguaagcuagugccaccacuccguccuuugagagccucacuugguugccucagagccuggcacucaucacaguaucucaagcccagugaguggccacaguucagccuuuguaaacacaggcaagagcaggcucuaaagagaagagugaggggcucuccucaggugaagccagaagccagugaggagugggugagguguggugagguguggugugguguggugugguguggugugguguggugugguguggugauggguggugacauaaagugaggacuauuucaugagaaguugcaaaaauaguacuuuuucucaugucccacucacccagcguccagcgaugauaacaucuuauauaacagcacauuaucaaacccaaagcugucgcugguauuaacucuuuguugucuguuucacccaaaacaauuaacaauaguacuggauagugcguuuagcagacaacaaaaguguauuaaacgucuaacuucugccuauuaaucauucuauccacaggacugccucugaagcuagcgacaaucuugauccuuuccuauccaaucuguugccccaccccccacuuuggcugcauggcuggcuaucuguaccacagaacucaccacgacgcuccaugacacuguguuucugggugucccauuucucagguuggaaccagaguccagcccagaguccuaucugcaucccacacucccauuacagcuaucugugagugcucaugguugugacugguguugacaugguggggcuccaggaccuauaggccagaauaggauccaagcugaacucgguucuucacucuuagccuccugcaccuccuaacgagcccagcagaagaguguguacugcccccuuaucacacagucccaaucgagcacuguggaggcagaugcugaacacucgaaauuaacuaacuaauugguuggagacaggacagcccagaaacaaggagcugauuuagauuugcccagaagugacugcagcagccaaucagaaaucucuggggaugcugggguaucccuguagucucagcauguggauagagugaggcaggaggauuuagaguucaaggcuagccuggacuacaaggugguacuauaucucaaugaaccuacccacucacacgccuaccuaacaaccaacaaucaacaaauaaauaaccaacaaaaaucucuuuauuagacuccguguucaaaagauucuuaaaauucuggagagccaaaaauaaaaguucauagagcagauuuuuagcuaauguauauucccucuuccccucucuucccuuuucguuuccucucuuccuucuuuccuucuuuuccccuuucuccucucucucucucucucucucucucucucucuuucucuuucccuccuucucucccucuuucuucuaagacagcucuuaccaugugguucuagcuggccuggaacucacuauguauaccagcaguucucaaccuuuugggccugaccucugugggggucaaacaacucuuucacagaggucuccuaagauuaucggaaaacacagacauugacauuaugguucauaacaguugcaaaauuauaguuaugaagcagcagcaaaaagaauuucaugguuggagucaccacgguaugaguuaaagggucacagcauuaggaagguugagaaccacagauguagacuguacucagcucaaacucugagagauccuccugccucugacuccccugcauugggauuaaagcugugugcucuuccaugcugggcauauuguaucuugauaaggaaagucaacauuagagcaucaagugcagcucucugaagaagcauuuggggugcauaccaugugugaugaauuucauuauggauaggggugaccccauccagcagccaccauguggaaucugggagggcagguacuggcuuauuuuguggcugauaaacauuccuugggcauuuaacaguuaaauuuugcuacugguuuacucuuguaguuuucugaucugucaagagcugauagucugggcagagucaccuuguagacacaugguggcaggugucaaaauucaggggggccuguucggaccccuugaacccacacagccgucucagcuccucugugcagcuccucuuccuagccuagaccaugccuaucucccucucguccagcaagucucaaugaacauucccaacaagauauaugugauauuugucaaaugauuuucuagaauuccggaaaagcauuccaucuagcuguguuccuuugaaacacugauuuucuccugucagga

SEQ ID NO: 8180 - RNA, 21792 nt, Mus musculus
ugcuugcaacuuuacauacugguaacuuuaauuuuuucaaaccuuauuuuuaaagaugguucuuacaaacgcuuuaaccuuuaaccucccuuguagcccaccaccugccagagguaguggaaaagaaaggauaugggggaaguggaccuguuucagaaagguucccuggagcaacuccugucugcauugucuggaaaucagcaguucaguucacagguuggcagcggcagcucaguccacucacaagcacuucauagauacaccagcaguccaguucggcagaguagugccaccaacaacagugacaugaccuagcacagacagccaggccccugccucagccugagccagugggagggccccagaggggccccaggagaaguucucagcugugucucucucaggaaaaugaaggucagcgaagacucgagacucacaagcguugcucagcuagcuguaccagcaagccaagcucugucuccaucacaccauggaguccuauuuauacccuuccaccuguccuccaugggucuugccucaauaugggaauccaaucagugggaauccggagaagugacaagaaacugcagcauaccaccagaaguuuuuuuaaguacauuucucucuaugguguccggacaaaugcagcucaaaugcaguguaaggcagaccaauaccuuugugucauuagcaaauaaccuuucaucacauguucuuucacgugccuguuucaguagaacauccucucuccugugucggcuucagugaaauguucugaguccgucuuagccuuucacaccuguguccacuuuaaggaaacguccccucaaguguuggccugagugaaucaccauccaaaggacuuuccaaagaacucucguuuccacuucacacauucuuucaagauuugaaggcuuuuguuguuauuuuuaucaaaagaucaaagaaagcuucucuccuauggaugagccguacggcugcuuuaugggcagaaauguugcagaggugcugagagguugugaggccagaucaugaagagacccccacccuggucucuuuuccuuugggggcacgugucuuaaggcugugauucacaggagcucuguccuccuagaaucagcugucagacauaugagacaaggccuuuaaaugacuccaauccccagccucugagcugucacagugacaucaaguagaaccaggcaucuccagcaaguccagcuauuauguggccuuguggggaaaauaaaauguugcuauuugagccacaauguugaauaauugguuccacaguaauagcaacgggacacaacccuucuagucucaucugccugucucacaucacccuaggacaucaugaccucucuucuauagcagcugcugagcagagaggaaguccucuguuccuaacagacucaacauucccuuacggaaccacaaaccccugggggguuuaguuuauuauaaugggaggccuuacaguguuuuguacuacccaugauguuagacccuuuauuuauuuggguagcuuguuaucuacucugaucacacuugugggacaagcuugccggugucaucaguucaggugaugacggauggguggucaagccaugccuccucacugauguugcuucccugcucugaaacaucauguuucauguagccagcuucccugguuagcaucaaugugcucuggcuuucccuuagcucuucaaacuggcaagaguuaugagagccccagggcuucccacacagcaggcauuuggcacgaaagcucucuuccugagauacucggugccaauagaaauagcggauccgaacacagccccuuugugccagcggauucugccuuccaugucggcugacccguucacuuaucucagcagaugccaccauaauuagcaaaguaggaauccaaccacaugccuuccaggaauaccccaggauggaucuucaaauacuuuacuacagaaaacuugucuacacuucccuguucucccaguuuaacgaugcagcucaaaggugaagccaacacuuuaauaguuuuguucuuguuuacacaauccagcacuuggcagugguccccaggccuggcauccaucucugucucagaaguugucuuugauauauauuuuuuaaaagauuuauuuauuuauuauauguaaguacacugcaguugucuuaagacacaucagaagagggcauuggaucucauuacggaugggugugagccaccauguggucacuaggauuugaacucaggaccuucggaagagcaaucagugcucuuaaccauugagccaucucuccagcccuauuguuuucauauuugguagaaucaagcuccaaauacaaacucagccuauguugggccagccagcaagauggcucaguaagugaaaggucuuacgaccugggcuagaucccugggacccacacuguggaagaagagaacagacuccaauagguuguccuaugacuuccccacauguaccaugguacccauacaugcacacaguguacaaacacagaaauauauaaauaaauguaacaacaacaacaaacccaagccugcccuccuggaauuugcccucucuacauuagcauaccaggcuaagggaagaguaggugcaguuaaggggcauuauuuauuugacuuugcacuuugacuguuauucguuuuacaaaauaacuugauuuuuauuggcaaccaucagaauauggcuuuuaaaaauuaucuguaacugcagggcugauuuuagaguucaugccauuauuuuagcgccaccuggggacaaaguuguuuacugcaguggaaagaaauggaggggaugcccaaaacuaaaccucccaaaccuuuauaaacagagauacaaaguuacuucuuuuuguuuauccuaagaaagguacuccaguugccaaugucuaacuguugaauaaauaucuaggaggugggcauuguuaaaaccaccuacaauggagaggcacugugauaaaacuggaaaguggacauacugaaugugaguuuggauguauaauuucccacuguggcaugaaaaauucccaacuuacuuucuuucgucuucugucaaaacaguguuagaaacuccccagacagaaugaauaccagaaaggaggacucuuggggaagcggugauggaugagacagcagcaauguuugaaagcaaagcaugucuacggacaagaugcagugugcuccggguaguauggcuuucggcaaagcauguugggaaggagacacugugaagagggggcugucccaucaucggaaacaugaaguucuaaccccaaggcucccugaggggaagcagcuucuccugucaccgugucacaggguaacuggaucuaaaugaaccucuccacacaccccugagggcaugacugacagggcuggguggaacuggcuugucaaucuggagaauuucaugacaaaauccaugacuugguuucaguucuuuggcagcaacuuguucaguuuaggaugaaaaucugccucagcaaacacaguguucagauuacagugcaggggcagagacaagguugcccaguggaaggacuaacacaguguaucugccuggaaugagagacacuaauuacagcucuuuucucccguguugaccgaggcagccugggucuagacccacugucuacagaaacacacugugaacugcaaaugugcuuuagcaaauuuaguagucacauuuugaaaaguuuuaaaauaaucuuaggugaauucuaauaguauauucucuuuguaaaacuguacuuuacccgacauaaaauaguauuauugucauauaauguaagaaccgagauuuuuacaucuuacaguuaaaucuucacaauccaguguaaagaagcaggggauauagaucaacuggcaaagcgcuugccuaggaugcacaaagcccuggaguugacugccauuacuagugaccugggcauggccuggcagguggaaaccaaagguucuugcucaaggcuggacuagcgaguuugagaccagcugggcuacaugagaccccgacucuaaaacaaacauccaauuuuguacuucauuauagcaucucuugaaccacacauggccauaccucccucaggcacucagucuuccagggagacugucuuauguuauucuuagcugcuuuaauagggggcaugugcuuauuauaccauucagaaguauuuugucucucaguggucugggguuuuaauuuuuuauuccauuuauuugcuuaugcuguugggggaggguauaugcaagguuuucuuauggauaacguggaagaacugguccucuccuucuccgguguggaucucaggcauggaacuuagguagucaggcuuggcagcaggugcccauuacccaccgaaccaucuuccugucugggucugggcuuuugacauaacaucuacacaggaacuguacugaugcucacugucugugaccuuauucaagccuugaucacaaguacuggugcaauuguggugugaaaaauacuggaauuucaggaugugaacauuagguaacuguuuuucuuucuuauuuccuggagucauugaacauacuugcuuuuucagcucaucacuagaacuaaacuuuuauuaaaaaagaaaauucuuucuaccuccacagguaguaacccuaaauucuuuuucaacuggggcaaaacuuuaaaaaauauuauaauuauucuguguguguggcuguaugccugcaugagcuauggcacagauacugaggccagagggacuuuggaaguccauucucucccuuuaccuucugcaugugcugcuucauacuccagaguaagcuggccugcaaccuucccuguaugauucucuagacucugccucccacccagcagugggagcaugugaguacaagagccacaauauuuggcuuuugguggguucuggggguggaauucaggcuucugcagcaagcccauagagcuaucucccugacuucugagcaugccacucaucuaugaugggaaucuaaucacuuagccaauaacugaggaggaggaaaaauaaaacggaauagccaaaccagauauuaagaaugcacaagagcuuagguuaaaaacucacccuuuagucgggcaggguggugcaugccuuuaacgccagcacuugggaagcaaaggcaguugcaucucugauuucaaggccagccagggccacacagagaaaccgucuugaaauaccagaaccaagccaaacagagaacaaucaccuagcccuucuucaccucagauaacaauauucagagggguuaacuggcuuucgugguccaugguuaauucugguuccaggccagauauccaaucuaccuuaucgacuucccucaaaugccaguuuuuccuugcagauccgaacugcaaagaacaccaguucuucuccuaucaucuugaccuuacauccauugucuuuaauuuuuuauuauuuauugucugugugcaugcacacaugcaacacgaugcuccuauggacgucagaacacaaccuucuguucccuccuuccaccauacgggucccagggauugaaaucagguuguggagcuuggcggccuuuauccacugagcggacucucuggacuuuauuaccuguuuucuaacuuuguuccuggacuuacauauucauuguaguaaguacuuuuucaggagcaaaauucccuagguucaaauucuggccccuacuuaaaagcuuagucuauccauacaaagaaaaccuagcuagcucauaguagacccuuaccaagcuuuuuguccuugucaaugaacagagccaaguuuucacuguuccuagccugcagcauugcuguugcagcuuccucccaacucagcauccucaagaaagggcucaggagaaaaacaaaagaccauaucugggaaaguagaaacuuguuagaagucuuaggagugagcagcuguugggcgggaugggagggaugcagaacucugcaggcagccucaguuuugcagauggucugcaagcugugcagucccagaguagcugauagcagcauuccugaacuguugccugugcuggggugagcuuguugaugcagcugcuuucccgagucaucccugcugcuguaccuccucacucacacuccuguuagcaaccccaggaagagcucgaguuuaccacgcuggacuuuugguuugaucaaucauuauuuuggacuguucucuuuauggggugaguagacaugcauuggugcccacagggaagagcucuuugcacaagcaaguggaaauuucuggcuugaaggaacuuucugugaugacgacuacaaccucuuagggcuccaacuccuuugcaacaucuugaguggauagauauuugucaguuuaugaugggaacuugcugucucaagagaccacaauacccuuggagggcacuuacuugugcaaaaaucaugagcuuugcugccuggcauugcgacaugucacaguuuaacauaagguuuaugccacuuugacauaaaccuuucugacucacuuaaagugaacugaagcucggagcccagcaguagaaggaacuccuuaagucacaacagucuaggcaaugaauaaagaucagcaaagacccccaguuccauuucuucacagcgagagcaaggucugugugggccuuucuagucucagcuuuuagugaacuggcuccuggaaaaagcacauuagcaaguacgaauaaugaccaggguucuccugggcuaccauaggcagcauucaacagauaauguaaaaauacccuacugaacuucuacuuguguauaacgugugaaagcccacugaccugaaaguguuuacagaugugcaaaaggcacacugagccccuguaugugcauacaguguacagaaagccggcugaauccaggucuggguuucugcgguuuguuggauucuugacagucucaaccacaccagcugcugcacagagggcaggggcgcuggacuacaccaguacauccaaagcagcucccacacugccacaguaacccucagucgcacugaaugaaauacucagcugcggcaacaaguccuguguacggagcagcggaggaggagacugaaaggcaagugugcugagccugcuggcgucugagucugugccacuggaagacaaagccaccugcaauucugcuucuaauauuuauucucuaaagcugccaucuuagcucauaaggcuaccuuggacagauacagaaaaguaccuucuaaacaguaaaauacccauaucagauuuuauuauuaccaaagaaaacgggaaaauauguucucucaaagacagugaggucuuuguguaacuuuaauucauguagcucagucucuagucuacucgguuucuucgagcucguugcuauagacaccauguguuuaguggggccugggagccgggcucucaucguuccucugcaugcuguguggccauccugccugaugggaagacuucccaucggcucacaggaaaaagaaacaggagucaagaaaaaaaaaauaacaacaagauguauuuaaaaacagacuucuccaguuggcauuuugaaauagcuaacaauugucucuaacccucaucugguuuccuuugcucgggcauccucugagacguuacuccuugaaccucgggcagcaccagacguuaaauccccagagggggagguauuagguaaccuucugcuggccauuguugucugaaugcaauagacagagccucaaaccucuaguucuugucaggacggucaucagggaaaaaaggacuaagccaaacuugcauauugaaaauaaugaaacacacacacaaaaacccacugcagauaauaaauaucgcugauccaccucuuucaaaguccaguucucuucgcuccuaauagcccugcagcccguuguacaccuucugcacggggccuuguuugagaagcugcuugauaccugcagaaagaacgaguaaauggcuucauuaacgaaaacguggcuucucugcagcuuccaacuucacagcggacaccuccaaacacacaugugugaugccuuacuucuuucagucaagcccaccuccccccaucuugugaagcccugggaaaugagaucagguaaaaagggggaagacaaucaccccagcugacuccacuccuccuuccuugcccuuuugccagcuuucaccgcuucuacccauuuccuuaucguuuuaaacacuuagagcagggcacgugcaguuggcgcagagaaguucacccugagccuccugucccucccacugacaucgcaucuucccuucaguuuggccuggcuucuucaccuaagcgacucgauucacagcccagcucacagagcccucaagugagcacagcgacagcggggcuucuuugcuuugcagaaggccugcagccaugucucccagcucuaaaggguuuugcuaguuuccuuucagacagucaucccauaccaugcacacgugcacacacacaccccccuacacacacaaacacacccaccccuguaccuucuuuugcuuccucugucagcuguucuuuuggaaaguccacaucaaaagugauuaucaaagagcccuugauguuauuguuaucaaaguugggcagcccuuccccuuucuuccacagcuuggcuccuggccuggugaucuugucccgggaaauauggaccuggaaagcaaaaggagcacaguggagcaggacaggcacacacuaaguccaucacacaacuucuacugggcacuggggacaaugcuaguagugucacagcucagcagaaaaggcagguugaagggcaaggguugacaggcacagagagacuuaaaauacagcuggaggcucagcagcagagaggacagugagagauggccucuggcucugauaacccaagagcacauggcuacaaagccggaagagaggguguuuaccuugugaccauccaggugaguuauguccaucucaaagccaaccagagccucaaccagugagacggucacauuuguguacaggucauccccucuccucucaaauauccggugccugagaaggaaaagguaaaauccaucaggguuuauagugcuagagaaauccuggagacagacgcacacauggcauuucugagauuacagagcugugucagucuuacugaacucaauugcuaaguaccuuacaauuagcacaaguacacaaauguaaggaaaaagcauugaucauuagguuauagaaaagaaaggccaugcuuagcucgguuuucugugauuucccaaguuacagauaaggugagaccacugacuucaaggccagcuugggcuacaaagugagcuccaaccucuuaacucccuacccccaccugaccuaagguaccaggcuuacugagggaacacaacuguucuaguuccucagggaagcucugagggagacaaggcaugcaagaaaagaucacccaaucagggugccggaggggaagccugggaagaggagccaguucucuaucaucuggugggaacaaugaauguuucagugaagccuaaacacagaccucuuacugguuuccaaccaguuaauaagagaauagucaguuggaaaggccgaguacuggguguaagcagcacuccgcacuggaggaagccuaugaaaggcgaggcugaggauuaauaugaccgaauggucuuguugugggaaacaagggcagcaugccuuauuccuauugcagacugccucucauucacagcucuuuucacuucuggugguuuguuuguuuguuuguuuguuugugagauaagauauaacgaaucccaagcuagaugaccuugaacuacggaucugucugagccaccuggaaggcacagcaggcguggcagccagcagggcccacacugggcaaugugcauguggacagugcucgaccagcccucagcucucucuuagauucuuaccugucuuuccuuccagcagcuuuugaauuuauaaguccuaaguaaauaacuggggcucagggccagcgcaucaccuccuauuuucaguacuauugcagaguuagaaacaaugacuacgguauuguaggcauaaaacagaagacaaagugaggacucccuaccacugcaaucgcugggaguccucuccccgcuggcacuuacuugacaacuuugauucggaaccguaagucuccggguuccccauccacaugcggcucaccuggucaggacaguccaaagaagaacagaaguuacacaagcugaacguguauuuggugucacuucuagugacuuuuaaauccacugccucaggcgaugucucugucauaucugucugggaaggcaaugccuucacuccccccacauaccauguagccguuagguuauggauaaggcagaagugagcucugauagucaacaccagcaucucaccuucuccaauaaagggguacuccaugccaucucgcaccccaggcucuauuuccacuucuaguguucguucuucauucacuaaucugagacaaaaggggaagagaauaguaaugggagcccagauaaaucagcuccaccucugagcuccuggggagccucuucuuggauagcccacugugcuguuugccaaggcuaucugggccugaguagagcauccagaugcuaacacucagaggagagugacucugcaucacauagacauacagguuugugcuugaggucagagcuggagggaaacaaauaucugucacaugugucaacaagacacacacugagggccugucacuuacuugacauuagggcacucgucacaaaccacuuccugggucauuuggaagcgucccggucccagcugugugguucucaucucuugccgacaguugcauuuccguuugccaggagccugccuggccacaggcuuguuucuaacuaccuaagaacacaugaaacagccuuuaguuuuccucucugggguacaaaucaacccucacacaggguggaagcaaguguauauuuaaaugacucugaucucagucugaaucuguaggaaaggagagaggggaagaagagacuaaaaccagguauuaauaccagcauuuccaagacacaccagggccucugaauugaagcaguucacaggauuauuauguuguugagaaaucugaguuguuuaaagcaccacccccagagcacagccauggcacucaaaagcugccguguggcuaccucccaguucugugagccaucuccccagaccaccucuuucuguuuuaggcaaccuagcccaggacuaauccccagcacugucaccauucagacacacucauagucauguccucggguacauggugaauuuguggccagccugggcuauguuauccucaucccccccccccaaaaaaaaaacaaaagaaguacuuuaaggcaggacagaucaugguuaagagcacaucuugcucuuguagaggauugaguuccacuacuuauauccacugcccugaacaccugcacucaugcgcacacacaccuauaaagauacacauaacaucucaugucgaugugcucauguagugaagugacauagcgucuggagaaaacgcccagagcagugcucgcaugccuuacaagugcacacagccaucugaucgcagcucuguagggagcucucacucuucucaugcacagcgaggaaccagcagcauuuaguuaagugagacaacaggguuugaaagcgugcagaguagcugcaaagcccauuccaaauguuacagaaagacaaccucaggcaaaagaaagcccaauuuuacuggagaacccagaagaacuuucucauguuagagcagacuuuuaaaauuaacaauuaaagaucagacuuuuuccacauuaaaaugaacacuuguacuaauuaaaauaaaucuuaaauacuguguaaagauaaguuauauuauaaauggauaacuauaucugcauuacggcucacaaaaacuuaagagcaaaaaugaagcagucucagaaaucaacaaagcggggcacauggugaaacggcaugucacaagaagaaacaaacagggcaaaugaaagagauguuuugccuaguuggaaauuaagaagcacaaaccaagaccacaguaaucccauacccacguaauaacuaggagggaacagggacuauuccguauggacaggggcagagcaaacaugaacugccguggcaugcugacuauugacuuggacaauuucaaacauacuauggcacuuuugugugaagcauaaauguguggacccaacccagcaauucuacuuucacacguauccaugauggagacauccccgcucacguguaacuagaguacauacagcgauguucacguguaggacucuuugggaguuucacugaguucucaggcuagguagugagcucaguucgugacuacuaugaacuaaguaaggauucugaugauuucaacuauguaugugucagccacucccucucauacucuaaaagacacaaagcacuugaaacucucugcuuuguggucaaaaguacgaguucugugggucaguguggguagguguacugugugaacucacuuccacaaaauuuccugcguacacuucuuccagagugacuucuagaucuacgaugauaucacuuccucuuggaauauuccuguccugcugacgagggguuccuccaaacaugaagccaaagucuccaaagaagcuguggauacaggcaaacucaucaggagaaaggacucggauccuaagucucacaacuguugauuuucuuccccuugauaaaauauuguuccugccagcacacuaugcaaaacagauauucuuaauauacuggguccaaauacaauacaaauuuuaauuuacauaauuuaauuuacagguugcugccccacccccaaauuacuguuuaauacaauaugucccauacauaacagccagacacuaaugcacaguauaucaaaggauucaauguuggacucaaucaauggaauaauccauucaaauacugaggaaaauccagauauuauagacauaaugaaaggggguauaauauauuuaaucuggugcaauucagacuuuuugguuaauguaaggaauuucuuuuuuuuguuuguuugucaagacagggcuccucuauguaucccuagcuaaccuggaacuugcucgaaugaccacucuggacccaaccucagagaucuaccugccucugccuaggaguaaagguuuguacacuaugcccaggcuaacuuaggaaauuccugaaggucaauccugaacaucuugaauggacugcgugugcucacuaagucugcucuuuagagaucacuaaccuugaugaagaagcuaccgcucuacaaaaaccuugggcaccuguuuaaaguuggaaagcaaaaccuuggggcaguccccguccuuagggaacaguaaguccuggccugcacaaggucaaauguuugaaggaaacagaagaaugacugugagauggauaaagacguguuuuucaguuguaccggagccugcugcugaggagagggcggagcaggacagagcgcuccucuuucugacaucuccagcaucauuuugaugggcaggggagaggcucuucccugacagcucaacagacagagcuauuguuuauaacugcacucuuacuggaggggaggcucuagaagccuuuugagaaucugaagaaauggacguucauggcauacaagugcagacucacacauuuuccuguuuauaacuacagagcugaacucuggaguagaucucccaguuaagacauuaugaugcauggagagucaaaugucuaacaaggagggguugggucaaagugaggagaaguucuuauuagcauugcagcuaccccgaauucccagugagccaagagugacaggagaugaagagacccuaugaacuccuuuucugauggugccugucauagccaccccucuccuguccacaggaugacagagaggcaacucugcccucugucuccaagagcaauucaguuagugcccaggggucccgucccaggauauaauacuccgcaaaugggcaaauuacuuacugugaaaaaauguccccaugagagcucugauggccaucuuucaagccuucuucaccguaaguaucguacuguuuucguuuuucacuaucugacagaaccuggggaugaaugccagugaagaaaaugucaugcucuaagucaguuaaaggacauucacguucacagcuguuuuccacucugacccugaguuucuaaagcuucgcagagagugugauuuucauugugugugguauuaagguuuguuuaaaguuguuauuuuuguuuguuucuuggggauuuuugagcuaaggccuugcuauaugacucaggcuugccuagacuuccaaauguagccuaggcuggccucaaacucauguucuugcccuagccuccugagaaggagucuggacaugugcacacaucugggaggcuguuagagcagacuggauucuuugggguacugccuacugcaugcugcccaacuuauccuuucaaguugucaaauccgauugagugcuuuaaaaaccgcauuuaagcaugggacugugaaggucaagaagguagcaggaaagaagggagacugacugcucaaguugguuuucuggguaauuuaauuccagggcuuauucuguaagcucugugcaguacuaugucacuaaacuauaaacuagaauauacccaugaaagaccaucacuaguaacaaaugcacuaaauuacugucuuaaaaacaguugccucucuccggcuccugcacaacacacuguacagagacgucuggcacgccaaaacaacaggaucauggcccugaagaaaaauccagagcuguucccacagcuguguuuucacacuguuuguuuguuuuuucccaugcuuucguauguguagaaauccauuuguaggagaaugcugucugccuugacgugucuaacuuugugaugucuugaguucaaacuguugaaaagaauaucaauaaacacuacucuauaaauguaccuucaagucaauuuuacugccugaaagaacuuugcguaauguuuguaugauccaaagagcauaagaaaaaaauuaauuucuaagcauguaaaaauuugccuucaaugugcaagaagaaaaaauguauauaggggaccaauaaaaauuaaguauaaaauauuuauguaggaaacucccacaaugaaauccacacuuucuguuaaguuuaaaacuuaauuuuaaaaagggcucagguggaagauggcucaggugcuaaagcauuuguugcucuugcagaggcccuggaucccagaacccauauggcugcucagaaacauccauaauuccaguucuaggggaaaucaaugcccucuucugauuuccauggacaagaggcaugaacaaaaaugugucuauauagacaagcaagcaaaauguucaccuauauaaaaaacaguuuauuaagaaucaaaacaaaacagagcucagccugcucuugcagaggacucaagauugacugcuagcacccacgcugguggcucacaaccacucgugacuacagcucuggaggcaucggacaccucugggccucugcggguaccuccuggacucacaugcacacacaauaugcauauuauuaugcacaaauaauaaaaauaaagguugaaaagacaauaucaaaggguucuuuuauuuuagaaaccugaagcauauguacaugugaagcauaugcacacauauguacuugugaaaauuagagagugugaacucuuuccuuggacaucugcaaacuccucacucugaagcucaggcuagcuuaaccccugagcucaagggauaacaguuagcucacuuucacaggugcuuucuacaauacugagccuacuuuaaguagggcgggggggggggggcaggucguugauuaaucaacuaaccugcagacuuucaacuaccuaaaaugcuaacaauaaucaaucuugcuucagcagagggaaaaaaaaaaaacccuuuuguuugcuagagucuuuguauucuauuaauauucugauuugugcacacuaauuuaccuggaauaaaggcaaacaggcuuggcugauacaaggaaaaagaaaaucaacaaugucacagagguaguuagggucaaauaaacuucaguuucacaugcuagguagagccugcccaggucauggauaaagaccacugcagacucuuuaucaaggacagcaguacacaaagccaggugugcugaggccagcguagucuacauacugaguuucaggauggccagaacuacacagugagaccuuccuugucucaaaaaaauaggcacaugugcauugcaaagcauugaaaaagagugcaaauccagcuuucuuaggaaguauuuuugaguacuggguuucuaggaaauaaugacaauauaacaggaaaauacaaaauaugaaaucuguaccucauaagaaauaaaauguagugugucauuuuaggggcuaccaacucacucagauuuacacauggucccaguuaagaauuucugucggaggggcuggcaagguggcucagccauuaagaaggcuugcuucucuugcagaggaccugaguuugguucuuagcacccacauuaggcagcccacaaucaccucuaacuccagcaggagagcugguacuucuuuuagcgucugugggcacccacgcauaccuggcacauacauaaauaaaaacaucuuuacuaaggcaggaaauggagucuguggauaaggaccguucaauccggguacacauagaguuuucacuucccuacuaucugcuuucgaacagaaaugaccugagggagguuugccuggaugcuggucuuuuccgcauccccuggugguguugccauuucuguuuucacgacucaccucauaagcagcaccuagauccuggaauuucuccugggcuugggggucaucaggguuccggucaggguggagcugcagggccaguuuccuguaggccuuuuuaauguccuuuauggaggcacuucgaggcacccccaagaucuuauagaaaucucgccugaggggauggaccgguaagauuucauuaaagaauucuuucucuauuacauuuuuaaacuugauuucuuauucuuuggucauuuucaccugacuccuuuacucucucucauacccccacucacacugagccccuccuuccucccaacaagcccccccccccuuucauauaacuuauuugugauccacggagcugaauuagggagacuuacaugaguguggguggggagguaguuaccggagcauggcaaccuaccagugccugcaucccuaaagaaaaaugacuccccccacccagcaaccauuaacugucaacagcucuucccuuggggagggaggggugaaucuuuuuuuuucuuaugauucauguguuuguucaauucaucucucuagcucccuauuauauuaaaaaaauuauguguauguguuugugccuguucgucuacaugugaaaguugugagcugccugauguggguccugggaacugaaugcaaguccucuguaagaacggcaaguucucccaacagcucaguuaucucccaggauguauuacauuuucccccuuuccauuuagguccaauuauauaagcauguaaggauaaagacaaagguguaugugacaugugcacauauauaaaacaaugaacaaaaaagggauauaccgcaauuuacagucuuaggcacugaaaugaucacaauggaacuaugauuuggagacaguucaacacuaugugaagaacugguggcagucuucuuuuagaauuaccuucagcagagcaacuauuccuaugcuuuauggcuccaugcuauuuccagcuagcaaccaaacaauccaauugacucccucuuuauucccuauaauggcuccaaauacuuuuuuaaagaaaaauuuauuuuauuuuuaauugugagcauaugugugugcuugugugcgggugugagugcaaguacccuuggugucaauuaaagcuggguccccuggaucugucagguggccguguaacccaguuacacgugggugcuggggucuuccacuaagagcagaagugcccuuaccugcugagccaucucuccaaccucaccccagugacuuuugacucuaagggucaaauaauuucaaaagauaguuaucuuuauucacaaagauuaugucacauaaauguccuaaacaguagcacuauuggaacauuaaaaauggacugaccuaaggaguuaaaauaaagauuaagcaaaccccaaauaauaacccugaaggaaaaguagcaugcauccggauguaaggauuaugguguaucuugcuggaagagaaaaaauacauuucauucauucacugcuaguaacuccacuaauuuccugagaucaagucuuuaugauagacaucuucuaaaguccacaugcaggaaccucuguaucacugaagcugagaauaugcauaugauauaaacuggaacauaaaauagagaauauugccaggagcuaugcuggaaucagccauaaaaggguucuuucucugcaagaaguguuaauagaaagcuagaguaagacuauaaaaagcauuccaggcaagggccauauccggcucauugaagaggccagugaacacccuccgagaggugaacauaaguaugcucacaacaccuacucuuuuugccagaaguuuaaccacuagaauuugagucugaaacuagaauagaaacugaaaacauuaucucaacaauggggcuaaggaagucauauaauagucacugacauaguuggggguaauuuuaaaaugcauggggaaaaugcacuggggaaccaagacauaagacagaauauuaaacaauacauuuuauggucuggcauguggcucagagugccugccuuaaauucauuaaguccuagauucaugaauccuagcauucagccuuauaaacuccuagucauacuucugaaaaguuaucuggcuauuuuaaucauucuguuagguuucucgguuaguuuucuuagacagggccucauguagcucagacuggccuugaacucaguauguaucugaaguuuguuuugaacugauccucccgccucuaccucucaaaugcugaauuuauagguauauaaaaccauauccagcucaacuacauacauuuuuuuguuguuguuguuauucuguuuuucaauacaggguuuuucaguagcccugccuguccuggaauuuacucuguagaccaggcuggccucaaacauagagaucugccugccucuagggaugaacuuauuacuguuguuuuguuaaauaggcauguugucaaacuaccuuguaaauauuuagguuauauccauagacuacauaugaauauauauggaaauauaugauauaauauaaauacaaucuaugauacaacauguaaguauguuauauuaacacacacacaaauauauauacaugguuauauguuauauucaugaauauaagguuaaauccaugccacucuccuuuuuggacagagagaccucuuucuucaggggcaguaguuaaugcaacagcauaacuguucaaagcauggagaauaagugagugaguauugagacaucaaucuuaaauggaaugguguuucaaccuuccaccccucucccacacucccgaagguucauggguagaggguacagaaagaauguaaacacagagggugggaaggaguguugucaaauuuugucuucugcaaaugguauucaugaauucacucaagauaugguuaccugaacaagaccuaccugagcaagccaauacaaauagucaccaugugagaaggcagcacuaacuaaccggacucagagagguacaugaaguuaggacgggaacauauuggggugugcccagggcaaguauauguguggggggagcaaggaguuguggguagguauauguguguauaugaaacugucagagaauaaugaaagauuuaagagugaaaagguuaaaugauagcucagaaaaauacaagaaagaaaaagggggggggggcugauauaguugagugucagcauuauuuccccagaggcugcuuuaugagugacuauaguauuaacaauauuaguauuuuccaggaauggucguucaugccugcaagucuaacacuugggaagugacgacugaaggaucaggagggaguucaacgcugccuucagcuacauauugaguuggagaccagcauaccucaacuccuacaugcaaaaucguauguugauguaccuuggguacuccguggcuuaaucaaacaagaacaaaacaauaaaguguauguaagaaaugucaacuuugagaaauuuaaaguaugucacaaagaagaaaugauaagauuaaagcaaacaaaacaaaacaaaauaaagaaaauaacuuuaaaagcuaugcuaagcagugaguuucccauuaugaacaaccuauaaauugucaaaaucugacaucuaugagcuuuugguguguuuuuauuuuugcaguuauguauauauuugaaauagcaugugauauaggccaggcaaaucuggaacucagucgauagcugaaaaugaccuugaguucugacccaccuauuuucaucagcccaaagaagggauugagggugaaggcauucuagaacacaaguccaacauaccauauccuaagucaccacaucuauagggucgugcaugcauuuaaaugcugggagaaacuuuaagccugcucuuucucccugaaaguuggcacaguuaucccugauuucaggaacuugacacaguuccuucaagcuuguaggauuccuaagaguggcaugagacuagaaucccaguuuuuaucgccuguuagagaacuguugucacucagaccauccagcucaggaaggaaccauggugagaggcagcgaggcaagaagacaguucagguucguuagcccaagaaggugggaaguacaaggucucucuaaagugucuugcugcucucucaagccaacuuucuucagucugagcuuggcuuccuuucuugcucuccucauuugacauggcaucauggcccacccacuuuagugucagccuuuuggaggcuuguugcaaacuggguaacccacagucccacucuggaacucagacgucaaggacguaucuauaaucucaaccccagcuugacacucgcuuccuucauuuccaucaagagccucaucccucagacguccgccucccuucuucugcucacagccacuuaacucccuccaauccccaaacgugguauuuggcucugcaaccaacccccgcucuuccugggggaaaccuggcccugcaccgccagccuggcccacacuacccccuugucccucgacccggcagugccccucccucacuccucgaugucacccgcguccuucucagcaagggccgccccucggccucuugcugcacgcgcgggagcccccuuccucacccggcgaucacagucccgaugagguacagcagcaacaggcagaaggugcucagguucugcggggccauggcguccccugguccuacccucucagccuccggugccgcugcgucggcugaccagcccuuccggcccagggaggccgccucacgccggggucucucucuugcccggccgcggagacagguagcgcgccccuuccucagcugccaccuuccgggagccccagagccggcgagcagccaggcgugggccaaucgccgccg

SEQ ID NO: 8181 - RNA, 7446 nt, Mus musculus
augaccacauuuuuggcucagagccuucuuauuugagaaagcucgugugggcacuuuuauuuauggcuagauugaagauuggcaagagcaccuuucagagucgugguugcaacuguuuuauaugaggucagugggaaggcagagaaacaauggcagucauuugucaccccaccagugccaguguugcugcuggcuuuaugccuuucaucaaauuugaccauuaccucucugccccuguucucugaggaaugaagagaccuggaauucgagcugugaugugguauugcuuugucaguggacaagccacccccuccccgcccccagcuucagugguggcuauguccugucugccaaaaccuuacuuccccgaaucaagccuagauuuugaagugucugauccucccugggcacaugggggacacuggaccagcagcaccaggcuggcccaccuuaggagaaugaagaguuucucccgaggccgacuccaccgaggccacaggagagaaggcguggcguaggucgugguaaguucgguggucugaaaguccucguggaaccaccacaggucccaccaccacagaugcaggugggucagcugguagggcugcauucgcuguggguacgggaccuacugcguuggcauuggcuggcuggggcugcgggggcacagguggagagaggaucauuucaguaggcaagaugguuuuccaugacaggaauccccaugaguguggguuacagucccuugcaguaaugcuuuuuaguuggaaagagucuagcuaaggagaauggguaagaugcuaaggaugaugacaggaagagcuggccuauggagcgccagucucaccugcauuaccucagucccaguagauuuccacaaacauaguccaguguacaagcuccccacccgcagagaaccuucacucucugccauguauacuugggaacugcugggcagaccagcccacuuggucucuguaaccaggaagaguacucccacccuccacaaauagcaagguggcuuugccagcuacacauggggauuguuuugcccugcagccaccggagguugggagggaaaacacaacugaaauguccuucgcccagcugauggguccacauacugcacuguuauacaauccacuucgaggcuuagggccagacagcaagugucccaugguuacuaguccacugcagauguguuaaggggacacuguuuugaagaacguccaugaaguuaccuguguuuggaauaacuugcaggccacugaaacuucuuccccaccaagauuaugcaugagauuugccuugcagaagccauguugcuguuuccagaaagacagggguuauuuuaaaugaugcauggaccuccccgggguuuucaaugauauauauuauuauuauacuuaauaauauugaaacaaagaaacuuuuaauuuuuuuuuaauuuuuccccuuuaaguuuauaauuucugggcaacccucucuugagacguuauacccauguaauaaaaaucagucucuuuuccucucucucucucucucucucuuucucucucucucccucuccuacacauacacacuuaagucuaagcuaucacuuuccuuucuuucuuuuuucuuuucuuuuuuuuuuuuuuuuacacaggugucccuuguguagaccuggcuguccuggaauucacucuguaggccaggccagccuugaacucagagauccaccugcuucugucuccugagugcugggauuaaaggcgugugccaccgcagcccagcuagcuaucacuuuauuaaacgaaucuuauaucuuauuuuuaaaaaaacccuuacuuuguauuaacuaaaacuucuggauuuugcuaauaaaacauauggugugccauuccacauauuacagugacuauccagaaauacuaugcgaucaagagcauguuccuggaaucccugagauggugguaacacggggagagagacacugcuaauacaucuucaacaugaauugaugucguugugaauaugaguuuggugcccugugucaucauccccuuauucuggagauauuuucucacaucugucauuauccugcucaauuuucuguucacauaaccagugaccuucucuggcuaacacugggauccuuucucugugucugaccacagguaucuaggauaccucaucuuuacagguaaaauuuggucaaaccccuucuguuccucacuuuaagcuaaaucucuacaaauggauauaucuggcucaaagacucgguguaucccgguaucagagacacaccuagaaagucugcucuucccguucccagcagccagggugcacugggaacuggacacggacuuaucugauuucaugugcuucucagaggugagagaguuuggugucuaugcuuaaagagggaggugaggcaccagagaaaggccuggcacagccuagccccauagcaaguggacauuuuuaaaaauaaagauuugauuuuauuauucuuaauuauguguaugggucucucucugucugugucucugucugucucucuuucugugugugugcacugugugugugcacucgccugcaaaggccagagguaucagagcuggaguuaaaagugagccaccuggcacaggcaccgggaacugaccuuggucccuuugcaugaacaaagaaagaagugugugcucuuaacugaugagccauuucuccagcuucacaaggggacaguuuauacuuuuuguuuguuuguuuuuuacuuucuuucuucagccccaagauauaaacugcaaaaagauacuuuguuccacaaccagauugggagcccuagggucuggcccacucaccuucucugccagcagguugcauuuggcuggaucugugacuucuuuugcaguacagucaguggcagcuauuacaaacuccaccagaguagacacugggagaggcugagaaugaaaaugagaacacgugggaaagauggucuggaacaagaggggcaagaagaggugggacagagggagggaggggggaaggagaggugggauagagggaggaagugacagagaggaggagggagagggagggagggagcaaaggagaggaggaaggaagguaagagggagggugggagggauggagaggagaagcuauggucuggcacaguuugagagaacacaaauccacacggacuacguguggcccugggcaauuggaaggauugaguucugacgaugggcugcagaugaaagaucugagucuucucaaaguauuggcaagagaucguuguccaucgcauggggcagagguuaaguuuucagagaggaaacaggaagccaaaaggcuaacuuuaguccggcagggauggaaacccagcaucuccuggcccucaaccuucagaauucaauguuccagucaucccaggcucgaagcgggaagugaaaagaugcccccaccccaguuucccacagcaggaucaaaauggaagucacugugcuuccuucccccugacgcugggagccuugcaagcacagcgccuggugcaguaugggaugggaauugucccaggaauuacagaaucaccaccuacacuaauguauuugcaaguaugucuugacuuauuuccauugccagcuuccuuaaacaucucaagucuauugcacucaaauaguugcuuuggcuauacaauuagaugguccccucccaaccucaaaaccuggauuugaaaggcagauuaggaaccuuccaguauuugcccauaccuuuguuaguguugauucccagacugcggcagauguuacuggcaggguguaaacguguggcacccggugaauguauugugucugaacagagagcccugcuauuaaguguuagguaaagccaggaggccaggguguuaccugccuucugccuguggcugaccuauguugaacuggcucaguuugggacagcgcugcugagaguuuagggcuccauaaguucuagaaccccugccaguucuuccagccaauguuuccuuuucuucugguuaucacccccacacaugccccaagggccaccaaaucgcccaaaucuaucaaaagaguguuaaguuuuuaccacauuuugagcccgggaaaucuccaccaguuuaaaauagguuccauuauucuguguguugaaggcagccagggcaguguugacgguguggaccacguugguaucguugaacggagucaggagugggcaccgugggcacaacuuacgaacguccucugcagagucugggcgggaagauagcagggucucaacugcagcucuccaguguacucacaacagcuugcuuauuuagaaagggcuccuagugcuccaauguagcaugacuucuucucuaagccuucaagcagcuguaugaaggucaccaagucacagccacggggacaauguucgcccacaagaacgggcuucuuuaaaagauggcauuagaauccccaggacccagaauccucacagaggaagugagaccuauuugaguucaaaacuauucugauuccuuucucauucuacgagauaaaaacaagaggcaguguuuucugaccugggguggaaugacacugggugugcaucacccugaacuggccgucuuguuucaggauguggaagucacagucucccuccaccgccugggaaagaaaucagaugccggcauucugaagcaguauauauacucuggcugcucauucagggagcgucuuggcaggguugugggagguaaccugcccaaggcaaccuucacggguguuauugaaacaucauaaucugcucucccgagggcuucaagaagaaaagcccaaguguugugaaaaucaaccucggggaaggcaccaucuaucccacagcggguuuuagacuuugcucucuggcuagccaagauggcugcugggagauggagaaagccaaaccugcacuuugcugaacugugguggcugggcagcucccacccacccacccacccaccaaccaaccacaaggcagcacucacgugcucagucagcugccucacagaacaguuugccagcggggugggguccaaagcauggcaaguggucuccagugugucaacuuccaucucauacaccacuccgaagggccgcuguggagccggacagaagggagaggugagcaaacgcccugcuccgcugauccaaugcauggcaccuagugugaacacuagcccugugguggggcuuggcugaggggugggaggacuaaggagaugucagccccaccccuuccagcuaugcagugcugcagugguuuuuuuuuuuuuucuuuuuguuuuguuuuggcuuuuuagucuuccacuauagauggagcgggugugaaauggggaggggggagggggaagaggggaggggagggggggcggugcucgaacagcugucccagccauaguccuuauucugagcucucuuuacaaagaagugacucugagggcuagcuuuuaucuugaaagguuuauuaucuuugcuaucuuucauucugcuucauucuuucuucucucuaguugcccacuuuucucccuuucuuugaguguuuguguccuuaaagguuucucuugcuccucccuuggcucuuuaucuucuaccuuccuggguccuggaugcacagagaguccuaucuccuguuugccgccuuucuauucugaggcugggaaacugucaccacuaggauggaagcauuuugggaagcuugcaggacccugugaggaguucaguguuucaccugucuauguauuccccguucacaccuugaaaugccccaaaguuugaaaacucucaacccaauuuaguucacugggcauuuucacucuccggagaccucagaacuaccauggguagaugcacuggguuuaugugcagggacuucuugauccacucgggcaucccauaaugagcaucucacaaucagcacguagcacaugcacagugcucgcucacggcuuucccuucagcauguaaacuaggcagagagccggccauuacgucuuuugccaacugcccuuaaaacucacccaggaaaaccgugguuucaaaucagcugucccauuguaaagcugguugucaauccucacucugagcauccugguguuuaccuuauuuuccuccuaaauccuaagucucuagugacacaaacuuguucuucucaucuuuauguuaagcugaaccguauggaguuuccaacuuugcauguuaaaagcagacaaauagucggugacacaugccuaugauuccaggagccaggaggcagaggcagguggaucucuguguguuugaggccagccuggucuacauaguaaguuccaggacagucagggcuacaaagagaaaccuuucugucucaaaaagaagaaggaaagaaggaaggaaggaaggaaggaaggaaggaaggaaggaaggaaggaagaaaggaaggaaaagaaagagagaagagaaagaagagaaaggaaggaaggaagggaaagaaagagcaaagagaaagaaagaagaaaaaggaagaaagaaagagaaagaagagaaaggaaggaagaagaaagaaagaggaagagaaagaaagagagaagagaaagaaaggaagaaagacagacagacagacagaaacaggaaaagaaaagcagacaaguauuggcgguuucauaguuucagucuguuagcauaugagaucuguugucuaaggagaacauggcuaucaggcaggucuggaaugaaugaagggaggauuuaaugaaacgaucugcauuagauggccgucacacauggucacugaucaaaugcugcuuuccuuuucaucagagauaaauguaauccaagaaagagaagucauucacaaauuagcaaauagggcccagguucucccagcaagucccaccuucugccuguggucugugaacuaugccucggggucccuuccucuucccgugggagcauccucugugagauacacggcuacaauacugauguggccucuccugcucucucuuucccaaucucugcugccauuccaucuccacugggagaugcuagccuuugaggcacuggguuagauccccuacccagauucauucagcucauuccugguaggcucacuuacccgagaccacaccuugacuuugucgaucugauucaagaccuguuugaaucccugaagaagaugauuauugagguaguccacggccaacaaagcuacuugcucugcuucuggaucaucacaagccaauucucuaaaacccaguccuguaccuuguggagcggauuggcagccccagagcugagcaaaacaaaggagcaagaccagggacuucaugguugcuccagagaggcccuggaaaaugggcaaaugucaggagcagcccggauaaucagcuuggagagcuagaccaauagaggggcagagggccuaauuuaucugaca

SEQ ID NO: 8182 - RNA, 1387 nt, Mus musculus
auccuccucaugcugcugagccacuguccucgagcgaugaaaccguggccguauauccugcucacuauccgggauggucucuuccucaacaucacccuuaagcaggauaauaucuauaucugaguacuucaugccauucacuaacacaggaaucaacuuugguagaugccuuacaaguacaucuuugcauauuggcuguucagccaaagucagccagaauucacaggccuccagagcuacauucucaucuuggucuuggguucucugcagcauguacucgacuauguugugcauaugaggaagcaggcgguccauccgggcuucaagcaacaucacaagcgcccggcacacguucuuccgcaccucugcuuccucgucgccagccagugcaaagagguucucaaugaaggaauccaugugcagcaugagcgccuggguccggcugaugaugaacugauugacacaugcaacagcacgagaccuuauuuugggacuccugugcuugaaaaacuguaaaaacuuggggaucaugauguugagagggcgaucuaagacaucacugucuaaaaucucugcagaguccucacauaucuucugaagggcaccgaaggcucccucacaaguguuguagucuucggaauccagcaggcuacagagguuugguaagagaucaggccaauucugcagcucucccuuggaggcuaugguuguaauuaaaauaccgacaguggcucugaucaacggagaggaguccccaauguuauuuagacauucacucuuuuuuuuuuuuuaaagauuuauuuauuuauuauauguaaguacacuguagcugucuucagacauuccagaagagggagucagaucuuguuacagauggcugugagccaccaugugguugcugggauuugaacucuggaccuucggaagaacagucgggugcucuuacccacugagccaucucaccagcccuagacauucacucuugaugaagucugucacaccauuugggaaguucugaaaaugagcuuucacauuguucuucaagaucagaccgcucaaugaccgugugggcucaucuucagauuuuaauuuuguaagaacaaaaaucaaguaguuguuaaaaucuggauauugauugaguuguuccaguuuuuguugcacgguccucuggaugguggugucuggggacugggacuccuugagcagcugcaggaucugcugaagcccugcucaucagguuuccaaucauacuccaucuugguuugccggucccacaccaucccagaggccucuggcgcucaggccuuucugccaaaguggcacugccucccguccugggccugaaauggcugcggaacaaagagaaucugggcuccagugagcgccg

SEQ ID NO: 8183 - RNA, 5594 nt, Mus musculus
cgagucuaauggccugaguucugauggucagaacccacuuacaaaguuaaaugcgacgagaagcagcuauuuccugagacaggagcauugccagagcugccccccacccccacccccagccagcuacccuggaguacacagccaggcggaaacgagaagagaccccgccccaacaagguggaaggcucuccagcgguggggcuuucaaggacuccugaaagcuguccugacucugcucucacgcccgugugcacacaaguaagcacauuuuaaaugguuuaaauaaauagauaaagcaauugguuuacacugaacacuuauguauuuagggagggaggucgaggcgaggcggccacacccuacguguaaaggucagaggaaaacuuacaggacucuguguuugcauuucacuaaauggacucuggagaggaccuugguccucggauuugacuucaggaaccuuuaccuguagggucuucuagcuuuaaaugacuuucuaaaauguuaaauaggacaaaaauaaagaagccagguguggguggugcuugucuuuaauccuggcacucagggggcagagacaagaucucucucauuucaaaaccagacuggguuacauagcuagcucaggcuagcaagggcuacuaaacgagacccuggcucaauuaaaaacaaaaagaaaaagagaaagaaaaaaaaaaacaaaacaaaaaggaagaagagaaaauauuauggcuaaauuuguggaaaugguuuuguuuuguuucuauuuauaguguuugcuaucuucuaaaaaaaaaagaaagaaagaaaaaaacaggaaaaaauagaguuugaaauucacucauccagaaacaacaaaccaggaaauuuuuuagaggaagaacaaaauaguugaagaaagcuggguggugauggcacacgccuuuaaucccaguacucaggaggcagaggcagguggaucucugaguucaaggucagccuggucuacagagugaguucuaggauagcuaggguugcacagagaaacccugucucaaacaaacaaaugaaugaaugaauaaauaaauaaauaaaauucaaaauggaauggacuuguuuauuuuuacauagagaauuaagucuugacugaauuuuugacaucucgggacacaacauaucagaauuuucacaguuaauugguauuugauuuuauaacaucauuucuuucuuucuuuuuuaaagauuuauuuauuuauuauaugugaguacacuguaacuaucuucagacacaccagaagagggcaucagaucucauugcagaugguugugaaccaccaugugguugcugggauuugaacucaguaccucugaaagagcagucagugcucuuaacugcugagacaucucuccagcccaauauaacaucauuucugauggcuuguuuuuuuuuguaaaaauagaauauaagauagcagaaauguguucacggucauuucagaaaguguuggauauucuacuccaauccugaggaaaaccccaaaacaugaguauuaggagaagaguugggcucucaaacaaacgugaccccgggugacaaccauauuaaaacaagcaaagaaaacucuuguguacuuaaaauaauucuggcacuacuguacugguuguuuguauguguuuguuuuuuuuaaaucuccaaucugcuuaaggggccagacuugcagugcauuugaggcuaaccuggucuacauagcagagaucuaguauauuuuuuuuaaaacuuuuuuuuuuuuaauuuaaagaaaauguuuuucuuuguucugguuuuuuguuuuguuuuucugaguuauuuucucauuccucagucaauguauuagaacgaaguuugcacuggacaagcagcucugagugagccucucuccuguaaucccagcaccugggaaacugagguaggacugagaauucaaaaccugcuugagcuaaauggaacggggcgggggggggggggguuccuaacuaggauugauccucaaaguucaaguuguuuguuucucccuuuccuccuauuccccagcacgcuccagcccgaagguaggaagcuuguacuggccuacaacuaagacacucagaguauucugguaugugugguggagggacgagccugggaauagcccauggucucacggugcgggcugugccagaugaaguagcgcuguagggcaagcugucccguaucugcaaaacccagacuuuccugcuguuugcaucugcacggaaguuggaagaaggcaaagaguuggggcuagcaggcuggggggcugagccuggggccaggagagucccaagaagcaaguuuucuguuuguuacguuccaucacaugcuucaaagugggggcacaaccaggcuaaaauggccuaaaggauuguggcuguaaccgaggcaccucagacugcugugaauugcuaggaucagagacugcucuuaaggcucacagcaagauaggaaagugagaaaccccaaggucccugcagggaaccuugcuccagcucccuacaaagacagccccugagcaggacucugauugagagaucuuagggugggaacgucugugugaccaggucaccugcuggaaguaccuugggcuggugccucuggugcucuggguugcagaggugugucccccugagaagccuccgcagcugcaagccucacuuucugaguugcgggcagggggaggggauggggaugggaguaggggagaaaggugguuccccuucagaauuuuccucgguguccucuggucguaucuucucuucugugccuuucuccuguucuuacuccaccaucgggaguccacuuccugcuucucccagggccccugcuuccccacccccacacuguggcuccagaggaggcacagacccuuccagaggaccggccgcccagccugcugccgcagcucagccgccuguuggaaauaccuugcuuuugcaagauucugcuaaaauaaggauaaaaggacaagcuacacaggaagaaauacuugcaaaccaaccgcacuuguaucuaaaauacuucaaacgccuucaauaaugcaaagggaaaugcuaaaacacaaguaaacgccgagccaaagccuuuacugugaaaaggacgcagagcagagaugcucugcgccuucugaauugugauguaaaaagugacgguuugcauccuuuauucccaggucaaacaagcucucucccuuugcacacagucacuuuugggggggggggagggguuggcuuuuggugacaggguuucucugagugcugggauuaaaggcgugcgccaccaccgcccggcuacagucacucuuuugaaagcuuuggauugaguaggaacugacaaacaggagggaugucuccuccagugaucugcggugucaaagcucuucauuuauuuuacagaguauuugauuguuacccguucuguucauaguuagaauaugggaucugagggucaagagaaagggcucagcaagcaaagagguuugccaccuagcccgauaaccugaguucaaugcccaggucccacaggguaggagaaaacuggauccugcaaguuguccucuaauuuccauauucacacacacacacacacacacacacacacacacacacacacacacacacacacacaucccugccuccccccauccccccucauacccaagcaugaaagcccuuuuaacaaagaauguuucaaaucaccuggacagaucagaaacuguuugucaacuguaggucuuuuuacuugaauuuuguuuuguuuugguuuuuuuuuguuuuuucgagacagaguuucucugaauagcccuggcuguccuggaacucacucuguagaccaggcuggccucgaacucagaaaucugccugccucugccucccgagugcugggauuaaaggugugcaccaccacaccacgcccggccuuacuugaauuuuuaaaagagaauaucuuguuuuauugugcaaaucauacuuuaaaaccacaaauaguccaggcauggugauggugagacacaaccagucuuauauuuguuuaaauuaugagacagggcuucucuauguaucacuggcugucccaaagcacacucuguagaccaggcuggccucaaauucagaugccucugccuccugagugcugggauuacagguguguaacaccaucagucuuuuuuuuuuuuuuuuugguuuuucuagaccggguuucucuguguagcccuggcuguccuggaacucacucuguagaccaggcuggccuugaacucagaaauccgccugccucugcugggauuaaaggcgugcaccaccaccgcccggcaacaccaucagucuuaaacagugacucuuaaaaauaaaauaauuuucagggcagugguagcacauaccuuuuaccuagcacuuagaaggcagaggcgagugcgugucugaguucaaggccagccuggucuauauagugaguuccaagacagccagagaaacucugucuucaaaaaccaaccaaccaaaccccaaaacacccaccaaaaaaccaaccaaacaacaaucaaccaaccaaacaaaaaaucuuaaaauguuuauguaacugagaaugaaaaaguauaacguaaaagcaaaauucuaggccuuuaggcccaggcuugagaaugugaccucugugacucaaagcuccaagguaugcuaaucauaaaacagauagugauauuccuccacccacccucuuccuggguucaaggaguguucauucagagaaagucacccugacccacccugagcauugcuggaacuugcuaugcaaaugugcuauuguuaggggcucuuagaaacugucuggagaaauaaccugcacaauuaccagguauuccuugugacucuugugacuuugcacuuccuugugacucuuaacugguauuuuugguauuuuccaacaacgcccuccccacuuccuugaguugugguuucuuccuuuaaauacccccuuacccagcuacucggggcgccauggcccucuaccucugcaugguguaugacugugggcccgagagagcucuugaauuaaaaguccucuugcaguuugcagcaagaccguuucucaugagugauuuggggucgccucuccugagucagaauguggggggaguccucacauugugggucuuucaagaugaauauuuuuuuaaggauuauaugcaugugacucauguuuugacuucuaagaccauuuccuucaugucugugcuucccaucugugcuucccaggauggagacauuggcaguuaaaucugccccagaugguagaagcagugcacucccugcaugucuaaugaugcucagaggauggcugcugcucucacuacauuaauagcauuggcaggugcugcucacgucuccuggcuuuugugaggugacugucacaaauacaguuguccccgccuuaggaaugaggacugucuuccuaccuucuggaaaugucucaacugugcuugcuccuguaugggugaauuucacugauuggcugcugcacucuggugagucagcuuccuuucuugcaaaauaaaaucauuuucauggag

SEQ ID NO: 8184 - RNA, 13799 nt, Mus musculus
cuuucgccgccguucuguggcgggaaccgcggugccagggggacggugacgacuguaagugaugggucugaguguucucagccuuuuacaggcuggcggggaccgggaugugaccuccgccuucccucuaggcacaaaguuagggguccuuucaaggggagcugccccauaaugguuucuuuuugucuuauacccaggagaagaagccaugcaggcauuucugaaaggcacaucugucagugccaaagcacaacugaccaaggaccgggggacaccugccacugcaggaagcaguggagaaaccaagaaagucaaaccaguuccuuggguggaaaaauaguaagaacugcuuguacuuuuguugaaauaacuaauaagugcuagugggguuuuuuuuuuaauguaagggggacuuugcuauauuuagaucacaccuuugagggguagggggacgcgguaucacccaauaauaagucuuaguccuuggagugauacaguaguugaauuuaauucuuuaguuauauagaugaccuaagauguuuauaaaguguacaguuuuagagcccuacagaaacgaagaaagcaauguuucugugagcuggcuauaaacacuuccacugaaaucugacuuuuauccuuguauguauauggugaaauuuguugggaucuuguuguugauguuaaguaccacuacauugucauuugcuagaugauacuagaaccgucagcuacguggaaccucuuugaucacuaaggaucuucagguuauuuacaagucaaacaagguccucguguguguuauuuugcuguuucaauauuauugagaaguucaaauaugaguacuucaucuauaucaccccucuuccugcccccaacucaucccauagccguccccgcagcaaagcaagugguggucccauucagaucaucgggcuuugaaagcucgcacuuaccuguugggaaucucgcuaaccuuaaucuaggcaagcacucuaccacuguucuauacuccggcccauagaucuauaguuuucacauguuuaaaauuuaucguugaggaaggaggaugcaugccaucacaagcaugcuucgacucccagguggaguaaguucuuagcugcccuguguauuccgugugucaaacuuggaucaucagacuuggcaguaagugccuuugccugcugagccaucuuaccacuccaaaacuaccuaccuaccuaccuaucuaucuaucuauguguguauauguaugcauguguguguauguauguguguguauauauauauauguauauguauauauauauauauauauauauauauauauauaauuuuuuuuuuaacaaggagguggggaagggaggaccuaggguucagcuucuccagucagacggcucuggcuccaagcucucacauuugcucacuuuuaugcugccucuccuuuggagaagccuucaucaccacgugccugucauacauccuuggacgguuucacuguuaccugccucauccuggcagaccuuuauagcacacgcaaugauucuugcccaguaccaaccugauuaauuacgcugguguggaucagagaauuuggggccaauaaaagggcucaguggguaaaaacacuugauguagaaaccugacaacaugaguuugguccccgaacacgguaguagaaggagagacgugaccucugauauuuguucccuuuacaucaucuguauguguugcccacaggcacacacacacacacacaaaacaaauaaaaaauuuuaaauuguuucuaguuaauguguuugaguguuuggccuacacauauauugccuguguuccauguguguaccgaaugcccauagaggcuagaaaaaggcgccaaauaccauagaacuagaguuauaaauaguugugagcuaccaugugggcucugggaauugagcccagguccucuagaagagcagcgggugcucuuauccacuaagccaugucuguagccucaaaauaaaaggauguuuuguuaauuuacuagguagaaaucucagucauaaaguuuggaaagacaacuuugucauaguuucucuuaaaauuacuaaauaauggcagguggcucacagcuuuagucacagcacuagagagggagaggcaagcagauaugugugguccagauaggggguuccaagcuagccagggguacacagauauuugucucaaaaaauaaaaauuaauaagugacuuaaaaucaaaauuauuagcugguccugguggcgcauaucuuuaaucccagcucucagcaaauuucugaauuuaaggccagccucgucuacagagcaaguuccagaaccacaagggcuacacagaaauucugucuugaagaggggggaaaugguacugaccauuuaauguauuaacugagaaagugugcuauuuauuuauuuauuuauuuauuuuaaaccaaaguaguugccauuuguuagguuauuaaauagucauuuuuaacuccacuucaugagcuuuucaagagauuuuagccgggcagugguggugcacaccuuuaauccuagcacucgggaggcagaggcagguggauuucugaguucgaggccagccuggucuacaaagugaguuccaggacagccagggcuauacagagaaacccugacugggggggggggggggugauuuuaugagauuuuauaggcaguguucccccuuuuuuguuguuuuguuuugagaaaaggacugacugugcuguguagcccugacuguccugcaauacauuagguaggucaggccggccucaaauccagaaaacuacuuaccucugucucuuccuugcugggguuaaagagguaagccuccacaugcaguugacuuuaauuccaaguuuguucuuuaugauacauaaaauucugcuuauuauuuuaucaugcaguacagguagaaggcaaaaauaauuucauuccaguaguguguauuuguucaagguaaauacaauggaguuucugccuccuucaacuucaugagugacaugugagugcugucauuggugucuuagcagcaggaacacuugagacuuuucuguggcuaucacagugcucuccauaacccacuucccucuguccuccagccguccaaaguguguggaugaaguggcuuuccaggacgaagugguugcagugcugagaaaguccuuagaaggagcugacguaaguagaugguguuugaugacggaaaauuuaagaauucauucauaggaaauacaugcaauaagucuuugauauuuuuuaaaacuauaaguaguuugccaaaucaucuucuaugugacauuauuauguaguauugaaauaaagaucacugacuaagauagguuaggacccuuucuccaugagccuuuauuuuuagaggagaaagaggacaaacaaguaaaccccgaagauaaaagaauauuacaguuacagauguguuaucaaaacaagucauuuuaaaauguauauaguuggcuguguguagugucauguggcuuuaauucuaacaucugggagcagaagcuaaccuggucuacauaguaaaucccuggccagccacagugaaguuacaguuacccaugaguaccacaggcgcagcugugauacacacacgggccuuucagaaacauuucagacccaagccacagcauuuacauagauccaaaguaaggauauuugagaugaaccaccaccccacaccccccaaaucaacacagacuagccuggucuacagaucuagcucuaaggacauccagggcuacacagagaaacccugucucuugaaagaaaaaaaaggaaagaaaagguaaaugagacuaaaaacaagagucaauauauuauaguucccuggguuaaucauuacaaauacugagucauguacagaucaaaauaauuauuaucugaaaaacuaugggaccugguauaguauucuaacuacuuuguacauugcuaaaacaaaauacaacuuaggguuuaugcuggcucacaguacaagauagagaaggcaugcagcgggaacuugaggcagcuggucacacugcauuuaugcucaagaagcagauggcucagugguuaagagcacuggcugcucuuccagaguaccuggauucaauucccagcacccacaugccagcucacaccuaucuguaacucuaguuccagggucucugacacccucacacagacauacaugcaggcaaaacaccaaugaacauaaaaaugaauuuaaaaaauaaaaagaagaggcagagaggugaauaccaguguucaaccuccugacucccuagugcucaugucaaauauacaauuagugcugcuaccauuacaagucucuccucgugaacuugacauuuaaacauaaaacuuuuaaacuaugacauucuaaucuuugucccccuaggcugauggcugacucauaaugcgaaaauguauucaaaacaacuucaaaaauucucagucuuuaacagugguaaagcuguuuaaaaggauaaggguagggcuggcgagauggcucaguggguaagagcgccaacugcucuuccaaagaccccaguucaaaucccagcaaccacaugguggcucacaaccaucuguaacaaagucugaugcccucuucuggagugucugaggauagcuacaguguacuuacauauacuaaagagagagagggagggagggagggagagagagagagaaggaggaggaggaagaaagagagagagagagagagagagagagagagagagagagagagagagagagagagagagagagggaggaagaggagauagggauucuucugagacucugucucuaaauugugagucccauaaaaucaaagccaaguuacauaauaauauacaguugcacagaugagcaucccuauccacaaagggaagaaaggucguagcaaggaaagaguagaugaauaucuuaaacccuaggauagcuaucaaggccuacgcuugaggcucuugaacaaaggacuuagguagccccauuccacagcucugccaccugcagaacacauacucugucuuggccuucagcagacaucucccaaaucgcaagagucugcucugcagcuugugccucacucacagacagcuucauucaguaacccugcugcaguuggaaccuuggcauaagcacugugacuuuauucuuauauuuuuaaaagagauuuacuuauucauguauaugagugcucugucuuugugcacaccagaagagggaauuagaucccauuacagauagaugugagccaccauauaauugcugggaauugaacucaggaccucuggaagaacacacaagugcucuuaaccuuugagccaucccuccagccuuccuguucuuguaucuuuuugucuguaaaacuaguaccauuuagaugaugcuaaguuuuguuuucaguucaacaagccucacuugccuggaccucugugugucuucuggguugacccugaggaaacacuucccuagagguauuccucaauccacagauuugugaaccuagaaucugucaaguugauauuaucacauaaauuaucacauaaggugucuugaguuuuauuugaaauuagggucucauagcauuaucuuaaacuauauguuguucguguuaaaguaguucucucuucccuucccuucccuucccuucccuucccuucccucuuucucucucucucucucucucucucucucucuuucuuucuuucuuucaacaggguuucucuguguaacccuggcuguucuacaucaaacucaagagcucugccugccucugccucccaagugcugauuuaaagcaugcaccauuaaucccauccguaaacaaaaucuuauuuuuaccuuuuuaagugaucuagugagguaaccauggcuuuuguaauuaaagucaacuguuaaacacuuaauaacugccaauuaaaucaagugcagcaaaaauagugaauaaaagcagagccacuuuagaauggauguuagauaacuugcaauguguagccuugaaaagacaugaagaauggagccagaguccagauugagaagugcagacauucagaggggaaaguucuuucuaaucagaagucaguguaagugcuugagguuacuguuguccaaguguuguaugaagccagugagagcuuuuaagucgcacccagaguggcaccugguagaacgagccaugaauaaagcgugaaugaacaagaagggcaauauuuggccaaagucagacgguuggcuacuuucuuaacuuuaggauuuaccuaccugaauuggaacuuaaugcacuaucagggaaugguggccugaaacucuugaguggacauagaagcucaggagucaucaaggucacuuacauagcacauucaagggcauguuuagaacuuuauuuuuuguuuguuuguuuguuuguuuuuugagacaggguaucucuguguagcccuagcuguccuggaacucacucuguagaccaggcugaccucgaacucugaaauccaccugccucugccuaccaagugcugggauuaaaggcgugcgccaccacugcccagcauguuuagaacuuuaaauacuaugauaccacuuacguuaaaaaaucuuuagacgugugcauucucuauuagaaaaguuaccauaucauucuacagaugguugaguauucucaguuucaucuauuugugacagcguauaaucuacaaacauuaaaauuuaauuucugcagcuuccuaaucucuuguucuaugggccaccuggaacuggcaaaacauccaccauuuuggcagcagcuagagagcucuuuggguaaguuggcauuggugggugucuuaguaacuauucuauuucugagaagagacacuaugaccaagacaacaauuauaaaagaaagcauuuaacugugugagguuuacaguuucagaggguuaucaugguggggagcauggcggcaugcaggcaagcaugaugcuguagaaguagcugggagcuacaucuuaauucauaggcagagacagacagagcacaaacugcacugaggccuggcauaugcuuuugaaaccccagagcccaucccauugacguacuuccuccaaaaaggccauaccuccuaaguaccuccugcacucaaguguguguauauaaacacacucacaaagcacacagcauuuuggugcuguuuccuucuacccccuuucuuucuguaaggugcuuguuggcuuuauugcugguuuuguuuguucccaugguucugucuuggacacagaccuuuaauccuagcaggagcaggauuuuaguucaaggcuagccuagucuacaaagggaguuccaggauagccaaggcuacacagagaaaccuuaccuugaaaaacaagcaaacaagcaaacaaaaaaauuaauuagaucucuguggucucauuuuacuguucccugagugaaugaguuccuaccucuugagcauucugaaccuucuucauaugcugcaaguacuauaacagagaaacuuuugauuucauuauuuuaauuaugggguccagacagucauauccucugaaugguucacauguggcuuuauguagcaccugccauguaccuccucagcccugccuuuaguggucaggccacauuucuuguccugagguccccugacaagagcacaguugaguaguaacugagugcaguuuuaggugcauuagaaaaccuccugugaggggguggguaugggggacuuuugguuuagcauuggaaauguaaaugagcuaaauaccuaauaaaaaaugggaaaaaaaauaaaaauaaaaccuccugugaucuugcuuagaucccucgucccguguuuucuaccuccacuacugucacuguuuuagauuucaaauuguacaauuccuaaauguaguuucauuuaagaauuuguaacaauccgaaaauguaagagagcaaucuuugcuucucagaaguuuuuauuucaugauucacagauucaagcugaacugaccuuaaugauguaacaaaauucagcagcauauuuauuuucgaaugggucacagaucuacuuuauguaucuucuuacuauacuuuaaaaauuauguucauggccagucauugugcauacugacaacauucaggagucuaaggcagauauugaucaugaguucaaggccaacuugggccacaugacaacaguuuccaaaguaauguuaguaauaauccuuuuguuugucuguuuuguuuuuuuaaacagaguuucucuguguagcccuggcuguccuggaauucacucuguagaccauguuggccucaaacucacagagauucccuugccucugucccccaagugcuggcacuaauggcauugcuccaccacaugcccagcagugauauucuuaaagaauuuacuuucauuguaaauuucauacuuaguuguacauguaacuuaaaauaaaggauaaacuaaaccauugacuuagagagauagcucagcuuuaucaaagguuaucaaaggaccagaguucagauccuagaucccagcacccauauuagguagcucauaucagcucuaggggaucuaaaacaaccucucgcauccuugggcucagacacacacacacacacacacacacacacacacacacacagaggcguauaaaccagucaugguggaacacuccucuaaucgcaucaaaauaauuucauauuugaggccaauuugggcuucauagcaaaaccauuuccaaaugaaaaagugcaugcaauagagaaauuuuugaaacaaugguuuucuugagcauaauuguauuauuuuuauuuuucagaucucuauugugccaaauuacuuuacauacucauuuaaaaauugcuuauaugccaaguguaauugguguugcauaccuauaaauccugcacuaaaaaaauggaaauaagaauuucaaauuugagccacuguaggcuacauagaagguucuaaucuagcuuggcuaugagaaucaaucuuuuuaaagaaaaguucauauuuagggaugaggugguagguagagcauucacuuaacguguaaggcccugagucuuaccuugccauguacaaccugccuauucauguuuuaaucuagcaguuuucuuuauagcaagcuauucuaugggaagaagucaaaauauguuaaauuauaacauuuagaacuugaugucuaacaauugaagaauaaguaaauuaucuaaggaauguuacuauuuaauagaacauacuuuaauagaaaaguuuauuuuuaauagaaguuuaaacuucuaguuuuaauagaaaaaaguuuauuauacaaaacagaaauaauuuaaauguuuauuagauauaguauuuguuguuuguuuguuuuuuagacaggaucucacuguauauagacuagacuggcuuugaagucacagagauccaagaucuggaugucucuuugccucccaggugcuaggauuaaaaguguuggccaccaugccuggccucuaggauuuuagccaaaauguuaaaugcauagcucugcaaugaaagaacauguguguaacugugccuucugucuugcucaccaggugagcucuaaacuccuacacagcaucagcaccuagguuacuuagugcuauaugauguuucauaauacuuuucauuuugcaauaggccugaacucuuucgauuaagaguccuugaguuaaaugcaucugaugaacguggaauacaaguaguccgagagaaagugaaaaauuuugcucaguuaacuguaucaggaagucguucagaguaaguaacuugccuuucccucuccauaauauaguucauuauauuugcuuuaaauauaggcugugguuuuaauuuggccuucugucaaguauuggaaauuuaauucccaaauucauaugugaaugguauuuagaggucaggcauuugggugggauaacuuguuuagaaguuaggaaagaaagcccuucugguaucucuaucagaugacagacccugcuuaccacaacagggcuuaugguuucuuucuuagugguuugacuagaaaauccucaacagauaagauuucacccucuugggcuuccuaauaucuagaaccgagaaauaaauuaacauuucuuuaaauuaccagucucagauuccauguuuaacacaaaccagaguaagacaaauuaugaguugacagugggaaucccgaguggggagggugggaaguggaagggaagcaauuuagcgucacugcucuucaugcagccaagcccugcaagguccuaaugcuacugcagucuggucuuccucagcaugugcccuugcuaugacagccaaauccugcugguucugcucucccugggauggguaguuaggggcguggccccucccucccuuuguugauacauugaaggcauuggugucagucagagccccauacagugauaucacgucaguaacagccuggcagcaugaagacugaaaagcauugaaaugccucuaguaguuuucugaauaucauuaaaugaaccuagacugacuaaaugaacaguagaagcccaaaacaaaauucagcuuuguuaaagaaacaugauauagggaauaaacugcagcacaaucaguguucagaaacuaacccacaaaacuggaauaaauguuuacaaaucaucuaucugggaaaggacuuuuucaauucagaauaugucaagaauuaaaacucaauaaaaauacaacuacaaaaagggcaaaugucauagauauuucucaaccacuaccauugcugaaauaacaaaaagcagaaaacaacaagcacuuguuaaggaaaaacacuguaaaugucacauugaugacuggaauauaaaauaggacagagucuuggaaagguuugucaguuccucugaagacuaagcagaacugggcuuaaaguaagauagccaacagugaaaaugcccgccucacagaccugcagccugaguccauuccguaagguggggagaaaaggugguucuuugaccucacaugaaugcuguacacacauuuccacuccuaguaugcacaccuaaaagaugaaaauuagguugccuaaauuauauauacaagauucauaauuguuccuaguagucaauacaccaaaacauaccaaacugguuaguggguaaauaaaacaugaaauaccugucuaucugcuuagcaguaaaaaauacacuaaaaagccagcuauggaccaugaacuuccagaacaagcaaagcuuaggagacaggaaguagacuugugauuggagcugggagucuugaagggacugcugauaaacagcugcuuuuugaggugaaaaaaguacacuagcccuugguaguggcuuuacaguucuggaauauuguauguucuuccucaccccauagucuauacuuucaguuacuuauggcuaacaguggucugagaacuuuagaggcaugcauuuuagauugcacaccagucuuugagcugcaguauuaaaggucuuccugaucgcaaagcacaauaauaauaauguuauaguuguuaaaucucauuguaguuucucacuaucauuuuauaaauuaaacaauauagauucagagggguaaguacuugucaugcaagccugagcaccugagauuguuauccagaacccgugcaaugguggggagagccaaccaacuccagaguuuauguguuaucuccacaugagugcuguggaaugcaugcacccagccauacacauaaccauaaguagaguucuaaaguaaacuauaguuauguaugaccaagaguuauggauuaccacauagugaaauauaaacuauauauuguaucucagcaaagauacuuacugagguuuaacuccuuuguuucugauuuagugggaagccauguccucccuuuaagauuguaauucuggaugaagcagauucgaugacuucagcugcucaggcagcuuuaaggcguaccauggaaaaagaaucaaaaacaaccagauucugccucaucuguaacuaugucagucgguauguauacacccugaagacaugcaaaacagccuuuuuaaaauggugcagaguauugcuauguaguuauggaacaccaguggacauaucuauacacuuauacauguauaauaaucagaucaaaguaacuucaucuuucaacuuggauuuguaaugagaacauccagaguccucuuucuaugcuuugaaauacaucaugguucuuucaaucuuuuucagaauaauugaaccccucacuucuagauguucaaaauuccgcuucaagccucugucagauaagauucaacaggagcgauuacuggauauugcugagaaggaaaaugucaaaauuggcaaugagguaauuacuaauuauuauggugguuaguuuuuuuuuuuuuuuaacgauuuauuauuauauaugaguacacuguaacugucuucagacacaccaggagagggagucauuaagucagaugucauuaaggaugguuguaagccaccaugugguugcugggauuugaacucaggaccuuuggaagagcagucagugcucuuaaccacugagccaucucuccagcccggugguuaguuuuauaccaaucccuuuuaugaauguacaucuuggggaggucuugaaaauaaugcuaaaaucuugauguuaagugaguaacaguugggggcuagagaagugguucugugguuaagagcacuggacuccuuccagagguccugaguucaauucccagcaaccacaugguggcucacaaccaucuguaauguugccggauucccucuucuggugucugaagacagcuacaauguacucauauacauaaaauaaaaaagggagcaacagugaagcacaagacuccacacaugcauuauugugaauucuauaaucaaguaugauuagguuagaggucuugcuccucacacuggguucugggaauuuaacuggaucauugugucugcccaauuuucuugcaaauucucucuucaggaaauagcguaucuuguuaagauaucagaaggagauuuacggaaagccaucacauuucuucagagugccacucgacuaacagguggaaaggaagucucugaagaugugaucacagacauugcuggggcaaguacaguaaacccuuuaggcuuuuacaguccuucaagcuagagagcuugcccugacuguuaaugcuuauuguuucagguaauaccagcugcaaccauugauggaauauucacugcaugucacaguggcucuuuugacaaacuagaagcugugguaaagguaauauacucuuacacuacugacuggguagucccagcacuuaacaaggcagaggccagggcaaucuguaacaaaaacuauucuggguaugacagaaaucauagauuagcaacauuccuaauccuaaacuuucuguugcagaaccucauagaugaaggacaugcagcuacucagcuugucaaucaacuucaugaugcaauuauagaaaaugaaaaucugucugauaaacacaaguccauuaucacagagaaacuugcuguaagcuguaagcauuauacuucaacaacaacaaacuuuuuuugguaugucuugguaauuuuuuuauuuccuuuuguaggaaguagacaagugcuuggcagauggugcagaugaacaccugcaguugaugagccuuugugcaacugugaugcagcagcuaacucagaacuguuagaggcuucaucucuccccuuuuguaugaaaccaguuacuauaaauaaauggccagaccaccuauauaaaguga

SEQ ID NO: 8185 - RNA, 44676 nt, Mus musculus
cuuuuuuuuuuuuuuuuuguaauaguaucaucuccaguccaagagagcaguuaaaaacuuguuuggaauuuuaaaaagucauuuuugaauauuuaugaagagaugacucauuaguuaagagcacuagucuaauagaggaccugaguucaguucccagcuuacaagaucaccugacuccaucucuagggaagcugaugcccucuucuggucucugaggucaccugcacucaugugcacaccuacacacccccuccuucacacagaauuaaaaauaaaauaauucuuuagaagauguuuugggcuggagagauggcucagugguaaagagcacugacuguucuuccagagguccugaguucaauucccagccaccacaugguggcucacaaccaucuguaauggggauccaaugcccucuucaggugugucugaagacagcgacaguguacucacauguaugaaauaaaucucacaaaaaagagagagagagauauuuugaagucagaucuguaguugucuucccaugcccaggcauggauaucaugccaagauugccuuucaggcaagaacuuggaaaacaucugugcaugacacuugcaaauacuggacuucuaagaauaagugagaacacuuacccaagcugccuugcauuaaaaugcugacuauguggcaguugcuguuaaacaauuagagauuuggccagaacaugugacuuaauaauggagacacagguuuuuuuuuucccucauucucccuaaggaccuagaguggauuuuagaauuaaugggugaaguguagcccauguauacacauaguaugucuacccuaacuauccuggcuauaccguagcuaaacuucuuuucuauuuuggaguuggcaggucgcugcuugcuguacuaugggcugguuccuucccauccguggcuacugaccuacucucaagagacuuugucaucuucuccuuaguccccgauaguccauuggcucaucugugccacucagcaagcagcagaagcccucuuuggugcccagagacauugcuguuuuauucuguuuucuuacuugggcuucuuguaauucccugguauaugagccucacccucgagcuuggccacacugaggaacaacaugggcagcacauguagaacacaguuuguugggucccagagcccagccuccuauuggacaacgugugcuacgggugcucaggguagaaagugcacuucccuaagugauaaccucuucuaggucuuugggagcauauguagugggguuggaaaaaaaugauuuaggaggaaacuuucaauugcuucccacauccuuugcggccaagguauuucucaagaacaccucagaaauacuguuugccaguggcuuguugugacuauuacaaagcaacaccucauuuauacucaccaguaaauggccugaaaugauuacugugaaggacaggaccuaagacaccgagggacugucuaagucuauuaagaaugcagcaacaagggggggguggguaugggggaccuuugggauagcauugaaaauguaaacgaggaaaauaccuaauaauaauaauaauaauaauaauaauaauaauaauaauaauaauaauaaagaaugcagcaacaaaaccaccacaaguuaggugauuuaaagcacuuggaaauauauucuucaucauucugaagucuaguaggcccaaggucuaggugacaucagcuuuggcaacuggugaggacagacaucuugucuguagcuggugccuuuuagcuucucuuaaugagguagaaggacaugccugugucuccuugguaaguggucucauucaagauaauguugcccucaugacuauuugccucuccaagaucucaucuccuaaugcuauccauugagugcagguugagauuucagcauaggaauggaggguacauucagauagugggagcagaaguuauggaauguggacuucuaaggaaagcaaccagcacgauaaccuauauuccuauagccugcagcucuauagcccccaaccagcaugaugaacuacauuccuauagccugcaucucuauagcccccgaccagcaugaugaacuacauuccuauagccugacaaucuauaguccccgaccagcaugaugaacuauauuccuguagccugcagcucuauaguccugagauauaguucaacauuuugucucucauugcaggucagaaggccuuacugaugaaagagccacuuuggaaagcuaccagauggugaugccccugcaguuuuucugggaauaucccuacaugucuauuuaucuguucuagaccccccccccccccagggcuucuuuuuagguuugccacaguguguggguauuaucaauguggcaaguucaaaacccagagugaaccccuucccuuucccccccauugacugguuagaguucuagaaaauagaacuuaagaguagaugcuguaucccauuuuaaaagagucucuuuccuauuguaugguucuuaguucuuaaauugaguggaaacaagagggagguugaaagaaaggauugaggcuuucaaugaacgugagggauacugagauuucucaagggccugggugacuuaauuuccucauccacaaguggguuuaacaccuuacuguguauaacacugaaaccagcacugugucuuuggugauucuugucuagaugccuuuucuucauuuccugugucagcgucacaguucaggugcuuaagcgaucuccacugucugucagcucccaagucagucugagauucucacuuaaaguccucgcuccuguuuccaucuucaagaaccgcgaccgaagaaucuaccuaaagcacaaggaugcacugugagccaugcauuaaaaucguuuaauggccucuuaauguagaacaaaaucuucgacuuucaguuagcacccuuucagaaacagucacccggggucugcuuucauuggcucacagcagagugcacuauuaugagcaugcucaguaggcuagacucuacguuacuugcuccacauaaaucauuucguguaaacaugauccuuagugcugucuucuagcucuccauguugcagaagaggaaagaauggcccagaaagacuguggaacucacccaagaacaaauagcuucuuggccacagaacugaauucacugucuggcacuuucugauuugggucucuggcuccagagcagcugggggagggugagcagcuaggggcucagaaucaaaggauggaggaagacaaucugaaagacaggugcuggggaggaggcggcaaucuuuucuuucccagguugguggugggaagcggcuaucuggacuugaagagaacgcucugguccuggcuccagcaaucuuacuguagaggcuauuuugcuacacagaaaacccagaccagcaauuuucugcguucuuggagcucuauuugauuccucucccagcucagagguggauauuugggaugugauuacugccucagaguagucaaaucucuucucuaggauagaaaggaccgaaggagcggccagaugguggcuuccaguucucuuacagaggaaaguuuucagucuuucggaaguggucuguggguaaucagagauggucagacugccagacugcuucuucaacaagauguuuccuccugacuucuccagcagccguauccuaagcccaguggaaggaaggugcccggcugucuuuaccuuuguaaccggguccugccugccugcguaccuacugugagaguuccaggucgcaggacuccagaacaucuaaaaaaaaaaaaaaaaaaguuugacaaggcuguguacaggauacacuuaauguugggggauuuuuguuaaacucuaaauacuacagucuaagauguauguguccuacauaaaaauuugaguuuucacagggguuaaaugacuuguuugaucaggaucacccugugcagagccaggacaagcacucugguaagaacguuuucgccagauaacacugaauccaauccaucgggacacgcaggggguggggguggaggcagcauuugggcuuccuugccugccgcauugcuccgccccaaaggcuugcucuuuguggacagacugcaagauucccugcauuacggggagcccuaagcaggcaccuuuaaccuugagccugcucgcuagcgaccuccagagggccaggaugguuugggaccggugugauagagcacuuuucuaguuuuaacgacucuauuugcauaacggagaccaagcguccucccgccggucugccgugcuuuucuucccuccuucccgguccucuguacccucaucugugcucccucucugcuucccagaagauccguucucaaggggacucacucggagcuugagucccgggcucuucucccucggcccggcaagauccagaggcaccugggggaguggaguugagcgccagccuggguuggggagccgcccuggcacugcccgacccuaacaaagggaaucggacugcgcgccgugcgagcgcucggugggcucagcgaccgcagccgccuucccgauugagagagcugcaagugaguaggggcgaggcgggcggcacgggucugaagaaggagugcaggggugcgcugagaggcagcccuagcugcgggaguaggagccgccgccccgggcuggggaugucugucgcggguccaggggagggaccgccuuggccuccccucccuaaucccccacccccacccccaccccccggcacgccagccugcgcacccauaacaaacccacgugugcggggacgcaggaaccuacacugcagcgucuguauuguguaaggcguugacucgcggagugagggucucuuuagaucuugcccacuuugguaacagagcaggaaaacaagcccgguggaaggagagggggagcgcaggcaccacaacaaacgcacgugugccccggcugaaccucuuuuggucagguuauuguuccagccaaaccaacgggugcggcgcuuggaggccaccuacuacugcuggagagguggggaccuuucgcagcggugcucugugaagggacggacuaaaccuguugauuuuuaaaggaaaaagaaaauacaaacaagaaagagccgacaaaaagcccccaccccacccacacguaugcuucacccauuggcacggguuuggaggugaaaccuacaagcccucaucucuucuucgagauuuucuuaagagucgugggcugaacuaaggaucuguaggguacccuucuaaaauagacccugcccgacacaccauuguccccgugcacuggcgacugccccuguuggggaaucucgagcgccucccuagcuugcugaaagaauaguucauuuuaacaaaauccaccagugaggucuuggguuuugcuugcucuucgccugggagcucccuguggcuagacauuucaggugucacuggcccuggccacacaaggccaacgggggccccucgucuagacggggacguaucggaggcucgcagagguagguccacuguuugcugugcuuuccccuuaacuuucacucugcucacgcagccggauuuuuagcguauugaggucugggcuugucagcucugaggaaaaguugaggacaggaagggggcggugaacggauccuaggcgaccugugcaggagugacagcauuuuaccaaucugaugcugcaccucgaguagucccuguggagacuaaccugucucugaagacaacuggacagccuucaaccguguaccuuuguuauugaaaaaauccaggcgacagcuagggaaccuuuuuaauuuuacaggcaggaagcugaggucugagaguucagccccuugggucuuccaacugcucggccuucauccagaggauucugcggucggcuuaaaaggcaguagccucaggcagggcggagugaaacaaagaaaauaauucaaauuggaaacugcgcccuuccauuauaccuuucuagaguucucuguuuuaguggagaagagggacuuagcauuucccccacuucucagccugucccgcuucauaacuuugcucugcucuccuggcugcccucuuguucucaaauugaacuagggccaacuggagaggcuuagauguuuugcgggcgcuaagaagccuuuguucgggcagaagcuggggcuguugacaucagccccgcugggaggagagugucucuuguagucagcugcuucugagccccucaguacagaacgaagcauucuuuucauugauuuuauuuaauuaauuuaucuauuauguaugauucccguggaagugacugugccuuuuguguuuagcagagaagcaggcagaggacagugagauuaguuucucuaaagcuagcuaguuugugcuuggaggcuuuucucuccaucuucgcuccgccuagguguguuuccuuccuccuagucguguuuacuuuccccuucauuuccaggcuguuuagcuuuguaauggcaacguuaaaaaaaaaaaaaaucacagcucucaauuuacaggaauaggagagaauuuauucuggagccacuucgggugacccuggccugggaacacagauuuagaugaucucaaauucuauguugcaauguggaagcagcuucuuggaguguuuaguuuuacugggcggagaaaguugugaauucaggaaaguuuaaaauacauuggcagguacaucagagaggcagguaccuaggaauuugggaagcuuuucuauaacaucaaaauucuaucuggugggauucuuggcuuuuagacugguagaaguuaguuuccugcaaaauuaauagauucuaaaaggcuuuuuauauguugccaaaagaugcuaguuucaacacagggaguguguguguguggggggggggguaagguggggggcgggguggggguaagggcaggggcaggccaaggauggauuggagugauggagugagauggaggugggggaugguccaggaaaccccuguuuuggaggacuagaacuuagcccuagauaaaguaauuagccucuggaccugcagaauuccagucuccgaagugcuguaauucuuaucugaagaccaaucucggcagacagggauuacuuucuggaguuucuauucccagccaggugagguugucuccucaggaugguaaugaaguugaggcuccuuuuuuuuuuuuuuaaacguaggaaaaugaaggaccugagaagagaaaugaccugcuccaaacacacagaaacacacaguccaccugcuuuuaguguccccuuuuugcgucaaagggaagguguugcaucaaacaaguugucgguaccccagaguaaagucaaaguuagguugcuauaacaacacccuugcauccuagaggauguaaacaggcuuggcuuucaagcagaggagugggugccgagggcagguacgguguggaguacugcauuuaggaugagaaucgcuuuuccuugguuugccaagugcuucauuucccucuugcccugggaagaugcuuugcaaauauuugcaaagcaaaggacaguaagaccacagagacuccacucagcuagucauuguaguuaaccucugggguccuauuuuuuuuucuuuucuuuuuuuuuuuuuuuugcccaaugaaccugccaguccgugcccuggcucuccuaggaaguagaugcugcucggagccuuaguguguggcauuccugaaugagaagaacuugauuagggaaacuugauuguuuuuucuugcuucucugcaugcguucucaaacuucagggaaauguguuuuagugaucccccaaaacacagauaggagccgaucugaugcaacgcacagcaggaucuuuuauucuauuugaguuaucaagcuagcucauccccccuccccacugcaauggugggggaaguccccgaaugucuaugggggcaaggcuuuauaguaagcagcaagcagugguaagugugcaagcaucuaacuggaaagcuccuguggccuuuaacauaauuggcuggugcugggagucacaucauaaacuuaacuucuguuccccuccucauuguuugucguuaggcaggggguugggcuuguaaccuggggugcauuuuuguugggggaauaaccaagagacacaggucuuguugaggguguaaccuggaaacucuggucuuguuggggauuaggguuaggguuagagacugcagcuaggcucagcuuuuguuggggggcaacuuggaaacuaaugcuagauacuagccuguuagucuaccugaguucaaacuugggucaaguucucuaaaauggagucucaauguaaaagcuuuggcaugucaauagcacgcugacucccauagcugugaucuauagaacuugcaacacuaacauauuauugcaauguuacuguguuguauuaacauacuagagaugauccuacuaaguaauuacugaaaagguuaugucagacuucauaaucaaaguuuuccgguuauacgaaugagacuuucccauugcagagcauucacaaaauucaaaaaaggaucgagaaacagaaauaaaaaauccccaaacagccuugcacuaucugguaauuugguuucuggauuuuguuuuuaaaaaaaaagaaaaaaauauauguauauguauauauguauguuuuuuuuguuuuuaaaauaauauauaauaauauauuugcuugugugcaugcauucucaaauuucauauucccuuagcuguguuucuauagacucacuugcaacacuaauauauuauauagcauauacauaauauuacauuauuaaauauaauuauauaaacacaacauaauugaccauaugcaauauauaauauauaaauauauaauaauauaguguauaaauacauauaaauuuaauauacaaauauacacuuaucucuauggcuuuguuuuucuuuucaaaauaauugagaaucauuguauguauaauuacagcuuucguauuucacacuuuauaauaagguuuuggugaugagcacaucagcugccuaucaccuucaaguguccguguccccuugggaucugaccccuuuaaugcuuguuucagugagggcaugugaaugguugagccccugcuucucuccgccuucaaaucguagccaguuuuucuuugagaaaugcagaggugaugacagauacaguagagggaggagaagccugugcacgcauggccuuugagcuauggaucaugauuuuguggccccuaaaaacucaauaguaaaguuucuguaaaugcucacugagcaaccuuaccuuagggucauuuauuaauucacuggcacagugaguaaaagccuuguagucuaaaggagggaaccugggugacaagagagaagugucagaugcuauugaucacagaggcgacaagcucucaugucuggagcaguggaggccacucugggagguugugcguacauguuucaguugauaccaugauuuacuuucuugaauuuccacaggauggagccugaugucagcuguugagcaaacuuagauuugcucuaauuacauaggaagucuucaagugaaagagcauuagaaacguagaacccaagcaguucagaauguaaauucuuggcuuuccauucacugcccauggagggauggacaagcuacuuguugagguucaggaaucaccccacaaaccauagcaacaccgaucuccgcuuagcaagaguccuucuuaaccacacacccgagacugaacuuucagggccgcaaaaagggcucuggagccuaauugaggcaccaaucuguccucaaggcagacuuuuuuaaaggaaaaaccagguucacaaguuuaaaggaaggcagugaaguggcacagcauuuuuugcuaauuagacaaaguauucucagcuaucuuuugagcugauuguuccuaggugaaauaagaggagccguacagauugugaacugggggguuugguacuuugagauaauagaguacaaguguugcaaccguaaccuuuuguguuauuuguaacccaaccauucuugaggaucugcuauggauaauuacuucugggaaguggagucugagaccgcgaacuuaacuucaccuuaugagcaaaauggagacugaauacaaaauggcuacaguuauguuaaaaggagcaggauucacuaguacuuaguaucaauuagcauucucugugagagcagaauagccggccuaacuccacagggccguuguaagaugauauugaagguaaaaggccaguuccugguuaagcccucaauaagugcuagcuauuaucauuaauagacguuguggcccucaugguuuuuuuuuuuuuuuuuuuuaaccaugaaagcaggguauggcuuuuuguucuuagggaagguuaguuaaaauggaggcucuugucauccaaauagcaaguuaagagagauauaaucucuugcacaaugagauuuucauuuuguuuauuaugaaaaacuucaaacgcauaucaaaagugcacagugaguucuguaccucucauccacuccuuaugaaaaugcauggcuggccuauaacccugccucaacccuaugcuaacuuuaaagcaugacccagacgucuuaucagccuagccauaaauauuucacucagcucaaugaugcauauuuaaggcacugaguugcguuggcuuggggccugucucuugucucgcccuuauggaacccuucaaguuuguggggagcgggccaaagagggagggcacagcaguccugggaacuuuuucagcuuuacuggucaaauacagaggucaugccaugucccaaagagacaaagagaguguaaggaacacagaaguugaaguuagagucaggagaccugauuugagcaagagccaccucuugcuaguugucugcuuuuggcaagugacauggauuuuuuuucaagcacguuuacagaaaaaggugaccacugauuaaaguauuuaagguggccaguguugggccucccauucuuacgcccaguuuuccuuccucauaggcauuguuucauaggggccgagggagggcccuuaggcugagggcccaugcucaccacccugucagaugcaguagucaaauuaagccccaguuuacugggacucccgucauuucuaagccuagccagugauguguggucccugaggcguggcacccuggguaugccaugccaggagcucaacuguugcuccucuccuguccccucucugcucugauagcaaauaaaaguuguauguaagucuaagaggcuuccucaugagaauaauaaaggaacuuccuuuauaguauucagauaauaaaaaaauucaccuucuuccuauaugcuguuccucccacagucugucuguuugccugcaggccuggagagcaaacccugggcaugugcacccuaggccacuaagccacacacucagcccuuccuuccacuucuccaaagugauucccuuuuauagauggagguagacucuuucagccccuucugccaaguagucaugcuccuauacaauuuguuuguuuuuucuuucuuucuuucuuucuuucuuucuuucuuucuuucguucuuucuuucuuucuuucuuucuuucuuucuuucuuucuuucuuucuuucuuucuuucuuucuuucuuucuugaaaugggaucucacuguguggcccuaacuggccugcgacuuaagcuggcuuugaacucacagagauccaccugccucuccaguucugggaucaaaggaaugugucaccuugccuggcucaaagguacuuuauaaacucaguuuauggauuucgucaugucugccacuuuacaaauggggucuuuuuaguuugcuguacgaaauagaagucucccuagcagccugcguuugauauauuuuugcacagcuacaccaccgucuauauucugaguacauauuuacuuagcugaucuuugccugcaagauacauuugucuguuuucauaaaauauauuuugaguguuugcacuuugcauauauauggaagucaguuaugaaugucggugagcgacaggaagccagcucuggggaggagggggguaagugugcgagaccagggacacugagaaccagaucuggaaaacuggacuugguagcugcccagcuccaccaccaagagacuguauuuggaugaaaagauauuuuuggaacuagccugaccugguugggugcccucagcugcaagugaaaacacugaggagugacgucgucagcuucucccccaucccauggagccuuccaaggcugauucgauucucagggucaggcuuggagauauuguggggaggacauggagacgaaaggcagcagugggagggugugauggggaagugagaaaaggugauguuuguucucaggcucugcuggaggaggguuucuacuccaucuugguuuagaucccuuugaagguugugcuucccugaguccugcucacagaggugggcuacuggaagauggggcuuaggacacauuggcaaggaaaauagauguggaaaugggagcuuucuuuccauauuucauuuucuuuucuccuuuccuuuccuuuccuuuccuuuccuuuccuuuccuuuccuuuccuucccuucccuucccuucccuucccuucccuucccuucccuucccuucccuucccuucccuucccuucccuucccuucccuucccuucccuucccuucccuucccuucuuucuuucuuuuuguuuuuauuuuuuguuuuguuuugagacaggguuucucugugucgcccuggcgguccuggaacucacucuguagaccaagccgaccucagacucagauacccgccugccucugccuccugaggcuuucuguuccgcaggaauucaaaauaagaagccucucuccuggagagucacacugagugugacucuuguggaaaagagaagcacucugaggaacgggugggcuggguguggugagcggugaagaaagcagaacugcccagugugggagugagcuauguggaaagccagagcacucccugucagggagagucuccagaacccggcggaaacagaggacucugggaagucugcauaggaagaggcaaaaggcacgggacggacgauaugggaccaauggaggacagaagagccaguuuccacuuacuuggcaaacauggaauagaauggaagcguucaaggaggccugacuguacuuuccucuggaucuuggcagcccuccgcuguucugucauugaacagcucagccugaccuuauauucauaaguuauguugacguaaauaaauauaccauauaugcuuuagaugaccaggaaaccuggccacugggagagaaugaugugucccaggagggugaccauggaauucuuuuccuuagaguuggcuucugucuccuggucuguagagcacaguguuucugauguuacuacuacuauuuuuuuucuuuucuuuuuuuuuuuuuuuuuuuucacugcaagacugaugcucuguacaugcaaggcaaguacucuaccagcuaggcuauaaacccagccccucauccaacuuaaacuuuguagcaaucaacccccugcuugauuagcccucugggcuagaacagagagcaccuaccaugccauuuuguauaagccucggauuagcuugaugagggaaacaagacauagguuuuacuguguucuugguucucauuaggcacuguguguguguguguguguguguguguguguucacccaauccugacagcaagcugggauccugacauuaguagcucccuuuugcaggugagaggaaaaucgagguucagcacgggccagaggcuugcccacaguccugcugcuguugggaguacaguucagaguggggauagaucucuaucucuucuucuacacgcucccgcaggugccuucacugccaguaucucccacuccuuugggucugagaaaugcuuaguuuugucuguggggagccucaucgaacaguuucuucucacugggcuggagggagcuucucacaguuccucugagacaaaugaaagaacugaugggccgugagguggguauagugugacuuuugcaucaugcaugugacuguccauuucucuuuuugguaggacucauuuugagucaugcuugguuucuccuuuucucccauuuacacuuuaaagcugugagauccacuuacaaucacuaccugguuaggagcaggguugaagacacccauugauuagcauggccugggauuuggugaccuauuagcuugcuaccuucaguguuuugaaacguguaaguggaacucaauguugguauucuuagggacuuaucuuacagaugugcugcuuaaacgacuucuucuuuuagagaauauagucaacaauaauuuguucuuuaaauauuuauugaguaccuguuaucuguuugacaagagacuaccuucuuaaagacuauaccagaaacacacacacagacacacacacacagacacacacacacacacacacacacagacacacacacacacacacacacacacacacacacacagagagagagagagagagagagagagagagagagagagagagagagauuaacuaguagggcuuuggaagcgagugacugacaaacuucccauaccccccuguuccucucuucucaggauccuuaacuuuguucauucauucaauaaaucucgaguucccgcugcaugccaugcacagcgcuugcuuuaggauguagacaaauaagcucuuucuuuucuuccauccagaacuugcucagagguacacaugacugaaugguuacaaguuaauugaugcaugugaugauucaagugugucagccuagggagaaagguuucgaaauguucucugaaagaggaaacagcucagcuagguguccgaagguagcaggguuacccuuuugacaggagggugagaaagggcuauauauacaacagagggucaagggugagggucagcaugcugauguguugagguugauccugaggaggaacaucagagucgggaaguggugagagacgaggcuagguacuugugugcgcaggacagucuuuccucauucccucuguaccaugcacuauuauuaccuguuuuugugggcgaggaaacaaaagcggaggcagucuggugacuuguucaaaggcagaucauucggugagcugaggugcuugggcaucuugcucuccagucaggcauuuggccuucacuccagggccugcaggggcaagcugaagucugguuuuugcuggccaagauaaccuuccuugucuuucagucuuuccaggggagcaucccuggucaaaucuuuguuuauccaccugccucucagcauuaguccccuuugcuacaccaaggccggcugccugaugucccccucuccuguggcuugguuuugucuucuauuuauucagccaaccaguagacuagaaaugucaaaagaaaccuuuaugugugacaaaaaggaugaugaagggcuuuuuuuucuuaaaacauuucagauuccuaugggaguuuaggcauuaccugggacacaucugggauuggcaugggcauuguggggggucuggagggguggagcaagggucuguggcuggacuggacugguaggaaggauuugggaaggaacggaauucacuuacaaacaaaacuguucugucuuacccaaccauaaaugagcucuugggcuguugucuucaucucccagaguaauuucugguuuggagcuggucuuugguuagguguagcauagauacucaaaguaaaguuuauugaaaauuauuaaauugagaacucaaagacagaucauugaaauuacgggcugaaauaaaaccauagaauuacaaaaaaaauaaaauaaaaacaaaaacaacaacaacaacaacaacaacaacaaaaacaacugaggagaacacaaacgauguucuuagagaaaauuaauagauaaccugcaaguaucauggcagcuuaguggaggacacucucccagaguaagugaagcucuggguucagcccccagcaacguacacaccuugguaggggaacuggauguagccauuaaacaccaagaugguggcagcguaggggagccuaaggaaaauccauagcaugugcugaggacaacagaaauagaccugaagucucaagguuguaccaaggggguccuuuagaaugaccauagggggauuucuaagaauucuauuuaaaaaaucuuuauugcaugggaguuguauaaggucacugucauguaaauauauaaugugcucugaucacacuuccuuccaaucccuauggucaaccaucagggaacccuuaagaggcacacgucauucuugucauugcccaaaacuuggucccauaccacagcuggcugcagaggucuccagauggggguugucugaucuggaaguuggcgccagagaaggcuuuucaguacugacaguuaugaggguaaaauugacugaaugcuaaaccagacaggacagccugggagaucacagcucuaaaaacaaacccagaacagaacaacuugcuuaggcuuaucuaaauggcaucauugacccaugagugggcagagggcagaucaggugagagacucagaugagcaggacauugucuuuucauggguuuuggggacgcaaucguguagacaaccuccaggcaaaagaaagcacacuguagaucacaagacucauaagcugcugcgcgguggagggaggccucuuggaggagacuguuuggccugggugcugaaggugaguucugcgguuugauuugagaaaagggagucgugagaauacugaggaggagugaaguguguggccugcagggccauugugagugacuuguggccggagagcaagggcgaaugcaugcacagcugcucuugaccguguagccucggcaugcuagcaagcacacaccaguuuggauaaacugaacguuuggcccugguguauaaacugaagccaugaucucucugaggcaggguuggggaaaagcuuuaucguagauaugaggcaucuggaagaggcgaauacagaaugagagagagagagagagagagagagggagagagagagagagagagagagauagagagagagaauagauugaacauagccaccagacuggaccuggccaugagaggagagagagaaggauggggagagcgagagaggagagagagugugggcagaggagaccaagagaggaugccuagagaggaagacaagagagcaaguagccaaaaauaguaggguucuauaggaaugagaagcugggggaggggagcccaggagcuggagaaguuuaggcuagggggaggggugaaggagccuggaggccucuguaugcuuugauaggcuaauaggcccaccgauaaccuucuauccuccuugauagugacaagaaauuggcugcuuugauaggggaaaugggugccagaauuuugggggauggaguuuucuuuggcccugacagcagccccauguaacacaguuguuuuuccugcacugaugaaggcacgguauucaaagugguuuaccuaaaguaauucaguguaaaguugugccuuaaacccugugggcucucugaauuccaaagccugugguuuccucuugugcuaugacuugugggccauagggacaccugauuagcuaccuuacugaaacaaacuuuacaaaaggcaaaugugagauaugcuuuucacagauugcaauuuuuuuaagcaugaaauaguuuauuuagggcauggggaagggaguugagaggguaguagggacagagaaagugagggagggggcggggaagaaggagaggguaagaggagaagagaugggaggggaggggaggggaggcuggccauaaacacauggaggggguggggggagaaggggugaugagggaagagggcaagagaguaagggagcaagagccacaggcagcauuuuaucaaugagcuuccuauacauguacuuacauacuucuauuuaccugucaaagaaacuauacuuuagcuuauggugucuuaguuacuguuacacuacugugaagagacaucaugaccauggcaaacucuucuaaagaaagcauuugauugguggcuugcuuacaguuuuaaagaguuagucccugauugucacagugggaagcagacagguauggcacuggugccuuagcuaagaguuuucuauucugguucacaggcaucaggagagagacagagacagagacagagagacagacacagagagacaaagacagaaacacagacagagagacagacacagacagacuagaccuggcauggucucuugaaaccucaaagcccacccccagugacacaccuucuccaacaaggccauagccccuaauccuucccaaacaauucuauucccuuuaaauguaagcauuuaaauuaugagauauggagaccuuucuugucugaaucaccucagguuguaaauuuuguagcuaaaguuuuagauuugacaacaaucuauuguccagacucucuaguaucucgcugcuauaugaucccagcauacguaaugacacccuaauuuccuucucauuaaaagguuuuuuguuuuguuuuuuuguuuuuuguuuuuguuuuuuuuuuuuuuguuuuuuguuuuuuguuuuguuuuuuuuuuuuuuuuuuuugagacaggguuucucuugaguucuguccuggaacucacuuuguaaaccaggcuggccucaaacucagaaauccgccugccucccaagugcugggauuaaaggcaugcgccaccaccgcccagcgugucaugaguuuuuaaaguuuaaauuaggcuacagauauuacaggaugcauaaagauagaagagccacauagaggguuugcuacuguggacacaggcuuugccuucccgaagguguacaacggcugaagcacccacagguaggugucugagugcuccuagccacagacugggucccugaaguguugaaauaagugacuuggucaagaggcacaacacucugcauccugauucagauaagcagcccuggcuuucagugggaggcggcagagagggcuuggcaggcaccuguguugccuggccuggugagggagucuuucuccugucuuccagcuugcuggggaaugccugggcuagggaguuggucuggauggcugucaacagcucagcgaggguggaggaggguguccagacguguguacuacaaggaggaaugugagaacugccaggcaagcaguuccccuuccauaucugggaaaggcugguggucgggaaagagacaggcaggauaggguuggcaggaugugugguagcagucuucauucuguauggguaccuaugaggacaaacuauauucaggaggaagggcaucuagcucucaggcuguuuuaauguggccuggaguaucuuccuucuacuuuaggaagaauagagagggcccuggcauggccuggaggcucaaaagccuuagcauaggggaaugugugcccacauguguaggcauggccacacuacuguaaauaccuagugcaccccguaguguugaagggcuccaccugucugaauccaccgaucuuucagcuuaugagagccaggccuaugucaccaugcucagugguagacagccuuagccuugcccaaaugaggcccugaagcugacagagaaaagaggauuucuuucaucucuugaaccguaguuauuuguuagaaugcgguuucuuggaugguuaguauugugcacagcuucaagcccagcacaugacugagcacuggggcgucuccuggaaugagcucagcaacccugguggucauaggccacgcuuggccucgacacaugcacagcagcccugcaggggaggccgggagagcagguagagggagccguagccgucuggggcaagcaccaccuugcagcugugcucggcucaugaaagaguccuuuuuuccuaccugucaauuacgaccuucggagggagagucaagcagaaauggaagaggaagugugguguggcucuccaugugaacuaugcuggggagccaggcuuggagccuugcuugucugagccccuugggaaccaaguauaucagaguuuguuccagaugggagagggaaggaggcagccugccagcucugacaaaugcugcuugcuguagggcuggaggcugcuggcccagggccugagcuggaggaggcuaaugauagugugaggaaucaaucaaucccccagaugagggaggcuuccugcuagaggcauguggcugcuuuucuuuucaucuucacaaugaaugucuuauucugggcuguccauuugggaaagggagggagcaggcaaagaggagcccugcagccucgcccagggcagcacuccugcauuggaagcgucuguccguccgcccuacccaugccuucagggaccgucuuggugacucaacaggaugaggcugagcaguuugcugcuacccagucaccuuuacagucucccuuccucaggaagcccuuagcuuuugggggaaagucacaugcuuuccagcuagguggacuuggguuuaaauucuagauguguuguuuguuguuaacucuuugaacuuggagacugaacuucucagaugcucauuuugcguccuagucugcaguaauucuuccaacaucauagcauugacaugcaugcuucaaguagagcuggacacaugacugugaucaacaaauagcuguuucaaagaccacaacucaguauccagaaucuacaaaguacugcagagagaggggugguggugguggcagagacagacacacgagagguggggggcagagacccaggagacaacugccaaucuacaauaggcugaagaaaaaggaacagguagaucucaaaagaagaaacacaaauggucagcaaauguuuuaaaaaguguucaacaucccuagucaucaggggaaugauuugagauacuuacugucacauccuagucagaauggcugucaucaauauaucugauuacaaauguuggagaggauguaggggaagagaaaccauuauccauugcugugcgaguccaaauuauacagccauggugcaaauaaauggagacuccacaaauaaauaaauuuuaaaaaauugccguaaauauuuaaaaagaaccgccaaguuccuacgcuccauccaacuacucucugcccaccaacucucuggcagggccggagcucccgaguucccuucgcugccauaccagccccaugcaacgaccgucuaccccucagccagcgaccacaacacccagcaaccugguagaaacaaaacucuagaaguuuauaauuaagucagauuuauauaucaauaaauucucaauucacaagaugcccacacaauaauuucagagccaaucaauaaugauauaagcugcccaccuagaucagacaaguuaucccaauuauuccauuccuauaugauauucauaacuaccuguggcuauuuaaaaccaugugagaucaggaucuucuuccugucuguccgccuccaucuuggcuucuuuucucuccucucugagucguucucugacccugcaacucuucacucugcuucccuuuucccuguccaaucacaggccuccugcugccccaccauuguccuccugggcaaugagacucuaugcccuaccacagagauacuugaaccuccaucuguguucauugcugcucuuuuuuacaguagcaaggaaacagaaucaacuuagauggcauucaacagaugaauggauuaugaaaauguggaacuuucacagagcgggauacuauacagcugugaaggaaaaaagaaagaaagaaagaaagaaagaaagaaagaaagaaagaaagaaagaaagaaaguaaguugcaggaaaauggaagguccagaaaaguauaauguugagugaggugacuuuaccucggaaaggcaacaagccacaugucuguccucauauucggcuucuguccuguagucuauaugugcccuaggucaaugggugugagugggggcaaacuuuagaaaggaggccacguaaggaaggacagaguguaggcagaagggccagagucagggaagagaguauuaaagcuguuacuuucuaguuucaacgucaucauaguguuuucuuuucuuucauucuguagggaguggguauguggauucaauuuuccuguuuccaaguagcaacaaucauguuugcauuccagaagaguccagcauguguucuuccuuugaggcagugcuuguggaagcugggccuucuuuuuaauuccauugaccacucgagcaauagaaguggacaugacuagugccuuaguuaggguugcugagaagagacaccaugaccaagucaucucuuguaaaggacaacauuuaauuagggcuggcuuacaguugcagacggucaguccauuaucaucaugguagggagcauggcagugucugcuagaggagcugagaguucuauaucuugaucugaaggcagccaggaguggaccugagcauaggagaccccaaagccugccuacacagugacacaccuccuccaacaaggccacaccuccuaaugguggcacucauuccccaugagccaagcauuugagcacaugagucugugggggccauuccuagugcagcuaccacgaugaguuuggaagauuugucaugucagcccacuuagaaagugugauccuuucguuuagauuuauuuacucuaguucaugguuaugaauguuuugcuugcaugugugucugugcaucacaugcacgccugguacccaaggaagucagaagaugacaucugauuuccuggaauuggagugauggcugcuugugagcugccauguaggagucagacacagguccucugcaugagcgagugcucagaacugcugagccaccuccccgacccugaaaaagugauugaaauaauguuuuggggagagcgacuuuguaaccugauacuaucccuuuuuucuucccuuucuuucuuuuauaacuguaucuacuuaacuauaucaaaucauuuauuccauuauuuaacuuguaaaucacauuucuuuacauaaaguguggcuuuaacuacaaaauucaaggcggcaucucuuuucaaugguuauucucaguuguugcucacccaguggaccagauucugcuaggcacugcacagacaaaggcaggagaaacaauuucuggaggagcugucagucugugaggagagagggccguguguaguggagcauaagagauggaccaguugcggagggaggagggagaaugacaaggccagagaagagauaggaaacucucccuccaaaaagaguuuuccagacauuuaagguaggaaucaggaggaaauagugggaccagauaugauggucacuguuggaauuuggcccuagacaucaugagguaguggcuuccuugacaagcaacccuuuagggcaucuacuccugcuggcauuugaguccaccuagguugcguuaggacaaggucuacagccucuucccagcugguggaucaacacuggcaggaaugccgccaagguugauuauaggagaacauuaugggcuacuugucagcucaggguucaggucagaggggggcuuuccaaaggagugggggccuggggauucaucauuagacaagaucuacagaugcagagcuuccagaggcagagcaggauucagguagugugggcaggaggagcuucacaauccaggagggagagagagagagagagagagagagagagagagagagagagagagagagagagagagagagagagagagagagagagaaagugggcaagagugaugucugcuguuguuggaaaguucagggacaucgcaggcugcauuuaaugucaagaagaacugggggauucaaggucucaguaaucuacuaacaauuuggcgcacgcccuggggcgggcauuugaugaguuauuugagacagaaacauaagaucuacaaggcuguuacgggucauuuagcugaugaggagaagagcaaauguagggcaucuucaguugcugggcuccacucccugcccaggcagaguacagggcuuuguguuucucuaauucgguccaauuaaauccagucugcaccaugccugccucacaaaggaaauaaaggcgagacauggugacucaccuccauccugcuggucucccuagcucagaugccaucuccuugguccuguguccuaccucuggcuucuguuaguauaucucaauguagucucgauucugcccuaagcuaaugaaauugaagucucuguagggugguucugggcacuagccuuuucuuaaaacucggcaguuguuccccaggcagucguggacaggaaccauuguucugcugucugcucucuucuuuaugcucucuucuuucucuucagaaggcucacaucaccuucuugauagcuaggguucucugucucucugucucugucugccugucucucucucugagacaggguuucucuguguagccuuggcuguccuggaacucgcucauguagaucacguuguccuggaacuacuucugucucccaagugcugguauuaaaagcaugcacugaaaccacacggccuaggguuuacugucuuacucuuaccuagcaaccuugcuucacauuugccugaagagaagcauuggugucaugugucuuagucaguucaggucacuguaacaagcagugucaacugagguugagaaagccacgauuaagauauugagaaaaucacuuccuaguucccagcugguauacguaagagcugcuggcucacucggguuucuucuacaagaacacuaacaccaucagugacgagccuuucagacuucaucagcuccagcuucuaaggccauuguacugcauguuaggaauucaacuuaggagcuuuuggagacaccgauaaugagaccuuaaugcaucuccaucaccagagcuguguccgcgugguccucauuccuucccauuaccauggaugcugcugugucuuagucaccguucuauugcucuuaagagcaacacugugaccuuggcaacuauaaaaagaaagcauuuagaguuaggagcuugcucauaguuucagauuuuaagccuuacaucaugucagggagcacgguggcaggcaaguauguuggagaaguguguaagcuacauucugaccuguaggccaagagagaaaagacccugggccuggcuuggagauuugaaaccucaaagcccaccgucagugacacacuuccuccacgcccccuaauccuuccaauaccauccuagaguucuacuuccuagugacuaagcauuaaaauacgugagcccacgggggccacucuuauccaaaccacugcaguccuacugacucgcccucuuuauucgugaauauauauuauucugucuucauuaaggguguggcucuggcagcucuuccuucucucagcaauacuauuucucuguugugauauucccccugcccugccccgucucuauaauggaucuaccuaccgucuaccgucuauucaucuaccuaucucugaauggcugcccugucucuauccuaccguuugaguauaugguacauucccucugguuucuuacgcccuuuagugaaauucgucuguaucuuccuguccugcugcuucucuucacucacucccaccuaagccuaugucuccccaagcaucuaccaaucugggccauccaucaucugccaaaugcaguggucacaucuugagccuugucuuguuucucuguaggacucauguaauugcuugucccaucccacuuuaaaggcgucuucucuuugcucucuucuuuagccaucuuugcucacuuucugugguuggcucauugucaccuggucucuuuggaguggcccacaguggccucucuucuguaccucagucccugaucucauucaguuugcuaugcugacaacuuucucuugguaucuaugucccagaccuuuccccuguaucccaugcuuauaugcuuaaacauccacugggaaaccuuccuugggugaguagcacacaccccaaauguaacaaaccugaaaccgagcugcugucuucugaaguagcugccaccuccaguagacuugaguuaggacuuacaacuccagaguccuuccagaugauccuuccaguccccauccaugaaugcaaaccaugccagcuguaucuuuguaguaagccaagagauggauuaguuauuugauucaccaaguuugacucaagacaggcucgucucuauuuuuaauuugcaggauaauuuuguaccugggccugcuuauauuucuagcuucuauggcuuauuuucaaaaaagcaccagaguugucauuucaaaaguugcagcaacgugugauuucuuuuuucaaaagcuguaaagcgcucuucgacaucugcccccccgcccccaacacggugugccucuuccuuuugcuucuuuacugaggccuguaccucaaacacagaaccucagaaccucugugccucggaucccuccaagcugucccgcuacccccacaauccugugcuuuguuccaccucuucuggcuuguaugugagugucauuuugacagauaauucaccaaccuuauauaaagcagugaucugugcuuucuaaaccucucaaacuuggcucugcccuguuagccagcugugcuguucccuauagcauacaaggccagcugacugacuuacgcucugugguuuuccaauagggauuucuuucuaugaggccaagggaggauuucaucucuccuuauccauaacuagucuccuaggacccaguuccaaaauaaaacacuagggaauugaacuaaauccucccggcaucacuucagaguuaaccagaguaacccacaguuuauaggugaggagaccaaggcccagagaggcaaaguaacuuucucaaaaugauacagcuugcuagacuagagcgaugagggagaccuccccaguguccacaccaucagcuguucuuucucuuaagucugcuccucauggcacucgccccuuacuuaagcugccccaguuucccacgccuuguagaccaaacagcccccacugagagacaaaaucccucuggaugugacuggaggcaugagaaacacaaguugaaugccccaugauuaauuucaaagcagaaaucaaguuuuauuguuagcuuacuuggugcaauugaggugaggacuuacauaaaauuaugcauauuuugguaaguaauauuuccuuuaaagauauuuccaagagcauauuaagcuuucagagaugacugggaccugucacgaggggccagagagauggcucugcgguuaagagcacguguucuugccaaggaccugaguucauucccagcacacacauggugguucacaaccauccguaacuccaggaugaugcucucuuuuuaccucccugggcuucaggcacacuugugauucacagacauacacgugagcaaggcacucauacacauaaaauaaaagaaauauaucuuuuauaaccaaagucuaacacagaagacccaaaugagaaggcugugugugacaugguguucugccccagagggaaggagggggcagguaccuccagguccauggugagucuggccaaccacccacacuagcuagacaaggugaugcucucuuugacagcccgaguaaaaggcauacagauucuuauauuaggaguuccucaauaaaauguacaaagugaucucaguguuucugagguaagacuucccaucucagcacccaguccucagcacccaguccucagcacccaguccucagcacccagcuauaccacuuucgggaauauaccccaaaaacaccccaccaggccacaggggcacguauuccacuauguucauaacagccuuauuuaugauagccagaagcuagaaacaaccuagaugucccauaacagaagaauggauacagaaaauaugguucauuuacacaaugaaauacuacucagcuauuaaggaugaggacauccugaguuuugcagacaaaggaauggaacuagaaaauaccauccugaaugagguaauucagacccccaaaaggaugugcaauguguguccucacuaauaaguggauaauaaguccuuuuugugcuuaacuuuagaauuugacaggaugucuaaggaacgucagauaucugagaggaauugagacgugaaagacagaaaccaacagauaacaacagcaacaucaacaacaacacacacacauacacuaccaccaccaucauacacaacagcaacacagaaaugcaacaacacacauaaacaacaacacagagauacaacaacaaccuggagaaauugaggcacuauaaagagcagaggaaaacuuaaggacuuggggauguggaacccaccaacccccuaaacuguaaugcuagacucagaaguaaaagggugaugagggagagaugcaugcagcauugagagcucagaggaggagaauggacucuuggaauucaaagcuugagagcugaaggaaauagcuacaggguccguacuagaaaacgaaaucaagaaagcugugaaauggaaaaugaguggguuauucuagaauaccggaauacuaggauguaccaaacaagagaacaggaauacagaaggagaaaguguuagagaacuaacaagaaaaguguagggcucaggagguagccgaguugguagagugcuucuuacuuagcugcaggagguucugggcacugacucagcaccacaugagcuguguacgccugugagcucagcucuugaaaguggccacuugacauguaaggauuacaaagucaagggcauccacggcuacauagcaagcaaccaggccagccuggcuaccagaggaccuaucucaaucaaucaaucaaucaauaaaacaaagcacuaaacaaacagccuucucuucucuuuguuuugucuuguuauuauuccuuaaugccauguuuucuaaggagagacagaacuggugugaauucugaugggggaugggguuugggaggaacuugaagaagguaggggaggggaaaccauagucugaauauauuuuacaaagagaaaaacuauuuucaaugaaaggaaaacaaaccuggagagagaacugaaggguguagguugcuagauagaaaaagugaccgagcauguggaacaaagcaguacaaaugaagaagaggaaaagacaugcagugaaugaacagacggacgacagcuggacaguggcgggguguggccaguggaugcagauaaauaggugagaagugaaacucugggaccugaacggauucuaugugagaacagaaagaugcuaacucuggcuuaaagccacugaauccagagcuguccagcggauaaaagcucuugcuaucuacccagacacucugaguucaauccccagggucccccaaaccaauuccuuugugucaaucacacacacacacacacacacacacacacacacacacacacacacacacgcacacuacauaaauaaauacauuuaaaaguuaagaaaagcuucaagaggauauuguuucugagacguucugccagacucagaauaaucuauuaaucagacuugugggaggaauaaugguguucucagaugcaaggagcaccaguuuucucgccucccacggaggcuuuagaggagccacugacugcaucugcuccucuaaccggggaguaaacuagaaagaguaaagggagagauagccuguuaugccugaagcaaacuaguuuggguugguguaggaggagagaaauuuucagaaggaaagagcuucaagaaaacaaaaacccaagaagccuaucgauugcauaacgguauuuguuuguacuuugaugaguugucugguuuggggggaaaagaguaggcugaauuagugagauuuauacagaaaaccaagcauucaaacaggagaugguuguggacuccugaaaugacaguugagagcugugugugaagggaguaagcugagacacaucacaugucucuacugugagcguaaccacauggucacauaaugagccgcucggaggcuuacuuaaacggagugcuguaacuuuguuaggagacgcaugugggcucaaagagagcuacaucuuucuuuugcauaauaggaaguacaugacuaacaccuaauacuaaaaacaagagccauguaaguaugugguuuacauaugccagcaggagcauagaaguagcuaagaguugaaaguugguggcguuucuuuggcagcaggaaccaaggcuguggggggugggggagugggcaggggcugcugcuacugugcugagccugcuggaacucaagaagggucacaaauggacucugcuuugcuuagaaggggggcucaguguuucaaguauccagaugggugcugagauugcaagggugaccgauguagaccugaggucaccgugugguugaguauuuucuccgugggggucuuuuccauagggcaguguguuaggugaccuucgcugaugcucugaaaaugaacugggccauuucucucugaguguuaggaaccgcuccacuccggggcuuuugucccggcucccauuuaaugucagcuccucccuuggagugagcagagauuguuaggaggcaggucugccugugagauucgcagucacuucucagcucugugcuuagguuccuuacuaaaucucuugucacuuugucagcaaaugagcagaacacgccuuaccuuacaggaguaugugaggaauagagaaaucaauuggaacagggugccuagcauggcagcugauaaaugagagagagagagagaacacacagggaacagcugcagcuaacccuuuguuugagauaggaauccccuaaugcugggcugggcuggggccucaacagaugaaccuucuaaagggagcaugcaucuugggagggguggaggggacagaggggauagagggcuaucccagaagccucuugauguuagcagauguuuauauagaguuuccguuauagugucuucucacuugacuuaagugcucagauuuacagggcucagcucuuagggguaucuccuguguaaggaucuugucaaaacacuuagcaaaucuacaugcaugcccaaauguuaucagaaacacugcccccauucccaaacuguggaauaauggcuccauagucaacagaauacucuucuauucuagcucccugugccucacgguugcugcuccucaaugccagggaccuggucucugugccacaccugugacaggccagccugacuguaaacaggacuuguuagcauuguucugcuucgugaggcugagacgggaaauucucaggcuaaguucuuggucaguuuguagguuucuuggguuguuggcacggcucuugagaccuugacuguggucugugguccguaccucaugccaucaguaguuuagaggaagcauuccagaaggcaagugaccccagggcagccccuuucuuagacuuuuugucuucugggggcuucugggugggagaaaagagagacuggcugaguugcugucagaguagcaaggcaggguggacuguacaaugagguggggauauucaaacagaacauacccacgggaaagccuuggcuacccucgugcgaucugaagggucauuggugggagcuucugggagagacagauaggguugggagucagcugcuuggagacaaggggacacacgcucacaugggcugcuuagggaugaugagggguuacuccaguggaccacuaaccugcucauggugcgcagaaagccucagcaggcuguacaacuccaguugguucacagccuguggucgcugcagacauagagucccggagagacuguuuuguugggguagugcauucauuucacacagauuccaucaaaaggagguuuuucaaaagauagucaggaugaacauagagacuuccuaacuacugcggccacggagcguguacugucucugggucugaucuguuccuucuucaauaaugugugugucauuugccuagcacagguuccugcuacuuuucuuuaacccuaaggccuacucucaaucuuugaaacaauaucuggucagccuacuuuauuuaauuauccuuagaguauauccaucauaaacuaggacgggcccaggagugagugccguguauagguauaggucaggaauguuggaagcccaguaagguauuuacuuaagagcuugcaaagcccccagggaguccacaacccauuaggagccuccagcuguuggggcuccggugauggguauauagggauagucaacuaggaaaacggggugggggggggagugggucucuugcuggugaugucugggucucaaaaaucccaccauuuguuuggauagaucaccuggugaauuauuuaccuaucucucacuaaauaaaaugugacaaucacuaaauaaaacuuagaaucaaagauggcaagaaggcugacuacagagaagacguguguguguguguguguguguguguguguguguguguguguguguguguguuuccccaugaaggaggcuggcgagccagcugcccagggcucuuuuguccuggggaaggccccuuucugaaggaccuggugcugaucucuggcuggcugugagcuugcagcucucugagcuggcugcccgccuucacaccagagucucuggcugccuucugguguuuuguuaacauuaauuauacacagcagcaagguucccaaggccuccagcaacucuuuuuuugguaucaccuguugcuuuuacuguucacuguacucugccuuaauccuugugaagccuugauccuuccagcccugcacacggcaagaccagcuucagguuccugcuuccguuuaccccugucuugucggggaauggcccuugguuuucguugccucuaagacuuuuucuucaccgguacauuuggcuuuguguuuggacugccccuuuccugcccugcauggcuuucucacuucuugcuuguucauucucaggcauccccuccccgugcaucuuagaccgaagcugagcuugcugggagcacaagaaagccagacuucugcuaacccauauucauuuccacugguguggcuguggaggaggggcgaacuccucccuagcaugguggccuuagggguugcauauuuccaggaugcagaaaccugagcaauuuggaaagucuuugauucagcaauuugguuuccaagacugugguuuaaggaaugaauuauggcuuccauauauguauguauauaugauauauauuacauaugauacauguauauguauguauaugauauaugauauaugauauguauaucauauaucacacacacacacacacacacacacacacacacacacacacacacacaccccauauguccauuauccauuuaucuguugaugaacagauagguuguuccaauuguuugcuauggugaucaaagcagcaaggaaaaugacgugcagacaucuuuaugggaaggccaggaguccugggugugugcccaggagugaaacagcugggucagaugguaguucuauuuuuaguuuuuuuuugagaaauauucaaacugauuuccacaauggcuguauuaauuugcacucccaccaacagugaacaaggauuccuuucucccauggccucuccaacacuugucagacuuguagauggcagccauucugacugggauuagaugguaucccaaagucguuuuaauucauuguucccgauggggagauugaagacuuugaaaaauauguauuggcccuuuugcguuucuuuuuccuuuuucaaaaaaccaucuguucaguuccuuugcuuauuugcuaauuggcaauuuuguuuucuuggauuucaguguaugcaauucuucauaauucuggcuauuagcuucugaaguguaacuggugaagauucugugggcugugugugcccugcugacugaucccuuuguugggcagaaacuugauuuucgaauagcuccaucuguuaauaguuagggguuagcuccuuugcuauuggugcucugguuaaaaaguucuugcuuaccccgaugaagagcauucccuauguuuccuucuagauccugaggugugucggguuuuaaauaaagaccuuugauccacuuugcaaugaguuuugucuaagguggagacauggcucuaauuucaucuucugccaaugaaacccagcauugccagcccuguuuguugaacaggcuaucuucuuuguccccuuggcaugucuuuacauccauugccaaaacauagguaggcacaguguagcagugauuuuugcauccuuuguucuauugcauuggucuucauguguauuuggacgcccgucuuuaucauugcagcacuguaguauauaaucugaugccaggcauugugugugacagcuccaguuauggccugacucucuaggauugcuuugucuguucauggccuucugugguuccaugugaauucuugaauuguuucuuucccugaacuugugagauaggauguuaguaaauuaacuuugguagcacagccauuuugaccacauaaauucugccaccccaggagcauggaaggucuuuccguugucuaauauuuucuuuggucuccuuuuucaguaucucagaguuuuuguuguagaggucuuucacuucuuuguugugauguaucucuaaagcuuuauuguuugggagugugggggugaugcaguuucaaauauuuguaacuagcacgaaaagaauuagugggggcuuaaaugucaaccuuugaaugcuucauagaauuuaugguagggcacugcaugagaaucacaggggacucagggacacauacauaguauguagccauuaaauggcaccgcagaacacugugaggacucaaauuaaaccacaccucacccauuaccaucuuuauuaaaaaaagugacugacaaagauaaaacaagaaucagaaagccauauguuuuauaaaaugagguaugauaugaagggaggggugucuuagcagggucugugcugaggcguuucccugagguaucagccauaagacaggucuaguauaaaaggaaguuuacuugggacaugggaagggggugugggaagggaguagagccagagaaagaaaggggacagaggaggacagaaagagagagagagagaaggaagggaagaggacagccugggacauuugcggagaggaaaaaugauagagagagacagagacagagagaaacagauagacagagagagagagagagagagagagagagagagagagagaagagagagagagagagacagacagacagacagagugacagagacagacacacacacacacacagagcuuuuauacaugagucaggccuguaccuggguaacuguuaggcagagucuagaggaaaugcuaacagaaaguguauuccuaucauguguaguuuuuuuguuuguuugguugguuuugauuuuuccagacaggguuucucuguguagcccuggcuguccuggaacucauguuguagaccaggcuggccucgaacucagaaauccgccugccucugccucccgagugcugggauuaaaggcgugcgccaccaccacccggcuacauuuuguguuuuuuuaaaaugucuaaguggaaccuaaaucucuuuggcgcaaggucaaaugcaguuacauuaaaaauucacucuaucuucucagacguagccuauggauuaaaaauucagacccaguccgaaaugcuuccagaaugaaugagaacgugcauucacacgucuaacggcagagacaguuacucuggugggagacugagcacguuucaugagagcaacagagcuuugucuggaugcuggacuugggcuggaucugaggaugugucucucaccucgccuuucuucaugcuaauguugaguagcaucaggauuccgcggcucuaguaaaguuugcuuuacucaguuuguuacucagacugggcacaagcaaguggacaggggugaacagauggccagcuuaagccauuugggaggaggcuggcuucuucccggggaggaguaugcucugcaagggacugugaggugggagcugcuggggcagggcagagggagagggagcacagguguguguggggagggugcucacucccacaugguauuuaccccaugcucuggcuucagcuugcacucucucuuuccucugcaggcagggguagagccagcugugccaagcuccacagccagcgcccgagagagaaguuaucagugccccggaagucaacugaaaugaacuggcccccuugagccuuccccaaauaccugguacccacuuuccagccggaugcugagguaagagcccuuugggaaaagaugauggcaguucucuuaaggcuccgggaggagggaguuguuuucaguuccagccaucugcucccaucucagcuacacagaggcaaggucaguggaggccaaaggcuuugauuuguuagcacaggaacuuccacuuucuccauugcuaaggagauuugaacccuaaagagagugaaguuauccugaagguaagacuauagcggacuuggauggaugcuuuugugcuguucugcacaggaaagugagcccccccaggaaacacaacugugugcaucccugccuccucgacaugcacuuccuaacccaggaaguacagauaacagacauuaugcagggagguuauggcaaagcuuuccaguagguuuaucaaaugugauuuuaauaaaucuagcuaaguacucuuagcaauuuggaagaaaauaaagcagggucuaaaaacggugcuuuguuaggcucccucuuagaauaacuacugcaggaugcuggucccuucuacauggaaguggagggaugauuccaugaggggccaggagagcuccccucucaccuagaaacucucccgagcugcuucuaagcauccaggaauuuuuuuccaacauaauauuuuuauuguuuuccugggggcaauuucacaaaccccaaacacauucacuucauaguccucuuaggucccccuaccuuugugacuucccccaaaagaaaaaagaaggagaagaggaggaggaaggagaggaagaggaggaagaagaggaagaagaaggaggaagaggggaaagagaaggaaaagaaggaggaggaagaggaggaggagaaggaggagaagaagaagaacaaggagaaagaggaggagaaaaaggaggaagaggaggaggagaaauacagaauuuggcuguguuaccccuauacucacuggagcauggucaaacucccagaggccagccccuuaaagaaaacugaguccuucccuacuagcacucagccagaagccaauugugaagagcuacacuuuagcauccuuaucacauaagaguucucuucaauggcuuccugucuagacuguuucuuuuguuuuucggacggcuugggggggggggcggaggaggggggguggagagguugucacagaagccuuccaugucucauucucaaacuuugagauuuuacaaacugguuguuagaaauaguuagaaacaauacacuaucaccccuccccaaaccccccaaauacaagacaaaaauaauccaaaccaguuugcagcuuagaauggaccguugugggagagugauguguugcuguugaaacuggaggagcuacaaagcucuuucuggaagaguuucuuuugguggugcuggggaucagguuugggguccugcuccugccaggcaaggcuguaccaguggguuuaacguucuuccccuguggagacucggugcucaguaaacacaagccgagugcggucuggucucauggguagcugucaggguccggcuacauaauggcaaugucugauacugugaggcuucuugucugcugcagggagggaauuaggccaccagaaaaccuugguuuauuaauggagagaaacgggcugcauuucucucucugacugacaucucgguauguguguugugugugugagguuaugaauuauugauacccuuucauaacagcagaagaaaacccuccauuuacugaccaacaucuggggugcauuuuccuucuggaaaaguugagaggcuggucagagaagugugaaaaggagacuugacaacuccaggaccccagucagggcucacucauaaucucugagggagggggagggugacuuccuaccaaacaaguuucaacaaaagccucuuuucucucuucaaggcccugcugccagcagauuagaacuaauuaaauuagcauaauggaguccuggccucugcccucuccuccuuucucagucuucugguuauaccucuugcucgcaugucccuuaaaaaaaggggcuuagggacagacagggugagacauuggugacaugccacuuucccuuugugguucaggaaauuagaaagguaggaaagcccagagcagucagggauccagacugccuagcagcugggugucagcccuugaagugaagccaugggagguucuggaggaagacgcuggaaugggggaagggccugggcccugaggcugccugaccccugagcucuuguaugugaccagcacuggaacauguccgugaucuccaguuauuagcucugccucuggaagguugccaaagccccagcaccuuucagaaacagcuucuaguuuucucggacuuaagccucuuuccuccagggaguugguuuuccuucuugacgcugcugcagguggagaagguuuuauucuaaggacggaggaaucuuugugaguuaggaaaggauugagcagccaugcucucugcucuaucugugugcccucuucuuaccucugcacccucuggcgcugugucugcacccacccaugucucagauaaggagacaugguuauagaaaagcucucagagcugccaagugucccucacagcaaguggucaucaaggcagggguucccaggccagugccugcaagcauuuccucccccaagggaguaucacucuacuucggaaugcuugugaaccagggcccuggaguuugcagaucucccagggggcucuucuuuguacugggagagaacauuagaucugggagacugugcuuccugcaguguguccaugcaaugccccaggagaugggcccacuguaaccucccaacccuuccugcugacuagaaauaggguuugccucucccgagcucucagacuucucuucucuucucuucucuucucuucucuucucuucucuucucuucucuucucuucucuucucuucucuucucuucucuucuuuucuuuuucuuuuucuuuuucuuuuauguuuuugagacaggguuucucuguguaguccuggcuguccuggaacucacucuguagaccaggcuggccucgaacucagaaauucaccucucucuaccucccaaaugcuggcucagauuucuuuacaaaggacaauugaugcagguuuuguuuuccucugugauuggaggaccggucuauguacgagagaaaacauaaggcuauuugucuuuucgaaucuggcuauuuagcucaccacaacgauuuccaguucuaucuauuuuaaugauuuuuuuuaaauggcuguauggaauucuaucguguagauggaccuccuuuucuuuaucuuuuccucaguugaugggcaucuugcugguucccucucuuugguauugugaagggugcugcuauaaacauagauacguaaggcauuucucugguguguuggccgacccuuucggguguagcugacucacacgguaauucuaugucacuuagcugagaaaccuucauauggguucagcaauggcuauccuaguuugcacacucaucuguggacaauuaugguucauuuccccuacaucuucaccagaacuuguuguuuguuuucuugacuuggaugagauggaauuucaaacuagcuuuuaauuugcauugcccugauggcuaaggaugcugaacauuuuagaauauauaugcugccuguucaguucacuggcacauucauugacacaacauuuguugccugagguauauauacuuggccaagacuucuucccauucugcaggcuguccauucacuccagcgauuguucuuuguuuuauggaagcuucuugguuucauuucaacccucagguuuauuucuugggcuauuagaguccuguucagaaaauaucccaggcaagaagacuucgauuuauuuuuguagcuauuuacugagugucuacuauauggcagccaaauagcccauucuggcccagccuugggcacacagacuuaacaagggcaaggggaggaacuuucuggaaacaagaccauauaggacauaggcccuccuugcuagagcuauacaccuccggcuugucuuucaaagacucuaaaggcaggaacuacuucugaagguacugugcauuccaggguguccagaccccuaaucuuaguuugaaguguuuggucuaugacgagcacacuaagcaacacaugcagugcuggcuuguuuuaugucaaccugauacacgcuauagucauuuagaagagagagcaucaagugagagaaugucccuacuagacuggggucugggcaguccugagugcauuuucaugauagaugauugacacgcagggccuggcucgcugagaguggggccaccccugagcuggugguucuagguucugugagaaagcaggcugagccaugaggagcaagccagugagcaucaucccuucugugaccucuguaucagcuccagguuccugcucuguuccugcacuggcuuccccugaugauggacugugcuguggaggugaaauaaacccuucccuccucgggcugcugucggccaugcuuuucuaacacagcuauagaaacccuuaacuaggauacauggggaagagggccaacugaggggaugcggcagagugucaggagcugucuagaaaggcacugcuggacugaagagugcucugcccugagcugggguggugagguuguggggugugguuucacagagaaucaagacuccuuuugacaguggcauccaagucacuugagaaggaugaaaagcuccgcucgcucugcaggaugcucagagaacauaagcuagggucgaaagagcuccuucgccuccuuccuuggaaaaaguagagacccagaaagagggagggccuuguuuauuacuuaaguggaacaggagucuggucuccugacugaccagggucugucucaucaaaccuuccuggccaaacggaaugcuggccuggaggccagcacugccacuuuccuggccuggccugcagugggcuuuguugcaaugacaaccuaggauagggaggugacaucuuaguuaccagagaagugcccugucccccagcuccccacucucuuuguucagauguuccugugucugcuuuugcuaggauuugcugccuaaggcucaccaugaguccucacaacacagagacaguucgugcucagccuugagacuaagcagcacacccaugcuugagacugacuugaugacagcugcaggucgggccaggcccuggaggcuuucugagucagcuuccuccugcugauaggcugcaggguuccuaccugaguggagacuaguaguauuauguaaaauaaggcuuuucuccuucaagcugauuaagugggggacaaaagagcauuaucaugcuccacugcaccuuuaccuaggacugauugauagaucauaaccuaccuauauuuaaauugcacaacuuggaggaguuguggccuauguaucugccuguggaucacaucaaugcucacaagcauuggggccaucuccacaucucuuccugugcuuuguucccuccugccccuuucugucucccucccaccucagccugcauuuccuaagaccacaggaagcuggguuucuguugcaugcaccccccccccgcccccgcaacccccccgcgaccccccgcccccgcaaccccccccccgcaacccccucgcaacccccccggcaacgcccccgcaacccccgcacccccccccgcaccccccccccccgcacuccccuccccccgcagccccccccccuuguuggccucuauugacugaaccagcaucucuuccuuuauugcuaaagggguguggaugucucacggcuuaaccaccuaccuuuaggcaaauauuugauuguuuuuaauuugcagcuauuaaaguugcuaagcauuuggaaagcguaagaaaaaaagucuuuauauagucauauacauagauuucccuugugaggagcccuggcagagaccggcuguguuguaagguaggucuaccucugcuuuucaggaagcugcaaacuucuccugucuuugcaggcccucugccuccuugucaguccuugucugcgucagguuuugaacucuggggaccaguggccaggugccuauuuaacauaucaaaucggagagugacugcuggacucucccuggaucacucagugcccuguuacaggguccuccuggcuggcaugcacugcuuccuacccggaauucuucaacucagggggcugggcugcucuuuucuaaaauccaauucuuuggguacuuuguccuuugggguuccuggccacggcaucugguucuccaucucuccccacauggcccagcucagucuggucaugucuacuccggacucucccagaugucccugccccuggcuaugcuugcccuuuuaccuacaagaagccuucuccuccaccauugcuaggaccagccacuuucuuucauuuuuucccuuuagucugccaggugaucuuaacuuuagccacuuucacugggauguccaccuugcggugucuggcuuucuuuccagauacucguuacucgaccucauuucguggaaugcaccagcuaucuacauauuuccuuaaaugaaguuucagcucacauuucuggccuuuuauauauuaaaaaaaaguuuuauaaaaaauugaauuggagauaccaacaagaaacguuaauuauaaucuaguugaauaaguaauggcgcacauucugguaggaggagagcagcaguccuaaggcaggaagugucuugggggagaaugcuggcuccacgggaaguuggcagugugcaguggcggagggugccuugagcagagaguugcucacacuacauucagaguuacaggagguuggaucugcuuugaggacuggaguuuggaguacaggaguguggucuauaauccuagcguucccugauugcuggcugggcacuccugccuuuacaucuguuuuguuucagaauaauuacagaauccacagaaagcucuacugguggguccaggagaacacaaccgugguuucuccaguggcuccaucuuguauaauuauuguguggggcgugugccugaaacugcugugcugagcaggcugugcucagaucuucucuguagagccccgugugaccaccacugcggcugggauucagaaguguucccuaaccacagagcaccuccucccucccucccaccuacucugcacucccccccccccaccugccuuugacguugcacugguuccucccuguucuccaccuagauacuugucuagcacaacacacaauugaugagaagcacuuuggacacucauugugaagcccuucaagcccacggaggauguugacuccaucucuaaguuucucuuuuucauggcugaguacuauuccacuguauggccauucaccacccuaaacuguguauuuguuaucuguugcugugaucaaacuccacgacuagaaagcaaguuaaggaagacaguuuauuuugguuuaugauuccagaggguuggaguuccuauugguagggaugcccuggcagccagcggcagguacacuuggcaggaacuggaagcugagagauuacaucucaaccauacaaaggaaacacagagugaacuggaagcgggguaaaccugugagcucucaaaaccuuccccuucugacaggaagaucacuucucugaaagguuucauaaccugccaccugagaccaaguguucaaguaccuuagcuggugggggaucgacuucucauccaaaccacuguagcccuucacccauugaaggauauuuuaauauucucaggcuggggcguguuaagaauagggcugaugucagcagucacaggcuucugugugaacaugagguuucuuuuucuucuuucuuuuucucggacaagugcccagaacuagaaacagugaguucuauggcgaacgucuaauuuuuaagagacugccaggauguuugguagagugauggccauugcacacccucugcuccuccccgaccacuucaggggugugugcgcuaguuugcuucacuaacaacuguugugguagcuccucuuuaccacacugaccggcacucucgcguccgccccgucuuagucugggucugucugcaggugcagccuugugugcccuccagugggggagcagacgcaucuggugguggcuuuccucuuccaccacguccagaacugcccuggacguggucccucuguucuuugcccugguucauu

SEQ ID NO: 8186 - RNA, 1684 nt, Mus musculus
uauggcagacaaauuaacaagaauugcuauuuucaaccacaauaaaugcaaaccuaagaaauggaggcaggagugcaaagagaguugcccugugguucagauggggaaauuaugcaucgagguuacaccccagagcaaaauagcauagauuucuggaacucuuuguauugguuaugguauuuuuauuaagaaaugucccuuuggcgccuuaucaauugucaauuugccaagcaacuuggaaaaagaaauaacacauugcuauugugccaaugccuucaagcuucacagguugccuaucccuccuccaggugaaguuuugagauuaguuggaaugaaugguauuggaaauucaacugcacuaaaaauuuuagcaggaaaacaaaagucaaaccuuggaaaguaugaugauccgccuaauuggcaagagaucuuggcuuauuucccuggaucugaauuacaaaauuacuuuaccaagauuuucgaagaugaccuaaaagccauuaucaaaccucaauauguagaccaaauucccaaagaugcaaaggggacagugggcucuauucuggacagaaaagaugaaacaaagacacaggcaagaguaugucagcagcuugauuuaacucaccuuaaagaacuaaaugucgaagaucuuucaggaggagaguugcagagauuugcuuguguugucauuugcauacaaaaagcugauauuuuuauguuugaugaaccuccuuguuacuuugaugucaagcagcauuuaaaggcugccauuacuauucuaucucuaauaaauccagauagauauaucauugugguggagcaugaucuaaguacauuagacuaucucucugacuucaucuguugucuauauaguguaucaagugcuuauggugcugucacuaugacuuuuaguguaagagaaggcauaaauauaguuuuggauggcuauauuccaacagagaacuugagguucagggauguguugcuuguuuuuaagguagcugagacagcaaaugaagaagaaguuaaaaagaugugcauguacaaauaucuugggaugaaaaaaaagaugggagaguucaagcucacaauuguagcuggagaguucacggacucugagaucauggugaggcugggggagaaugguauugguaaaacuacauuuaucagaaugccugcuggaaggcuuaaaccagauaaggagaagaaguaccaguucuaaaugucaguuauaagacacagaaaaucagucccaaaucaacaguaaguguucaccagugacugcaugaaagaucagagaugcuuaauacucauccgcaguuugugacugcaguaaugaagccccuacagauugaaaacaucauugaccaagagguacagacauugucugguggugaacuucaucgaggagcuuuagcucuuuguuugggcaagccugcugacgucuauuuaaucgaggaaacuucugcauauuuggauuuugagcaaagauuaaugacagcucaggucgucaaacauuucauucuccgugcaaagaagacagcuuuuguuguagaacaugacuucaucauggccaccuaccuagcacuaugccccauuuucaaaccucccuacaauaugggggcauguauuguaagagaaagaacaugcagaaggacagagagagugaaagaaacaaaauaac

SEQ ID NO: 8187 - RNA, 3381 nt, Mus musculus
aauacacaaaagggagcgagagaguugagccguuagaacaaguguguuagaggcagguuuagagagacgagggagggagaaaacaauaaauaccacagcuccuuccagcuagaguauuaggcaccacgagaaaaauauuugccaagcaguuuucgguggguucauuuguuuucuuuuuauuugggacaauuauguuggggcgggggggggguccuuuggggaugguggcuugggaugcuccuguuguauuuuaaugauuuaggugggguuuuuuuuccgcuucugauuuuugccuuuugcaaguuugugguguuauguaaaucgucgggacugucauucguugguuuuauugucucccugcguucucgcuuucucucucucucucucucuaucucucucucucucuaaaggugcaauauuucaaccuaauaccauugacagaagcuuacauuuuuggccacauaugacagccccaaccuccaacaccaccaccgcuccccgcccgccccccccgcccgccccccagccgcccuugguacaauuuccuuuuccucuuggacuuuugcugaagcuuuccugcacuugaaagagauguaaaaggauuuggauugguuugguuuguuucuuuccaggacagcgagugguggguuuacucuguuacuguugacucucaggaaauuucuugaugcuagaaauguguguguggguacguguaauguuugccuguuacaacauucugugaagccaaauacauguuuguauuuugcuauuuucuuaaggucuugaacauuccccccacccuuuuuuuuaaacccccacuggguucguuucaaggucgucgggagaaaggaaaaaaaaucucuucaguauguguugaagggaucagccugagggaauucuaaaggccuggcugccaggaucacagauacugcgcguauugaguacaggcugugcuacacuaggcgcacugcucgcagccggguccucuaggcuuuggagcagagcugaggggaggagaggagcggaaucuuucuuucccuucuuucuuccuuuauuuuaaaaggugaauacagggcagacuccuuucacggugggcccuggguuauguguucauagcugcaguuuccuuauuuaaauguuggucgggguuuuugcccuccuacucaucccuggaugagugagacucuuguuucuuuuaugucugucucuugcaagaagggugugagcuaaauaauauucagauuccuuaagaacuagaaugaacucaaaguguuuggagcaaaagacucuuucaaaggucaggcuguucugggcuuuagcugugaaaguccuucaaguggcucguuaaaucacagagggguuuucaagcauucgcaaaauaucuccacauauuaauuucuaaugaauacuuguggaccacaacccuaaacgugggcuuaaaaauagagaugcaagcagaguucuggaagacugcuggcuugugggguacagaggacugguccuaugagaaguuuuugcugugcuguuguuggaguaccaccacuucaaaagaugaugucacagguuuuagaacugggggagucgaggaaggagcugguuguuuucugugaggguuggaacuuagaaaauccguugucugucccugagaaaucugaaugcuuuaauacguauuggcagauggauuacugcagucucgguggaaaagccugucuugugaaggauuuuugaggaauacacauaggccuaauccuaucacuguugggaaaaugaacauuuuacuuccaaagacacggugacuuugucaaauugauccacacugcccggaagcaggguggcugcuuuggguuuuugugucuuagaguccccuucccucucauuuuagaguauuaaguuaaucccacuggaccaaaaugacacccuaauuuugcugaagugaauuucuuuguguagcuagcugucugauuacuaccuuuucugagcauuaaguacuucaaauuucuuagaugcaauuuagcuuuggaacgcagguguaugguuuuguuguauuguugucuucauaaauagaauuacuuuuauggugauuuugguuauuuuucuucucagagugaccuugugucuuaucccuugacucccaccaccaagucuucaaaacacacacacacacaaacacacacagaguuagagagagagggagagagagacagagagagacugucggucuuguguucccuuugcuauuccacuuuuauccccaugggggcgcugcagagcaaagggaaaugugcucccucgggcgguagagccagccagagugggggcugggaaggaauuuacccuucucauaccucaaacccuuugauucucugaaaaguuucucagagcaacagcucaccagcccugcuuuauuaacccagcacuaggaccucuuauccuuccugggaccaugugccagaguuuguguuacuguggugggauuuuuguuguuguguuuugauuuuuucccccuucucucucucucuucccaccccaccccccaagucaaaguguguauguuggaagaaaauaaccaaaacggaaggaggcaccugcuuuuagaugagccucuuuucucucaacugaauggauguugaagaaaauuaugcgcucaccuuucaguuucuucgguuccagagaaagugacuuaauagaguuuuauaccaaugcaaucucuuccugcauguccuuucuucucucuuuaugggucuuaccucaucacuucuagcuauguaaggcccuugaauucuacagugcuauuauuauugggauaaagaaaugaccggaauauauucagaguccuuuaaaucauccuuaaggagcccacaggagugaucccaugcccugggguuuuaugaauuauuucugcagacuugagaaaaacguggaucagcuaaugccaugaguuaaugauuccugguugcuaauacucaggaucggggacucggccaacuuccuugccccguggacugagcuuaggaaagauccuugaucacggcugcuggguaaauauaagcucuauuacaaaauaaaauaacucgguacuaauauuacauuguugaagggauggaacacaauucacacccaagaccguucccacaauucagcacuguagauucuagaacgaggagccuuacugauugauaaucaccccuccaggcucugucuucgcaaagacuagacugucccucgugagccaaccuagagucacagcucaaaacgaauccaugugauuugaugcccguggucaauucugaagaucgggcugaccugacaaucuggccuucagggguguguauccugugcuugcagaauggaggacagcaaggcugcaugaggcccugugua

SEQ ID NO: 8188 - RNA, 1002 nt, Mus musculus
cagggagcgcccgucuuugcuggggcuggagcggcgcuuggaggccgacacccggucgcuguuggacucccucgccugccgcuucugccggaucaaggagcuggcuaucgccgcagccauagcugcucagcgcgggcccgaggccccgggcuccacugcgcccucggguuccugcuccgccgggaugagggcaggaccucgggggccuggaggaauaggacaggcgcggggaggcagugcuaauauuugaggagguugcaguaucgaaaaccuggagcccacaagguuagucagagucugggcaguggcaacaaaacgugugaaaauccggauguaaacuuccccaaccacuggcggcgggggcggggcggucccaggccuucuugcgaaguagacguuugcaccccaaacuugcaccccaaagcgauccacguccaaagggcaguagggaguuuggucacacugcguucaggguaccaaguggaaaggggggaaaagauguccaaaauaacaagcugugccccgguuggagaggcgcaagcguuguaagguguccaaaguauaccuacacauauauacauagaaacccguuuacaaggcagagucuggaccgaggcuagaagcgagcccccagcuuaaaaauauauauaguaaaaagugaauaaaacguuccuuuagaaaacgaaccaccaaccgcgacagagaagaggaaggcagcaauuuaacucccuguggcccgcgguucugaagauuaggagguccgucccagcugggugaggucuacgaaaugcaucgcaccggcugcgguucuccgggggccggcacccccacuucuagaauuccaagaggcgagaagugggagcgguuaaccagacucgggguaggggcgcggggcggggcgggagggggggugcagcuguuuccagcugcggugagcgcgccucuccuccagcagcacugcaaagagagcgggagacgagggagggggagggagagagggag

SEQ ID NO: 8189 - RNA, 1002 nt, Mus musculus
cucccucucucccucccccucccucgucucccgcucucuuugcagugcugcuggaggagaggcgcgcucaccgcagcuggaaacagcugcacccccccucccgccccgccccgcgccccuaccccgagucugguuaaccgcucccacuucucgccucuuggaauucuagaagugggggugccggcccccggagaaccgcagccggugcgaugcauuucguagaccucacccagcugggacggaccuccuaaucuucagaaccgcgggccacagggaguuaaauugcugccuuccucuucucugucgcgguuggugguucguuuucuaaaggaacguuuuauucacuuuuuacuauauauauuuuuaagcugggggcucgcuucuagccucgguccagacucugccuuguaaacggguuucuauguauauauguguagguauacuuuggacaccuuacaacgcuugcgccucuccaaccggggcacagcuuguuauuuuggacaucuuuuccccccuuuccacuugguacccugaacgcagugugaccaaacucccuacugcccuuuggacguggaucgcuuuggggugcaaguuuggggugcaaacgucuacuucgcaagaaggccugggaccgccccgcccccgccgccagugguuggggaaguuuacauccggauuuucacacguuuuguugccacugcccagacucugacuaaccuugugggcuccagguuuucgauacugcaaccuccucaaauauuagcacugccuccccgcgccuguccuauuccuccaggcccccgagguccugcccucaucccggcggagcaggaacccgagggcgcaguggagcccggggccucgggcccgcgcugagcagcuauggcugcggcgauagccagcuccuugauccggcagaagcggcaggcgagggaguccaacagcgaccgggugucggccuccaagcgccgcuccagccccagcaaagacgggcgcucccug

SEQ ID NO: 8190 - RNA, 1593 nt, Mus musculus
aacaacccuuuguuacugaacaagaccggaagugauauuucagcaaagcaaugaacugugcaccauuuaauauaccuuucuuaauugggcugcacaccaggggcacccucuuaaugguauuauggcaccaauuaccucauuaggaggaaagagcugcuuuuaugacagguuuuggaaauuaaaacagcagagagagacaucuuucagggggcauugcuucugggcaauggcccugcccagcaaugugcgugcguggaguaagaaggccuagggauggaagucagucugugacaccugucuggucugaccccucuugggcaccagaucuggagcucucgcuguguuuuuccauugggaaugugaaccccacggcucaggcacuuuaccgugugcaaaggccgcuggcgagccuuuccggaaguucaguuucuagggcugcacccugcaauucugccccaggaagccugggugggcuuucaaucacacugcuuuucugacaaaguccuuaagcagcugccgcgcaggagacucaaagauaccauuuucaaucacuccuggaggguccugaugaccccagcuaacccccaggugcauguguuggcuucuuaagucuccaagggucaggaucuuggcaaagccuggaccaucugagacucuuugcuuugcuucucugaacauguuacagcucguuuucucauucccuucuggaaugguucaauagugggggucaagcugggugucacugugucuccucaaaugcuugccugccugccugccucaucaauaaaagaagagugcuacucucagauguuagcugggugaguauagauguggaccggguuucucuuucuggcagccuuucacgguuuccuucccugcaguggcaagaacuccaaucuccagauuuugugcaaacacuggauuuauagcaaugguuuuguagaguguuccaguuugccgcguugaugauuaaugugguuuucucagagagcggcuugcuuuuccugccagccugguggauugcauaaaggcugcgcaguuucugcuuuuuuuuacgucacccuguggaauugggagaugguacuguauugcccgaggggaaggagaagcuucaguugggaaauggcaaaccugggcuaaucuguagaggauuucuuaagaauuucagagacugcccugauuccaagccuuuguugauuguccacugccugcaggcuucuccguguggcauccccuucuccaucaucuggcuuucgguaauccugggugcucuccccaaguaacuaggagugcguggcuuuaauuuccucuugugaugguuacucuuuaauccaacccugcucuguacuuccaagcagcccgagacacuucuccaauggucuugucauugcuacaaacuuaaaauauccucaaguauguccaauaacuuaaccccaauacucuccccaccgccauccaucucauuucaaucuuggacacugcucuagagaaugaaaaauaacuggagagaccucauguuuuuaccucaucuuucacaaggacccauugcuuugaaauacccagaguuuaauagacauuaaaagaaaaacaaca

SEQ ID NO: 8191 - RNA, 6601 nt, Mus musculus
cuuaaguccuggcaccuaauacaucacgcgugggauuagucacaagcugggcugucucgguggcuaaacaggacugcauugccaccaaaguugucauuuuagcgccagcugcaggcugccgggagcuuaguaggugcucaaggugcuuagaaacgaggcuccccucucuuaggguccccagcauccuuguccggugcaaggcauuuggggugggggauguccgagguggucccugccugccuucuccugucccgcuggccugacuccuggcagggcccugcaggccuccggugccccgacccuggcccccgcccagcuccgcggcuucuaaacgcugccccgagcuaccgggagaacuggaaaaacacuggcaggccgccccacccccagcgggucgggcggccgagacucugcggcuggggccugcugccugggcggcgcuggcccggggcggggaagcgggggcggcggccugccugucagcgggagcgggcgcgggcucgugugucagcggcucccgccccucgccgcccccgccgccgcccgccgggccucccgccgccgccgcccgcccuccccgcggccuggcaggcugccggcugcacaggcggggguucgcgccguucucacgaccucucagguugccugagcucaucugggagcuauucauuuccugccagaaagcagccgggccugcugggcgagccaccuuggccgcagggccgccggggccggcccgguguggcugcccugggccgcucccgcccggccgcgguccccgaggccucccaggaaccccgagccaccccggcgggcgcgcggcgggggcagcucgcccgcccaucugguugcacuuagaagcccggaggaagugagcggcggguuguuaccggccaaaggguguggggaaaguuaauugacuuuaaugacagguuccccgugacgaugugggggucugguuaaaccucuggguccccacugcagaagcgcgugggaggggucaggaugagaccccgaggaaggggcgagccucaguugcucacccagaaucaggcccucaccucuaucuaccucuguagauugcugccagaaccuccggagagcagagaggcuccaaggaccuucaaggagaggcccucgaggucucuggccucaaggacagaguuuggagcugugucuuaucacaggagagaucuacucauccggaucugguuagaggggcaaggcagcugggugugcccugaggugguauaauuaggccaggcccagaggaucuguagggaugccagaauaaacuggaaugcuucaucuccccaacccccagcuacugauuuaagaaacagcagggauacaggaggcagcagugucuaagaaauaaaucuauagcguuuaugaacuuggaccuauccuagagaagggaaaugacuuauccaagguggugccugccauaaguucagugguauagaacaauguaaaagcucccaacggggauauaggcuuucuucuacuccauauuauacuugaacaggcuucauuuaauaauguaaauccaaauuacgggggggggcacuccuuuucaaaaagaacaaaugguuucuuuuccucucacuucuuccugaagcugcugcgugacacuuuuggugacauuaauaaagaugcaugaagaaauuaauuucccuuguagcccccuccuccauagauguaaaaggaauuacuuuuauaaaauugaguuccugaugucuugauuauuucuacuacagaagcuaggaauucuugguggaaacagaggacuuuaauaucuaaauuugggaugugucuuaauggaguaauuguuacuauguuuauguauaaacaaaaaggaaaaccaggaaaaaauggaaugacaaaguaugcguugaauaccuuucuugggcagaaaauaaggcaaauaggagccaauuaaacaaaacaaaacaaaacaaucuuuuaaaccucucucuccgggggucgaagcugaagguccuggaaagaaccggcugcugucugcuagaucauuccugugauagagccgcacucggcgcuggccugugggaaaggcuacagccaggcgggggagagguaaggcuuuugaaacaagacagaaaaucguuggcuuuaucuuuguuaggaaagcuucaaagauugaucucucccgccucauccuucuccucccagaagccgccgcuguaagggaaaggggguaggggguugagaggcgggcgggaggagcgggggcugggcggaggacuggccggcugugggggaggaagggcgcgccggccagacccacagcgcggcugaugugucuggucucgcagggcucgugguuuucauuuccccaacaccuggaugcagucaaacaccuggccaaaucugagaaaaucugacaagccuuugugaugggauuuggaagaaauucccugcagauccuggcacaguuuaaagcuguccgcuuugaguuaggacuuguuaaggaggguugugugagcugaaacccgagacaacccuuuugcuucuaucuggagcccacaucuugccuggaaauggggcaugaccaugcgaaggggucgcuugcuguuuguauuaaaaggggaaaaacggcccgugugccugccagcgcaacccccacaugcuuucuccauuaaagucaagcgcagaaacuuaucagaaacauaugucugcuguuaaucaucuggcccgggcuccacuugggagucuaacuaguuguacccuggcagagagaaucuguugaccuuuucagcuugcuugaagagggugaagagaggcauuucaaacuuugugauacgggugccaggggaugccuagcuacgccugaguaaggacagacaaaugaaggucccaaugcuggagggcugcaauguggcuugagcgcgcuuuuacuuuaggaggccaguggcuacuacagggagugaguugggagccgcccuuuggaagguaaaaaaauaaggacuguuuaucaggaaagccccaucaaaugaauucucauaaauuaggucuucuuagaucauugaguguugcugaaagguuugaugguuccuguuuaaaacuuuaaaaaauacauccuauuucugaauugccaaacuacaugaauuucaagccccaccacuuuuuuuuuuuuacaaauuuugaaauaaucaguucuaagacauaaaagccuucacucuuuuauuauauuuucucaaauaaacuuccccaaaggaagauauuuuaagagcauuuucaaacaucuuuggcaucacauaaaaaaagaaaucucguguaaaaaacgaaaugucaucucaacuuuuauaauacaaaggcgcaauccaauaugaacauauaaaauauauacaaaugcagugcauggucagucacuuaauacagcucucuacaaaaaguaacuuuuuagaauuaaaaaaagcaacaaaauaaccaccaaauuauaaaagucucuccuaaaauccaaguucguuuuuaguguccgucagaagagagaggugggcuagggacuuuacggguagcaguggccugaggcucucaguuccgccacggucuccacauggaguccgaagugagcgaggagccacuggaaggugacacugcguuaggacccaccgaggucccacuguugcugguguagaccgggaugaccgggccgcugugagcgaaggccccguuggggaugagaaaggcaaauuggccgucaggagccggcaccacuuggaagccgccaaaaaccuuggcagccucuccagccuggcugcccaacuugcagggugcgcugccgggagggggcgccgcgcccccggggaugggcacaagcggcggcggcggcggcgcgaauggcgcgugcuggggaccggcagguccugacgggggcggcggcggcggcgccugcaaggcggggugcgccugcccgggguaggucauggcguugaucugggucaugcaguuggccagguggcccagcagccgagugcgcaccucgguguuaacgcccucacacguggacaggaagcgggucaccucguucaugcacucgcugaagccggcgcgguauuuccccaacacgcucgggucugugcugagcgcggcugcaggccagaaggagaaaagaugggucaccgaaaagcccuggccccggagccauacagccucccgcccugggagguccccgcagcgcgccuccggaaccaccugggguugggaggguuggguaggcuaagaacagccagcuccuucucccuagguuggggacauaagccaggacacucccuccaucuaaaccgaucucagcuccagaucugccaccccuagucccgcgcgcgaccugaccuuggacaaugccacccaaggcgccuuccaaaccccacuuccccuccugcggcagggguuggaccggugcuaaaccacugaccccuaccuucuauccagccccaaacuuccucagucuuacguccuuucgcccucaccggcuucuaccacagccaagcugcccaccacccuucucggcuacagccucucccuccauuuccggagcaguaacaacuugggagcuguggcuauaaauaagacccagaccgugggaacgcggagugagccaaggcaguaaaauguagcugaaugccucucacaaccgcgggcggaagucuggaagaaaucaccgcgggccgagagggacacccgcagagaggggacgcacgcgcgguccuuaccggucaucugcgcccgcugcagguuccggaggugcuucacagucauuuccagaaugucugccuucucuagcuuggaaugccgggagcucugcgcagaaaaaacaagggaugaaagucaguccuccuugucagcugccuccgaguucugaagguccccgcccgcaugucccacaucccagggcccggcggccucucucccgccagugggaacguagugcuggcgggguaagauccacaugcagcaggcuaagagcuuaguucuuugugccugggaaaugccauuccauucguaauuaaaaauaaaaaaaagcauugcucacuuacaucuuucuuaagugcauccaaaaucaguguuuucaguuggcuuagacuuucauuuauucuugcccuucgccucuucuccaugauaggcuuugaugacugcaaagggggagaaaagagguccugaguucccacgggaucugccauuucaccccgagguuuuaagagaaaaguaaaaggagucccgcugugcacaacccacuuaauuucuagacgcagguacugucuuaccuuucugugcucagaggccgucuuugguuuguccggugucguguugacacuggcugggguagcagccaccggggaggaggaauuuuucuccauuauaucagcuggcauuuucguuuuuuuuuuuuuuuucuucucaguccccagagaauuuuauuuuuggaauccuucacgcaaaaaaaaaauaauuuuuuuuugcuuacguccuuuuacuugacuuucauaagaaaaacuacugagcaguugaagguuuauuaugucuuagggcuacuuagugaucgguagcacuauuccaggaccaaggagagagguagacaggggauuccgcuguuaucagcaccagcuccagauccugugugauccgcaggcccuggcggccucuauauauaucugggacugcacgcgaacggcucgugugaaacuucccaaacuuucuuucccacaguaacuuucagccaaugggaggaagagacacgcggcaccgcucguggacugcgcccccccauuggccgcuaggcacaaggucuggcggccaauggcgcgcgccugagcccggggcaccggaggcuacaacgucaaucaaaaggauuuuaacccuuugcuaacucuuuccucugggcuuugcuuaguuuuagucuagucuauuucuuuuguggccaggccuuugguuuuuauuguucuugcugcaugcaauauaacuacuuuguauaauaaguucauuugaaaaauauuuugaacagauauaggccaagacaaaauuuagugauugaaaaaaggagggaacaagguaaagaggauguguuacucuaaugucuuccggaauucccgcucgaacucuguauguuuaggggagucaaaacugcucaugagguuggggagauacuaaaccccacacgcuaaacaugcccuuaccguccccccaaaugccuucacagccaggguuuucggagcaaggugucuuuuggaugcuugucucccucuagcccauucauuccucucuuggaauugcaaccuuggaccucacgcuucuccagaaaacaaucagaauaauuuccuacugggcagaaaggaaauggaauuucaaacgaaaaaaaaaaugaacaaggggggcuuugauagcaaugcgacaggaggggcgcgcucguuccuccgccacucucucuaccuuucuccccgcaggcucccaguuggcaauacggauagacggcgggcaagggagucggggcucuccccuccucaccccgcgggcggccaaggcggccucggcgccccgcgcgcgagcccuuuaagagcuccaccagccgagcugcaguuugaca

SEQ ID NO: 8192 - RNA, 529 nt, Mus musculus
auuuuauggauuggugggccaccaggcuuccuuuuuuucugacaucuuagcgaggcugcugugguccacacgacucucugagcuucgccaugccgcccaaagaggacaggaagaagaaagaugccggaaaguuggccaaaaaggauaaagacccaguaaauaaaucugguggcaaggccaagaagaagugguccaaaggcaaaguucgggacaaguugaacaaucuuguccuguuugacaaagcaacauacgacaagcucuguaaggagguuccgaacuauaagcuuauuacuccagccguggucuccgagagacugaagauuugagguuccuuggccagggcagcccuucaggagcuccuuaguaaaggacuuaucaagcugguuucaaagcacaagcccaaguaauuuacaccagaaacacaaaggguggagacgccccaacugcuggcgaagaugcaugaacagggucaaucagcuguacauuugggaaaauaaaacuuuauugaaucaaaaaaaauaauuuuaug

SEQ ID NO: 8193 - RNA, 5231 nt, Mus musculus
caaguagucagaauagauucuacuggcuccugcggguguggcuuggaagaaggcaccagggcacccucuaucauccucggcccugaugcucuuuggacuucuaacaggaacugaacggacacuuccaguggugagaaugagccacggaaagauggugccaucucagucaugaccaaucagguaaagauucagcugagcccuccccacaggcaagcacagggggcccuggauccucucuccagccugcuccagagguccccaaggaguccacuuugaagcauaucuugcccgauggguucccucugccucucccuaccuuggggcgugugccugcauacuuaagcaccaucuguaaaggguaucugggguaccgagccucgcuucuaagguccaaugauaacagguaacaagcuuggggaacccccugguggaaguuacuaccuuuggaauaacuucaacuucucacucauuccuugaguaccuacuaugggccggucauuacagaaggcuagagagaaacaguaggaaagaccuucauucuuugcaggccuggcccuuguaacuggcaggcgaccccuggccugaagaugggggaagggugaaugaaggauggacgagcuucauuagaggucuggugggaggagcacuugcuuauuuggggcaccccaggaaacucucacauagaugacacugagacgagacaccgagacaagaggaugucugacgaugacauugaugggaaacagggauaguucucgaccagcaguucucaaccuaugggucaugacccauuugggggucacaugucagauauccugcauaucagauguuuacauuaugaugucauaacuguagcugugaugguuuguauaugcuuggcccagggaguggcacuauuagaagcuguggcccuguuagguaugggcuuguugaaguagguguggccuuguuggaguggguguggcccuguugaaguagguguggccugguuggaguaggugugucacugugggugugggcuuuagccccucauccucgcugccuagaagccaguauuccgcuagcagccuucagaugaagaugcagaacucagcuuuuccugcaccaugccugccuagauacugccauguuccugccuugaugauaauggacugaaccucugaaccuguaagacaaucccaauuaaauguuuuguuuauaagaagaguucuuggucauggugucugugcacagcaaugaaaacccuaaccaagacaguagcaaaauuacaguuaugaaguagcaacaaaaauaauguuaugguuuuaugguuggggggucaccacagcaugaggaucuguauaacaggguugcagcaucaggaaggaugagcaccacugugaucuggacagacaguaggacacuagccucagcuccccacacuccaguugguggauucgcuacaaagcuguucuggggucguuuccuuaccuucgagaugagaaaaggauuccuagcucugaucacauauuuaucacaagcauaucuuggcaucguuaucucggaggggcaaccuuugccgccccccaauccuggccuucaggauaugaucagaccccucacuucugucucucagccuuggccauuccucuuggcuacuguugcaugugccugagagaggauuuaugguaucaggcucccacuauggaagccaacaucaaguuaauggaauggggaggcuggagaggugguuaaggguauugacugcucuuccagagguccugaguucaguucccagcaaccacacgguggcucacaaccaucuguaauaggaucuggcauccucuccuggugugucugaagacagcaacagugcacucauauacauaaaauaaauaauuaaaaaacaaaaaguuaauggaauggaucuugccccuggagcaaaggcucuagaaacuuaggagccugcagccaccucacuuaucaacuccaaggaaacccaaaacagaggugaaaaaggcagacagucugagcuccuuccuccaaggugacuuccuuccuugcuuaccuguguggaguucuggguggucugccaacagcaguugggaucaguguguuaguggguaaagaaaaggugcccaucacgagaauaccacaaagagguuuuccuggguucugacaaugcacaagacccaaaaucucuacaacagaagcuuucaugacuguggcuacaggugacacagaggauacccagguugaaguugaggcuggcugucacacagggauauacagguacaagucuaggggccuguaccagccuguauauuccaccuauggcccucucagcagacggguugagaucaugccugccucccacuguggggauauccccgugggugccuuaccccuugcagccuucucaggcagguaggggugaacucagacaucccagaccucaaagcaaaggcauaaagcuggagcugacuacuuccuggcugccugcccagccuucuucuugagagucaguucagcagguaugaaagggggcagacucauuggcagcucacagggcuuccucugcaggaacugacacuugguaggacuuacaggaccugggaacagggucacaccaccgucacuauugguccaagccacaaagaaagaaaggauacaaguaggacuuaagugauacugagagauccucuaucugcuacaaauaucacaugaccucggggcuagaaaggacuucccaaccuacagcuggggccauggugaacccaaugacucgacucuaaaaauggagacacugguuggcaaaauaauuuccccaaacuccaaauugugggacuaugauagacagccuauuuuaguuaaauggggcuugcuccggugacccaguagagaucucuacaagggacagaaaagugagccacagucccagagucaggugccugacaccacagaggccccaacuccauaauucugugacuacaagucacacagacaaugucccaagcuucuggaauucugucuaaacuccacccccacaguuaccugacuauagccagguaugcuccucccaacaguuaccugauagcccagccacuaugagaggggcuucuuggccccuccugacuaucuuuaagcuuuuaccuuucuuacucucuagcccuccuucucugcgcccccccccccccccauguggccauggccugucucucucucuuucuaccuucucuccuucccccuaccuuucuacaauaaagcucuaaaaccauagacugucucuguucaugaaggcccaccauacuugaauaaugggcuaggcuuuuucccaacgagcugcgucuagccucccaccagaaggccauucugugcuucagccauggaccagaccaagcacucucacccgcgugggaacuaucaagugcccucucucccugcccucuccucccuucagccccagggccccuauucuguucucagcuuuuccaagguguccaucgguguaugggaugcccaaagcugggaaccuggugccuaggacugccccuuguccaccacccgccgagcuggggucaguggcuuaacacagccaggcacccagccugggccgcuuggaaaguguacgguaguccucccauguccaccuguccagagcacugaaacucuggcgagacacggguucucucccacucccucauucccccacacccacagcccuggaccaaaugaugugcaacuauagaaaaaaaucaagaauagugacagacuuaguaucauggaucgcuggagagaagaagagugauuaaagcccacuguggaggcucgagugggaauggccccaguuggugaaacuguuugggaaggauuagggaguguggccuuguuggaggagguaugucacugggaguggccauucccauucucuguaauggacacuuuuucuuaccugcugacacacugaucccagcugcuguugacaggccacccagaacuccagucagcuaaacaaggaagaaagucacauuggagguggaagcugaggcuguuuaccuguuucaucucugucuuggcuuuucuugguguugaugacugaggugggcuguagguuucuagagccugagguuucaaaagcccacaccaggcccaggcuaucucucucuccuaccuacccaccuaaaguucucagcuacugcuccagccugucugcuucccaccaugaugacaacagacuaaccccucugauacuguaagccagccccaguuaaacgcauccuuuagaagaguugcuuuggucacggugucucuucacagcaauaggacaauagcacaagccacaccggacuccagucaaacuugguggguguacuggcuaguuuugagucaacuugacacagcuggaguuaucacagaggaaggagcuucaguugaggaaaugcuucuaugagauccaacuguaaggcauuuucucaauuagugaucaagagggaaaggccccuugugggugggaccaucucugggcugauagucuuagguucuauaggagagcagacugagcaagccaggggaagcaagccaauaaagaacaucccuccauggccucugcaucagcuccugcuuccugaccugccugaguuccaguccugacuuccuuuggugaugaacagcaguauggaagugugagccgaauaaacccuuuccuccccaacuuguuucuuggucaugauguuuacacaggaauagaaacccugacugagacaguggguaagcccucaagccccacagggaugucucagaccucucagcaacaacaaggccauggagccuccuggcugggagagcaacagaaaaacuuacuguccuuccuuccuuccuuccagagagugaugcaccacaacagccccacacggaagccugggaggcagagggaugggacuccagaccugagcccacacagcugugcuuuaagcaguaagccaagccaagaauggggaggugaagaggagcuggaacagacccaaggagcgagagcugaagcagcugggccaggaacgacuggggaaccuggaggaagucugggagagguccagguucagcaggccuggauucccaaccacaaagggccagggucacaagggaccucuaguaagccaggaggcaaagcacaugaagacggcagagacccugacagcuggguacagaaugcucacagauuaaaagagggcagaugguaaaaaagcuauaccuca

SEQ ID NO: 8194 - RNA, 4972 nt, Mus musculus
uaauguucaucuucagcucuccgaaggaugcugggcagcaggagaauggagcuggaugccgucuuuauucccgagucagagguggguggauuuaagaacuggcuacacgucugcacguuaaggccaggagaaaaaggcagaggaauuagagaaaacgcuguuuaacaagggucucuuuugaccagggccucugggaaggacucaggaccaggacgaguaauccucuuagcaccgacuuauguguguguacaaaacaggagaguugaaucuggcuaaaacaccucaggaaaacacagagauuuguguucuggucuucacccugcauucaggcgccagagaccggcagaugucugcuuguaaggcucauuuacaaaugcagacugggaguuugggggugagggaggagcugaccccacugucuucagaggugaagggucaggauuuugagccccacaacuuucccuugggguucuuggcaguucuaacccucaccucaugccuuugagguggucccuguggucugauuucuugggggggggguguugacuucaccauaggaugggauugugaggcauagcacaagaaacauaaaauccugaccaacaaaugcaauuggcucuggaggcuggcaugagaagaaaugugccucuaaauucugagcacuuuguuaugggggucacuaugccaugaucagaaaaugcacaaaugguccucacaccacacacauacacaccucacauguacacacacacacacacacacacacacagagacaccacgugcaugcacgcacacacacacacaauaugccacauguguaggcacacacacacacaaaaacacagcauaccaugugcaugcacacacacacacaaacacacacacaccacaugugcaugcacacacacacacauaccacauguacauguacacacacacacacacacaaacacacaccacaugugcaugcacacacacacacauaccacaugugcaugcacacacacacauaccacaugugcaugcacauacacacauaccacaugugcaugcacacacacacacauacacacacauauaccacauguguagucaugugugcacgcgcacacauacauacacauucccccaggcacccacacacauguauguacguguguauacacagguaggcaagcaggaacgcaugcacacauauggacguuauucaucuacggaugcauggcagacaucugcauccugucagucauaaacacacacccugccaugccuccagauuaacuugguacccgcaccuccucccagccaggacugucuagccuuuuuggcaaacgugguccuuuuccugauucuucacacacagacuaucaggccaaaaugucuuuuuugauuuaaccuuaaaccaaaucaagaguugauagggguaaaugaaccaaaagggauugccaaggacgcuucaccuaacgaaaaacagggagugcucuuccuuccaggguggggcuacucacaaucuaaacuguuugcuguugcaacacaaaggagagggcagccagggccagaguggcuccagucagauguaagcugucccucugugaguuggcccuguggucuuuagcuucugggacaggucgugagcuucuagauuguugugguaaguaguuuucugaaaguuuucugucacgacacacuauguuuauuaauuuauuugcacacuuguacacacacacacacacacauguggaggucagaggacaacuugugcaauuugauucuuuucuucuuucuugaguccaggggauugaauuauucagcugucggguuuguguagcaaguccuuuuagucugcugagccaucuuggugucccagugcaggucuuuugaaguuggagaggaucagccugguggugauggggcauaccuuuaacccaaaagagcaggcagaucucugaguucaaggccagccuagacuacagagugaauuccaggacagccaggacuacacaggaaaaaaaauugucucaaacaaaaacaaaacaaaacaaaacaacccccccccaaaaauuaagcaaauaaacaaaucagagaggaucucuguugauguauaguugaugugggagugcugugacauuugcaguguuugugaccuucaggggcuucagacacucaaguccucaugccugcccaacaugccccuuugugucugagccaucuccccaguccagauucucuucgcaugccgacuuugcuuacaaagaaucauacccaaagagguuauggacauagcuagcaaugacagucagcauuugaacucagagacagcuaucgguguuaggcucacacugguauccuuugaagagacugguaacugguaauuuuccuccccuuccuuucauggugaagagacccaacuggacugucucaccccuaagugucuagcuuggagggaagccaugaaaaucuuugaucucugcuagagagacuuuacauucagccaucgcuagggcccaggauccuugagguggcuagacauugcucuucguaucuacagaugggagcugggucagacucuaugcucagggcgcgggacagcaggcccuccaugggaugagaaugacaguguccugcuauguagaacucucagagccaucuucucgcucacuccccagcccuuccucuccucugaggugagcucuucagcuuagagaaagauccacaaacuugaugcucuuuucaugccauaccuagugcucugagggguagggaagccauaaucacagacccaguaccuuuaaagaugacuggaucuaaugcccugugcuaaauccaaggugaggugguuaccaaauugggaucgauacaaucuuauuuuauccucuucagagacaggggucuucuugucuguggccuggguuuagugaaugccuccuggagacuggacugugguggaagggugucuagcuuggagggaagccauacuaagucuggguuagggagcgauagcugccgacauugguuuucaucucucucucugucuucuguagacgagacuggccucacacucagagaucugccugccucugccucccaagugcuagaauucaggcaugugugccaccaucuccaaaaucugugggaaaagucaacuaccauuuugagaagccaugauggacuauggaaagaacauacggugagaaacugaggucugccggccaccacagugguccuggggacaggucuaucucagucuaacugcaggccuaaggcacauugacuguaaccacaggagagaccuuguacccaagagaucaggauaauccccuucagagaaacaaguguuuguuguugaaguugcugcuuugggggacaauuugcuaugcaacaguuacacagcaagugugcuccaucauugaguagcugggagaacaaggacuugaaggaagccacggcucuugucagcacucuuucuaggauauaaaacuucaacuucuucuuccuccuucuccuccuuuguuuauuuauuauuauaaauauauauauauuuuuugagacaggguuuuucuguauagcccuggcuguccuggaacucacucuguagaccaggcuggccucgaacuuagaaauccgccugccucugccuccugagugcugggauuaaaggcaugcgccaccacucccggcuucguuuauuuauuuuauauaaguacauugucuucagauaccagaagagggcauuaguuucuauuacggaugguugugaguccccauguggcugcuggcaauugaacucaggaccuuuggaagagcagucagugcucuuaaccacugagccaucucaccagcaacacugcccccucccccgccccaacaaguaucuuucuuacuaaucaauaauaaccaugugaguaaaaggcucacuuuguuuauuacgagaaggcuauccuaaauuuuuauaccacucaggcuaccuucaaacucaugggaauccuccugucucaacuuuccaagugcugggacuguagguguaagccaucacaacacaucacagguucucuuccugcacagagggaauuuuuuuuuugagacuucauuuuuauuucaugugcauggauguuuuugccuaacugugucuaugcaccgcaagcaugcacuacccacugaggccaugggaaagcauuggauccucuggaacuggauuuacaggcagcugugagcugccauguggguguggggaaccaaauccaggucuucuggaagaacagucagugcucuuaaccacugagacaucucguacagccccaaacagaacaaauuuuauuaagguuuagcuagcuuuuguaaaaacaaaucuuacccuacuuuuuuuuuuagcaagaauauuuuacuaaggaaauuuauuucaaaaauacugcacauuuuaaaucuuuuagaaaacacuuucuuaaaauugcuuagagguggcagggcagugguggcgcacaccuuuaaucccagcacuugggaggcagaggcaggcagauuucugaguucaagaccagccuggucuacagagugaguuccaggacagccagggaaacccugucucgaaaaaaaaaaaaaguuuuuuugcuuagagugcugcuccacugucaagaguggcugucaaccacacacccuagcugugaucccaaacaacucuauaaaccaagcaugacaugguuggugcuuuccuggaagcccagcacuugggaagcaaauucaagaucaaaaauugaagacaucccuaacauguggauguacacaagggugcuacccuugggcacgugcucuuggguucucuaagaaagcaggcugagaaagccaugaggagcaacuguaucuucugcuucaguuccugcccccagguuccugcccuaccuugaguuccugcuuugacuucucucagugaugacccaucgccaggaaguguuagaugaaauaaaguuuuucuucccca

SEQ ID NO: 8195 - RNA, 13957 nt, Mus musculus
gcccuuuguauaccguuuauuguugauccuguacaccaaaucuguuacaagccgcaucuagcaaaggacagauuccccuaaaccugcccagcagggcucacauucuacagaacccugggagccuagaaaucucuaaaugcacugccaagcaacugggacuacuugcggagacugucuaguaagucaagcaugauuguucuagaaggcagagcaaagacagugggaggcaagaacaaucucuccuuaggagaagggcccugacucgguggggcuccacauggaaguuaccugcugcacacucucucagacaacacuaauggcuucccuccugcaaucaucaacagccagauucucuuccacagccagaucuggcucugacuucggagucuggggacagaucuuuaaguaguuuauagcuaagucuaggacacaugcaaggccugcuuccugacucauguuaucauucuguucuucaugcucucccaaggcuggaaccggcuuccacacuuccauuccaccaucucgaugccuguggaaacuguauggcugugggugagaugcuccaagaagccagcuguaacuguacugcgagcuguuuccuacagucuccugaugaaagcccuagacagcccaugaagccucuacagggauuguaaguugggcacugugcagaaaagacucacaaaagauaaugguggaacuaguuuccuaaggugccaagaggguuaggggaagagcuuugaaggacacccaggcccugaacaucuuuaccaugcuaguucugguuggccuuuauuagccuucuagagucaacuguucuccccacucugcacaaggcugggauggcagucuagaaagcacugaacagaugaggcgaguggauugaacucugcacccuaucacagacuucuagggaccacagagcuuuuuccagcccaagaacugagcaaaauggauuaccuuauuggaaaggacccuccacccaguguucugccaacucucucccugacuagaaaaugugauuuugaggaacugugccuucgcucacugccugggagcuccugggcaugucauuagaggacagcuguccucaggccagccuuugagccagugagguacaccacugccauggucaaugucagauguagccuguguuuccagguuaugauuggcaggggacacuggauacuauggaugcuaccucucucuauccuuagcccacugaggaugggcauagcucacaaggagcgccugauaguucugggagcacgguacugugucaagcuuccaucugcuguaaagcaggcccagcuccuucucuucgccccaggaccuaccagcaagccacagccagcagaaccaagcucacacucacucuggggcuggagacaacuuugguucgugugugccaguugcuagagauacuuuacaaacacuuugacgacccagauuggccuuggaaagaugaugucuuuugaccaacaucagcuucccugggccaucgaguguguugguucucacaagcguuccuuaugaaguauucugucggggaccuggacauaguguaaguuccacauugccaagacccagagggguuucugauuugccuuaugagugucaccucagguuggagauagagucacuucacaaaucccugugcuuagcuggggucuuucccucacuuacagagaaaccugaaauucuuuguuuccuguguuguuuuugagggagggucuuucugcauagcccuggccauccuggaacuugcucuguagacaggcuacucuugaacucacuaaagacaugacccaccaugucugcuuauuuugaagcuuuuacuucugcauggauugguguauuagucguccugagaaagcuguguugucuuaucagaacuguuuaaugugcagaaauaguuuguagcaggaaacagagcuaaggcagauauagugugacugucacccaaagagaaaacucuaaacuaaaccacucaguucacaaccagaccccaggcagaaaguucugcagagcaccccauacccucgugugaccuuccagcgugccccgauaucugcugucuguaaacacgcugcacucuagcuacagcugacuaaugcugauggagaauuugaccacaguauagacugauuccugguuuccauuacacuuggucguucagcuggaagaucucaucucuuagcaauuuugcuuccccccaaguggggaacaaaaauuagaaacagauacaggccuagaaugcccauaaaaggauuaguagaggggcugccaaugagcaacacggggcucacugucagggaagaagugcuugcacaggccacugucguuucuaugcuucuggucuggccagcguggcugcuuuuuguccugacugcaccuacaucucuuuuacuccuaacagcugggccuaugcaaaggcuuccuucccauggagagguaggggagguuguaagaauccuuccccagaccauggggaagcuagaaacucuccagcauccccagaaagucccccagaacaagcuuggaguggggagucacuacaauaccauuucuugguaucaugccaaucacacggguaugugugugaugcuucaauacaaaaucagaagaggcaaaggcagcagggugugcaaggaccccaggcagcgggucacauucuucagccacuuucagugagcugauuuuuguguuuugagaacuuagccauuuggcaugauucuauaccaucaagggccaggcucuuugaaggaaagcuugaggcuuuaaacaugcuccucugaaaggcugagcuuggcacagcagaugcugacaauaacacugccuuggaucagauggcacagaugucuuccugucuugcagaacacccuccaaagccagugcagugagcuaaaagauucaaacccucucggagagagaauauagucugucuucagcagcagauaaacaaaagggggaccucucacuggaagagacagagucaagccguggcacaaaaaggagaagcgagaggggaaaaaaaagaaagcagcaucuauaauacuuugaggcacagcugugccagcagagaacuaucucaccaugugagcaggccuugucaucauuaagucuacagagguugggaggggcugggcacggggaagcuuguucuugaaagaagugaggauuuggcagagggccccucagaaaguugccuaggcacugaccgagaaaccccuugguugauugguuucuugcuugcuugcuuuuuuuuuuuuuuaaugaccaauuagauuucucugggaguaaaagguccugaaacaccugcuucucuauagaagauucaggggcacaggacaagauggggcacauuuccccuggggccaccagggccugguuauguggccccagguuuggaaguugaaugaucaccuucucggauccucugaccuccuccuucccccacccuguucgagcuugccucccuagcacucauugggagccuucaucugcaucaggacugccuggcuccucuuuuugcagcagcagcagcagauacaggcagcgagggaacaggccaaagcuaugaugccaaucacaauggcagcaauggccagcccacucugggcaucagucaugccccauguauugcggucaucaauggguucgaugguguuuagaucgguguagucaucaucgguagaccuggugaucucugugguagaagaaauggaugugcugucaggauagcuggauguaucuggguagcuagauacuucagggguuucugggcccuggacacuggguccagggaaauugacauugaugaugacaagggacuggccucggacacuggcuggacuggaacacacuggaagagugucuguccccaaccuggcucuguugagaaugagccagucaugaagugggaggauguuugagucacaucuccagggguugucauagagacgaagcucacacagguucccuaagugaucaaagaugcccagaggcaaguucucuagauuguuguucugcaguuggauggucaugagaccauugacguuggcgaagaugcugccagggagcugucgaaggcgguuauucuggagugagacguuccucagguuggccagugaucggaagacauucccauccagguccuguagagcauugguguggagggacaguucucggagauucgucagcccauugaaggcuccuggggagauguaacugagcugguugugacuaagaaucagaaccugcaacugguucagguggcugaaggcauugucagggagggagguaaugugauuguuguagagccaaagcucccucagguugggcaugggcccaaagacccccggggaaagcuccuucagggaauucccaaagagugugagcuuguuaagguggggcagcugcaugaagaugccagggggcagaugugagaugugguuguuggauagauacagucucuggagguuacgguuauuguggaacaagccaggggagagggugccaaucugguucucuuggagggccagcuccuggagguugccaagugcaucaaaagugcccauggggaugucugaaagccuguucucauauagccgaagcaccuggagguugcccagaugcugaaagacccuaggggauaggugggugaagccguuguugcccagguugaguuuggugagaccuaccagguggucaaagacuccuucggggauguauuccagauuguugccauacaacuggaguuccuuaagauuacuaaacugggagaacugggccggcuggaucugcaccagcugguuauuggacagcaggagggucuccagauuguucacauccuggaagagccuaacgggcagguucuuuaguuuguuguuggcaaggcugaggugacgcagcgagcccagauugcggaaggcaccuggcaugauguuggccagcucguucuucuccaucuucagggcgaugagggcugaaauguugaggaacuuguccucggggaguucggugauguguguguuaaggaucugcaggcucauagcauuccagggcagaggggaaggcaucgccacaauuugugccccugugcacucuaccugggaggcccgggaacagguacauucgcuggggcagccauaguaggccaaaccugcagcccaggccuggcagcucaccagcaaaaggagauaauguuucagcggcauggccugugugagcagagagagaugugagucaccguuaccucaccuacccacaaccuucugcuuccaucgcagcuucgagccccaccuucaugcaccuaacucaaagcucucucuacuuuuggccagagagccccuuccuacuucugcccaagcaaucgccucgccuggaaggcucugcaaguucauucaagucuuccccaugcuucuaggucaaguucaagucccgccaucauuaagaaguuuucuagauuucaucaauggguacuagucacccccuuguacgagugauagcccuaaccccuucuauugccaugaagcagccagccuuaggugacaucuaucugucuccuucccuaguuagcaagcuuuauaaguguguuaaccuuacaauccuauggguugcuaagauuaaaagcuguaucuuuaaaaauaaauuuuaauuaagucugagaauuuaauaaauguguacauuguauuucaaucauacucacuccucccuccagcccuccaccccuccuccaaaucccuccaggaucuacccuuaccucuccacccacuccaucccaauucaugucauauauguaugugugugugcauguauauauguauauacuuauguauauguguguuaauguauauauacauguguguguguguguguguguguguauucacugaguccuauuugugcugucauauacacaugggugcauguaugcuccacccacuggagcauagucuaccuaccaggggccacacuguuaaauaaaacuuccugucucucccuuagcaccaccaguuuucaaguagcugcucagcuagggguagaggcucauagcucauaagccccucccccaugcaugcuggaauguugucuggcuuaaugcagggcaagucuuaugcaggcagccacaguuguagugaaccccccuaugugugucucuuacaaucucucugucccuucuucaaugaugcucccugaagaacugggucuuauaccuccucuagcucucagcacaugggaagauguucaggcuaaagggaggggcagugaaggacaaacaagggaggggacagugaggacaaacaaauaucucucuguaccccucucuugcccuccccaccagcccauggccaccaucaccacccuguccauaugugcuuccucuggauuaaauccaagccauccuccaauaagaagccacugucugcaccacgcucugucugucuggaagaggugacagggccucagccgaugccaagggugugacuuguggcgugagucccgguucccacaaagagacacuggguggccuggaguaaguagcugaaaacguagacacacuuuaagcugaaggguauaaaugaguccagcugucuccucagacaaaggagcugaaaacacagaagaccuggcgugugaagucaccuacggcaacgauaaauacagaaccgcgggcauuguucccuauguggauauuuaagguaauguuuggccuugaaugagaguccucaggucucugucuucagcuuccucaucugcuaagacgacucuucucucuugaggcugucauguggguuagacaggaaaauagacuccaaggcauccugcgcguggcuauaucagugcauggcccuguuccaggauuacccauagcaugcacucauagguccccaaagacaggaaguccucaacaugucuuuagucuggcauucucagucaagggacgaaggauuucuauguacaggcaugaguguucaugaucucugcccacaauugagccugaguaacacccaggcccuacggaguugccaccucucgugauuuuauagggaagcaggaagcagaaaaacugaggccuuagucuuaagguucgagucuccaggcugugaggugaggacuuugaguggugugcagucccucgcauaaggggugaaguugccgaguaaaggcagggggucagcaggcagucaaggcacccacuggggauggggcacucuacaccuucucuagcuacccugagaucaugggguccugagccugguccuucaacccugccugggcucuuuucaccccuccucuauccccugacaaacaagcagcucagagacucuaccugucucccacccacccacaccucagcuuuucauuuauucauagcccuucuuagcccuggccuguugcgcauucaugaaggacuugccuaaguauauauaacuguggaggaagagaaaagagcaccaugcccaccacuccagucccguggcaaaagaacaggagacaggcaaagccgaggaccacauuuaaacagcgagucagguccagaugcagagaaaacagccaugcagagucaggcauagcgggcuugugacuguaaugauuacuugugaggcugaggcaagaggauucuugcaaguaugaggcuagccugaguuacagagugagaccuugcucccgcccccaaaguugagguggaaaaaaaaaaagagucugggcacagagaguuugguggcuccaguguugggugacagguggauccugggagcuugcuagcuagccagcugaccuagcugaguggaagaguucuagguuccaugagagacuuuaucucaaaaaccaaggugguauacaacgaggaagaccgcugaaguugaccucuggccuccaugugugcaucccacagguacaaggaagggcacaucccggaaaaacacaugcacgcaaggagagcccagggggaaaaaauggcuccauguccaaaauguaaggcuucugauuggugguaacaaagaaacaaccaugauacagaagcuaaugugauaugaagcgugggggcagggaggugacagccugacucuacacuccccuggccaggccacauccuucuguguccugcucagcucuacucugaacuugaaggccaaugacaaacugguuucucaaagagcuccuagaagauggugagagggcaaagagaccugagcauccuuaggugcugcagaugaauagucaggagaaucaacagagaauccagagaccuuuccagagggugaaaaaccaccaugggauaaugaugcaacacagauccagaggccagcacuagcgggccagggucaggguauugcagaguucagugcacgcuuggcgugcacagucucccagaggcagcaagcuccgaguucaaacacagcugagcacuuuuaaaguaaugagaugagucccagugagacugagcagucaggacucgcauccauccccucgauagguguguacgagacagcaccccuggcugaggcuccgcugcuccuggugcugucugaaauccuuauuuuucauaaaugcuaauuugcucaguuccgaggaugacgucaaagcccaagugauggagagcgauuccgugcccaucaccuguugucucuuccuguaagaaggagcucccuugagcaccaucucccagcuacacagggguaucaggccagcccugugaagauucugaguucuggcagggcacuuugaagcaugggguggggggguagggguuggggguguggaagaccaaagugauaacuccccaugggaacaggcauuguagucuaaaauggaccacacucagcacaacaaauauuguaauaauuccccaacaucuuuuuauaaauccucccugucugcugagcccacccaaugcugcaugcagcuguuuccuguuuuccaguggucuuugcagcuggugccccacccccaccccugccugcuccugaccacggggaggagcaccacaaaggugcuccaguucugcaaggagggagcacccaaagcagcccugggaugaggccuugaacuccuggcagugcugcaggccacggcccucagccuccagagccggcauaggguggcauaauagcccacgcugcccagggccgcuugguagccgugacaauggcaguaaaaggcccucaaagcugcccuaauuauagcuuucuccucaaggcauagaguagcguccucaaucauggcaaccaaccgcuggggagagggcacaccuggcgacagucauauccacacagucagagaacuggcagagagacagaaggacagauggcuccccuggacguggacgcggccccuccccaagaguggaaacgcuugaacaagggcuccggcugugggucucuuugcagaaacacccugugacucacaggugaauggguaauuagccuugaagcccugggcuuugcugguugggagcuggggcucucuuggauuagucccaucauucauguuaacuaaacaguguucccuggaaagagacuccucauuucaaugccaccgagacucuugagagggccauggagagagacccuuacucuacucuggccuugacauuaacaaccugaguuuaggugaauucugccugccucgguuuucccuuccguaaacgcuuccgaugcccuuauagcacuagggugcuucagcuggaggcaagggaagcuggggggaaggcucaccuuucucccauccucucucccucacgaagagccaccuggcuaggccucacuugcacgccaaggcuugaaaaccacacuuccucaagccugcuugcuuaaaacguuucccuggcagggaaaucccaugaguuaaucguucuaucuucacacagaccaagacccgaggagcuuaaauggccucuccugcccuucccagugcaucugagagaacuaagacccucaaagaagaucuccccccauaccugugacacuccaagaauggcuuccuaagcaaggccucuucucaagugagauggaccccaggccacccaagagaggccaggcuugguacugccuccccacucccaccuaggacuguccccaucuuggcugcuccuuggggcacagucaaagagaagugaggucagagaggcuaaacacagauggaauucagaccucagugucuacaucuuguuucucucucacacacacacacagacacucacacaugaucuaucacacauacucacauacacuugcacucucucacauacacacauuaacacauacaaacucacacacauucacacucacacacauucacacagacacucacacauacucuaucauacacauacaugcucauguagacauaaacucucucucacacacauacacacacuaauacauacaaacucucacccacucacacacagacacucacacacacacagacacucacacaugaucuaucauacauacucacauacacauaaacuuucucauacauacauacauacacacacaacaacacauacaaacucucucucacacacacacacacacgcacacucacacagacacucauacacucacacacagacacauacacucuaucauacacacacucacacacacacucacauacauauaaacucucucacacauacaacacuaacagauauaaacucucucuuacacacacacacacacacacacacacacacacacacacgcacacuggucugagaaccuuguugacuagaucugaugucuuagcaccgcugcugggucugugaagugaccuaaugcaugcaauauacggagacugguucugggaacaaaguggcuuuccauaaaagcaaggggcuauuauuacugcuuuguuguugagcaaaauuggcucucuggaggcuccacccacagaacuccuaacuucuagguugggcugaggguuagacucacacacaguagggacucccuauucaaguguccacagaccacacucagaaguaccucacaugugauccagacuacccgggaacccuuggucacauccugugucauuucccaccaagaacagagaagcaaugggaaaacaggaggcugacggcugcuucaccucuaggugcaucucugaguuugccucucucaacugcaauuugcagauagcucuacuugagccuauaagcugcucccagauacaguuuauggaguccaggacaccacggguacaagacccuuuugaagucaucucccuggaccauuuggcuguuuuguagaucagaaauugauggguccugagagaggaggggucacacaggcaacuugaagacucaagggccugguggaccucugaaccucaucauaacgcuacuacagagcuaugucucaggcaguagguggggggagggggaggagccagccuugccccuccccuagccugauuggcucauguaaucacccuccaccuacccagcauuauuagcuacacccaaguugggcccccaacucauucugcaggcaacuuuauccucugaggcugcccugaugguguguuguuuagcgucacgggaguaagcuggaagaagggagagaagguucagaggggguggggggaggggcaccaggaggguugagccuggaaaacacagcccaugacuugggacuucucuacuccagacacaaagcacccuuaaaucccuggacaggaccuucacagccucauccuccccggggccuucaaaaauccuuguuuugcuuuuuaaaauaagaaaagagcagccccuccccaggcccucugugggaacccucccaagccuggggcaagccuagcccggcuuccugcagaggccagagcagggcuguaauuugcuuccaagagcuauaagaguuguaacugcccagcacaacagcaggaguugugucugaaguggggacuuucauaagaagccagagucucuuuugaaacucagucuacagagaccacuucucaguggagcaccuuaggucugagagggaaaugguauggucucuguuuagccccgugcuccacagccgaggcaggcacuggaaccugcagcuucagggguucuucugaagucuggaggcagggaggcaaauugucaucuguaaucacagccuuggcguguucgcuggcaggacaagcccugggcagugcgucucccaucucucucucucaucucugcacaucuggaucuacuuccacuucaggcuucacauccuccauugacagagcuaaucuggguaguguccccaagccccgggaggaaccuuccuauacuugcuguggggucuucucagagcucuuccuggccacgacccucucaacaugccuucccugucacaguuguugcugagcccagcagcugacucaugaccacaggcaaauugaacugucugguccugaaucuacuccagauguucaggcgaugcagaaaaagagaccugcuuaaggaauuuccaagucacagagcagggacacccacacauccgagagcugccugcaauggguagugccagcuagaaaucccuggcaggcaaugcucagcaccuugaguucuuguguuaucucagcagucacggucugcccuaggguagugcauuuggcccuaaagguagagccgcucagguuggagggucccgaaggcucuccuuuuccacagcucacuccucuucauuuugggcagagacacagauaaggggugagauuaaaacccacccaguuugugcgugguaguauaugccuuuaauccuagcacuugggaaguaggguaagaggaucucugugaguuuggggccagccuggucuacauagugggacccugucuuaaaaccaaacaaaacaaacucaccuagucagcugugguuauagcuaaguaguagacugcuuguuuagcaugcuugagauccugaguuugauccucagcaccaaaauacauacaaauaaacauacauacauacauacauacauacauacauacauacauacauaccgacaccugauuuuuuuucuugguuuuucgagacaggguuucucuguauagcccuggcuguccuggaacucacuuuguagaccaggcuggccuugaacucagaaaucugccugccucugccuccuaaaugcugggauuaaaggcgugcgccaccacgaccagcgagacaccugauucuuaucacaaaccuaccuccagcaucucccucccaaaggcaucagcccuggacccugugacacaucuagaugaucagaaugggaucaucuaagcuacacacagaguuagaaccuggacacuuaaaacuucaacuggguuccaaauuggcacuccugacuagagacugcauauccgccugaguccagcaguauaaauguaacacuguaaaucuaccacaaguagagggccgauuucucccaggcagaaaccuugugaguucaccauccuggacagaucuauaugcagaguccccuuuaaguggcuaccucuguaggcucaauggaaaugauacagguuccaacagccagaaccuuagagaaacuccugcccuuguggaucuggucucccggaguagguaaaccgggugcuucaguuaacuuucaaccaauuuccugcaggucaaaagcucuccccgcugcacuccaggcucacuucacagaccauaaagucaaggaaagcgaaacagggcaucaagauucacagcuagacacuaggaccggcucacccagcuccugcgcgggcuggaccaguccagguccucagagcaucccaggcacgcgccagcccugcuccuuguagagucucgggauccuaucgucaaccgggauguggggcgcggccgggauggggggugggcgggcacccacuuaccagcagcuccacgaggcugccgggucaauaagaaggaggcggcgaggagaggaggcggaggaccggaccggcucaagacugcagcaugag

SEQ ID NO: 8196 - RNA, 1620 nt, Mus musculus
ggaagcaaacccaggaugucuguguuccugcagguccucugugaguaaacacagucuuugguuugauguggagacaggguugggggaggggcagcauacauacacacagcaauuugaaaggaauggaaagaaaugagaaggaagggccuagagcugguagcacuugccaguaaugucagcauuugagguugagggaugcugggaguggagccaggaagacuagguuugaggucagccugugaacucaucuuaaaaaaaaaaaagguguguguguggguggguguuuguguguguauguuuguguguuuguguguggggguguuugugugugcggguguuuguguguguguguguguggggggguguuuguguguguguguggggggguguuugugugugugugccuguguguguguguguguuuguguguuuguguguguggguguuuguguguguguauguuuguguguuugugugugugugucuaugugggugugugugugcacccugguuuccuugccaugguuuggagauacgcugcugcugggcccaguggccgugucugaugggaaagcacacagacacaaacuguuguucuguuuuaguggaacuggcuuuugggcgugccucauggauuucuggcgauuuuauuuucaauucagagaggcugcggcuuucaucgggagcccacagcacuucucucucagcagugugacuguccacccguguggguaaagaagauguugcaagggacacaggcaggcauccaguuuucaucucgacagucuccagucaaguugcaaugguaguaccugacugcaggcugggcuggccuuagcuacuacacugggaaccuuggcggcgggagggggggggggcgcggcaccgacccauccuugaggcaguuauggaauuccagguauuuucucuuccaacauuacaauccuagggcuauaucuagaaggcagguugacgugcuuggggucccaguuacccaaaagucauuucucgucagucuuuuuccccuucuccaucccuuagacaacgugaaagggugugcgugagucccacugucuccuccacgcaagcgcaguuuaucgcaaagugacgucagcacgggcuaucccagagcugaggggccaucucagucaccgcugaacgucaacauccauggcagagugcaucagguucugccgacaaugaaggcaacaggagacugagcgguaacgaaucaaacgacaggagcuagggaagaccugggaucaucugugggaaugacacggacagagcagacgcgguucaacacugacgcuucugacaaauuauuugcugugagggccaacuccaagcagccuucauuagcagcauauuaacacuucccgguguaaauccggaugcuugauccuuguggcagccgaaggcuacagaaacaacgcuugagcauuuguucugagccaggcuuuguuugagggggucuuacagauaccgccauauuuaauccucaucacgguccucggaaguuaaucuccaccaagcagaaaagccaccuaagguucaaagaggcgaauugcuuguacaaagcaaacaggccuggcuuccagcuggagaagcugccgagag

SEQ ID NO: 8197 - RNA, 1620 nt, Mus musculus
cucucggcagcuucuccagcuggaagccaggccuguuugcuuuguacaagcaauucgccucuuugaaccuuagguggcuuuucugcuugguggagauuaacuuccgaggaccgugaugaggauuaaauauggcgguaucuguaagacccccucaaacaaagccuggcucagaacaaaugcucaagcguuguuucuguagccuucggcugccacaaggaucaagcauccggauuuacaccgggaaguguuaauaugcugcuaaugaaggcugcuuggaguuggcccucacagcaaauaauuugucagaagcgucaguguugaaccgcgucugcucuguccgugucauucccacagaugaucccaggucuucccuagcuccugucguuugauucguuaccgcucagucuccuguugccuucauugucggcagaaccugaugcacucugccauggauguugacguucagcggugacugagauggccccucagcucugggauagcccgugcugacgucacuuugcgauaaacugcgcuugcguggaggagacagugggacucacgcacacccuuucacguugucuaagggauggagaaggggaaaaagacugacgagaaaugacuuuuggguaacugggaccccaagcacgucaaccugccuucuagauauagcccuaggauuguaauguuggaagagaaaauaccuggaauuccauaacugccucaaggaugggucggugccgcgcccccccccccucccgccgccaagguucccaguguaguagcuaaggccagcccagccugcagucagguacuaccauugcaacuugacuggagacugucgagaugaaaacuggaugccugccugugucccuugcaacaucuucuuuacccacacggguggacagucacacugcugagagagaagugcugugggcucccgaugaaagccgcagccucucugaauugaaaauaaaaucgccagaaauccaugaggcacgcccaaaagccaguuccacuaaaacagaacaacaguuugugucugugugcuuucccaucagacacggccacugggcccagcagcagcguaucuccaaaccauggcaaggaaaccagggugcacacacacacccacauagacacacacacacaaacacacaaacauacacacacacaaacacccacacacacaaacacacaaacacacacacacacacaggcacacacacacaaacacccccccacacacacacacaaacacccccccacacacacacacacacaaacacccgcacacacaaacacccccacacacaaacacacaaacauacacacacaaacacccacccacacacacaccuuuuuuuuuuuuaagaugaguucacaggcugaccucaaaccuagucuuccuggcuccacucccagcaucccucaaccucaaaugcugacauuacuggcaagugcuaccagcucuaggcccuuccuucucauuucuuuccauuccuuucaaauugcuguguguauguaugcugccccucccccaacccugucuccacaucaaaccaaagacuguguuuacucacagaggaccugcaggaacacagacauccuggguuugcuucc

SEQ ID NO: 8198 - RNA, 18619 nt, Mus musculus
cacaaacaauaucucauuguuucuuccucagggagcagcugugaaggaaacuaagugaggggacagacacagcaucccaucuuugugccccacacagagcucagcuuugaggccaguuucccccaagcugugguggguguggcaugccugacuaucaaagggcaagggccugaugggagccuauaaagugacuugggagaagccacacaccucacuuggaggauucuggguggaaacuucagucaucugaucugagagguacguucauaguuggagcuugcacuugggguaaccgauggguaaagcagagaccacccugauucccacugucuucauuucaguuagaaacugacagugagcaccaacugaaggcuuuuacaggcuccaucucauuuuccucagacuucuaagguaaguguuauuggaacccguuuucaggugauuagguggaggggguggcuaagccuaugcuugcccugauggcugcuucugcuccacaccccuccccccuaucaaaaggagaccaugagaacauugccuguguggcaagacagcaccagaugaguuuucuagugugacucaacugcaccuggcaguaagaucaaccaaaaacuggaauuauuugugugauuagaguacugaacagcuggacacaaaacgguuuuguuuagcauacguguuuggcuuagccuagugguguaauccuuuaacccuggcacuggagaagcagagauccccacuguaggacagccugaacuagauagcaggcuugaggacagaggaccauguagaaaaaaagaaagaaauuaaaaggauaugguuccuguucauucaaaggcuacauguauuuguuugcuuuuaaaaucuauucacccaugcaaacauuuugcuuugccaugggacaucugcuuaauauucuugagcuuagggacuguagcuaaagugacacacgugcucuuggagaccuuaacagagaacagggucaauuucagcacagguggcuuccagaugugagcuccgaugcagugcacacaauagguacucagaccagcacuucccaaggagaagcccagugugcuugacccucagugugccugcaauucagguagugccugguccaggaugcaccaguuuuggaagaauuaccuuuaaguuauuugguaguuaguuaaaauuauaguuaagcuuauuuuuugaaaaguaaauucaccucgaugaucuuccuaugauauuagaagauaggaaaugauauguccuaaagcaccuaucuuuuucucagaguuguacauauacaucaauagcauguucugucagugaguguuaagugaauccaauuggacagaacauggaaaacaugcuccccucugaaggacuuucagcuauaggaagaaaacucaaagcauccagacggugucucuggaagccaugcaggcaaggggaguuagccuuguucugaauccucccacagagcccaagggugugcuucagcucacaugagaacaucuuguaaugagacguuugucggaguuagacaugggcugacugguugucgcuggugcauggugagacagagcucaccaggucucacaggcaggcauuuucugaaaggcaccaagauggaugcaggugggaacauggcagagaggcucuggguggacagcuggcccugucauaguccaguucccuuccaggccucaguuucuccaucugcacaccuggcaggagcuugagggagagcugaauagaugaccuuuaugguccugcccauuucugaaaugcaguagaaugcauauacucuaugccacccacccuuuaaaguucagugugugggaaaggcuauuggcuuaggccuguuggguagagcuacagagauuccaagagcccuugaaaaugggugcaaaguuuuuaugaguuuaggcgaagcuucuacaaacacuccaccuuccaaaaugucaaaagacagguguuguuuauaugaugauggaaggaaggaggccucuaggacuaaagaugguggucccaccacagauuugcuccagagaacuucagcagccacccccuccccaacccgccccagcuggcagcucucgcuccuuacauaacuguucuuguugaaaaccaggcaacaaaaccuucaggaagaaaaggcuauugauuauuaaaguuauuuggagguucagagacucauaauaaagugguuauaauuguuccuguuaugacacauccuuugaaaugcucagaucugagaacacuuugcuugcauugacucagucaucacaggcagaaaggcagcgagcuggaaauagcucaugugcggugagaggcaaggaggcacaaaaggggaacagagggaaggcaagucagggagaaaggcagagaggagcccaaggucuccauccauagccugaacugacugaccgccaucucacuccccuguccacuccccuccccaggguuguggccaccagaggacuuguguauggaaauaaaguuggaccuacacaucagcugaccgcucuucuccaguuaaaugcacauccucuaugcaaagcacccucagcaaacggggaaaacauuugggaaaugcaauccugauucugcuuuucaaaauagcaaugcuaauguuuagcugggcaagguagcaugugucuuuaauucccagcacacgggaggcagagacaggaagaucgcugugaguucaagaccacuucagucuacaaagcauguugucuagccaggacuaauggugagacaaaauaaacaaacaaacaaaaaucuaauauuuacugagcucggugucagaugcuacucugaacauuccuguuuucucucuuuuuuggcgggggugucuucuuaugucacuggagcuggucuggaauugguggacuccagugucgucccaccuaggccucccuaguagcccccuucaccagcaccucugccucuauuuuauccugcuucauuuucacaaagauucaugagauaggcaugacucuuaguccuacuuuauaggcuaaggagcaacagcccacuuugcacaguuacacuuaguaggugacagagccagaguuggaacucuagcugaacaacgcuugggucccuccucccccaccccaccuuaugcugcuuggcuuggccugacaauaagacaauggcggacagcccaguaagacaauggcaaggauaaaaugugaggcucuggggagccuucccugauggacaccauuuuuccauucacgaaccuuuugacuuuucagugccccucuuugccuauuccccacauacagacuacuuuuauuccagaaaccagucucuccugagccuggcauuuccaagggaugguucugaggagaaucagacaggauucccacucuggagaaauaugcaauggggcaggggaggggguggauccaugaaggaagcuaauccaacaagagaugcuugaaaagagguaucaaggcucugaggcgauggccuuacagcugcugggcagccaggcuggcagcggcugccggaugcagcuccucggugcugaggagaauuccaacugaauaacauaguccauaagggcucuccaucacugugugucgucagucacugugucauccggagacccagacaccgccauuugcauuuucuccccaggccucuccugcagccaccccaccccaagauggugaccaugcugauguuccuggccacgcuggcgggucucuucaccacagccaaaggacaaaauuuccaucuugggaaaugcccgucuccuccugugcaagagaauuuugacgugaaaaaggugagguaacucaaacgcccccuguguuuugagcaugcuaagagguucgauuuauucuuuuugaaucuccaaagcaaaucucuucccacucggggaagugcaggggucucugcaggcaucagggacagcugagaaacagcugcaugaggugagaagaaaguccaguacuaugugacucaguagcuccugcaaacuucuagagucugacacuaggcaguuuaauuuaggcauaucuaaauacggcauaauuuugggggggauuuuuuugguguaacacaauccccuguguacaugggggcauaaugacacugaagcucucucaaagcacaugucacuucuuccauaaagguggguucuguggcuaggcuacauguguuuucauaagggccuaggggagaaucugggguggucuuggucauacagauagcauagaggucagcuacuaauuccuuccagucuugguugugggagcuugggagaagcgaguuauagcuuggcucuacagauagcacaggguuaccugggcaaucagccacuuccauucccagccuucuggguaggaaacagguuauacaucucuucccuugaagagacaacccuggguguuuaaaauucccagcuacccuagugcuaucugugaguucaaggaccuuugcucccaacagggacagcguuuuuuaucuuacguucgguuuucccugaaucagucugugaggcuugaaagggaguaagggaagucuuuggugccucagcuugucccauagauggaugccaacaggccaugagagcucccauggcccugguaggggagagcacagggugauaagagcugucagugucugggaauggccuccuacagcuauggggagaugagagugacugggggugugaguaggggcugauucacuacuauugucccacagagacagaagcugggugucccucaggugacauagcuagaacaugaacauaggguucaaaacuaggcuuccuaucaauacagagcgcucaagacaggaccuaggaaaagccagaagucccccaggggugcuuucuuguuaccuacaauauaaccagcuccccauaaaugaugugucuuccuggaaucaggcaaagauggcagcagaaagggacagcuauuagaugucagaacucagcagcucuacggcuagggauggccuggacucuaaucccagggcccauucuccucuaaagguuuuaauugcuuuuaggaagcagcacaguugguuugaaaaacacugaaauuaucaaucacuggaacuuuagagugagcgucagggauguuagaggguggguuaggcaaagcagagaggagagagcuuagggacucuuagagaaggguggaaagagggugggcagugccccaggggaggaaggagaagccacacacuacggccugcacugacguucuucauuaauguuuaaaggauucccuuuaguugaguaagcaagggaaaaucacaaaccaacaaucaaccaacuuaccaaacaaacaauaacuucaugagugggaaauuugauuuagauuuuaauuuagaaguaaaaauuccgaaauaucuuggaaauuacaacuggaaucugcacuuaaagaaguccuuuggggacugaagaagauuguuuucuuuaauaugugucugugucugugugcacaugugcauaggugcccagggggagaguguugggucuuccagagcugcaguuacaaguagcuguaagcuguccaauauauauucugggacuccaacucuaguccucuuccaaagcagcaagcacucuuaacugcagagcccgucucuccagcccuaaaacagaauaaaaaaauuauugagauuaguuuauauaucauauuacuggcuuguucaaaaagauucuuuuauuucaaggauuuuuaauauauucacuguuaugcaaccaucauuaaaucaguuuuagaacauuuuuauuaucucaagaagaaaccacaagccuacuaacagucucuccaccugcacugcucagacuuuucaucgcugugacaaaugccugaaagagacaacuugaaagaggggagaucuauuccggccccugguuucagugccuucaguccaggguucauaugguucacaggcugauggggaggcagaacaucuuaagauguacggcacagaaggcggcuuagcuaaagauagccagugaguggagagggagaagcgagaucauguaacgauauaucucucccacgcauguuuucacuggccugcuuucccuaacuagacccucauauuuucaccaccucucaauauaucauauugugaauccaucaagggauucaucuauugauuaggucagagcccucagaagccaauuacuucuuuaaagucccaccucugaacucuggucgcaucaggaccaagcuucacauccaaaccagaacaccuccacagcuauggggagaugagggggaaggaggauguggguagggcauuaaccauggcugauucacuacuguugucccacagagacagaaacugggugucccucaggugacauagcuagaacaugcacauaggguucaaaacuaggcuuccuaucaauacagagagcucaagacaggaccuaggaaaagccagaagucccccaggggugcuuucuuguuaccuacaauauaaccagcuccccauaaaugaugugucuuccuggaaucaggcaaagguguuagcagaaagggacagcuauuagaugucagaacucagcagcucuacggcuagggauggccuagacucuaauccaaaauuuuacuuucugucaauaugaauuuguccaugaaauacacaauauuggccuuuugugacugagggucugucuucaugugugucaaaaauaggaaucagauaccacuacagaugguugugagccaccaugcaguugcugggaauugaauucaggaucucuggaagagcagccagugcucuuaacugcugagccacucugaagucuuacaaacagccccugacucuaauuucucugcaucuccucuagcgguuguuaccauguuuucuuuuauugcaggcuucauggugaugguaaaugacaucaucuccauuuccuaauggcuccugguguugaaugucuuuucucacgcuugugagccauguguaaaucucccauucaaaucuuugccuuuaagaaaauggguuguuuaucuuuuaauuauugauacccacauguucuuccucuaagcuagauacaaaucucuucucacauauuuuaaacuauuuucucucauuugguggaauuuuuuuccuuuagagauauacccuuugaaacaugaaguuauuuuuuguuuuuguguuuuaaauacugaucaagucuaaguuguccauguuuucugauguugcuuguucuucuggugucaggcauacaaacuuaaguacgcgaugaguaaauaucucacuaguguaguagauaacagucucauaccuagagauccagagccuaaucuaagacaguaaugauuuacacauaucuguucucagaacauucauuuuaaguuaaagauuguguccuagaaggauccaacuccauuuaaaugugacuuuucaguugucccagcaucauuuguuuaaaagaucgauugucugaugguagucuugauauccauagugaaaaucaauugaccaugaucaugggguuuuauuuucaauauuccaauucuauuauauuaauaugucuauacauaauuucagcuuugauuacuacaaauuugucccaaguuuuuaaucuuaggguuuccauugcuuuaaagagacacuaugaccaagacaacucuuauaaaggacaacacugaauuggggcuggcuuacagguucugagguucaguccauuaucaucaugguggaaagcauggcagcauccagacaggcauggugcuggggauuuaagagaucaauaucuuguuccuaaggcagccaagagaagacuacugucuuucagguagcuaggcggaggguuucaaagccuacccccacagugacacacuuccuccaacaaggccacaccuacuucaaggccacaacuccuaauagugccacucccugggacaagcguauucaaaucaccacagguuugaaucaaaauguaggaguccuucagcuuuauucuucuaacucuucuguguuccuugcauuuuccuaugaauuuuaugaucaguuuguccauuucugcagagaauauaaagaaaaauugaaggauauugccaucuuaacccuucuuguccagaaguagaaacuaucuauuuacuuucuguuuaccuucuugucuuaccaauauuuuuuaguuuucaaaauguuucuacaugucuuuagccaaauuuguuacuaauuauuuuuauucuuuuuauguuauuauuaauggaauuucuuaauuuuauuggcagauuuuuuccucacauguauagaaauacuuuuguauauugaucuugcaucuuuuaaauuugcagaacauuauuucaauguguguguguguuaagaucccuuaggaaggcugaauuuauaguucaguugguagaaugcuuacauacagugcacaaaaucagguuugauuccuguuaccaaauaaacuaaucguggccagacacaucucuaccauuagauaagggcaagugaaggcaagacaaucagcucaaagcaacucaaaaacaguuccuuaggacuuucuguauggaagaauauaauaucaucuacaaauaaaagugaauuggccucuuuuccaguuuucuucuuuagacauugaguuguccuccuauagaggcuucacuaagagagauuuacagaggaacaugggaucgugaggaaacagagcaggccacccucucaccucugaguuuccucguuucuggaaagucauacuucuugcuaacuguggaucacuaaggucccaugaauaguuaagaacucuucuaaacauauuauaagacagaaauuuuucugagcaugccuacgaaaccuguuagccucagucuuugguacuuucaaugaaggucacauuugauuuuguuguuguuguugucaguuuuuuguuuuguuuucuucugaggcagguucucuauguagcccagguuggccuugaacugucuaugugucuaaugcugacuugaauuccugauuuuccugcuuugugcacaucccaaguuuuggguuucgaggccucugcuaaguuucaguguuuuuaagugacaguuggagcuuacugaaaggauggggacaggguggucaaagaugugggugugugcuugggcagucacgugacagaaacgguacugucacuuucaggaugcuucugaggguuuggcaguaaaugcuugcuuuacuugcucuguugggugacagauuuucaaaucuguaaaacaaacauaauuaauauuuugacuagggagauacacucacauaguuuaaaaugcugauggugcaaaaaaaaaaaaagccaaaacaacaaaaacaaaacaaaacaaaaccuaugcacauagcucagugauagcauagcucagugacagcauaucugccuagcguaaagucuuuguuccaucccuagaaccaugcagaguggggguggggcagacaaaucccaaaccccacagguccaacagagcauucagugaaguuuccuuuagucucccuaguuuccuaucccaggagcggccaguaaaaacaacauacuguauaucuuuuuuuagacaauguauacacauauaagacugugauagccaaaauaaaagcuuccagauguccauggccuguuuucuaaccugugaacauacgaccuuccaaagaauaaagggauucuauagaggugaccugagauggccagauuagccugguuauccaaguggauccaacuuaaucacauaaaaaaauuguuagaaacagaaaaucuuuccaagcuguggucagagagagagguuugaugaaggaaugagagucagagaggugcaguggagguguugccaagggucugcuuggcguuagaugaccuuaaauauggagaacucucggguccagaaagcagguggccuguguaacacaaggaaacagagacacccacucucccucagagccucugggaagggaggaagcccaaauuucaguuuuagccucgugacguuaggaucagaggcugacauauaaaaccauaaauuaauaaaucuaugcugguuaaagcuuauggcucaucacaguagcaacagaaagcccauacaauaagcuuuuccuuguuacaucaaaggcagcuuaagcauauaucucacuucagaccugacucuuugcucuuuauucuuuuuuuuuucccccaagacaggguuucucuguguagcccuggcuguccuggaacucacucuguagaccaagcuggccucaaacucagagauccgccugccucugccucccaagugcugggauuaaaggcguguaccaccacugccuggcugcucuuuauucuuuaaaaaaaauuuuuuuuuaauuuauuuacuuuacaucccaaucacagccccucuccuuccucucugucccguccugccuucuuucuccuuuuccucccucccccucucuaaggagaagggagaguacccaccaccaaccuacccuggcacaucaagucucaucacugaggccagacaaggcaucucagcuagggaaagggagccaaaggcaggcaacagaguucaagacagagacagccucuccaccccuaauucaaccccugacacuauuaauguucuuuauucuuuagauaaccuuugagauaauugcauauaacuuuuuaacaggagguguauaagaugucaucagagagauacacuaucauguauuuccccaacuccucucuagauuguuuccugccuuuuauuguuacagacagaccugcaacaaauaaccuuauacuuacacaccauuucuuuacaacaggagaacauucccagaaaucaaauugcuggccuaagagaacguguauuuuuaguuuugcucaauauuuccaaacugcccucugcggagguuauggauugguacaguaacuaacuccaaacagaagugccccacagucagcaugucugaguuacacaaaagucaaaaugccccguagaguuaucagcuguuggagggagaagguauucuccaucgaccacacaaaccuuuccuuucacagaggcuggaauuucacacgaguucugacuaaagagaacucugagaacauauccaaauaacgagccccuuaggaauagaacgugacauacaaucauugcccgcacauccgcaucauuuauucucauuugaaacaguaucuugccuaguugucugggaaugaugcugcaguccauuuggccugguuuccccuggaaagggcucugcuucuaaggcaacaauggagacgagucagcaaggucccuagagagcccuuggguuuugccucugcuuguuguugucugugcaguaucuuggaagaugguacgaaauugagaagaucccagcgagcuuugagaaaggaaacugcauucaagccaacuacucgcugauggagaacggaaacaucgaagugcuaaacaaggagcugaggugagugcgcaugccugcccggauggccuuguuuugugcucccagcaggcaggggcacggagagggugugagcuacucaaacuaggcaggaugauccggaugcauguguucccuuuaaccacugcugagcaccuacugaauaccagacacugagagaggcaauagcgagucgagaauaccagucagcgccccugcucucuuucuaagauggagacucuuguagccuggccucuaaacugagagagaaacccuuucuguccaucuacucacagagagcaucaaguuuugccaaauacuucugugaacugggggcucaaccugucccguggcaauuuguucaccuccagccagcuucccuguuaggaaccccgcccccuucuuuucuuuuuucuuuuuuuuuuuuuuuaaauauuuauuuauuuauuauauguaaguacacugcagcugucuucagacacaccagucagaucuccuuaaggaugguugugagccaccaugugguugcugggacuugaacucaggaccuucagaagagcagucgggugcucuuacccgcugagccaucucaccagccccccuucuuuucuuauuuugagacaggaucguguguagcccaggcuggcuuccaacauacuguauagccaagguccugggauuucuuuuguuuguuuguuuguuuuuguuuuuuugagacaggguuucucuguagcccuggugguccuggaacucacucuauagaccaggcuggccucgaacucagaaaucccccugccuuugccucccaagugcugggauuaaaggugugcgccaccacuuccuggcgguccuggaauuucugauccuccucagugcccggaugacaaaugugcaccacccugccuuguuguguaguacugaugguugaacccagagcuuuuuugcauacuaagcaagucucuaccaaaugaaacacauugccaggcccagucaccuucucucuuuuuuuuuuuuuuuggcuaagcaagcaucagguacccgaacagauacauguacucucuagcuuaugucaacaggaucucuuuuggaaguucgcacuucugucacuagguacauuggcagucgauccauaucuguacacucuggagaacagacuuagacucaggaugagguccuacuugcuuagccucuaccaacaaagcuugcagcaccaacgaccgcaucuaaguaauuccuauaugcaaggcacucgcuaccccuguacuugggccucccugaaaauguauuuaccuaauccccaugauguagcaaaaguagauacuauuauaaaccucaugggcgagaaaacguugguauggacaaagagguuaagcagcuuguucaagggccauauaacugauacagcaugaagccuagauuugaacccaggagaggggaaauggggagaccugcuaaggaacuggauuuuagcgccucccucaccgccaaucauacaacacuaaccuacccgacugccucacacauacuuuggucucaugguugcccugcuugaggaccaaugggcaggcagcuccuuugccaccucuggaagaguaguauucugaugucuaggcacaucccuucucuguccucuucucugaggcuuugccuguccuguguucauggauaaaugagaagagagagaaagagagagaaagagagagagagagagagagagagagagagagagagagagagagacuugcuccugcauaugguggaggagaaaguuuauuguagauaaaaggaagaccauagccagaggcagagacauagagacauguaggagaguccauuguggauaugagccugagcccuguaaggagggaagggagaagagauagaagggaaccagagguggguuaaccaaaaugacuguauuauauaaggaagggcagcuggggaaagggcccuucuccccgggcuagggaaguuuggguaaggggcaggguaugccugccaggacucuagaacugauagagacugagggacgcugggagaaccuggaggccaaguucccuuugauauguuaaguaggcaccucagccuuuugucccagguuugagaccuaacaaugggauuuuuguggguuagccugaaaugggucagauccccaugaauggucagagaacuuccuuaguuccaagaucagcacacuugcuguaggccaccauguaacaucucucuaaguguugggagaccagucauaggauuccugguucuucacagccagaccgagucacaguggccaggucuccucaucgccucugugcugagcugcucugcuucaaagucuuccacccucaccuggaccuuauccaaacuggaggugggguuagaacucaguccccuaggugggacccaggggaugggaagcgcccgccuccagaccccuucaaggcucugcauuguuuccaguggucuaguuccuccuuccucuguuuccuuaucuuccucucucuguaaaaagaugaacuuugggggagggggcagggugugucuguguguguguguguguguguguaugugugugucugugaauuuucccauucugcuuuauucccucucuuugaagcacaggcgcaagaugucuggaaugccugaaaaguaaauggcaaacaguccaaaaaacaguguuguaaugcaagggucuagcaaagaacccgggcccugagcaucgccaccgcugcuucugguccacuggugaggucuuucuccagcugagucucagacagucacagcgggaaggaccggaucuggcuggccuuugaagagccgcccacagcucuuagggcacaaagcuuucauugaucuuugguuuuuaauuaauugucucuuccuuuuccauaucuuuuuuuuguuuccuuuccuucucuguuucuuugcucuuuuuuuuccccacucacugcaguccugauggaaccaugaaccaaguaaagggugaagccaaacagagcaacgucucagagccagccaagcuggaaguccaguucuucccguguagguauccaguuccuucugggggccuggggugggggugccgggggagagacacacagauggaaagcaggagcccuguguucaaacacaucugaguccugccaucaagguucaauucucugugcaauuauuuucugugcaccuucuguguguacuuuccugggcuaggcacuggggugugcgcagggaugcagugaggggcaaugagacagagccagcuguguccuugaaagcugagagccaaugugaacaguuggggaggaaccagaaaacuuauuagcauuucagcagacaaggcucacagaagagccugaucugggacauaggagcgcccaaaugacaguuaagagaacaauuggccuaugggaaagcuuacaggccagagacaagaguggaggcucuucagaggccuggcucugcugcucucugacugcccucugagguuggggcaaccuuaggaauucacacaggcugcggagaaaguaguuuuguuugcccuguagauaggucggagaauucagcucagaccugugagguuuucucuugcuauaggguagacacuaaaguuacucacugccugcaagagaaaucaccuuccuucuucccgccaacagcucccugcuucuaacccccagccccgcccccacccagucaagucccuagagaagggcagaggggagguucuuacauacaaaccgagaaaggaccacuguaaggauaaagcuguucuucccgcacuugugacugugagcaaaugcccucaggugaaugagcugcccagcauugcgaagcuagaccaggcaggcucccugcagugucaagggcucugcguguguuuauuuuacuccucauuuuuaccaucaaggaaguuggauugcagagaaccugaguaagauggauaggugcugagcucauuggagccugacucucugaacccucaugggagaauuuucccuguggcaugcauggggaaggcguggggauaggagugaaagugaugagccuuaguuucuauuagcccuuggauucuggggucuccauggcaacugaggcuguaccuucaucaugugaaauaucacauacacaggcuaccguaggagcccugggaccagaggcaggagcuguuugcugaggaaguugaggacugagaggcucaucgggaauacaggguguucuggcuugcuuucuguugcuauggaggaguagggguguucagcuuuagguuauaguccauccuugagggaagccagggcaggaacugaaguugagaugaugcagggacaccgauuacuggcuugccaccuguaacucauucagcuugguguucuugauacaacucaggaucaccugcccaggaguaacaccacccacagugggcugagcacacuccauucaucauuaaucaagaaaaugcccacaggccaaucugauagaagcaguuccucaaacgagggucucuccuuacaagaugauucuaacuugugucaaguuaucaaaaacaaaacaaaaacaaaaaacaaacaaaaacuaaccagcacugagagguuaaacgguuguggggggaccuucuaggauauuugggagauugugggaaagauggaaggugccuccaguauaagauggaaguaagccccucaauggaguuugcaccacagucuccaugagcacugcagcaagggugacacuugccaauaaagagagacguggaaguugucugugcuaagaggaaacaccaggcgagucuauucuugagagacagacaaugugugggaaagacggaauguuuaugucuggguggauuuaggacccuuugaugcugccgagguggugggagacacacuuucccaaaacucaaaugcagagugaccaacuucacagacaguagacacaugaugaucucuccacucgugugcgugugugcaggugugugcaugugugugacauguaaggaccccaagugccaaaggacaagucaacaccaauugucuauccaggcuuccguccaccuucuucucuucaccccucuacuuucauauuuauaaaaagagacucaagguaggaagaaccuugguggguggcccucuagacccagguuuucacauaguuagcuggccucuugacaccuagacauacccccauccugcuuuaucacacaacuucucaggcauuccuggcaaauaugaacaggaaccguuaauauuuuugaguggagggggcaggcucucuggaaucuaagagggcaucaccaugagagcacgugugcccgaggagggcauaaaaacuggucuuggcuauugacacacacuacaaucagcagggaguuugguuguuauuuuuaaauaccaaacaugguggggcagaccuguaaucccaacacugaggagacuaggacaggaaggaugcuaguucuaggucaacccgagcuauagagugaggcacuauucaagauuaaaagguggcuggugacguggcucuguggauagccuaaggaucugaguuugaacccuagaacccaccuaaagcuggagaggacuccuaauauugcccucugaccuccauacauaugccacagcuugugucccugcgcccagugugcgcacacacgcacacgccuacgcacccacaaauaauacuuuaaaaaaaaaaaaagaagccaaccaccugaaaguuggagcagaaggguggggaagaggugcuuagugucucccccacccccacccccguuucagcaucgauuuagagauuggguccccagagcucuagaaaguaggcuucccuugcccuggucguuccucaugagguugcuucugguucucagugaugccaccggcacccuacuggauccuggccaccgauuaugaaaacuaugcccucguguacuccugcaccaccuucuucuggcucuuccauguggauuuuguuuggauucuuggaagaaauccuuaucucccuccagaaacaauaaccuaccuaaaagauauccuuacuucuaauggcaucgacaucgaaaaaaugacaacaacagaucaagcgaacugcccggacuuccuguaaagggggcggggggggaaaaccacaccagguuauuucuuugcuuugcguucccuggcuccaccccccacgccucuuaaguaccaagcaaccauggcaggcacuagagggagaguaaggcuauagaagccaauggagggaggggacucauggaaaguuggcccaaacccaaccugaccccacacugucaccuugcuagcccaauaauaaacauuuugcugaucagcuguguuuccuguggauucugagcuagguuuauagugcaagagucauggucggcagaugguuggaaacccuuuggcuguaguuuaaagguagagaaagcugauggccaaguuagauccuggugacucggauccagggucccucuccacggcagaugcucuggagggaauucugggacguuuuucacuucugucuggaggcuuccuugaagcuuuuacuuucucaucgggaagucuucggaacagggccgaagcaugagcauccugaaaauaucugggaaaagcagacagccugugaggaaaagacaaagguuguuuguuugguugguuuguuuuguuuuuucgacauaggguuucucuguauagcccuggcugucaggggacucacuuuguagaccaugcuggccucgaacucagaaacccgucugccucugccucccgagugcugggauuaaaggcgugcgccaccaugccuggcuucaacgguguuuguuuguuuguuuguuuguuuguuuaaugaugcaaauuuucucuuucacucagaauuuacugagguccaauugcauuccagucagugaaaaaaaaaauuuagaaucccugaccaccgcucuccuugcccccaagcgucaacucaguccagugauagaaauaagacagagcaacauagagggcaucacgggaaaucagagaacaucccacccucuucaagacacaggcucaaguuauccaguauccagucugucuucaagccuuggcacucccaugccucugcuccaguagcaagccagaaaccaccugguguuguucuuuucugaucuugugacuuuuaaaaccaaaaacccagauuuaucaccccacaaguucacuuaguuccuguuguauagucuguuguaugcuuuucauuuaauuaaaaaaaaaaaaaaaacuca

SEQ ID NO: 8199 - RNA, 1643 nt, Mus musculus
gucaggaaguguucuuuguuuuuauucuaaugcaaucuccaaggucaucugcuccaggacgagccucuccaucagagagggaguggaccuuccugccuggcgggccugguuuuuccuuguggauccaagugucaaguucaugcuuuuggacgaaaguaaguuccacacucagaaggacuuggguuaaaaaaacaaacaaaccgcugaguuucuaggauacgauggagugaacaucauaaauugucaaaucaaccaggacccuaaagauccuggcaggguuccaguaccuucucuaccauggacucguuuggcaucugugaugaugaugaugucaaugacgacaaugacuacgaugauacaggaucaaaacucuauccaacuuccugugggaaucaugaguuucagauuauaaauacacaauaguaaaaucuuucccagaaaucuuaagaacaucucucggguaccccagauaaguaaaagagccagaacaagccaucuccuuacuccuggacaugucaggaaccgacugguuuguuguuuuaggaaguucagaaaaacaaaacugaacucacaccugacuuccugcacagcaaagccuucaagacuucccugugggaaggugugcgguaacccaccaugaagcuguguuuaugcaggcagugaccuugcuucagagagaauugcaaaagcagauaaguacuauuucccagaaaacaucuggaaaaacucagagccguaguagcagaacggaggauucagccagcgcaccaguagcuagcuccaggagucgugggucuuggaacuugaugcugggcaggguggaagcccugaauggauggguucacuucugccaucaaauaaguggacuuugucugucacaggcagcucaacccucuugggaacugguuagggccagaagacauagcucaguggcagagcacuuauuuagcuugcuggaagucuuggcucccauuaaagaaugggcagggaggcucaguaagcgauuugugucauccuuacuguucugagaaaggggaccacaagcccaacaaaacuccaggagacagggagugggcucaaaaucccaccaagagcugaggaacuauugauauuugauaccagcugggagaggacuagucaguuuucuuuaaugaugucaaccacaugccagggcaggccccacuucugggagauguuugguaacacaaacuggaccugauggggugggauucagaguuggauggauaggaugaggugaggauggagagagggguuccagaaagaguuggggugaugggugaauaugaucaaaauuguaggaaacccucaaaguauuaaaguaguauuuagaaaaagaaagaacgggagaaaaauacaaccugagggugaugaauucucucccugcagaacauggcuagcuaugugaguguggacgcagccuuggauucucacuucaucgcuuuagaaaagucacgugaucaagcccccucgcagcgucucucgucaaaccugcuuucuggaugugacaugguuagagacaacauugaaaaggcacugagccagcacugaggcgcaggggccuguagucaaggguugugcucuaacuaguucagugucaaggagcagagcuccuuguaccaacg

SEQ ID NO: 8200 - RNA, 2632 nt, Mus musculus
cauguggcaaccuaaaccgccuggguuggagaugaagccugaagcuucaggaaaagggcaaaaacguacauaccagcaugaaagugggacagagauagagucugaagcuuugggacaagguccaaaaagaaaaugccaggauggaacagagaugguauuuaaagagcccaucaaggcucagaagaccccucaggagccucaagaccuagagcucccaagagaacagccuagcaagggucagauacggaaaccccagggagagacuccaaaacaacuaaaaccccuagaguugaccgaagguccuccagagcaggcuguaacugagaggaagccugcugaugguggcaagggucgcaagcggcccuauucugccauggaggaaaacgaacaaagcccccaaaaggaaaaguauggaagguugcuucaacaccuucaaugcgaccaagaugugaggucagacccacacaggucucagccaauccuuacaaaaaccuggaagaucaaagggggcgagucaggaggcagucauggaucagaaacaacucagagcaaucgagaaccaucuacuguuguugcucuaaaagaauaucuuucaccagaggagagagagaagugcuguuuugaggagaaauguguuacagagaagaaagguuguauaaagggugaaggaagaaggggggacagcuuggagccugauuuaccgggaacacgggcucagaucauccuggauagcgacagaggcaauagcuuacuccccaacaagguggcaguacuugcggcagagaaaaagccucucacagaccaagaaaagggcagagaaauggaucaaauccuugauauuacagaggacauggagaaggaaauugagaaugcgcuggguccaggaccccaagaagaaauccuaaguuccagauucaaguugcaaaucaccagaggagacauccagacccuggagaacggucaguggcucaaugaugaggucaucaauuucuacaugaaccuucugguugagagaaaugaaaaccaaggcuacccggcucugcaugucuuuagcacuuucuuuuacgucaagcuaaagcauagcgguuacaguucugugaaaagauggacucgaggcaucagucucuuugaaaaagaacucaucuuggugccuauucaccagaggguacauuggagccuggugguaaucgauguaagaaaaguauuguauaccucgauuccaugggacagacagggaagucuuucugugagaccaucuuccaauauuuacaaaacgagagcaagacacgcaggaacauugaacugaacccuuuggaguggaagcaguacagugugacaucagaggagauuccucugcaacugaaugggagugacuguggaauguuuaccuguaaauaugcagauuacaucgcuagggaccagccugugaccuuuucucagcaacacaugcccaccuucaggaagaggauggucugggaaauccuacacagucaauuacuguaacaacauccaccugguuucuaugguccccaucccuguacuuuuccaucccuguucuuuuccaucgcuguuucuaauauaccucagggaggaugaguugaagagauauaagacagguacugagcugucucacuggaugaagcccacucucuucaauauaguccucacaggggaugugggacugaugcccuaaugccaucucuaggaugcaugcaacuauugcaagcuuagaaacuacugcugcugcccaacccacaggagaccacguguuuuuugguuuuguuguuuguuuuguuuuuuguuguuuuuguuuuguuuuguuuuguuuuguuuuugucuuccugaccccacuccacugauuguuuucgugaacucacuugcaaaccuuggccauugucauuucccacccuccaguccuuguuugaagugucuauuucugaaaugaaggcucaucacagugccaggagggacaugagcaggaagaggccaaagcucuucacuggcaucucuaaugcuggacuuguaugcuguuaaauugaagcaggggauaguggugguguuuuuguuuuguuauaauuuuuuuaaaguuugaaaaucguaugagaaauggaaaugaggugcacagaccggugcuguucugcaccaccguacucugcuggaccuggacaggauguggaacugcagccagacuacugacugggcuccaggacuaguaaggaaagcaccauggucacuuaaagacucauccuuucccagaccugccuuaguuugggaaguugacuugaaguaaccauaauggcaaaaguccauuucuaucucaggucucauugacuacaaacccaucuauugcuguauugaauuguuuguuuguuuuuuaaaguucaauucaauuuaauuuuuuucuuaaaaaguuuugguauauauuaagaugaaauugagauuuuuuuucucauuagauuaauauucccauuguggaaaauugggcauuuaguauuuacgguugaaacugccaguuauauaauaaucuauuuuacaugugacacuuuguauuuaacuuuucuauucauuaucuuaugacuguguuuaugcaauuuuuacuuaauaaaguuuaaaguuauuuaaacauuucaca

SEQ ID NO: 8201 - RNA, 2219 nt, Mus musculus
guacagucuagagauuuauuguucuggauuacagcaccaucuacugagcggcauucugggucaccugagucuggcuugagucugugaaaugggcucagagaaccaaggcguucuauuuucaggauucucccugucuucagcgcucuggguaccaggaaauggguauaaaaugggaacacacagccucaauccucaagauccagggacggggcuggcagcuuucuuuaaagccucugucccccauuguccgcauacuuccccgggacguucagucccuuucugcgcaguccuuaagucauuuaucuaaacauagcucaccgcuauuagaugcuggugccguuccucagccugauucucauaauggaaacagguaguaggauuugaggagucacuuauggguggcugccccugcagaccacacgcacagucuauuggagaaaccuugggaaagugcgauauguuaaagacccucagaagaaaaaaaauuuaagugucgguuccuuaaaugacauucgaaaagucaaccaacuaaccauuuagccccgaugagcuuuaaagacagcaaauacaaaagaccuggaagaagucucguccucuacgcgguuucuucacuuccuggagcggcaccaucuccccugguuuuggggguggggguggggggcugaaaccuucucgcaccuuuugccuccccucaggauccaggaagcgaagaucagaugacagcgaggaucuguaccaggcuuggaucaggauggcccugcaugagcagguuuaccuccggggugucuagagauuaugggcacccuugacuggagcagagccagccgggauaaggagggcuaaggaggcugcgccugagcacuccccgccuccgcgcugucugccgucgggccccgcccggcgcagcccuaacgcacgcaccggaguguguguaaggcacauccgggugucagaagcaggaggccgcgguuuuaggggucgggagagggucuuggagagccuaggcaacgagccaacuccaagccagaagcgcgagcaccugcagagcuacggguucagacgagcgcacccguccagcccuugcugcggagcccccugccggcuugcuuugggguaagagggagggucuucaccgcgguagggcgggugcuguacgccagcgcagucugcucgguuuggguuagcccggcgcggcuacugagccggguccuuggaaggcggguggggaagggacaucguguccucuagacagcccugcggccgaagaggaagcagagauggagcgauugcucucucugccucggucccagguggucugcagccgccacccucugcuggccucucguuuccuccgugcgcgccuccaggaacaagguccuuuauuaucgcuaccggaggcccgggguugaucacgcggccgcguggccccaggugaaacguucagcacucaucguuuacugccggugugauuucacagaagggaaccgaggccccacgaguggagggaacuggcccaaggucacuucguaguucaaggccgagucugggucgaagccacuuaugcagccuuaacaaggcacggcguggucccgacccaucucccgaccuugcucuacguccguccuccuccucccguggccuccacuaggcucuauucucuggguuuuggcagcgccuccuccgcgccugcugugcucggaaaggaugcuggacagcggugaggccacggguccagucgcgugagcgcgagcagagccaggguugguggagacugggugggccucggugcuugggggaagaggaggagaauucuggucccggcauugguggcggcgcugcgggggucgucugggguugcccgagugacgggggccuuggcagcgccuggccggcagucaccccagcgcaacggcuggaggacagugcggcuuugucuagguggugccgccucagccaauuggagcccagccuuggccgagcccccuuggucuccgcccucuugccggcuggaagggaccgcagcucugggauuggcugcgcgaucuacugcgacgucaggcgcggcguggaggaggaggagccugugcgacuccauccuaccccuugccuguuggaaggcgccaggauugcguggguccgcgcaucuggguggggcuccgacguccuuuucccuaacccuguggcugcuccuuccaggaggaggcggcuugucauccauc

SEQ ID NO: 8202 - RNA, 3546 nt, Mus musculus
cagagguccagaugcagccuggggcuguggucacagcucgccaucccauccgcauugcuuggucugcaccuuugcucucccagcaccggcacuauccucgucaucucggccacgauuauggaugcgcuguccucugcccuggcuggaacaguugccuuccagaaagguacuaccuggcuugaacaacaacaaaugucuuuuccuguaacuuguauugccccacagaggaagacgaacagcucucccacacuggagccauaacuuuacccaugagccuucacucucagccagggcagacaagaguccagcgcgucugagacuguuccugcucugacccagauauccaaccugcuagugugugaggugaguuccagaccuauugcugaccucaacacccuacuucccccaagucuaguuugcucagguuuuccuuaauggugugagcagagagucaccaccucccccguaacggccugagcgucuguaucucaaaucaagcguguguuugccaugccaagguuuccuaaacaaagauuccguuuauuuauuucguauuauuugucuggagguuugugacuuuucacacauauccccccacccccaggguuuggugccaggaauugagcccagggaagcucucuacauuuuuuucccuauagugcuagagacucaaccauaauuuuuuugacuaaguuuuauaugucccuuuaugcuaauuucaagaucacacaagacccgcagucuuaggcaugagcucucauucaagugcugcuuccuccauuacugagagugauaauuagcacugauuugccuuuugccuuaggaucugugguguugauaaacugaugugucauuuuuacuaauuuccauagaauacuccaugucucagucaggauuuccauugcugugaagagacaccgugaccacagcaacucuuaugaaggaaaagauuucauguggacuggccugcagaccagagauuuagucuacuguugucauggcaggaaaccuagcagugugcauggugcuggagaggagcuaagaguucuacaucccgaucagaaggcagcaggaagggaacuuugagccacuagaccugagcuucugagacuucaaagccuaccccuuggugacaugcuucccucaacaagccacacccacuccaguaccuaauagugccacucccuguggaucugugggggccguuuucauucaaacuuccacaccccauauauuucuuggguugcgugucuacuuugucacacaacagauauagcguucuggcaagcuguagcaugugccaccauuuucucucagaaccacucaaauaggugacaacacccucuuacacaagccucugccaccuggaagagaguucaucccgcugcaagagaaggaggacugagauugaagggguguuuacuaauuauuuauuuauuuuuacuaauuaucauuuacuaauucugauuucuaacuaaggguuaguguuuaagguauaaggugcugggguggcuaguuuuaauuguuaacuugacaccauauagagucaccugggaagagcuuugauugauuaccuagauaaaguuggcccacaggccugcuauuauuuugauuguguuaaucgaggugggaagaccugcccacugugggugguaacauucccuaggaagggggaucaugaacuguaugaaaggggagaaaacgaauugguccuaagcacgcaugauuuacuccagugugcucugcucuugacugugaauguaauguucauucaagguccugcugcugugacuucccuucuaugccuuacuguaccauggaauugugagcuaaaauaaagccuuucuuucuuaaauuacuuuugccaggguauuuuaucacagcaaaauaaaagaagaccaauacacauguguuaauucacuugacuuuguuauaucacacuaauuuuuaugaauccuuacacuacuuugaauucuacagagucacacaaauguagacugugugggaugauuuggauaugcuuggcccaggggaugggacuguuaggagguguggccuuguuggagcaggugugucacugugggcauaugcuuggcccagggggugggacuguuaggagguguggccuuguuggagcaggugugucacugugggcauaugcuuggcccagggggugggacuguuaggagauguggccuuguuggaguaggugugucacugugggcauaggcuuuaagacccucauccuagcugcuuauaggucagucuucuccuguuugccuuuggaugaagauguagaucucucagcucuuccagccccacgucugccuggaugcuaagcucccaccuuguggauaaugggcugaaccucugaacugguaagccaauuaaauguuuuccuuauaaaaguugccuuuggcauggugucuguucacagcaguaaaacugaaacuaagacacugucaauuuacaauaagaauaaaagaaaaccacucuguaaccuuaguaacacaaguugcuuaccauauauuuuggguuuuuuuuaaacauuuuuuauaguuuaguuuuuauuuuuauuacauggguguugauauauuacaagccuaaagaggccagugaaggagauggauguauagguaacucacagcugccugaugugugcugggaacccgacucagauccucuggaagaacaguacagacucguaacuacugagccaucucuccagccucagucccacauacuuuggaagugaguacugacaugccaaaguugagaacugcucagauaaaggcuaaaggggugcuucacugggcuguauguuuuucauguuauuuuuuuuuuuuuuugagaccuggccucaugaauuuugguuggucuugaacuuucuauguggccaaagaugcucuugaaacuucugguccucuaugcucugccuccugagggcuguucugaugaauaccacugcauuuuguuuauacaaugcuggguauugaacccagggcuuugugcaugcuaggcaaacacccuauccacugagcuacauccucaacucugaacaguguacuuuuuuuuuuuuuuagauuuauuuauuauuacauguaaguacacuguagcugucuucagacacaccagaagagggagucagaucuuguuacagaugguuguuacagauggguuguguaaaucccauguaguugcugggauuugaacucuggaccuugggaagagcagucggcugcucuuacccacugagccaucucaccagcacuugaacagugcacuuuuaaauggcuaacuuuaugguaugugaauuaccccugcccacucucuccucagaaacccccacauuuguuuguuuuauuuauuuuauuuauuucuuuuuacuuacuuaauuuuaaaauuauuuuauuauuuauuuuuacuauuaguuauuuaguuuauaaauauugccuggaggcaaauaguuuacauuucauucaucuuuguccuaaacagguccucugcugagagaaguuuccuaauccuuaagaggcucauuucauc

SEQ ID NO: 8203 - RNA, 211689 nt, Mus musculus
agugaggugaggggugucuugagcuuguuucuugggaucuagcgcaggugaggucacuucucucuuucaaagucuccagcaacucgaguccggcgcgcuaguucagaaccgcaggccaccggaggugggcuagggcaacgugcaggcuugcugucccaaagccacuucgggccaccuguagagcgcgugucaacuccuuuguccccagagccgcuuccaccggagcuccucuccgcaaggcgcuucccuguggaugcuuaaggguccuccuuccaguacuccagcccccuccccgcccuccucccggcccuccucccuucuccaaccccgguagcagcgcccggagcccggggcucggagcgagccgccuccucacuucucauuggcugagagcgucggggaaagcagucacgugggcgcgcggcaggccagcuccagggccgccaucuuggcggaaaguuuagggggagagcgacugggggcgcggaaggaggcgagguuccggggguggggcggcccggaggcgagcggacgagcaggggccgcgggccgcggcgagcgggcgagcggcggcggccgaggcggagagagcggcgcgggggugcggccgccgaagggggagcuccucccccguccccucacccccucagcugagcucggggcggggcgggguacguggagcggggccgggcggggaagcugcuccgaguccggccggagcgcacccggggcgcccgcguacgccgcucgcgggaacuuugcggcggagccgcagguguggaggccgcggaggggggugcaugagcggcgcggagagcggcggcuguccgguccggccccugcuggagucgccgccgggaggagacgaacgaggaaccaggcaagcgagaggagggggcccgagcgggccgggggagcagccgggcgcucggcugggcgcugcgcggcugggcacgggccggcccgcggcagcagguggggagcguggcaagcacgccuuggcggcggcggcggccgcggcggccgggcuucuccucuucaggugcucuuugcggaggggggagcucuggaggcaccuaccgaagcgggcuugggucugaucuuaaucuguagggggcauagcgacccccgagaacucgcuuuccgcuuuggcugacacugcuggggguuugaggcuucugcuuuuuuuccacuugggaaaacuuuggaaggugggcaguuccaccaagguuggaguuuuucccuagucgagaguuuggggcgggggauggggucggguaggguggggugaagugggguggggcgggggcaacgaauggauccacgauucaguucauugcauuaguucaaguuuuccuuccuguuuuguguuuguaaaggugugugccgccuuccugauucuggagaaaaaugccgguccggaagcaaggugagaauuuauuuuggaacuguuuuguggcugucacuugcuguaacauacaucaguguugugguuacuguuuuuaaaagguuugugugacuuugaggaaucagcaggcucucgcuuuuauuccuuaugguaucagagcuucccaucauuucagaagguggaaacaucuaguugguugcacacaccuucuugacaucuguagucauuacagaagcaaucaacagaagcaaucugcccccuaccaugucuuuuucaaaacuucauugcuucaguauuucacuuuaucacucauaucaacacuauuuugugagcaacucugugagcaacuaggaauuaauguuuugaaacacguuuugguuauaggaacaaauuguagauaacuuguucuugucuguuaggcauucuaaaaaccaaguugcuaucaguuuaguuagacggucuuuuagucuuggaagcugucaguccacagcuaacacaggcuacucacuuucuccuuucucugcugugauauaaagccuuuaaaauauuugucuuaguagggaauggaauauggauauagugauggcagcccuugccuuggaggcucaggggaacuuauagaugucuuguagagguagcguguagcacucucauguaaauauguaugcagauacacacagagccuuaauauauacaugaaauuuucaccguauuugucuuuucagauacccagagagcauugcaucuguuggaagaauaucgaucgaaacuaagccaaacugaagacagacaacucagaaguuccauagagcggguuauuaacauauuucagagcaaccucuuucaggcuuuaauaggugggaguuaaaacuuuucuacucuugaccacuguacuagugccugaugcuucucuguuauguuaaacuuagaauuugaaagacaauguguuuggcucucuagaugguccuuaacuuaggacaucucuagugauuuuuuauuuugcaguuaggccacugucacuucuaaaaauguuuaauuaucagaaaaacuucuggucuggugauuucugugcacuuugagagcacaguuucaugucuuagaguuaacagcuggaauauggacaaguuguagaaauguuuuaggacaccagucgugacaacugaacuacuguugguguuuuuguaguuggcguguguuucucuggaauccuuggaaauauuugaaaggcucugcugcugugcuugagagcauuugccucucugacacacacacacacacacacacacacacacacacacccucuguuagaguugccauuuguggaauaugaauuuuagaccugaaacaugaucucagagaugaugcugucuaauuaccuuauucuaguauuccugacacuguuagggauuaaauaucagagaacuccuucagccaguucaggcuauuguaguaacuacagacuguaggugggaaaccaaacaguggacuuuuaagacuuguaaaguaaguaguuucuuuuaaaaaugaaccuucuuguuuuucacauuuuccccaguguauuaaacuaguugguccgucucugaccgcuauuguccuguacuuuaaaaguuugcaaacuacugaaccaggugguuuauuuucuucuagguuuaauaauaagaucuuuagaaaacuaaguaucaacugucuaacauguucaaauaagaccuacgcuuucucaauuaaguucauguucucaguaacuucccagcagcuaggccugacaguguguguguugacagaguaucggugugaucugaacacuguugucacugugugccuuguuggauagcuuacugcgauauugaugcucuugacugaguucuagucucuuacagacuuaauagagcauacaguguuguagaauuuaguguuacuacagacuugaagacaugccaccgcaggguggacggugaugagcugcuagugucacccauccucagagcuugucagcguuuccauaauauuagaguggacacuuuugcauuuguuucccaagccaugaaauuuaagguucaaguagauccccugauugguucccaaggauggaggaauuaaaaaaaaaaacagcacaugaggaagagaaaaauaauauuuuaguuauguaguuuacuagaucaacauuaaaccuagaaauuuucauuuaauagaaacauguuaggaaaaaaaaaccagugugacuuuuauguccucauuuacauauacaugugcuuacagacuguagucuuacuguaugggaaagccuaaccuaagaaaacuaaguaaauagaauugacccuuuucauguuggacuugcuauguuuugaggcaauuguuacauauuauucuugccuguuuugaauguucauuaauaugcauaguuaaauuuugauaaucuucuauuuaaguuuguacuagagaauuuuaucugucuuuaugauuuuuauggacuuccauugucagauggacuuacuugucuuuuuguauuuauaguuaauuaguaucagauuuaguggaacagaaguaccaacaucaggcauguugaaauagauuuggguuuuaugcguuauaacugcguugaugauaguauugcacuaauccauucauucuuggcacauacugucacuuuagcacucgaagcugaggcaggaggaucaagaauuccaggccaaccuggguuuaagaggagucagagcuacauaguccucgucucaaaauaaaacaaaaaaacccaacaccacaaaauauuucucauguuuguuucucauucagaaacucuuugagcuguuaagauuuuguucuuuacaucuuuuaccauuguuuuugaaauaguuuugcaaugugcuuuuuagcugguaaauuguccuauguuaaaaaaccaguccauuuuguccaagauuauacugaaaaaucguggacugagugcuuuuccuacggugguagcacuuucuguuuucuaagcggguggaugugaaugaaugucuagauucaaagggaacgcccaucucaguggccagagcuaacagaaagucacuuggcaguuagacuccugacuaucuaucgcuuggaauucagguuuuuuagguuuuagugaauuaccuguuuguagcagggaagcauguuauacacugaguguaauuucauuauuauuacuuauugauucuuugaaauaaguuaguacugacucuuuucaugaaauuaaaguuuauaugcaucuguaggguuuggugguguggaaauguuaagucuuugccccuaguugauauaugcauuagcuuucugauacuuugggguuauuugaaaggagacacuacauuguaucuguucugugauaccauuugagauuuuauuuuuauuauauugagagagagugaguauguguacacguaugugugugagcacaugugcucguguugauuagagaaaaacuuuuaggaguucauuuucuucuccuaucacagaggaucugggagugaacucagaucaucaggguugguggcaagugcuuuuaaauccugaaccaucucacuggacccuguuuuaaaauuuuauaacaugucugaaagugggugguaucuuauacaugcuauauccccauucccugcuccgcuuucucuucuguguagucagacaggcuccugagugcugcaguucagaugugagcaaucacaucugacuuguauugcuguuaugaauugguuguuugguuguggguuuaaaguccguuuguauuauuauuauuauuugcuggcacauaaaauagugaugcaacuuauaauugacaauauucucaauuuaauaagauguagaaaauguucuaguacuugaguaugaguaguacuguugaauaauaauucaaaccucugaaaauucuugaaaagcagucagguuuuuguuucagcuaaguuuguucauccgucugucugucuguccguccguccuuccuuaagaccagaucucacuauguaaccuugacuggccugguacucccuauauagacuaggcuggccucaaauucagagaucuaccugccuccuaggugggauuaaagguaugugccaccaugccugacuucagcuagguuuuugucuuuagaaucaaauauuuaaaauuauaucaacaaaacacauuauuugcacauuuguuuagaauuagucccaaacauaucuggugauucuuuuuguauaaauagaaaguaguauucuuuugccauucauucggaacaucuuugaaaauguaauacauuuuauauucccauaucuaguauuacauuugaaaacuuggggguuagauagacucaacaugguuugauuacaucagaacccagauacucagauuuuaaggugucugggauucagucagagugacccugggagucuagacuagaugucauaccaagucuaccauuguaacuguuucuuaacaccuugcuuuccuuguagacaggauucugguuucaagaucugucuuuaaaucuuuggguaaauuuagucaugugauuugcauguuuuuauuuuauuuuauugguauuuuuuuuaaucugcaauaaauagcaaacauuaauuuuauuuaagggaaggcauacuggagauuaaacccaugcuaaauaagcacucuaccauuggacuacaguucaauagaauuuuuuuuauuucuuauuuuuauuuuuuaaaauaucuacaguucauauuccucucccccgcaacuaccccuggaguaucccaacuucauguucccuuuuuuucuuucuuuuuuuuuuaauaauucacugagucgccgggcgaugguggugcacuccuuuaaucccagcacucaggaggcagaggcagguggauuucugagucugaggccagccugaucuacagagugaguuccaggacagccagggcuacacagaaaaaccccgucucaaaaaaacaaaaacaaaaacaaaaaacaacaagaaaaauuaauucacugaguccaauuaguacugcuuaugugcaugggcaacauaccaguggccacacacacgaagaacaugauuuucucuuccccaacagccaugcccugccaguaguagcuuuucagaagguuguggggucuugaaccccucagcuacccauacugggauuucuccuggcuagaucuugugcaggcagccccagcuucugaggggucacgaggacacuggccaugcucagagcgcccacccuccuccuuucuaccccaucuuauacaguguuccuugagccuuggugggaaggugacagugauguccuguuugggucugagcauucacacuuauccugagcacuugggucagauaugaaccucugcauuaacuacugcccacuguaaaaagaaaccucuggccaagguuaggagcuacacagaucagggccagaguaaccaugucaccggugaggcuguagugaaccuuauugauguuagauuuuaacauguauauuugagguuuacaaaaugauguuaugagauucauggauaaauaguaaaauagaacuauagugaggcaguuaauguaucuugcauacuuuuauuuuuugucaaaagcagcuaaaaucugcuaauuugacaaagaucccuaauaccguuccguuuuauuagcuuuaauccuaauguuaaacauuagauuccuauauaucccauuuauuuuaaccucuuuuccugggucucccucacccacagauugauccucaccguaugcaaacuucauucuuccuuaagcauuccacauccaggggaagccaggcaguguuuuuauguguacaccuuauuuuaguuagcacagcaucucuagguccauucauguuguuaaggaaugaauuuguauguaugaauauauaucuaugugcauacacagcacaucuuuaaagcuucugggccauuacagacguuuagauugucucccugucuuguguauuaugagugugcugcagugaccaugggcacguagaugucuuuacaagguggugauuuuaucuccucugguuguaucuguucccagaugcaucagggguuccugggcugucugguaguucuaaauugcuucauagaucuaaauucccuccaguaguguagcaugcuuuccuuuuuauuccugccaccguuggcuaccccuuguguuugugaugauggacauccauguccgugagauguuaucucaggauggcuuucaugaauuugagcuccuuucugucuuccccuucaucauuuuuaugucuauggaaaacaaaguauguuuagauuguuugauucuuuuucauugaagcuuuguuuuuccuagccaagaccucagauaacccaugaaaauuguauugcugaggaugguauaaaaaguaauaauggcuacauuuucaauauuucacuuaguccuuaguccugugagguauauuuagcaaugagaugguuauaccacuuuauauauuagaugucugaggcacuaagaaauaacuaguuuuacccaagaacccucagauacuaacuuguguaguauaaaauugaauucuaauuugaauccagaacuucugcuucaugaauuaaaauauucuuuaucauuauguucauugucauuacauuaaaugcaauaagcauaauaacaaguuuacgacaugcuggucuguaggguugguuuuuuuuuuuuuuuaaguaucauuuucaaggaaaauguuuauaauaaguugauuuuuuuuucuuuauaaucaggauuugagaacuuagcacucucugugugguucucucacuguaacugagguuacauuuuaaccugucacgagcuuguauuuuuaaguguguacgaugguugaccaggaaagcauaaguaagcuauggauuagacuggaaugaagagaauuuuuuuuuaaucuuuacaugugugguuuugauuuaacuaggcugaguuguuuauuugcuuacuccaguugcagcagcaugauuuugcuggaccuggcugaauuuucguuuaaaccauggaauaacagagauguaaaaucaucuguaacuacuucuaagcuauuucuucgguguaagaugaaaucuuuccuccguauaggaucgagguggggacuggguauuccuuuuaguugucaugucucuaccuggagcucuuucuccagccucucucuugacuuuuuaugaugauaucugucucuuuguaagucagucagucucagucucugucucccccucgcucucugaguguguguguugcuaaguaaacauuuuaccucugagcuauauccauggcacuuguaaagcuuuuuuuuuguuuuuuuuuuuuuuguuuuuuuuuaaauuuauacguauguugaccaggauggccccugagcuugccuuguggcccagacagacucugagcuugaagucuuccugccucuguuccaaggagcuccaacauugacacuuuuuaauaaaauaacuuccucuugauaccuccuuuaaacaagaugauuuuuauuuuauaaguaauacuguuuugccugcauguauguauguauauguauuacaggcaugcagugcccauggaggccagaaggaggcauuagauuccuggagcugccauauggguccugggaacugaacuuggguccucuggaagagcagccagugcuccuaacugcugagccaucucuccagcuccugcucuuacguuuuuauauaauguuuuucauuugggguuuaucagauguuuguaauuacauucauauuuucuauucuuggcuuaggauucuguguauccagaaauauacagugucaucuccccuuccuugauaacuuuaauucugaugaccugauuauauauugucuuauuucucuuucuaguagcuuuuuccuuacaagcauauguggacuguuuacauauauuacucuugagcaaaaucauaaaugguucuuguuugaaguaauuguuacugugguuauugaaaagugauaguuaccuaauaguaacauuccucuguguuucccaguuaacacuugguauuuuauuuuacaagaagcccuuucugucugugugccaugaacuuugcagaguguuguuucuuucagugguuucauuuuaccauccuaaugauuuugauguguagacugucucagguuuagcucagggugcccuccucaagcucucucuugugcuuuuaugaugugucucauuuuuuuagcacuguugauuuuuuugcauaaggcgguacuucagguccaccuugugacuaccagucauacaccucuuaaaaggaauauucauguguuagucaaaugaugucugaagaauggagauaacuuguuuuuauguaccacuuugacaucugccauguuuccaguguaugaaauauaaauuggguauagucaucaaauguuguaggguauuuucuuugggaauucaaguggcuuuuacaguguaccuugacuuaaaaguaugcugaguaucuucagcugucacauaaacugauagaugauuuuccuucugcaacuucagguugucuuucacugucauccugcucucgagacuuacucccuguagcacuccaaaauggaaucuaucauaaggcuaguacguguucuacuaagguuagacaaccuuaguuuuuguaaaauacaaguaaauguucuuuguaucuguacaaguacuucgauuuuguaaaacaucuuacacaaaacaaaacaggaaagcugcuuucucugugagaacugauuaaaguuggcauggaaggacagguuggaaagaugucaggcuaacagcaccugcuaccauugccgagaacucagucaaguucccaacaacuaugucaggugcucacaaauaccuauacuucugucuucagggguaucuuagucaggguuucuauuccuggacaaaacaucaugaccacgaagcaaauuggggaggaaaggguuuauucggcuuacacuuccauuuugcuguucaucaccaaggaagucaggacuggaacucaagcaggucagaaagcaggagcugaugcagaggccauggagggauguucuuuacuggcuugcuuccccuggcuugcucagccugcucucuuauagaaccaagacuaccagccuagagaugguaccacccacaaggggaucuccccccuugaucacuaauugagaaaaugccuuacagcuggaucucauggaggcauuuccucaacugaagcuccuuucucugugauaacuccagcugugucaaguugacacaaaacuagccaguacaauugacacacaaacuugacacacaaauacaucacuaguaagccucaacccuuaguucuuauucauccccaagaucuaaauaacuuuaaaagucccacagucuuuacauauuaaaaguucaauuccuuuaaaauauccaguaucuuuuaaaauacaaaguacuuuaaaauucaaagucucuuuaacugugggcuucacuaaaaaacuuccuucaagagggaaaaauagggcacagucacaaucaaaagcaaaaaucaaucuccaaccauccaaugucugggauccaacucacgaucuucugggcuccuccaagggcuugggucacuucuccagccaugcccuuuguagcacacacguugucgucuaggcuccagcugccuguacuccacugcugcugcuguucuuaguggucaucucaugguacuggcaucuccaaaacacaccugucuccugcuguaacuuggcuucaacaauagccucucauaggcucucuucauggugccaagccucaucuccuuugcaugacuccuucaguccugggccauuaauugcaacugaggcugcaccuucaccaauggccuuucauggccucucacagugcugagcuucagcugcucugcgugaccccuucaugccuucaaaaacaguaccaccuggguaacucuuaaauauuaccaaguccagccacaggacaagguacaaccuuggcuaucucuggaacacagccucucuguucucagaaaacaccucccagaagaugucaccucaacgaugcuggucucuucuuaaucaccacuaauuucuuagcuccagcuaaccagcaucaauagucccaguaaugcaaaguuuuugcuuuaguaguucugguaucuuguuaaucacagcugauucuucagccccagcuaaccagaaccacagaaucuucacaaucaaacuagcaaugguccugaaaaaagucuuuaaucuucccucagaaauuucacuagccaggccuccaucuucugcacuguucucaacauuaucuuccaaccuccuacacaacauucgacagagcucuuaacacuguaugggucuucuggcccaaaguuccaaaguccuuccacaguccuccccaaaacauggucagguugucacaggaauaccccacucugcugguaccaauuugucuuagucaggguuucuauuccuggacaaaacaucaugaccacgaagcaaauuggggaggaaaggguuuguucggcuuacacuuccauucugcuguucaucaccaaggaagucaagacuggaacucaagcaggucagaaagcaggagcugaugcagaggccauggagggauggucuuuacuggcuugccucuccuggcuugcucagccugcucucuuauagaacccaaaacuaccagcccagagauggcaccacccacaauaggccuuucccccuugaucacuaauugagaaaaugccuuacagcuggaucucguggaggcauuuccccaacugaagcuccuuucucugugauaacuccagcugugucaaguugacacacaaccagccaguacagggggguuugcauucauguguacauauuugcauucugaugcacacacucaaauauacacagauacaggcgcggguaacugagacagaaauaaaguaaaucuugaaaaaaaaugcaucuaguuaacauaucaugacuauaacuuuuuucucuaguggcauaauauuucaguuuccuuagaugaauaccagaugaaucauugacuuguuuagaacuaaagaagcacacucugcauagagagguccagcaagaaguccccacugcacacaauaccgagacagagagggacagacuucuucaccucgucuugugugugugagagccacuuacuuggugggcugacagcgagaacugcuuuguguguguugggguacugucguugaauuuguauaaaugugugaauuaucugugccauacuuaauuguuuuuauuuuucccaaaauuugccagaagauuucaaugucaguuucuuaucaucuuaaaugacuguuuauauaauauagauuuuucuguuaauagcuuuccaggaaccagccuuuuuaauucagauuuuuauaugauuugauaaacauuacauucauagacauacagauguguacaucuaccagugcaggugggacuuguucuguuuugcauucucuauuauauucguaggauaaauugccagaaguuaauuacuaggugaaaggguauacauuuuaaggcuuuccuuguaauuuguaaaguacucuuacuaauguuauaucaauguaauauuuuagacaguauauagaagaugacugguuugacuuaguguagaguguuauauaucuuuuaauauuaucuccucugauugguugauuauacugauuugaucuuuuauuuuaauuucugaauucccuguucaugucaguauauuuccucccauucuuuuuucuuuauaaaauuaacacgaggcguaucaacccugucuggcauguaaaucacaaguaacuacucugguuuguaguguguuuguaaacuuggauuuuaaaaccucauguuuauuucugguuagauuuaucaguauagauauguguuugauguuugugguaucaugucuagaaaggcuauccuugauacuuuaauccccaagaguauuaucuuaaucugucuucagcauuuaugaaaguauucaccuauauucaagacuuuuaaaaaacacuuuaauuuauguguauuguuuaaucccuagcggcacacucauuuauuuauguacaacauagauauacacacgugcacuaaaaggguacauuaauaaaugugugauggcugugguuuaagcugcuauagcaacuuaauuauauauguaaacuucuauuacugagcauguuuucaaauugugaaggaaacauugaaagcaguaugagggucaccuaaaguugucugagcaaguaaaggcuacaucacuauaaacaaaucaacaaggaaauugaucauguugauuuuuuucucaguucucauucauucauguguuucaauaucuaaucucaacaauaaggaaugcucauacuuuuauauacacacugugaaaacaguauauaacuguagaaaaaaaugauaaugcuucagaaauuguauuucucacuagggugucauuagaaauuagcacauuuauuacccagugugaauaaguccuuuaguaacccuaggcaaccauuaauuuggaugcucacuuagaaaauaagugaguacagcgguaaaaagugcuugguaugucauagaccaagacugauuccagccuucccugaaggugccacagacagcucaccagauacacauaauaaauagaaauaggauaacugauuacaauuuuaucauuacucugaaaaaauauuuuccugugaaaauggugaugccuuagcagaaaaaaacgauagaagaaaacacaggaaugcuccgauaugucuuagaggaaacugcuuguugagaugacucaugguugaaagccuugcuggagucugcugggucugucuuaucacugcagcccuacucuuccuucauggucucagagugcuugccuugaguuuaggcuaaacuaagagucagucagaaggucacuaaaagcuugaacauaugcgugaaagagaugaaaacuuaaacaccuugaguuaguccuaaggcucgcagaaucauucacauguauuuagaauaacaauucuaggggccagagagauggcucaguggguaacaaugcuugaagcacaaucccgaugaccugaguucaauccucagaacagaggaggaugacuccugaaagcugucccuugacucucacaugugccugugguacgcaugcaccuguacucacaucacauacugcauacaagcaaaucaguuaacguuaaaaaaaaauccaugaaaaucaaccaacuuacuugagaagucuucauguaaaagauuuucauugcuuucguuacuuucuuaguuggaaguauagcauuccauuaauagccucaaagguccggagcugaggaaggagcaagaagcacaaggaugggcauuuucaaguaggccaaggaacuuuacaguuugggguaacaugcaucauccuaaacagaaacacuucacguaauguuucucaagcuaagaacuaaggcaguacuaaccuaggcucaaaauagaaggucuagacacugaccugagacuaugcaauaauuuaacacaacauagagaacauugcuaaucuaugaggaaguauuuuauuugguggaaaaaauacugacaagucacaaccaguaagaaaauaauuguaaaacauuuaucugacaaaggacugguacccaaguacacaaaaaccauguaagauuugacaguaagaaaagaagccacagaaagugagaagaugcaaaauaucagacuaaaguagucagaaauagcaaguaaauauauaggaggaagaugucuaauauaaaauaucauagggcacagucaauaaaaaugucuaaacugagucaguggaauaaaaguucaagcccauguaacaacagcuuacaccaaacugggauacagagcagaauccugcucaaaaccaagcaaacaaaaaucuacguagugccacaugccuuucaaaaugcuuaaaauccaaagcacugauauggcauugaugguaaggaugugaguaacauacacugcugaugggugugcagagcagcauggccacaucagaauacugcuuaggcaguuucuuaaagauuacucacaccauauuaccuagcaguuacuuacacucccguauauuuacccagaguugaaacauguccacuaaaaaccuacuuauagccccccuuucuugucuuccuggccaccguaauguaaacaguuucugccacacucuccugcccauugauguucuacagcagguccagagacacagccgaaugaccauggacugaacaccuuggaaaccaugacccaaaacucuuuccucaaaacaaaacaacacaacacacacacaguaaaaccaagguauuggggauguagcuuagaaggugccaaaacaaaacacccucguauaauuuauaggagcuuuauuaauaaucaguaagaguuagaaggagucaagauguucuugauaaacaaagugugguagaaccauacaauauggaauauuaacuauaaaaagauaaaaccaacaagccauaaaaagacaggaaauuuacauguauugucaagggaaagaagacagucuccaaagacuaccuugggauacauuccuaaaacagaguuauuuggugaaaaaaauggaauacgcauuuaggauuuuuuguuaugaaaugcucauauaaaugauaugccaguuuaauucaaaugaaagauucuaaaacuauagagguugcaaaaagaucaguaguuuccagaauuuggggaguagagggcaaugaaacuguucuguuugguaucagacggauggauuaauaugucagaacaacggauguacauuuuaagucagccaguguacagcacaaaugauccuaauguaaacuaugaucuuuagauagugauaauuaauagcuugucuguuuuaauaaaugcaugcuacauaagcuauuaauaacagggaauguggggguaaggaaguggaacuacuuuccauucaauuuuucuguaaaucuaaggaugaaaauuuucaaaaagauguaugagcaugauaaguucauauuuuaaaacagcaauuuacuuuauuaaaauaacauaauuacauaacaaaauguuuacugauguguguguaugugcaugugcgcacacauccccacaccccacuagaccacugaagccagggucacugaguuacaccccaacccuuccccuucaauuuucucauuccaaagacauuuuuguugcuggguuuuaaaauauauauauuguuacuaauuuuuauuaguuuuuacauguaugggucuuugucuucaugcgcuugcccggugcccacagaguccagcgaggacaucagaucccuuggcgauggaauuacagguggcuguuugguuuugccuugugacccaccacccuuaaccagggccacucacaugggcauggguaugggugugaaguuuuccaccagaauauggguaauguaagacaguagcuuccucuuucccaacaguccucuaugaccauuagcuccuugagguggagccccaugggucccuucucccucugugacugugugcgggcuguuuguauauaagcccugugugugcacgggcagcuguugugaguucauguguaccacagccaugccaugccaugcccauaagguagcuuuucauaggcugccuucuugugaaagcucuuacaguuuucaucccagaacucuucuguuuuuuaguuauuuauugcuuuguggcaaaguauacauaauauaaaauuuagcaucuuaauuuuuaauuauuuucaacucaaacugaaauucuuuuuuugagcaauaauuaugucuccaacaacaaauaagaaaacaaaaccccuuguagcuguuuuacaggaccucucucucgccuugacuccuagugagcaguucaccuuuugucucugaauuuggcauucugaauacuucauacaaauggaaugaauauaauauuuguccuuuuaugucugccuuauuucauuuaaggauauuuucuuuuuuucuuuuaaagauuuauuuauuuauuauauguaaguacacuguagcugucuucagacacaccagaagagggcaucagaucucauuauggaugguugugagccaccaugugguugcugggauuugaacucaggaccuuuggaagagcagucagugcucuuacccgcugagccauaucuccagcccaaggauauuuucaagauuaauucuucuacauagacuauuaaggacuuaauuuccuuuuaaggguaaauuauauuucuuuguacauacauauuguacuuuauucauucaguuuugaaggauaauuguauuuucaccuuucggcucuuaugcuguagugaccacuaguauacagaucuuucagucugguuccgucucuuuuuuuuucucuguaugauacgaggaagugagguugcuggauaacaugguaaaucuggguuuuaguauuuucagaagccacuccuuccauuuucaguagcaguuuuaccauuuuacacguucguucaugagcaguaaagaaggggucuacuuuucuucauauccuauuaguucuugcuuuuuauuuuuuguuuuguuuuauaauagucauucuaagugguguuaacucagcucauuuuguauaaauccugauacagcuaaaauaggauugauauuuuauccucuagcugcaggaguuuaaauagaacaaauuaggaagggcuguaugaggggcuaggguaguggcucagccauucagaguaccagccacucuuuuggaggacccagguucaaucuccaccaucugcagcagacuguaacuucagacccaggaggucucacacccucuucuugccuccaagggcacugcuugcauaugcagauacuugcaggcaaauguaccacacacaacauuuuaaagaaaagccagucuaacuaaacuaaguauaauuacauauaguuagaauauacuaaauauauaccaggaaccaaagcccacuccucugcaaaagccauccuagccauugagccaucucuccagcccaguaauaauuuuaacagcuggugagauggguugauuucaucuucaguguaaaauauuaauuuuaauuaguacuuuacuuuuuuuuucuucugguuguuaaaacugcaaacagaacuacuuugucccuacugucuugugaauuuuggggcuucaaaagacuuuuauuacauuucauuuauuauaauugugcauggguaugcaagugccacuguuugaauguggaaaccuaaggauaacuugugggagucagucuuuccuuccacucuauagaucauggggauugaccucaggcuaucagguuuggugaccagcacccuuaccugcugaacugucucauuggcccaaggaaauagguuuuuaaagaguaugaugauaccuuuaaaauaguaaggaacaagaaauaaaaguuacucuaaauguuauuuauaguuauuugugacuuauucuggauaaugcccauauuggcuguuaaaccguucccacucucuaaaaaauuauaaauuauaccaguaggugacucaagaacucacagugugaaaucuaaacauuagguaauugucacucagcauuacugagcugugugacuagccacugcuaauauuauaauauaguaagcucauaugacuccuuuuaaauuauucuguacucuucugaauaaacauuugguuucuuucauacuuuuugcauacuuugaagugauuguuucucacuuccucuuagauuugcagacauacaauuacaguuggaaauguccuaguuguuugguuuuaaaaauguuuuucgccgggcggugguggcgcacgccuuuacucccagcacuuaaggcagaggcagguggauuucugaguucgaggccagccugguuuacaaagugaguuccaggacagccagggcuauacagagaaacccugucucaaaaaaaaaaaaaaaaaaaaaaaaaucaaaaaaaaaaaaaaaaaaaaaagggcuggugagauggcucaguggguaagagcacccgacugcucuuccgaaggucaggaguucaaaucccagcgaccacaugguggcucacaaccauccguaacaggaucugacucccucuucuggagugucugaagacagcuacaguguacuuacauauaaucaauaaauaaaucuuaggaaaaaaaaauucuguuuaaaaaaaaaaguuuuucacuuuaguuagaaggacaguuaaaaccauaugaggauuuacauuuccaaucugaauagugaugauaaagauguaaaauauuaguaaugauucaucugaacaauuuauaauaaugacauuuaccacuauuuauuaagaguauauuauaugcuaacaugcuagacacuuuacuaugcucaauucuugcacaguuuacacaauaagacaaauuaucagaggguuaguaauuuuuuguaguuaauugauaagaggauuuuaacacagcacuuuaaaauauauuuguuugaaaauuuuacacauguauguuuacaguguauuuugaucauauuugcccuauaauuucccagucaguuccccuagacucuucucccauaccuacuucucaccuuuauuuccaauacaguuuuuaaugaucuauugagucuaauuagggcuacucuuaugugcauggguaugguccaucugcugaagggaacaugggugacauaaccagucgcuguaauacccucaaagaaaauugccacucuccauuccaccauuugucacuggcuguggcuucuuagcuaagcacccauggcaccgucacuguuuacauuugaaacgguauaugaauguguauuggguauaggguuauguggaugugccuucagagaccacaagaggccauuggauacucuggagcuggagcuucaggcagugguguccucccuugcauaggugcugggacccagcugagguccauugcaagagcagggggcagucuuaacugagccaucucucaaaaacacgcuaacuuuugaaguguaaacuuucuaagacuugccuugcagguuuugaugugacauaaugaaacgaggaaauaaccuguuaacaguaugugguugagccgugguugguggcgcacaccuuugaucccagcacuugagaggcauaggcagguggaucucugcguuugaaaccagccuggucuacagaguguuccagggcagccagcgcuguuacacagagaaacccugucuucaggggaaaaagaagucugugguagaauuggacuuaguuuucuaauaguuaaagaggccuuuaaacauugcauaguuuaguagauguaaaugauuuugagauuuuauuuuucuuuaucuauagauauucaagaauuuuaugaagugaccuuacuugauaauccaaaauguguggaucauucaaagcagugugaaccaguucagccugugacuacuugggagauugccagccuuccaagcacugccgugacgucagaaacccugcccggcagccuuagcccuccaguagagguaagagaaaguuuuccugaagucacucagugaucaauuuucuuuuuaagguggguauauuuuggaaauaauaaugagauagagaauagaauuaaaauauucuuuaaaagugucaagaaucuugauucugucuaaaguuuuuaacuuguuugaggucugaaauacuuguuuuaggaaauuagugucuuggugguagaucucagaaagcuccauuuguauaauuauuaacauguccauuguaguuugaaagaugauuuucuugguguucuugacuaaagaaagaauacaauuauggcucugagcccuuauguauguuaagaauucuguugauuggcuugaaacucuguugaugcucuguugauuggcauuacaacucacugaagacuagcaguccuuccagucagcauuggccuuuacauuuuucuguaguuaaaacugcuaacgucuuugaguuuuaauagcuuaucuuuaccauuauaauugguaauguucuuuuuuuuuggcugugcuguacuguugcuaguagaguuggauguggugcagcguuuugugaugaggauuccgucugagcagcaucagucauuuaaaagugcuugucucuccauuggauucuagucccucugguuagugcuaggcugugcuuggggaaucgaaucagcuucuguuggaugaguaauaagucggggggggggggcagcuaugaagcacacuaggaaugaagaguccaaguuuucacuuucucuuuauuuaauauguuguugcauaacuagcauuugagaguggugugauugagcacauauaaucccucuccuacaguuuaaagcugaaaaaaaaaagagaaaucuaaaagaaaauuacugacccagcuuaaggcuagcuaauuuuuacaagucuaucuuuggauaucagacuuuuuaacauuaaauuuauaguuaguucucuuaguaacccugauagaaucuuacacauuucucuguguaugauucuuauuuuucucuuuuuaaacguuacuuuuuuucuuggauaauuucuuuuaccauccucuuuaguugauccauuguuugcuauaaugagaguucauccuguggucuguuucaaauguaguuuaaaaaugucuguaguuacuucugugguucagauaaauguguugcuuccaaaguaaguugccuggcaugccuaagacccuggauucaacccugaccccagaaguggggaggccaugagggauuguuugucauaagugguccuuauaaaagaagcuuuaugccaaaguuuaggucuguccucugccugugagaguggagcaagaugucacugaccagagcacaugccuagaauccaggccuggccuccagaguguuagugaggcaugugcuucucuuuuacagaaaugauucucauacgauaaaccucgacagguacuguuuucuagguuauuuuacauguauggucauuugccuuuauauauguaugugagacacauauaugccuggugucugagccggucagaugagagcauacaauucacuggggcugauauacagauaguaauaagucaccaugugagugcugggaauugaacccagguccccugcaagagcaguaaaugcuucuaaccccuaacuauugagccaauucuccaaccccccaguuagaguuucccuauuuauuaucuuaguccuauauuaaaaggcuuguguuuuuaaaaaaaaucauuaagguuuaagagauugauuuuucaugucuuuuuuuuuuuuuaaucuuuauuauuuuaaacuccagauuuuauuccccuuccaguccacccuccaacuguuccacauccuauaucuccucaccucgcuccugucuccacaaggaugucccuaaccccaccccaccagaccucuaaacucccuggagccuccagucuuugugcuucuucucugacugaacccagacccagcaguccucugcuguauauguguauaucagcuaguguaugcugcaugguuggugaucagugucugagagaucuugggaguccagguuaacugagacugcugguccuccuugaggguugcccuccuucucagcuucuuucagauuuucccuaauucaaccacaggggucagcagcuucuguccauugguugggugcaaauaucugcaucugacucuuucagcugcuuguugggucuuucagagggcacucaugauaggucccuuuuugugagugcuccaaagccucaguaauagugucgggucuuggggccuccccuugagcuggaucccacuuugggccugucgcuggaccugauuuucauguuuauuuacuauguuuucuauuguuugcuuauaaaucauuguguguaucacauacaugccuggugucugagcaggucagaaugguuuggaacuggaguuauggguaguugugagccaucauguaggugcugggaacugaacuccagaccucuguaagaacaacaagcacucccaaucacagagccaucucagcagcccucccuuuuauagaguacuuuacaaugucugauacaauauaaccaguggaaaugacuacucauuaaauugaaaaaaaaugagcuguuggugagguagauuucuguaaagaaaugucaacaguguugucuuuguuaggguaauaauugcuaugauaaaacaccauuuugcuaugaccaaaaaccaaguuggggaggaaaggguuuguuuauaggcuuacacuuccauauuauuguuuaucaccaaaggaagucaggacaggaacucaagcagggcaggaaccuggaggcagaugccaugaaggggugcugcuuacuggcuugcuucccaucggcuugcucaacuugcuuucuuauagaacccaggacucagggauggcaccacccacaaugggcuggcccuuuccucaucaucacuaauuaagaaaaugcucagcagcuggcucuuagggagguguuuucucaauugagauucccuccuuccagauaacucuaguuugugugugaauuaagacaaaccaguacaaauguauugaauuucaucaacauuauaagggaaaguagaaauuauggcuuaguacuugcauggcaugcaugaaaccucuuagguuugaucaccaacauagaagggaaaggguuuuagaaacauuucuaagugaaauacugauaccuauacagcccuaauuucuuucuuuacugucuagacacucgcugaaggcucaagcaaaugaagagugagaacauuuaaauaaaaaaauguuagaugugauuaguuuggaaaaugugugaggaugacuaggaucacaugguguucccugugguaaauguucaaguaauguuugaaauucauacucauucauggauggacucuuucagagaagcguugggauacauccaucaacuucuggauuauuuuuuuaguggggaaaaugucuaugccaaacuugugaagucuguuguuaaaacuacuguuucuguaguaaauagcuugacagauguuagucugaaaauguacauaguuucaaacauacugacagacaguucagagcaauguuuggagauuuaauuguuugagagaaucucaauaggaaauccauuccccuguuauccauccauccuugcuguguuuggaugggacacuuggcuaggugauuauuaacuugaucucuuguuucagucauauuuguggcugaaaagacuuuggaccacacugacccaaauucaaacaaaugcaaaaagacacuuguguuuaaccacaaauugaaugauaaccuggaaaucauaagguuauuuugcuuuauacaagauuugacuuauuguacuuauauacuaaauccuggguaggcaaucuuuuucugacaaaaaugucauacaacauggucuugccucuuuuacuugcaguuuuugcaaaacguauuugacauugauuaguuucugcaagcacuugucuguuuucucuaaaucuuugcaguguaaguuucuuugucguauuuauuuauuuacaguugguaacagguguaaaucuugccaaauccuuuuuaguuaaccuuaugacuuuguuacuuuuuuucuaauguaguaaaauuaaauucaauauaguuuauuuuuaaagugaugacuuauuuucucuguggcugugugugugugugugugcgcuugccuuuuacuuugaacauacuccuagugagauguuuaaauaaucuuuguuuguaaacuuguauuagagacaaggaucucccacugcaccccacccuaguguuaauggucagugagugugugcacgaggcaguucccugccuccccucucccuuuguuggacuuuuauucauuucuucaaagaggcauuuuguuuuaauaaaaauaauucuguuggauuacuuugagaagaguauaugacuuuaaagaaaggaagauaaaguaggagaaauuuccuaauuuacugagaggugauuacagaaagaaucuacuguucuguuccuagugucacauuuuaaguggcuggaagaaccaaaggguuaaaaaugagaccauaagaacaaacuuuucuaugacuuuaggauaaagaaaccuuuuuuuucuuuuuugauguuucaagacaggguuucucuguguaacucugacuguccucuguagaccagauuggccacaaacuccagaguucuccugucucuguuuccugagugcugguacuaaaggugugcaccauuaucccuggaaaagaaaccuuuucucuaaggguuacaaaacaaagaagcaaccacuguggugguucaggcucaggaugauaaguaaacuggggaacuuaaauccugauauaaaagaaacugaaaaagaagucuagggcuggcugaauaacucagugcuaauauauacgaggacuuggguuccauccuuagucugauuuuaaagucuguggaaggugccuuagugguuaguacaugccugguauauaugaagccugaugucugaucuccaaagaucaagaaugcugacuguagaguuauuuuguuggauuuuaguuauagaacuuuuguaucuuugcugguuguggugguucuugccucugaucccaguauucuggaugcuaaggcuggaguauuuugaauuugaggccaaccugggcuauauagugggugagcccaccuccuaaaacaacaacaacaacacaucaucgucgucagcuaaccaacaaaucaaaaaaagaauuuccacauagugcauaaggacuaacuuucuuuauuuguguaacuauuucaacucaagaaaaacagaauauagucagcauucaauaugaaagugaccaaaggauguggaugaacagauuauagaaaaaauauaaagcaguaaaccugacauuaaagaugcaaauaaaacugacaaggaauauuuucaaaugacuagcucauuaaaagcuagcuaaaugagugcacagacacuuaugguuggcagaggagaguacacuugcauacuacuuuugagacaacaauauagaauucugugacuaguaugugcuauagauuuauuuucuuauagaauaauuaaagaagugcucgugggaauauucuguguaauauuaauaaauauaggagaggaagcagucugaaugauuauggguaaggagcuggauuaaaaagcauacuguguuagugacauaguuuaacuucucaggacuccugugccagagagaacugacuugcacacuuguccacugaucuggacacgugugcuguggcauugugcucaugugugccugcauagacaugcacacacacaaaauaaaauucuaaaaguaaaagauuucacuguagcuauuuuaagcuaaagaauuuuaagcuaaaauauauucagcuaaaauaaacacaaauauaaauucuauaugucuacuguggcugguuuucagcuugauuuuacucauuguacuuugacuuugugauagucugagagugauagguucaguaaaaaccacauuucagauuuugaauuuugaucuuuuccaguacccacaacaguggcucagugaauccaucugacaccuccagaccucugugggcaucagucauuuugagcuugagugaaucucaugccuaggaaagaaguacugggcuguagcccugccuccaagacuuacuuuugagucuaggcagugguagcaccaccucugccagucagugaguguguguguguguguguguccacgccagucagugaguguguguguguguccacaugcgcgcugguuguucagcccuauuguucacuuugaaucuucagugaaguaucuguuuacauuucuuacccacuaaaaagggucuuuuauugauuaacaagauuucuaucuggauauaauucccuugucaaauacauacauuaaaaauauuuucucagauucuuggacaugcuuugucuauugucuuuuguuuuuuuguuuuuuguuuuuuguuuuuuguuuuuuguuuuuuguuuuuuugucuuuugagacauugcuggagcucucuauguagacuaggcuggucuugaacucacaagauugccugccucugccucuuggcucugagauuaaagguacuucuguuuuuuaauuuccaagguuuaauauaacccaguuuaugcuuaauacaguguuuucugguuucaagaucacuaagauuuucuguuuuuuuuuguuuuguuuuguuuuguuuuguuuuguuuuguuuuucaagacagggcuucucuguguagcccuggcugcccuggaacucacuuuguagaccaggcuggccucgaacucagaaauccgccugccucugccucccgagugcugggauuaaaggcgugugccaccacgccaggcuguuguuguuguuuuaucagacacuuuuauuuugguuuucaugauuauaugacccguauugcaauuuucagaaugauauaaaauuuugugccauccuucaaauuauaguugcaccauaugcaccuugaagacucaguucaaaaccuuuaaaugugaaaucuucacccauuucuugguagaaacuaaucucuguauguguauagauagcucuuuguacuuuuuucuucuugaauaguggagucagugagauacccaaguuuguuacuugguaacuuucuuuugggucccauauuuuacaauuaauuuggguccuuuuuaugucucuuuaaaauucuguuuuagaaaaaccuuauagccacagaaaaauuagagagaguuugugugugugugcacaugugugugcacgcacauacauacaaaaugaauccuauguguauauucacuuaaaauucauugaguuugaguuaaguagguuuauaguuuuuacucacauuggaaaauuucacccacugacugggauuuaguaacauagccugaaaaaucuugagucagagacaagaauauuacaaggccaggagcuggaaagaugauggcucagugauuaagaacauuggcugcucuuccagaggaccuggauucaauucucagcacacauuugacugcuuacaacugucuguaaccccgguuucagagggaaucuggcacacacacaggugggacacagauagauacauuuagccaagaaacccauacagacagagagagagaggagagaggagagaggagagagaggagaggagagaggagagaggagaggagagaggagagagaggagaggagagaggagagaggagagaggagaggagagagagaaagagagagagagagagagagagagagagggaggagagaggagaggagagagagaaagagagagagagagagagagagagagagagagagagagagagagagagagagaacgcgcgcgcgugcuacauuuagccaagaaacucauuuacuaagauagguagauagaugggaaggaaggaagaaagaagaaaaagaauuaaauauuauaagucuaaggcugacuggucuacagaguauauucagagccacucuggacaguuuaaugagacccuaucucaaaaccuaaaaaugaggauccuggauuaaaaguaagaaagauuucauucuccccccccccccccauacacacacacagggagagugauucuaauuauauguaaaucaguuugcuuggauuugucuccacagcucucuaguguuuugauuuuuccucauuuuggacaguuucuaugucuuaaaguuuaucaaauguaguaucauuaauuccacucagaaaaaaauucauuucagacauuuuaaugaucucuaaaaguuugauuagggcuuuuucuuuuuuuuuuuuaguuccucacaucuuauaaugucauguuuuuuguuguuguuuuguuuuuguuuuuuauacauuaacauacugggacagaaacaaagugacuuuuaaaugcccuuguauacuauuuuugccacuugucauuucugacucucauaauugacuuuuugucuuuccuuuuccugcucuuuauaugucugcucaucuuuaauaaguuugacagacauuuguguguuuuaccccuuuauaaguauagauaauuuuauuuuacuucuuuaaguauucuugagguuugguuugauauauaguaaauuugcuugggaaaaaguuuaaaucuguuguaguuuuaagcuuuuuuucccuugaguacuggagaaccuuuaguguaaggcugauuuuguccccagauuguggccguacucuuaguccuggcugguauucugccuauuaggaauuguucuauucuuaguacuuugugaauucuggguacacucuaccuccuggcuuuuuucuuaaccuuacauuuaugucuuugcugaucacagugaucagggcuaaccugaggacuugagggagcccugcccagcuggagcucccugugcagcucuguuccuucugcuuacuguuaccaugaauuuuggacaccuuggccauacugaguuuucauucaguucucacauauuacuggucuguguuuaguuuuucucuuccuuugcuguugccccaaaacuuugacugcacaguuacagggcucaucuuguuuccccucauggagguucauugcuuuaaacugccuagcucaguacuugaaaaugauuccuuuauauuuguccagaauuguugucuuaguuguuuaaggugggccauuuuguucuguuguucgucacgguuaaaagcaguagcuuauguagaaauccacugguauuuugaagugguacugguuaucuucugugccucaguguuagaugagguuguuauccccaaguguuuauauuuaggucuuuugaaaguuguucauauuacaggguagcuuguaaaucauuucaaagagcagaugacuuacaaaggaacauauugauuuaaaacaccccuagucaaugccacuuuggguauugauagguggaguaaaugcagaauuuaauucagauuaaaugauccuucuugaguaugagaugcuacauucaaacuucgcugaaagauaauuaaguacacuaaaaagguaauacaguuaacugguuacaacauagacauugcaaauaugcaacuauuguccaaauagggauaauagggauacuuaaaauagguacuaguaggaaauuggguaaauagucaggugauauuuuaauuaaaaaaaaaaaaagcaacaucucaugaaacuuagauucuguaaaauggcuguuuaaaaucaagaagguguguguguugggaggugaguaugcagacacacaugcacuuguguguugaggccagagggcaauuuuugguauaguuaugacuaauuagcuguacaccuuuguuuuugagauagggucuuucacuggccuggaaugugcugauuuaggcuaagcuggcuggccaucaagcccaagagaucugccuugucucuacuuccccagucuuggagcuacaagucugagcugcacauguggcagcucauaauuaaauauguguucugagcauuaagcuuagguccuuauguuuauaaugcaagcacuuuaucaacugagccaucuuuucagcccaaaugugauuauucacgagugacucuaaugucuaagaugaaaauaagcuuuccaacuaaaauuauuuccuaaaaugugauuguuguuaaauauauaucaagcugauucaaauuuaaacuuagcuuuuuggcaauucuauaucuuacaaguuuaguuggcaaagguauuucagagguuuucuugggaaaaugaguucucauuuucagaaucaauucagauuuucaauuuuguaacuaucuacaauuagaaaggcuccucagucauccacaccuacugagggcugguuacacuguggucacacugucuaacccagaggugaggaggguaaaauagugggcacaggagcgagcauuccugagcuuuugcccugguugggacuuagagucuccugaguauagaaauuaggacagaaguaagguggggcggggggggacgacucuuaguaccacugugcaguuuauaaaaaggaaacggaguucuccuaacccccaccaggaaaaaaaaggacugguuauauagcuuauuaguggguucaaccacguuucugauuugcuauagggauuguccaacaucugcuuuuaggaggucugccacacugaggaagaucucucucugggcaagacuauuucugguaucuuaaaguuucaugagagaaauuucagaacacuaagaaagaaaccaguacauucuucucaaaauacagugcccugacaguacuugaauauugccuucauuguuuuaaaacaaucauuuuguuuuaaaaagugauaaauuuauugaagggaccaaaauugcagacagugcucuuccuucuaugugcuuuucuaggggagucagccgcuuaugaaauggaaaggcacuuggcgccccugugcccagucucugcucugcuagccuguccaauacugugcuugauaaucuugaaggacagacaacauuuaaaaaguuggaugaauucuggguuaaaaaaauccccacuuauugaggaguuugaaaugguacaguuguaacugccuuccugugguguucccucccucuacuugagggacaaggaauugaguggaguagauuuaguaacacaauaaaguaacagucugucuucacugguaaaaugcuauuuauuuugauaaagagagaaaguggaaguauuaacgacacuuuaacaugauugcuuuguucuucccgcuccccuucucaaaaauaacacuuggaauauuccauucauuacugccgagaaagucaucgguuugcaggcugcagcugcugagauggcuuagugggagaaauguuugcuugcauuuuucuagugauucuuuauuaauuuuuuuggccguucuuugaauaucuaaacuguagcaaaccaggagaaacagauuuaaauuuguguuggggaaaccuccuuguggggcauuuuaucagaugacucccuggcaacgcacccugaagagauggauuaaugagguagcgucugaagcagcagugggcucgcacggaaccaacccgccaaguugcacaguguucuguuggauaauuucaaguucuugagacacagauuacauaaagaagauuguggggcacgugaugccuucuggcuucuuauguuucagagaguagaaaaauugcuagcucuaagaauggauccuggcaagaucuuggcacagucauaacuuuucaucuaugauuuuaucuaacaacuuuauuuaaaguuuuguuguuaugaaauaggcauuuugaauaguuuugcuuuuguauaaaauauuguaaugguagaauaauggauugccugugcauuguaacuacaaagguaagaugguaugauuuucuguguucauuuuuaaagauauaaccauuguuagaugcuugaaaacagaucuugaaucuuuguaaugcauaguuagcaaaggcaauaguuugcaauguauuucaaguagaucaaaaauaguguguuaaacugauuuuuuuccucucuccaagauuucaggaagcuuuccuccuaacagcagaggucuggaaagccuuggugugcucaggucuuguauuuucucagagcucuucucuucuacccugacgugucauguuagcugccaguguaguucauuuugcagacagcucuggacucuucuuucuagcagucggguucuugguguguuguucgauagauacuggucuggacugaggacccuugacuuccucaggcacguccgucuugaagcacuuuugaaggcugcucugcuuuuuaucuugagaacagcacgccucacuuagucuccaagcagacgacuuugguuauaaguuuuaggugcuuacauuuaaacuuuagcuuucaguucucaaaacaggaagugcccuuuuuguuuuuuauuucuacauaucaaugucacauggugauuuuuagauuuaacuguugagacuuuaaaauuauguuuagugauaaaagaauaaguauuucugaaaacaguguauuauuauuucuguguagugaauuaguucucagaagaaaccuggggaaauugauggcacugaguucuuguuuuguuguauugcgugcagagcuuugguucagguagcagucugugaucaaugccagugugaucagaugccuguccucugcucucgggcaugacuuuuuaguuuguguuuuccuuuuuuuuuuaaucuguguuugauugucuccugugaauuaccuuguguaauuucauuuaguuuaaauuuuuuucuuccaauauuauagcaaaguuauuugauauaucucuuuagucugaauuugauagaauuagauuuauuuuuguauucagcucuuuuaggcagaagagaacaauuuuuuuauuucuuaaaaaccauuggauauaaucacuuaccuuaaaauauuuauaaauuauuauguaacugugaaaacaaaaauaggaaaauauggagguuggaaauuaggaagcauaaaacauuauuuguaguucugaaaaugcuaaauuagaauaauuuauucuaugauuagaaauaaacacugaacauuuuuaaucaguugcuacagcaagauaagcaaaauuuuuuucuccucaacuaaaggcuucaguguaugcucccucccccuuuuuaucuuccgguucuaggguccuuucagauuuuuggagaguguuaagcuguauaaaaucugacaguguaguugauauaauucuaucguguuaauacuaaacaccucaaguaaaaauuuuuucaucauccgccuccccuuucucccacuuguguaggcacagugaacuagguaggcacguugcaucauugcuaccauggauacccuuaagaccaggccugugggcugagcuacagcagugaugauuagcuuuuaguccccccauaacuauaauaacuauauguucuucacaaugaagacuguuauuuuaaaaugcuuucaaaugacuagguugugagaugagaugacuaaaucuucacuguuauugaacugcuaaaucuuggccuccaucuacaguaguauaauuggcauuuacuaauuuaagacagucauaaauagcccuacguuccucuucugacuaauacaguccuuaaaagguuucccugcuccuagagcugggaauuagacccaggaccgugaauaugucaagcaagcgcucccaccacugagcugcauacccaacccugauuaauaccuucgaaacagaaauguaguggauuugaaagcaugcuucuuccaugaauaaaaagaaaaaggcauuuuggguuuaaacauuuuuucaagggaaaagaacacuuagaguauuguuucugguuauuuuuacuuauauuaauauagauuauauguuacuuaaucagcuuggguacaauauuuucuuguaugucucucauauaauaucuuagaaaacaguuuaguuuucuccuugagaguuuuuagcuucuuaacuagugauuuuauaaauauaucaguguggagguaacauuaggggcuaggcagaggaauaaguuucacuagguucauuaucacuguagggaagcugugaccacacuagaucuaaggaguacuuugggaauauugcuaaauagcucuuuuguuuauagagcaguaaagugcuauguguaaacugcagcucagggugucuaccuuccucauggauggaggauuuuaucuggucaguaacugggaggaaaaaagagaggaggagcuaacagguacaaugaguaucaggauugcuuguaggaccauaucuuuuuccaccuuugguuauaguaguuuuugaucauguaauuagaaaggcucuucucuaugucuucuuaggaccauuuaauagacugauagauggcagagaguagaacuagaaaaaagagaaguguuguguacaauccuuaauuaacucugggaacucgagauuaacucucuagcucgagauuugcucacacucagugccgggugugugugugugugucucugucugucugucugucuuguaugugccgugugugcaccagugcccaaggaggccaaaaggggguaugggauacuccggaacuagaauuagagacacuuguuaauuauguagaugcugggaauugaaccuagauucucuggaagcucagucaccacuguuaacugcugagcugucuccaaucccaguuguuaauacuuuuauuauuuaauuugcuaaaucagguagcucauguuaggugcugucaggacaguuuuaauauuuguguguguuuuuuuuuuuuuauauucacaauuaaagaauuggcaauacuuuugcuuuaagaacuaccccauguuuccguuacuuucuguuaauagggcuuuuuccaggucuucugagguguuucuuucaucuugagguauaugugcauagauagccguuuccgucuuguuaccucagagcuuauccuuccgacuccaguuuguggauggcuggaucagaacuacuuaguucugcugccgcuguacgagcgcacccacuucuucucacacacaguagacuaugugugcacuuauauucuuuaguacuguguuguucuuauuguacugaaaguaucaugcaaguagcauuguuuaguuuuccaugguauaucugccugcccaaguguucaauauauaguagcuacucaguaaauauuuguuauggguauagcuuugguccagauaaccgaaacuugaggccuaaaaauuauauuacuuuguaaugcacuuaaagauauuuccgaaaacucauuuuauuggugcuggagagaaguagcuuagugaugagaacucuggcugcucuuccaaggaucuggcuccaguucccagcacccaggugggggcucacaacugagugugacugcaguuucaggagagccagugaccuuugcuggccucaguggacaccaagcacacaaguagggcacagacuuaaaugcaggcagaacagucacacaccuaagcuacacuauuagaaauuaauuauaauucugcauauuuuuuuaauaauaaauucagaaagauccagaaaguagguuuuccuguuguuuccacuuauuauuuuuuuucuuuuuuuaaaaaauaauuuauuuucauuuuauguacauugauguuuugccugugugagguugucuggucuuccgaaacuggaauuacagacaguugugagcugccaggugguugcugggaauugaacccggguccucuagaagaacagccagugcucuuaacugcugagccaucucuccagccccaucacucauuucuuguugaguuauuuauuuguuuauaccccaagaugccccucacagauucucuccucccaucccccuuuccuuuuuccucugagagugcagaaccccccugguucaucaagucucugcaguguuagguacauccccucucacugaggccagucagguugccccagcuccaauugugggacccacauggagacugagcugcacaucugcuugcuugcuugcuugcuugcuuguuuuuuuuguuuuucaagacaggguuucucugugcagcccuggcuguccuggaacucacucuguagaccaggcuggccucaaacucagaaauccaucugccucugccucccaagugcugggauuaaaggcgugcaccaccacugcccggccugcuucugcuuucuuauuuggcuacucacuuaaaugccggaacaauccaucgacugugugacguuuguauuuguuucuggauuauacuagaauugagaaacagaaugcuuccucacauuagugcuucugucucugagcugcagaaugucagcagcuucaccaucguccaguagaauuucauacagugauggaaacaucccgaaaauggcacuguccugucuacuaacacuugaaauguaguuggcuuuuacaaagaaacauaaguuucuaauuuauuuaguauuauuggcuuguaacaaccauuguuauucagcagcuaaucuuucacucucugcuccuguacuuuuuuuaaaauauaauuuuugaggaauaagcuuaauucaagcaaacuaacaacaugcuuguaaucccaucuccugaguaguagaggcaggagaauugcaaguucuaggccaggcugggcuguuuggcaagacccugucuaaacgaaacaacaaaaucaaaacugucacuaaauaaauaacuuagauaaccaggcauggccggucucuauuucccagcauucaggaggcagaggcaggagguagcucacugcaguuccaggguguacuaguuuacuagcuuuaggcucaccagggcuggagggagagacccugccucaccaucucuccuccucaguauaugcacugucucauuuuuauuccuucucucccucucucucuucuaggggaaagugcuuuuuuuuuuuuaaauguguguguacauguguacacacaugaggccuggauucuuccucaucgcuuuucaguuuuugagacagggucucacagaaccuaauccucuuccagccaucaagccccaggggucuccugggcucugccucccuagugcuggguuacaggugcacacugccuugcuuggcuuucuacaggaguguggggaucuguucagcucugugaacugagccaucucccuagcucaagaaacuguuuuuauuuauccuguuuuuuuucaggacuuaauaaguaaguaaguaaauaaauaaauaaguacuuaauaaguaaaaagaauguuuuuauuuuucucuuagacaauugauaguauauuuuacauuuaugggacuuuucacccuuugcugaucuuaguuagaaacuucuccucaauaauuaaaaaaaauugauuguguguaugugauuauauuuaagcaaaaauggaauuuagauucauaccuauuuuaggaaaaaauucuagaucuucaaaagauacaugcuaagguuugaacgauaaugccaauccuccagauucagguuaaaacuuucuacaugcaauguguagguguugagaguuauagccuuugagaaugguugugucaugagugguuuggccaugugagcugcaccuugaugaaaagucucaagguucaaggagcccuuacugucuuucugccagagaggaauguaaaguguucugaaggaugccuucugccccuuucagauaccuguccagagaguguucucauacgguccucacuccaacuuccauacucauaggaaauacauuucaguucuuuauuaauuauguaaucuguggaauuagagucuagcaacacaaacgagcugaaauaaucguaaauaagacuuucagugagcagaacaauucuuucuaauuuuucacuguuaaaaccagugcuucaguaagcaacuuuguuauuuuguauuuaugacggucuugucuauauauauggcacugcuaguugagaggaaaauguaacuuaauuuugguaccuauuguucaguaacuccauaggaauugugccauuuugcauccuuauuagcaguauaugaugaaauauuuuccuguaaauuagcaaaauaaugaguuuccaaauuuuuucuucuuugcuggaugagcauuguuacauaagugaaguuuuaauuugcauuucuuuauaguauuuaaacaagguuuauuauacuguauuauuuccagaaguggucuuuuuucccuuuuggugguuuguaagaacuuugucauuuuaaucagagauuaaccuuugaugucggcugauggucuccacccucguacacguggucacggucuuuacugucacaguguugcccuucacccucccuuuucaguaaaaucguuuucuaaauuguuaccuauuuguucuugucauuuuuuaaaaauuuucuuauuuaccuccaucccaaugaauugaaaugacaccuaguaaauucgcguaucuuuggaccucuuucugggaagucggucuguuucacuggucuguuuaugaaccagcuugacagaguuugacugauugaagcuuuacauaguauaauuuagaaucugauauggucuuacugcuuaggacuguuuuagagcucugcuuacuuaaaucuuacuuauucuuuguuugagaaagggucuugcauagcuuggacugaccuugaaugcauacuccucaaguuucuaaguguguacuauuaccccuagcuucauuuauuuuucuauacaaaauuuggacucauuaaauucauuaaacauuuuguuguugagagacccucuaaaaaauuagccuaacauccuugggaauguuucuugccugguucagagaggcaauagagcuaguuagauacaucuuuccaaaugcuaguaugaauuagcuaaaagaacauucuguagggccagugagaugauucagcaggucagagugcuugccaugcaaaccugaucaccugaauuugaucugcagaacccagggagggcggggggggggggggagagagagcgcgcacugaagucagccuuaaccuccacauguguguaguggugugugccuccacucacacacgcacagaggggaaaugcaacauauuuaaaaagcaaaccacuguaguuuuccuaguuuugagaagcugggugguagauuauuguaacuggacuccuuaggggcugcuuuuuguuaauaggacacaguaugagcgaggauuaaagacguauuucaccuguucccaaguugcuuuuacccuuugcauuauaauuuuacuaauuaacuagcuccaaaucuguucuuugacuaaaacacacuuuuaauuuaauuuaauuuaaauuauuaguuuauuaguuuauucuugaggcagggucucagcuguguaguucugacuggucuggaacucacuaugcaaguaguugccagugcacccccccccccaauccuuuacuccuguguugacuguuggagucagaugagugcugauuagguugcucugcugcugaggugcagcacacccaacagguguauugagagaucugauaagagauugaaggcaagggugcuguaaccacuugguaucuuuguuguggcugagggaauggagaugggagggaaugggauauuuguguuuaaugaauuuugaaaauucuuaacaugucauuaaauguuuuacuguagcauuuuaaaugauuuuauuguuuggauguuuuauaauuuauuuaaucaacauuuuuguuuuuacuuuccuuaaaaugauaaacuugcuguuaaaucugagcauaaucaagguccauuugguaggaguuucuaauguaaauaacauuuuaauguguugguaaacacagcuauugucucacaguuaaauuaccuucagacugucuuuuuauuugaacaucauaauauauacugaauguguuucugcuaagguuuuuauaucuggaaggauucauuaguauuucuuauuuggaacacagugauuaggguuuuuugagcuuuccgguuuuuguuguuuggauuuggguuuagugacaggaucuuaggauuuaacccuggccuggaacuuacuaaguagaccagaguggcuccaggcugacagagaucugccugccucuguguuaucugggauuaaagaugcgcacuaccaggucgugcaguacuggaugguguuucucauuucaccuuuuuuuuauuuuucaguaucugguagugcucacccaucuuacuccggaucuucugagucgauacuguuuucaagcacugccuuuauugucuguucaguuuuuuguaaugaauuccagaugaauaagcaaggcuucccuuuucuuguucugcugcucucacuuuaaauucuuaacuuccuuuaaauuucuguuuuugcugaaguuccucaacagguacugugcuaguuagauggacaagagccuacaagguccuuggcgaagagagcucuggcucuggagacuguuggauuguugagaacaggacugauugaggggccgguugcucaggauuccuucugggcugcaguguccugaucuguaacacagggagauagagcgacuucuuuacaaccucuuuaagauuaagugaacaaagacuggcucaugguaaaguaacuuuuaauaaauagaaaauaaugcagccuccuggcuggacagaauagucuuuucugaauaauuccuuuuauaauuacugucccgugcuuuuuaaaugucugggggugguggaugguuuucagucaccaucagaacaaguuggaacuuagaauaauggcaguauaaaggacagugauucuuaaaguugcuucuacucaugccuguuggugcucuaucagcuuuuugucacguugauucuauagcuuugagcucccuacgccuggccgucuguggcaguuccagaucugcagcugcuaaagguuaggguuaggauagaguacuucuuccaggguuagagagaaaagaugcgccuuuaugcugggaugacuguguacuccaggacuuauuuuaacuggguaacuguuaaacaucaaguaauaaauuauauuaucauuuuuauuuuuguuugaccugcuugaaaauuaugaauaccaaauuuaaucuauauggacaaagucuucucauauacacgagggcacuuuuccuuguaauagguuguauuaaaauugcauuucagccagaaacuuugagagaguugugaacgcucaagaguucagauuuuuuuuuucaaaguuaaagugaauagaaaugcugcccucuacuguuagcuaauacuuuacugccacacaaaaauguucauaagccuauaccagguaauuuuuuaguauuuauuauuccacuagaauaaauuuugauaauauaaaauguuauugugacaauuugauuauuauaauuuaguaauauuuauuuccaugaaauguuuguacucauauugaccuuuggaaaaacuuugguccuaaagcaagcuuuugcuuauaguuuuacauuucaugugguaaccuuuaaguaguucuagcauuuuaucuucugcuugugugacucagagcuugcauugacuaccuauaaguaagccauauauaauaauuuuucuaaaacaauuauuguuucaguuuaucuuuugguauuuaaaguuucagaacuuucauguuuugaaauuucacauuuugaauaguauuaaguaaagauguagaucuuuguuuaagaacuaaaaggaaauuuuucuuuaaaaauuauguugaguacaguuuaaucucugaugaaaagauuagggguaauuuuaagauugcuucuagcuuuguuuuauggaguacuuucuacauauaaagcccuauaacguauauaaaauaaaugauaaaacccuaugcuaucuauaaaauaaacaugggagacaaaguccagcaaacugagcaguaggucaaaucaggcucccugguguuaguguggggaggucauugccaagaauucuaacaugugaaagguuggaugcugagacuggcuaguagucuuugccauaaccaugggucugcgaaaguguaccuugacggaaaaaugaggccauuugcauuuaauuuauuuugauauuuugacuuggauuuaguuuuuguacauggaaguucuucauauacccuggguauuaauccuuuauuagauuauuuauuaaauauuuucuccuguucuuuuuauugcuuuuuugggagcagggucacuguuggcucuggcugaucuguaacucacuuuguagaccaagguggccuagaacucauagagaucagccagccucugccuccugagugcugcaguuaaaggugugcacuucugugcucacccccuccccaucuaugccugcccucucucauucugugaauuugccuuuugcaauguugauaguaucuugaugcaugaauuaaaguuuuccugaaauucaauuugucuauuuuucuuuuguuaacuguauuuuuguugucauaucuaacgaacuuuacagguucucagcauuuuauaguuuagguuucuauuugguccuuuguucguuguguguccaauuuuuuuuuacaugguauuagguaaagguccaacuucauuuuguuacauaugcaaguauaguuuuucuaacaccacaaguugaccaacugccuuuucuaauugaaugauuuugacauauuuguaaaacauuauuugaccauguuuuuaagggguuaaugugggcuuucuauguuauucuauucagauaucugccuuuaguaucacugcuuugaguacuauaguucuguagaguuuugaaaccagguacuuauucuguuuuucacugucucuuucuuucugucucucuuucuucucucucucucucucucucuuucucugugugugucuguuugucucaguuucucugucucuuugucucuaucugugugucugucucucucuguauguguuguagauguguguaugugcauguuuguguguacgugaauguguggaggccagaaguugacauuaggagucuuuaucacuuacucuucuccuuaucuuuugauuagggucucaaugaauucagacucaggaauuggcuagaugucuggcuagugagcucugggucugccugacucucccuagcuccugcuaggauuuagaugcuagucaucauaccucacuauugugugggugccagggaucugaacucagguccucaugcccgugaggcagacacuuucuugacucuccauuucccuagcuccuuagcugugaucauuugauugaaaauuucccuuaauuuggaguuaauuugcugaaggaagucugccacuaaggguggacuccgccuuggucagguuugcucucugcuuccugcuugcauuugaggaugcuccuggcaccaugccugcuuccuccugcuuugcuucccuaccgugcugaacucacccucuggaaccuuaagccaaaauaaaccuuuccauuaguugcuuuaauugugguauuuaucaaagaaagggaaaaguaaugaagauauuuuaaacuuuccuuaauaauuguucaggaucccuugagauucuauaugaauuuuagggugggcuuuuaauauuauacuugaaaaaagucacugggauuuugaguuugccuuguguguguagauuggcuuagaaagaagcauugacaucucaacaguauuaaguguuucugcagagugggaaguuuguuaaguuuuuggucauacuguaguuuguguagacaaguauuguuguuuucauugcagaguaggauucaaccaccuguuacucagaggcacuugaggugggaaaacugcuuacuccucaaacaauacaguaguacuugcagguauuauuaaucauggggaugcauauagguuaugugcaaauaaaaggaacuugagcacacucauuuggguggcaaggcggccuuguaaucagucccuccaggcuccaaggaaaacagcuuuuuaaaggauuuugacaucaauauucagugucuuuugugauacaucagauuuuuguuuguuuuauuaauggguaauacauacggacguauucaccuuccuaauauuuuggagauaaauguaaggggaaauuaaagcucacuuuuaaaaaugugugguagaaaucauuggggucacuggguuuuuuguuuguuuuuacugguuuaguggaguuuuuuuucccccuuugugguuuagucuuagaaaguccuccauacaugccuccccccuucucucucucucucucucucucucucucucucucucccucccucccucccucccucucccucccucccucccucucucccucccucccucccuccauuccucccuuccuuccuuccuuucucccuuuccucucuccccuucuccucucuccuguuaucucuuugucucuaucucccuacaggaccuacuauguaucccuggcuggccuacacucaaaucugucauaaaucugucugccucugccucuucguccugagugcaggggaacuauuuccuuuuuuaucuucugccugauuguguuacucauagggaacaugauuucucuagcuauuauuguagaacugucuuuuacaguucuaccaauuuuugauuguuaauaguuugauacuguauuccuaaauguuuacaauuaugucuuccuguauugaaacugcauuaacauaaaaucucccuucuuugucucaaaccuuuuuuaaaaaauagguuauuuauucuuuuuuuccuauuugcucuucuuuuuuuuuuuuuacaauucaaauguuaccuccuuucccaguuuccccucugcaaaaccacuauuccaucccuccuuacccugcuuuuaugaggguguuccccuaaccaucuauccaucccugcccacuucaucucccuagcauuccucuacacuggggcaucaagccuucacaggacuaagggccuccccucccauugaugcuggguaaggcccuuucagcuccuuuaaguccuuucccuaacuccuccauuggggucccugugcucaguaccauaguuggcuuugagaauucgcaucuuuauuggucagacucuggcagagccucucaggaaacagauguaucaggcuucugucagcaagcacuucuuggcaacagcaauagugucugggugugagauagauccccagguggggcagucucuggauggccuuuccuucagucucuguuccacucuuucucccuguauuuccuuuagacagaagcaauucuggguuaaaguuuuggagauggauggguggucucaucccucaacugggggguuaugccuaaccucuggauauggucucgacagguucuccuccccuuuuuggguauuucagcuaaugucaucccugugggguccuaagaggcucuugcuuuccuggcaucugggacuuuucugguugcuaccccaaguuccccaucccccauugcuacacaccucuguucaauuuccugacccucuguacaucucugucucuucccauaccugauucuuacccucuuccccccucccucuucucuuccuuccaagucccucccacccucuacuucccuugauuauuuuguucccccuucuaaguaggacugaagcacccacucuuuggucuuccuuccucuugaacuucaugugguccuugaguuguauuguggguauucuauguucuuugccuaaugcccacuuaucagugaguacauaccauguauggucuuuugugacugagcuaccucacucaggauggcauuuucuaguucuauccauuugccugugaauuucaugaagucauuguuuuuaauagcugaguaguauucuuuuguguaaauguauuacauuuucuguauccauucgucuguugagagacaucuggguuguuucuaguuucuggguauuacaaauauggcugcuaugaacauaguggagcauguguccuuauuacauguuagagcaucuucuggguauaugcccaggagugguauagcuuauuuauucuuauuuuauguggguuggguuuuuucccucuguauguaugucuguuugagggugucuuauacggucguuuguuuguuuguuuguuuuuuaagauuuauuuauuuaauguauaugaguacacuguagcugucuucagacacaccagaagagggcaucggauuccauuacagaugguugugagccacuaugugguuacugggaauugaacucuggaucucuggaagagcaguuggugcucuuaacagcugagccaucucuccagcccccuuauauaguaguuagagauaguugugagccaccauguaggugcuggaaauugaaccuugguccccucagugcucuuaauuacugagccauguuuucagccccuugucuuaaaauuuauugauuugaaguguuuuguuuugucagacgaggcuaucaacauucagcaguucauggugccacaugccuuuaauuccagcacagcacugggagacaggaggaucucugauugaggccagcuaagacaacauagaagaaccuuccuuguuugaagaaacuuaaaaaaaguuugcuaggugugguggcaauacaccuuugaucccagcacucaggagacagaacaggcagauaucugaucuuuauugcuaugaaaagcaaaacauauaaauagacaaacacacacacacacauauacauacaugcauacuaaauauauauauauagagagagacauccccguucucuuuuugguacuauuugugucuaauagcaauucucauuccuuacuuucagcaugucuuuauauugaaaguugggcuuuuuuagacaaauacuugaaucaugcuuuguuuuaaaaaauacauucuucagucacuauuuuuaugguuaauagaggauaaaacaauuuauauuuguaauuacucguucuggagggucuucucccacuuugugauuuauuucucggguauuuuauggcaguuuuguucauuuccuaucuuucucucuucuguguuugauugauuuugcauagaacauuucaauuuccuucuuuuauguauguuccauuucuacuuucuuuauaguugccaugagaauuacauugaacauucuaacgauacagcacacuauuuagaacuuagacuaacccuuagaagcucaggacaauugcuuuuugacagcucuuucccaccccuuuuuguuguugauauccagauuauaucuucauguuuaaugugucccaaagcaugaguuaacagcuccuuuaaauguaauaguccuuaaauuuguuaggacaaauuuauaaggucauaaaccaaaauaaaaaccugcaauacaggcuaaacaucucuuaucagaagaucugaauuucccuauaguccaaaaacuuggagcccugaaaugagcucaccuguaggaaauuucacacuugacuguaugugauagguuacaaucagaaugcugguauguuaaauauguagacauuucccuuuaguucauguguauaagguauuuauuggaacauaaaugaauuuuguguuauguguaugcacacagacacacauacuuccaugcuacaaguacuuacuuaucuuacuguaauucuuuuggcaugaaaauacccuugcccaacuucaaacuuuugaucaccagucuagucuguccauuccucucugaaaaccaucauagcucuauuucuuuaaagauuucucuacacagcuugucaucacuuucuuaucuuggaauaacucuuaaguugucuuuaauccguccuuaacacuccauuuaaacuguucuauuaaauugcugacaguuucccucuucucacaguuaacgaucacuucuccuauucuccaaccuuuucguaguaguuucuacauccagcucacuuuugcugucauucuucagcucuugguuucugcuaauguguuguuauauuuagcuuuguauuucaccaguuuuucugaauuuucuuuugucuugccuauaauuugguaaugacuuugcucuugcuuuauuuuuuaauuacuaagaucaaucuuguuuaucccuuugacuuuaaccauugucuguauaaugaaguggccccaaucuguguuuaugaggaucucuccuagauauggugugcagcauuuuaguuugggcuucuuccuccuggagauaaguucauccucuaacaaaaucucucuaguugcucccagugcuucaggagaugccuggggaaauucuaacuucuuggagcccauuguuugaacagucugauaagcacccuucucuacaguguacucauuucuuccugucagccaguaacaucacaaguugaauuuguguucuaugagcagugaguuccaacuuuuuaacuuucucauguuagguuguagucauuuuacuaggaguguaguagcaccuuauuucaguauuaaaagcccucacagaaugcagaguugaacaucaccuuauuugcuuuuuuccuuuuucauuuguuugauuacauuuguauuuugucuauuucuuacugaauuauaagaguucuuuguauauuuugaccauuacuuuuuuuaaucagauaauuuccaguauuugcuucuaauuuguguuuuuuauuuuauucuguauuuucucuuacagagaaguguuuaauguuagugaaauauaucuaaacaguuuuucauucaugaaucauguuuuaguaguauaucuaaaaacaauuauuguugauauuagggucacuuuggugucauguaaaaguuguaguguuauaguuaucuguuaaucgagaauaauaauuuugcuauucacucaaauagugccauuuugaugaucuuuuaaccuuuaucuuauagauuaucugaaauuuucuuuuauuaaagaggcuuccucucccccaguuucacuauauagacgagauugccuuccgcacccuguguaaugaauuuaaucacauggaguuuuacuaaguguuucaaagccuuuguuugcuaacuaucacuuggcaguuuugaaucuguuucuauggacugauuuugauuuacuccaugaaacuggaucaguuuucugcuucuucuuguaauuuuucacugacuaccauauauaguauuuguucaugaggacagaaacccuuuccuugugguggauauguuccaaggacuccauuuaagcucacaauuaagagauuaccuuaaaucucagauaagacuugaacuuuggacuuacuuuuaaaagauuuauuuuaauguguaugcaugagugccuacaugccugguggugguggugguggugguggugguggugguggugguggugguggugguggugguggugggugcugcugcugcugcuggugcuucuuuuucuucuucuucuucuccuccuccuuccuuuuucauuucauuuucuuuuuuuuuuaauuuuauuuuauuagauauuuucuuuauuuacauuucaaaugcuaucccaaaaguucccuauaaccuccccccgcccugcuccccuacccacccacucccacuucuugauccuggcguuccccuguacuggggcauauaaaguuugcaagaccaaggggccucucuucccaaugauggccgacuaggccaucuucugcuacauaugcagcuagagacacgagcucuggggguacugguuaguucauauuguugucccaccuauaggguuucagaucccuucagcuccuuggguacugucucuagcuucuccauugggggcccuguguuccaucuuauagaugacugugagcauccacuucuguauuugccaggcacuggcauagccucacacgagaccgcuauaucaggguuccuucagcaaaaucuugcuagugugugcaauggugucugcauuugguggcugauaugggauggauccccaggugggguagucucuggauaguccauccuuuugucuuagcuccaaacuuugucucuguaacuccuuucacggguauuuuguucccuguucuaaggaggaaugaaguauccacacguuggucuuccuucuugauuuucuuguguuuugcaaauuguaucuuggguauucuaaguuucugggcuaauauccacuuaucagugaaugcauaucuagugauuucuuuuguugauuggguuaccacacuaaggaugauauccuccagauacauucauuugcccaagaauuucauaaauucauuguuuuuaauagcugaguaguacuccauuuuguaaauguaccacauuuucuguauccauuccucuguugagggacaucuggguucuuuccagcuucuggcuauuauaaauaaggcuacuaugaacauaguggagcauguguccauauuaccaguuggaacaucuucuggguauauguccaggagagguauugcuggaucuuccaguaguacuauguccaauuuucugaggaaccaccagacugacuuccagagugguuguacaagcuugcaaucccaccagcaauggaggaguauuccucuuucuccacauccuugccagcaucugcugucaccugaauuuuuuaucuuagccauucugacuggugugagguaaaaucucaagguuguuuugauuugcauuucccugaugauuaaggauguugaaauuuuuucaggugcuucucaaccauucaguauuccuaaguugagaacucuuuguuuagcucuguaccccauuuuuaaugggguuauuugaauuucuggaguccagcuucuugagcucuuuguauauauuggauauuaguccccaacguaaaaauccuuacccaacaugccugguucuuguugaagccagaagagaguauaggauccccuggaucuggaguuacgggcaguuuugagccuccucauguggguacugggaacugaaucagguccucugcaaggucaguaaguguuguuaaccauggagcuauuucuccaacucccuggucuuuggacuuuuaaagauuuguggaaugaguaugggaaaauuugagguuuaaauuuucugcaguuuauauuaugacauggccauuagccuauggagacaggggugaaaguauuuuggcucaaaaguguuauguuuggaugucccguugacaaaggguauagaguuccaaugguuuaucuugucaauuugagauuuagaucaccaugguaacaggucuccagacuugcuuaugggggauuauuuagguuggguuaauugaggugggaaacgccauccuaaacauggugaucccauucauugcuuagccugggauuccauccugaguuaaccaaagccacuggaaccaagaucaaucucuccuaagcugcuuuuguugcagugugaaacacgucagucacaugacagcgaggagaaauggcacuuuucuuuuaauucauuaaccauuugaaucccacauaguuuucuuaauagcauuuucuuuccaugagaaucaucaggagcuucugcccaggauaauuccuaauuguugaaguuagcaguggcuguucauuaauguuguauauuugagcugucaccauggaaaaauuguaacuaguucugauaggauagcucuaacuguugaaguuaaguuuaagucaauaagaugaucauuauuuaacagaauauacuugugauucugguuuguuaaaauuagauuuugcauauuaaaccacaaauuuacauuucucauauagccugcaguuuuaaguauugauacauguugacucuguaugaauuaaucuucauuuuauuuagaaaucaaauaaaaucauugaauuucuaaauuauuagaauuauuauaacaguauuauaacuuaaaauauuacauucauaauaucauauaaccagcucacuaaaguaaguccauuaugaagaucuuuggcugaauaguaguauuuaaacauugccagguguuuuauuuuuguagacacauacuaggugggcacaugugccaggagacaaucuuuuuuuuuuuuuuuuuuuuuuugacagcccauuacaagcuaccugaucagugagauaaaucucaguuguacauaaaaauuagagaaguuauuuucaugcuuauacaaaaugaguuuacgugguaauauaaguaaguaaauuauuauaaauaaaugcaagguauugaaacuuuuaaacauugauaacauucauaaacucauacaaacugugguugccuggacaagacuuguuugcacaagguuagaccagucagcauuccagcaaggaggauagaggggcucacaggcacccauccccgugcacagagcuaccaacagucaaugaucucuccuagaucagggagagucuguuuucuuuaagguuguagccacuagugaauugacugugcuccacugaauaggcagcauuaauuggacuuaguggguuauuuuuuccuugguuauuuuauuuguuuacauuucaaauguugucccccugcaagcuucuuauccccucccccucccccuugccucuaugagggugcucccucuacucacccacccacuucuacuucaccacccuagcaucaucgagccuccauaggaccaagggccucccuucccauugaugccagauaaggcaauccucugcuacauaugcagcuggaaccaugggucacuccauguguacucuuugguuggugguuuagucccugggaacucugggaguuccuguuagucgauauuguucuuccuaugggguugcaauacuuuucagcuccuucaguccuuucucaacucuuuccuuggaguccuugugcucaauacaaugguuggcugagagacuccacaucuauauuggucaggcuuuggccgagccucucagggcacagcgauaucaggcuccugucaguaagcacuucuugacaucagccauaguguuuggguuuggugucugcagaugggauggauccuucgguggggcagucucuggaugaccuuuccuucagucucugcuccacucaguaucuguauuuucuuuagacagaaacaauucuggguuaaaauuuuggagaugggugguuagccccaucccucaacugagggcugagccuauccacuggauauugucucuauagguucuaucucuccuguguuagauuuuuggcuaaugucauccuuguugguuccugggaaccucuugcuucucuggcaucuggaacuuccucuuggcuagucccaguuccccaucccccacuacuacacacauccuuucaauuuccugaccuucuucccugucuccucccauaucugaucugccccccccuuuuuauccucucccuccucucaccgucucagaucccucccucccucuacuucccaagaguauuuuguuccuccuucuaaaguagaauugaagcauccacacuuuggucuuccuucuucuugagcuucacauagucugugaguuguaucguggguauucugagcuuuugggcuaauauccacuuaucagugaguacauaccauauguguucuuuugugacuggguuaccucacucaggaugguauuuucuaguucuguccauuugccugugaauuccauggaguuauuguuuuuaauaguugaguaguauuccaugguguagccacuauggcucaagaucuccauaccaagaucuagauaaggaucuccaagccuccagauaagggucacuggugagccuuccaauucuggauuguaguucauuccaaauauagucaaguugacaaccaggaauagccacuacagaggcauauauauauuuuuuuaggguaaaauguucuauagauaucuguuaaaucuauuugguucauaaguucuauuaguuucccuguaucucuguuuauuuucuguuuccaugaucuguccauuuguaaguguugaagucuuccacuauuauugugugagguucaauguaugcuuugagcuuuguuaacguuucuuuuacaaaugugggugcccuugcauuuggggcauagauguucagaauugagaguucaucuugguagauuuuuuuuccuuugaugaggaugaaguuuccuucuuuaucuuuuuugauaacuuuugguugaaagucaauuuuauucaguauuagaauggcuucuccagcuuguuucuugggaccauuugcuugggaauuuuuuuccauccuuuuacucugagauagcguuuguuuuugucucugaggugaauuuccuguaugcaguaaaaugcuggguccuguuuauguauccagucuguuagucugugucuuuuuauuggggaaucgagcccauugaugcuaacagagauuaaggaccaaugacuguugcuuccuguuauuuuuguuguuugaaguggaauuauguuuguuuggcugucuucuuuugggguuguuuugagaagauuaauucuugcuuuuucuuggguauagcuucccuccuuguggugguguuuuccaucuauuauccuuuguagggcugaauuuguggaaagauguuguuuacauuugguuuugucauggaauaucuugguuucuccauuaaugguaauugauaguuuuguuggguauaguagccuggacuggcauuuauguucucuuaggaucuguccagguucuucuggcuuucauagucucuguugagaacucuguaauucugauaggucugccuuuauauguuacuugacuuuuuccccuuacugcuuuuaguauucuuucuuuguucugugcauuugguguuuugaugauuaugugaaaagagggauuucuuuucuugucuauuucguguucuguaggcuuuuuauauguuuauggucaucucuuucuuuagggaagucuucuauaauuuuguugaauauguuuauuagcccuuugaguugggaaucuucauucuucuauaccuauuacucuuagguuucgucuuuucauuguguccuggauuuccuggauguuuuggguuagaaacuuuuugcauuuuguauuuucuuugacuguuguguugauguuuucugugguauauucuacaccugugauucucuuguauucuguuggugaugcuuacaucuaugacuccugaugucuuuccuagguuuuccaucuccaggguuguuucccuuugggauuucuuuauuguuucuauuuccaguuuuagauccuggaugauuuuguuaauuuccuucaccuguuugguuguguuuuccuguauuucuuuaggggaguuaugugugucuucuuuaauggcuuuuaccuguuuaccuguguucuccuguguuucuuuaagagaguuauguuuuucuuaaaguccuuuaucaucaucaugagaugggaauuuagauaggaaucuugcuaucaaguguguuggguuauugagggcuugcugcggugagagagcuggguucugauggugccaaguagcauugguuucuguugccuguguucuugcgcuuuucccuugucaucugguuaucucugggguuagcuguuuuuacugucucugacuggagccugucccccaccccccaccccccaugagccugugauccugguugugucagaacuccuguggugccuggugucucugugaucauaugauccuguauauguccgaaguucuggguauggguggagugggcagagauccagagcccagagucugcucugggguuccagugcaugccggaaggaacgugugccucugguuaagugggggugccuacauucccuggauccugggguggggcauuuaggccagguauugagggaugggugaguggggggucucaccugugacucuggaucuguccgaaguccuggaggacaggcugccucuggguguggguuuguuggggaggacggaguacaggcucuguuccuggggaggugcaagccaaaaggacuaugugccuuuggcuagacaggggugccuguguccccuaggggguguccccaguuaggccagguauuggggguaguccuggaucuguuggaaauccugggguacaggcugccucugaguguuguggcuuauauuuuaaaaaagaaaagaaaagaaaaagacuaugaaguuuggagaacauaaaggguggaucugggaagaguuagggauaagaguugggaguguuacaugaaagaguaaaauagauuguauacauguguaaaauucucaaaugcauaauaaaauauuaauggccuuuaaaaaaaacaagcucuggaggaccugaguccugaucuaagauugaucucugaccuucacauacauuuucacacacaagaacaugcauacauucauacacauguguauauaccuauaccuaguuguaaaaaugccuguaaacuaggaagcuaguucuuucauaauuuuagaaagugauagguugacucaguucuuucugucaguaauacucauuagaaguacuuuaggauaguuguuagcccaacauauuuuuuauuaaauuagaauauauguacuauauuuauauaauuuuccucuucacccaugccucccauuccacaaauucauagugucuuuuuaauuauuuuauuuuuugauauguguguguguacacaaaacugcuggguccauuuaguguugcucauauucuauguuuuuagggcugacaacuugguauuguauagccauuuagggucucaucccuggaaaagacuaguucucauucuaucagaagucauuaauuaccagugguucuucaucuagaguugagaccuuguggaauuuaccccaucccuguugagaguuaaaugacucuagucuuucucccucuuuuggauauuccugugccuuugaugucaggaucaagaaaccaucauuguuuuguucuuuuccuccuccuccuccuccuccuccuccucuucuuccuccuccuccuccuccucuguauauauguugcaagugcagaugcaugcacauguagaggucacagacacuuuuuuagcagucaguuauuuuucuacuaugagauccagggaucuggggaaacuuuauuucucuaugguauucuuguauaacagaaaucaguuuagugacauuuggccugcuuacugauuuuucaggacuagggaucaagcauagggccucacacaugcaaaacaagugcccuauccuugagcuacacuccuggaaaacucugaauuuauuuuuguguauucaaaaauguguuuuaucuaauugaacuuuuucacuauucaagauuaaaguuauuauucugcuuaguuaugcuauacaguugauuuguuguucuugcuugaauaauguagagagaagaaaaucacaaacugcaugugacugagguacucucauuaaagcuccauuuuaagccacacaaaauaguauaguaagaaaguaucacgugcaaaaaucucagagcucauuucuuacaaaauuucuugcccucccccuaaacuugcugcauguauuugaacacaguggcucuguuacuguuguaccuucaccauggagaugacaguguguuuagacuauagcagguggagccugugguggcucccauguuugauuaaacucaaucuaagggccuugacaaagacaugccgaaaucugggaauuugauuguaacuuauugaaauagccuuuuuuuuuuacauuaaaaaaagccaucuuugggaucuuaaucccaaccauagcaugcagaucugaucucagcuguggagucgacacaacugaagaaugucacaugcaaaauaaaucuuuuagaaagagugcuuuaguuacauguucaaggcagcauuggcccagaaacuuuuucuagaauuucagucugcauugauugaagugcuuagaaucacgcauauaaaguagcaugcacuagcaguucagugcccucaauguuugcauauaaggugaguuuggaugcuacuuuguaaagcagcuugggucaaaguaaguguaauccagguaaggugauucaguggcuuuagucugugucaggaaauuccuuucccuuuguguguuugacacagagcugaucagacaagauaagggaaagaaagcucugcuuuuuauuuuaucuagauuaaguuuugcuauguugugggcugagagaguucugugguuaagaguacuaccuucuuuuccagaggauccaaguucaauucccagcacucacaugacaguucacaagcaucuccauaacucuaauccuaggggacacagcaucaucugcugggcucugugggcaccaagcacacagggugcacaggccuacaugcugagagaacacccauacucacacaaacaaauauuuaaagaaagauuagcuuuuauuuuuaucuauuuauuugccguaugugcagcugccuucagaggccaaaagacagcaucaagucucaggugcuugugagucucccuguguauaugcuggaaacaaaaugugguccuucagagcaacaaguauuuuuaacaacugagccaacucucuagccccaagcucuaguuuucacgagagcuuuaugugaaaugccauuauucuccauugauaagaggauuauuugcuucauucuuauguuauacauguggaaaauuaaauauauaggaaacucuuaugggacuaggaaucucaucugauaacauuuugauacaaucaguggucauugguuuaguauuuaaacuaauauuaugggcuuuuuaagggucaauaucaaguugaucuugguuauauagagaaaaaaagcuucuaucuaaaacaacaaagacaugcuccuucacuuaccaucuguaagucaguguuaaacuuuguggcagguucaaacuuugccacaaaauaaaaaaaucuuugcauagaacaacaguucuuaaccuguggaucacaguccuuugaggguccaaugauccuuucacaaggguucccuaagaccuuggaaaauguagauauuuacauuacaauucauaacuagcaaaauuacaguuaugaaguagcaacaaaaauaauuucaugguugggagucagcacagcaugaacuguauuaaaggguccaagcaucaggaaggcugagaaccacugacauagaaccuuacuaaauggcauagagaaaugauguguugggguugggcagauggcucagcaguuaagagcaccuguucuugcagagaggaacuggguuugguucaagcucccacaugauguccucaucuguaacucugguuccaaaggaacugauccucuucuaaccuuugcaggcaccagagacaaaugagggguacguauaaacaugagcucaaaacacuuguacacauaaaauuuaaaaaauuuagugauguguuuauauaauuuuugcaauuaaaaauauuauguguuuaaaaaccaguagaaaacaggaagagcuuucuaacagauuucuggguauaagaaauauaaagagauauuuaauuuuuuagcucguauguguuuaguguauguguuggugugcacgucauggugagaggacacguugcaagagucaguucuccuacuuugagggucuuagugucucaggugaccaggcucacugcgagacccuuaccucccgagccaucuuguuuaccccagaaauaauuuuaaauaauuuuuuucuuuaguuuuugaagaacugugaaaucuuccaguuuaugauauuaguaugucuuaaauugguaguagacuaaauuauacugaaguuaaauaacaacaacaacacccuauuaaugaguguguugcuuuucugaucuuuucggagaguguuuggcuguacuuuuggguuuuccuucauuacaaaugucuuuguacuguuagaaaaucauaguaauauuucauaaauggcuguauaauaaaaauguuuucauaaauguguuuguuuuaacauuuugacuaggcauuaaauugugagccagcagaaagucccuuuguaugcuuagagcgcucaggcuacauuuauguuucuguguguuuuaagcuuuucuuauguguguguacaaugggauguuuggaggggggcuuuaaauauuaaaaguuuuguuuuucaagguaaaaaguuaauuacuagaaacuaguuuccuucuuaaaauuuaaguggauuauauguuaugagauguauaaaaugucuuuacaaggccacccucaccauggaucauucuaagagguugcauaucaccaguuacgaccagcaguuaauccaguguucuuuaugagugcugacugccucuucugaacugcuucacuuuaaaccauucuaggauaggcaccacagagcaccauuuaggauucuugguggcccucuagugggagagugaagaaaauauuauauugaaaaugucuuaugggcauguauguauaauaguuaaagauaguuuaaaagggcaucuaaguuauauuugaacaauaaaaauacuucaauaauauuggaaguagaaagaauguggauugacuaguauuaccauuugagaggcuuaacuuuauaguuggaauuuuuaaagacugcuuucccaaaauguuggaauaguaaacaauauauaguauugacaagagacuauauacagacuacacaugcaugaguuacauuuucacugauauguucuuauaaauucagaacuuauuauuuagagcuuugugguaaaauaaauucagauagaauguuaaguguucaaucagagcaggcuacuuuuuagaggugaaugguucuguacauuuuaguuagagcaggcgagagacagccugaaacaaaaauggaaaguaagucuuuucucucaguauauagcuauaauacuuaaaacuaaaauaaaauuacauuuuauuuuauuuuuccugaaugguuuuauuucuguccuuccuuugguagaggacauggggcgguagcagcagcagcagcagcagcucuaaaucacaguuugguccuuccaggcuuccugagaucaguuccugaccacccugcugugaaugacacggcgcauguacuaauguaguuggacauagggcuugggaagcacagaaaugcccaguaaauuguuccugacagcaucagccucuacuguguaucaaaugacccaaacuuuuuuuuauggucucaucuugaguuccugcccugauuucccucagugauggacugugauguggagaugcaaaacaaagaaacuccucccauacuaacguggguuuuggucauuuuuaucauagcagcuaagagcagacuaggcagacggacaccggggcucaggguuagcuaggaggaaguuagcuguguaagcacuucacagucauuguacagaaaguguuuuggaguauguucuuaauaagaaaaauacuuuaaaaguuauauuuuauuucagcuaugacuguggugcuugguaugguuauaauuguauuaauggguauuuuauacauauaagauuauaguauggaauuugcgguaaauaugugauauucauaaaauaccauccauggcacuggagagcuggcucaguggguaagcaccugcugugcaagcagaaggaccugagaucagaucccagcacucagugaaaaacugggugcugccugugcagggcucuguaaucucagggccuguaggggcagagacaaggaucaguggcccuugcugccagccagccuagcuccagguacagcccuguggcaagagaguaagguggggagugacagaacaggagaccugaugcucucucggccuuugugcaagcauaugcaugcaugcacagguacacacacacauacuuacaaagagcugccauucauguagcucagugucuccuuccuugucuucaucauauccuuaaauaaucugaugggacuuuugguguuuguuuuuucccaauuagaggccauuagguagaauaguuuccuaucccauauaauugcuuguauuauuccucucucuuuggaaggaaaacaaaaaccuuacaguauagauuugaacagucuagcugauugacuuuguucagcucacucaugcuuaaggcuguguuuacaaauaaauacuaauguaacagccacuuuauuuauaguauauauauuuauuuacacuuauauacaauauguaaaauauauauguguauaauaaacgcaccuccccuacucucuaguacaaccaggcuuuccuucauugaaagucuguuguaguuccagccauaauauauaaagaagagguagaaaagggagagggauaugguuucaaaacuaguaggugucugcuuauauuucauugauuaugucugucuuaacaugaacucuaucagcaagaaagagcuggaagccugguagcuuuuaauaauagccuguguauuagagaaaagcaaggaaaacagaugauaguguugagugaagcagcauauaguuugacuucauauaguaauuuugaugaagcuauuaaugucagaauugcugucacuaauucauuuguccauuuagcugaaauauaggauaaauucaaacugaagcauucuuaaaaaccaguauauuuaucauacagagggauugcuuucuagugccauuucuguucagauguauguggaccuuggccacauucaccuccucuuauucucugcuguacucuuacuaggcccauucucuuuacagccccauuucuauuuuguguccguauguggugaguguguguauucacaggauagaauuggaauucacuacacucaguguaauaagccagacccaaaaugauaaguaguggacgcuuuuucuucgaacauuuggacccuagauugauuguauauauuucuuucucuugccuuaguaugcucaagaugucauaaguacacucaagcaguguauugauuaagaguggagagaguagaacccuuguuucagauuuuuagagaaaaugcuucuaaauuuucuuuauuuaggcuauagguuugucauauggcuagugaaauaucuucuuauuucuaguuucuuuggggauuuuuuguuugugacaugguuucucagucugcccuggcuaccuuggaacucauucuguagaccaggcugguuuugaauuuagcaauccgccugccucugccucccaagugcugggauuaaagacaugcugcccaggucuuuagggcuuuuauuauaaaagaauauuagucuuuugucagauaccuuucuuagaucuuuuguugugauuaugauuucugucauugagucuuucugugugccagauuuucauuaccaaucuucucuguguugaaccauccuagcauucuuguaauaaagacaacucagucaaggcggggugggggagagugagggagacagacagacacagagaaagaguaugaguuaaugugcuguuggauucagucugcaaguacuuuacugaaaaacuauacaucuguacaucagggauaguggaauaguuguaacuauuuuuguuguuacacuuacccaauuuugauauuaaggcaaugcugacuucaugaguuuuguaguauucccuuucugcuuuauguuguaaggugggagaguuauauguuaguucauuuuuaaaugucugauagaauuuaguaggcuuuuagaaguacuacuaauuagguuggagggguagcccagcaaguacuugcucugugagcaugugaccugaguucagauucccagggcacaaguaaaaugcuggauacagugcuugugccuaugcuuugugucuuaguuacggcuguguugcugugauaggacacuauaaucaagacaagaguuuauuuugggcuuauauuuucagagguugaguuggugaccaucauggugggaaagcagggcaggcaggcaggcaggcaggcaggcaggcaccauucuggaacaguagcuuagagcuuauaucaugauucgcaagcacaagaggcacagaaaaaaaaccugagaauggcuuuugaaaccucaaaacucaccccuagugacacaccuccuccagcaggccauaccuucuaauacuucccaaacaguuccaccaacugggaauugaggauacauaauugauccuaggugcucuuuagccagucagucuauaacuucagcuucaguaaagagaagguggagaaggaaagagucuugauaaucagcuucuggccuccacacaguuguacaacuaaugcuuccuccuccuccuuccccucccccucccccuccuccuccucuccccccucccccuccucuccucccccucccccuuccucuccucccuuaaauuauuguuuuaauuuuuaagacacuuucauacuguuuuccauaaugaccuuauugcuauagaaagauaagcuuuggucuuuugauagucaucacuuuaauuggacuuggaugaugucugugugucuguuuuucuguggugguuacugauguugagcuugguugacaugccucuuggccuuguaugugcaucauuuuaagauaugucuauucauguccauuucccgguuuuaaauuggguuguuuggggauugagcuauugcaugauuuaaguuccuuuuguuuucugcuugcugauccuauguuaaagguauaguugucacuuuccccauuccccauuucuucagucaugaaugcuucuuuuuccugugcagcaaguuuuuuauuugaaaucucauuagucuguuuuguuuccugucuuugaggucuuaccccccaaaaugcuugccauuccaauguccugagguaguguuccuguuuucuucuagugguuucauaggucuaggucuuacaaauaaguuuuaaaucuauuuugaguugauuuaguuuuauuuuuuauaggcuauccaguuuuuucaacaucuauuuaaauuaaauuaaaauuauacuuuaaaguccaguagcauaaugguuguugcuuugaucucauaauuguuuuggcuuuaaaugugguugcauuuaaguggcaggguuacuuuuucuaguucuauagacaauguuacauguauuuugauauguauauugaauauauagaucauauaaauuuacuauucuuuuauuguuuguauauguguggugguaagaaaauaacuuauuggagucaguucucuccuuccaccuuuauguggacgccagggaucaaacucaucagguccaguaaguaccuaaguacucuuaaagucagcugagccaucuugucaccccucauugugguuugucgucuuccccuuccccuuccccuuccccuuccccuuccccuuccccuuccccuucugcuuccccuuccccuuccacuuccccuuuuccccuuuuccccuuccccuucuuccccuccccccccccucucuuuuccuuucuuucuucucaaucagauuuauuucuaagucuuuagggggaggguagcugguauacauuauuaucuuuuacuuuuuauuuaugauuauuugcuacugacauauuaugauacuacugauuuuuguauauugaaacuauucugcaacuuugcuacauuugauuauucuaauagauuauugauaaaaauuuugggaguuuucuuuuaaaguuuugaauguaaauacucaugguuugcuuuccaucaauuuggauggcuuuuguuuccauuguuugauugcucugaucauucccuccaguacuguauugguugaaagugggcauucuuguccaguucauaucuuaauaaguaacuuaccaccucuuuccuagucagugaaauguuagcuguuggcuuguacaggugacuuuuacuguguugagguauguuccuuacaucuaauuucuuuagcauguuuaaucauaaaaugacguugucuuuuguccuucuguuuaugugguauauuggguauauuaauauauucuuuuaaaucuuuuaucaguauucuauguauguaguacacguaguagugaagauauucgcaaaauauaugguguuauuugaauacagcugaucauuaguuagcugucuugugugacuguguauauuuacccauuugguacacacugauuacauauuagauuucuucccugacaucaaagcacaauauuuucauaaauuuaauggcucauacuugggaaagaaguugugucuuuauuuauugaggcaggguuccccuuuccucucuccuccuuucucucucucucucccuccuuuccccucucuuucuuucccucacuguuucuuacucucccuccuucaguaugucucuaucucucccccacccccaccccccauuuuugcuaguuucacuagccagcuugccugggggauccuuguaucucucugcugugaucacuuccaugccuacucagguuauauguugguguggggaucuaaccuguaguccuuggguuugugcaguaaccauuuuaccuauucugagcuguuucccagcucucugcuuguacuuuuaagcaguaacaaucguccugagaucuaaguucuuagauaggaggccuuuuggaagacagucacuuaagaguauguaauucuucccuacgucccuccaguaacaacagaggacauuguacaacuacugaccaaaacuugaauaaaugcuuuaucauuaauuugauuauauaauuauaugauuugagacuuucaagucuucacaagucaacacuaaauuuuacucagauucaaaaacagaugagugaaugauuaaggaaaaauaaaaaagaaguguagcauuuucaucuacauaguuuuuuuuuuuuaauuuacauuucagauguuguccccuuucccaguuuccccuccgaaaacgcgcuaucccauccccccugcuucuaugagggugcucccacacacacccacuccugccuucccgcccuggcauuccccacaccggggcauccagguuuuaagagaccaagggccucuccuucuauugaagcccaacaaggccauccuugcuaccuauguggcuggagccgugguugcuccauguguacucuuugguaggugguuuaguccuugggagcuuugggguggggaggucugguuaguuggugguguuauucuuccuaggggguugcaaaucccuucaguuccuucaguccuuucucuaacuccauugaggaccccaugcacaguccaaugguuggcugcaagcauccaccucuguauuuaucaggcucuggcagagccucucaggagacagcuauaucaggcuccugucagcaaguacaucuugccacccacaguagugucuggguuugugacuauauauagaauggauccucagguggagcagucucuggauggccuucagucucugcuccacacuuugucuccguauuuccucccauauuuuguucccuauucuaagaaggacugaaacauccacacuuuggucuuccuucuucuugaguuucauguggucugugaauugugucuuggguauuccaaacaauugggcuaauauccacuuaucaaugagugcauaccauguauguucuucugugacuggguuaccucacucaggaugauauuuucuagguccauccauuugccuaagaauuucaugaagucauuguuuuuaauagcugaguaguacuccauuguguaaauguaccacauuuucuguauccauuccucuauugaaggacaucuggguuauuuccagcuucuggcuauuauaaauaacacugcuauaaacauaguggagcauguggccuuguuauauguuggagcuucuucuggguauaugcccaggaguguuauagcuggguccucagguaguaauauuuccaauuuucugaggacccuccagacugauuuccagagugguuguaccaacuugcaaccccaccagcaauggagggguguuacucuuuuuccacauccucgccagcauuugcugucaccuaaguuuuuaaucuuagccuuucugacuggugugagguagaaucucaggguuguuuugauuugcauuucccugaugacaaaagauguugaccauuucuuuaggugcuucucagccauuugauauuccucaguuaagaauucuuuauuuaguucuguaccccauuuuuaaauaggguuauuugguucucuggaguuuaacuuuguauauauuggauauuacccucuaugggauguaggauuguuaacaaucuuuucccaaucuguugguugccaucuuguccuauugacaguguccuuugccuuacagaagcuuugcaauuuuaugagguccuguuugucuauucuugaccuuagagcauaagccauugguguucuguucagaaaacuugccccugugcccauguguucgaggcucuucccuacuuucucuucuauuaguuucaguguaucugguuuuauguggugguccuugauccacguggauuugagcuuuguacaaggagauaugaauggaucgauuuacauucuuuuccaugcugaccgccaguugaaccagcaccguuuguugaaaaugcugucuucuuuccacugaaugguuuuagcuccuuugucaaggaucaagugaccauagauguguggguucauuucugggucuucaauucuauuccauugauguacuugccugucacuauaccaauaccauacaguuuuuaucacaauuguucuauaguccagcuugaggucaggcauggugauuccaccagagguucuuuuauuguugagaauaguuuucgcuauccuagguuuuuugaaauuccaaaugaauuugcagauuacucuuucuaacucugugaagaauugaauuggacguuugaugggaauugcauugcaucuguagauugcuuucagcaagauagccauuuuuacuauguuaauccugccaauguaugagcaugggggaucuuuccaucuucugauaucuucuucgauuuuuuucuucagagacuuugaaguucuuaucauacagaucuuucacuugcuugguuagagucauaccaagguauuuuauguuauuugugacuauugugaaguguguaauuuucauaauuuuuuucucagccuguuuauccuuugaguagaggaaggcuacugauuuauuugaguuaauuuuauaaccagccauuuuucugaauuuguuuaucagguuuaggaguucuaaauuuuuggggucacuaucauaucauuugcauauagugauauuuugacuucuucuuuuccaauuuguauuccuucgaccuccuauuguugucuaauugcucuggcuaggacuuugaguacuauauugacuauguagggagagagugugcagacuugucuagucccugauuuuagugggauugcuucaaguuucucuccauuuagcuugauguuaguuacugguuugcuguguacugcuuuuacuguguuuagguaugggccuugaguuccuggucuuucuaagacuuguaccaugaagggguguugaauuuugucaaaugcuuucucagcaucuaaugagaugaccauuuuuuuuuccuuugaguucguuuauauaguggauuacauugauggauuuccaaauauugagccaucccuacaucccugggaugaagccuacuugauugaucaugauggaugaugauuuugauguguucuugaauuugauuugggagaauuuuauugaguauuuuugcauugauauucauaagggaaauuggucugaaguucucuuucuuguugggucuaugugugauuuagguaucagcauaauuguggcuucauagaaugauuuagguaguguuccuucuguuucuguuuugugaaauguuugacauauugguauuaggucuuuuuugaaggucggauagaauucugcacuaaacccaucugguccugggcuuuuauugguugggagaguuuuaaugacugcuucuauuucuuuagggguuauaggacuaaggacuuagggguuagaugguuuaucugauccucauuuaacuuugguucaugguaucuaucuagaaagucauccuuuucauccacauuuuccaguuguguugaguauaagcuuuuguaguaggaucugaugguuuuuuuuuuucaauuugcuccauuucuguuguuaugucuucccuuuucauuucugauuuuguuaauuuggauacugucucugugcccucugguuagucuggcugaggguuuaucuaucuaucuuguugauucuuuguauaguucucuuuguuucuacuugguugauuucagcucugaguuugauaguuuccugcagucuacuccucuuggguguauuugcuuuucguucuagugcuguaggugcgcugucaagcugcuaguauaugcucucuccaguuucuuuuuggaggcacucaaagcuaugaguuuuccucuuagcacugcuuucauugugucccauaaguuuggguauguugugcuuucauuuucauuaaaauuaaaagucuuuaauuucuuuauuuauuucuuccuugaccaaguuauugaguagaguguuguucaacuuccaugccacguggaugugagcuuucuguuauuuuuguuguuauugaagaccagccuuagcccaugggcaucugauaggaugcaugggauugcuucaguuuucuuguaucuguugaggccuguuuuaugaccaauuauuuggucaauuuuggagaagguaccaugaggugcugagaagaaaguguauuuuguuuuaggaugaaauguucuauagauaucuguuaaauccauuugauccauaacuucuguuagucucacugcaucucuguuuuguuuccauuuccaagauuuguucauugaugagagugggguguuguugaagucuauuauugugugaggugcaaugugugcuuugagcuuuaguaaaguguuuuuggauuuuuuguuuuuguuuuguuuuugcuuuuguuuuuuuaaugaaugugguugcccuuguauuugggacguagauagauguucagaauugagaguucuugguagauuuuuccuuugaugaguaugaaguguccuucuuuauccuuuuugauaacuuuugguugaaaguugauuuuauucaaaauuagaauggcuacuccagcuuguuucuugggaccauuugcuuggaaaauguuuuccagucuuuuacucugagguaguggcugucuucgaggugcauuuaguuuaugcagcaacaugguggguccuguuucuguaucuagucuguuacucuauauuguuuuauuggcaauugaguccauuuaugugaagagauacuaaggaaaagugauuguugcuuccuauuauuuuuguugcuagagguggaauuauguuuguaugauucucuucuuuugguuuuguugaaagaagauuacuuucuugcuuuuuuaggguguagcuucccucuuuguuuuccaucuauuauuuguaggucuggauuuguggaaagauauuguuuaaauuugguuuuguuaugaaauaucuugguuuuuccaucuauguucauuguucauugagaguuuuccugggauggcauuuauguucucuuaagaucuguaugacaucuguccagguucuucuggcuuucauagucucuguugagaucucugguguaauucugauaggucugccuuuauauguuacuugacuuuuuucccuuacugcuuuuaauauucuuucuuuguuuugugcauuugguguuuugauuauuaugugaugggaggaauuucuucucugguccagucucuuuggaguucuguaggcuucuuguauguucaugggcaucucuuuagguuacagaagauuucuucuauaauucuguugaagauguuuauuagcccguugaguugggaaucuucacucucuucuaaaccuauuauucuuauguuuccucuucucauuguguccuggauguuuuggguuaggagcuuuuugcaauuugcauuuucuuugacuauugugucaauauuuucuaugguauauucugcaccugagauucucucuucuaucuucuguauucuguuggugaugcuugcaucugugucuacugaucucuuuccuagguuuuuuaucuccaggguugucucccuuugugauuuauuuuuuauuguuucuauuuccaauuuuagauccuggaagauuuuguuuaauuccuucaccugaugguuguguuuuuuuguaauucuuuaagggauuuuuguuuucucuuuaagggcuucuaccuuuuuaaucuguguucuccuguauuucuuuaaggcaguuauuuaugccccucuuaaaguucuuuaucaucaucaugagauguaauuuuaaauccaagucuugauuaccugguguuuugguguauccaggacuugcuguagugggaaaacuggguuuugaugaugccauguagccuuuguuucuguugcuuauguucuugcgcuugccucuugucaucugguuaucacuagugauaccugcucuugcugucucugacuggagccugucccuccugugauccugguugugucagaaccccucagaguccugcugucucugugauccuaugauuaugggaucccaggauccugaaauccuggggugaccagcuccugagauccuguugugucugagcuccugggagucaagcuuucucugggugaugcaggggugggaagggagucagagcccuggggucugcucuuggaacaggugcaaguuggaaggaacccgcgccucuggcugggcggggguuuauguuuuccugguuccugugggggucccauccauauaguuauuaaauacggauuuuaucauggaguauuuugugauauauaguaggcacaucccaucauaagugcacauuacaguaucuuaucucaguuuaugacuggcagcuaaugaauauucaaaggcaaaugaaaggaaguagaugcaaauauguaaacaguauuauugugcuaugucacugaagaaaagaaaauguucugcaguuauagacuaagauucucauuagguggauuaaccuuuguagagaauacaauucugugcacagaagguucuguaacuuguaccauuuauucuagaaucuuuucauugcacacaagagagauuuuguaaauacuagcaguugauuccuguccccucuccuggacaaacuucuauuuucugaauauauguuuaccuaaucugaacauuucuuauaaaugcaguuuuauaacauguagccuuacuaguuauauggggguuuuguuguugguucucagcuugacacagggacauauuugaagagaaaaucucaguugaggaauuggcucucucagauuggccuguaggcaagucuguggggacauuuucuugauuaaugauugaugucagugaagcgauucuggugagcauggcuaguaugacuuuggcaggccuuuccguucuccccagcucccccugcuaaaaauuguuaagauugcaucgccgaagcucucaagaacugucagacugcagacaaguauuccugccaaccaacagccuaaguuuugcugccuauugccuauuccuauugguaggaucucauccuccuucccuggucuuggaacuccucuacuaccaggaccaugaaccuagaaaugggaggacccagcuuacuuggcaggugguaugccgcauuucuccauggucuuugcuugaguuccugccuuggugucccugacgugaugaacuaugaucaggacacaacaugugagcugaauaaacacuuuccucacuaaguuccuuuuagucauugucuuuaucauuaaauaaacuagaacaguagccuuuuguguuuggcuucuuauacauaguauaauguuuuuaggcuuuuguguugugcuaguuuuaugucaacuugacacaagcuagaauuacuuuagaauaggaaacuucagcugagaaaaaugccucuaccagauuagccuguggaugauccugcauucuauuuucucgauugaugauugauguaggagagcccagcucucugugggccgggacaccucucaguaggugguccugggcacuagaagaaagcugacugagcagcccaugagggacaagccugugaguauucuucuuccaugaugucuguaucaguuaugcugucagacucuugcccuguuugaguucuuuccuugacuugccucagugauagacuacagcuguaaaaugaaauaaacccuuccccuccucuuuauugcucuagaggcagugggaucugggaaaggggaagcuaauaaacgaguaggcucacaucucaugaguaaaccgcacaauccaaagcacaggcuguacuggcaggcacauugugcacaguaguaggcaagcuguaugccaugcccauagaggcauauaaacaaauaagaaaagccaaguguaaugaauacucugaaauuaacuuacucuuauuuacuacaucugggguggggcauagaaacauaaucccagaauaaaucuguguuauugaagaaacugaggucacagacucuugucuuuguuucuugaaguuuucucacaaacacucagaaaucucacaggacuccauucuugggccauguucugacacucaccaaguuauuuuuggccauagcauuuauaacaauacaagcccuagugaagccguguguuacagaucuguaguucaccuuuagagauauuacuacaucauggauguauauguuuuuuuuauuuguaaguuaauuggcauuugaucugcucugagacuccucugaguaaugcugcuguaaacacuucuacauucugagggcuuauucucaguucuuauguguacugagacauggaauugcugagugauguguaacucuugaaacccucaggaacuguuacuccguuuuuaacagauuauaccacaccacagaguacccaccaaaaguauuuggagucugcuuuauguaucuccaacggauaacugucagugguuuuauuauaccuauuggauauugaguaauagcacguuauagcuuugaguucugucaugacugacaauguuaaacauccuuucaugugcuuauugaccauucuuauauguuugaaaaaugucucuuuaauccauuuuaaaauuauguugucuuuguuguucaguuguuagcaauccuuuggaauucuggaaauacuauuuguguuuccauaauguggauuuccuuuuuucuuuagaucuuuuaauguacaugaguaucugucugcacauacauguguagguaaguggaacaaggucagaagagggugucagaucccauggugauggaauuucagauguuugugaggaacuucuugugauaaggauaguggaacuaagcuccaaucuacaugauuguccaacaagcacucuucacuacucuccaucucuccagcuccaacuccuuuucugaguguccagcucagguuccugggauuacaggugugcaucagcacucucgguuuacccagugcugaggauugacucuuacuucaggaaggcaggcggcuggggaaguuguuacuaguugaccuacaccccaacccacuuuuugugaauaucucuguauugacaucuagaaucaggagguaugaguuucuuuacuucauucuuauguucaaagauucauucuguccacucuuggucccuugcaauuccaugugacauugagaucugcuugaaaaauuugaagugggggggggugguagggagcaagaugagauauuuauagcgauuaugggucauguuaggagggugguaaacaacuuuuguauaaauugaaaucugcucauagaaagaaaacuucaggcauuucuccuguuccuccuguauguaucauacaguaaguaagcaaauaauuggugaguggaggguuuuuauuucguuuuguuuuguuugauuguuuuuuuucgagacaggguuucucuguguagcccugacuguccuggaacucacuuuguagaccaggcuggccucgaacucagaaaucugccugccucugccuccgaaguggaguuuuacauguucucuguucaguuagugaaaagauuuacuugucagcauuguucaaacccuuuucauggaaugucuucuuuuaagcauuaauaaucaagaggaacuacuaucacaaaaagaaauaacuagauauuuuuuacuuccugacaacauuagauggcucaguaguuaagaggaccuggguugguuuccccuugcguggcagcugacagcagucagucacuccaguuccugaggauccauuucuuuccucugucccugagggcacugcaaacaagauaaagucaggcaaaacacacuuauacauguaaaagaaaauuaaagaaauuuuaaagaaaaaaauuaauuuaaaaaagagaucggaggaaauaucuacauuaaaagguagcuagaaaacaauaucuaaagugauuucuugcuggucuguggguguaggggaagagaggggagagaaagagcccaggucgggacagaguuccugugcucuggguaggcggaugugggaggccugccagacgcuuuccacuuggcccagguugggcaucuggcugugugaagccacuggcauuccacgcuggauacggcagaggagcugagaacagaauaggagcccuggagcagcaccaggucccggaaauaaggggagagagggcaggggagagagguucccacgcaauuaagaggccuuaguccgggccuugauaaacagagacagucuaugguuuuagagcuuuauuguagaaaggcaaggggaaagagaaaagguggaaagaguaagagaccggccauggccaagaggagaaagggggaagggaaagagagaaagagaguuuagagaauaagaaaggugaaagcuuagaaguaaaagcuuagagaguaagagggagagagugagguggggccaagcagccccucuuauaauggccuuguuaucuugcuguugcuagguaacuaggagaagucuaaccugaaggucagaagcuugggacauuguguacgugacugcuagccaugagccucuccugugggggcugugggggugguaacuucgauaggagccacaggcccaggagacaugaggguaugucccauguacgugggaauuaccacccaucggguucugccaggguucaaaaccucagcucgacugaagaccagacugaacuaauuuauuuguuauugcuaauuccuuuaaucuacuauuaaucuaauucauggguaugaauauacacaucuuuaugcuuauucaauacauaugcuauugcuuuacgguguauuuauaguuuuacuuauguacauauacgacuuuuuuguauuauauaaauacccaauuuuaaaacaugcuuuuuuaguccaauaauuuguaucuaaaaccuuucuuaauuuuuuuuaaccuaauuuaacuuauauagaauuucuugugaugaguuuacugaggccuuuuggcaagggcagggagaaucuauuaauagguacuuucaaaagaaguuuuguuuuuguuuuuuuuuuaaacuacccuaaaaucaggguccuuguggauauagcucuccuaaaaguacaggccaguuauggaguaccuuuaaaguuacaaaucugccuucuuucuuuguaucauaucugcugugaguauuuagauuuuacuuccacuuaacugaguuauauaucuacauacauacuauaaaaagaaccuucucugaugaggguaagagacuuucuaauauauguguauacugauaagaauuuaaccuuugacuauguucacuuagcaugauaauaguauuagguucuccccuagagacugugaccuagguacugucuguuuuuggccagguagugguaugaggcauaggcuccgucuugugaagccaacuuuuauuuuuuuuaaagauuuacuuauuuuauguaagcacacuaucacuuucuucagauacaccaggagaggcauuggauaccauuacagaugguugugagccaccaugugguugcugggaauugaacucaggaccucuggaagagcagucagugcuuuuaaccacugagccaucucuccagcccauuaagcaaaccuuaaauccagucagaaaguaguugguuacuguugauaacauuccuauuacuauuggacgcuugggggggggguauuuugccaggccagucauuauccuauauuaauccaguauuuguguucuuuauugacacuauuucuuuuuguuguuguugcucugccguuuuuuacacugaaaaugauacugguuaacauaaagguauauguacauuggaguguauuucucccauacaacacuaucuuccccuauacauccuuucuuucauuagucaccuuugucccuuaauuucauaccguguguguguguauguauguauguauguauguauguauauauguauuuacaugaaaucuaaagcccacaaaugauauaaaacauguacuguuuaugcuucuugagacugacuuuauucaccuaaugauuaucucugggugcauccauucuucuauaaacagaacuuacuucuuuauagcuaaaaguuuucuacgugcggaugugcaugcauugcuuuuauccacuccuuuguagauggauaucuaaguuggcugcuuaaggcuguuguaaacugcuucucucuuucucucucccuccuucucccuccccccacccccauguguguguggugugugguguguguguguguguguaugugcguguguaugcacaagcacaugcauccauccauucauccaggacacacaaaugauuaaaauuaccuuguuagguaaaggaaaaugcuauuuucugcugagcuaauuuucaguucuaaauugaaauggcugacuaguuuauuuucuuuuuuaugcaaguuaacugaacaaggaaccagaccaauuuagcagauuuucaugcugacuucauucaaacaguugccuuuuagauauacauguagcguuggauaagaaagaaauaggcaaauuaauauuuaggcuucuauuucaauuuuaaaaaaaaaguuuaucuugacuuuaaaauggagucuuguuuuucucaaauuuuaucuauuaagcuauacuaaauucuuucacauuguuuauuuuuaauauuugaauaguuauggaagucauuuuuuaaauuaauguuccuuugguuuuagaguuucuucauauuuaauaguuuucuuuacuucacagaaauaccgguaucaggaugaagagguacuuccuccugagcauauuucuccacaagucacaaaugaggugcuagguccagaacugguccaugucucagagaagaaccugucagagauugagaauguccauggauuuguuucucauucucauaucucaccaauaaagguaggaucauaucuacuuauuauuauuucuaauugcuauaaucuuuugcuauaauguuacuuuuguuuagaaauaauuguuuacauucauguaaauuccccacucuuugcguugguuuuguuuuauagucuuaagaguuucaugcuguuuauuaguguuucggauucauuuuuaaacacuugauuagcaucuuugaaaucucacaugugaaauuucuugguugugucucuucauaaacaguuacaaucuuguuuuaauguuuaccuugucucaaauucuacuauguauuuagacuacaauaaaugaauucuuuuguguauuuugaacuuuaauuugcaguuuugugcaacauuauauuccuacaauuuauuauuugauuucacaaucuagauuuuucuguuuuauaagccuucauaauuuuucucucucuuaauuggcauugaauuauuuucagguuauugcuagaucaaaaaaacaggaaagaccaucuagacacuugcccucuugauaaauagugccaaacuacuucacaauauuuguaugauuuucacuuucaaaagcaaaauuugaggcuuuaauuggucauaaauacaugguguuguuaauuuucucuugauuuugaaaugacauuucauuaugacuugaauauacauguuccuuuuuauuagugagcuaggcuaugcauacucaucagguaggcuucauguuuugugaguuacccagguaggauuuuugcuuguuuuuauauggaguaugauuuggaccaguuuguaagcagauggguuuuguuuguuuauucuaaguauuuguuuaagggccauuuauuuucuuuuuuucuggaacucaaacugacuugggaucuugagucccccuuuccuggccuucugagugcugcugggauuacagcccuucuuccuucaguuuguuuaugugauguuuacacugacugguuuuccuauguugaaccaucccucccuccaucucgaggaugagggcuucuugucauggugaugaucguuuugauguguucuugaauucagcuugugaguauuuuauuauuuauugcaucccuguucauaagggaacuugguuauuuuucucuccaucuuuuuuuuuuuuuuuuuuuuuuugguuguugaauccuuguguaguuuggguauuggugugauuguggccucguaaaauuuguuuggcuauauuccuucuguuucuauuuuguggaauuaauuugaggaguauugguguuagcccuuccuugaaagucugauagaauuauuugcugaaaucuucuggcccugagauuuuuuuggcuagaagacuuuuaaugacugcuucuauuuccuuagggguuauagauuauuuaaguugcuuaucugaucuugauuuaacuuuuuaagugauaucuaucaaaauuauccauuuuagauuuuccaguuuuauguaauauagauuuuuaaaguauaacccaaugacucuuugaauuuccuuggugucaguugguauguuguguuuucauuuucauugaauucuagaaagucuuuaauuucuuuauuucugucuuauccaguaguuaaucaauauagaguuguuuaguuucuaugaguuuauagauguuguuguuguugaaauccaguuuuauucuguaguagucugauaggaugcagaguuauuuaaguuuuuuuuuguaucuguucagucuugcuuuguuccauggggugcugagaagaagguauucuuucguguuugggugaaauguucuuuagauaugcuagguccauuuaacuuauaacaacuuuagcuucaguauuuaucuguuuaguuuuugucugggcaaucugucuuuugguugggagugggauauugaagucucccacucucagugugugagaaucaguguguguuuuaagcuuucuuguuucuuuuacaaaccugggugcucuuugcauugggagcaugguaagaauugaaacaucaucaugguggauuuuuccuuugaugaguaugaagcuucuuuccccaucucuugauucauuuuggugaagcaaugucaaucuuugauguugagguguguuucuuguaugcaccagcaagaugaauccuguuuucccauucauucuguuagucugugucuuuuuuuauuggggaauugaaaccauugguauuaagagauaugagugaccaaugauaguuaauucaguuauuuuagugaugggagugguggauauauguguguguuucccugcucuuaguuuugcuggugugaaaguauugauuuccuguguucucaugggugugguuaacuacuuggauugaaguuuuucuucucccuucuguaggacuggauuuauagaugcauauuguuuaaauuuuacuuuaucauagaauacuuuuuaaaaaacauuuuauucauucauuuugaguuucacaccauguaccccaguccugcucaucuaccuguccccucauauccccccuuugcccuugcguugccccucccaaauaaaacaagccaaaaaaaacaaaauuuuguucuuacaaaaaucccaacucauagaaaacaucucaucaugacagcuauaguaugucacagugugccccacagucuaucccucuguccacauaucuucacuugcagauguucauugcagugagucauuggucucauucgagaucucuggcaucugugacaugcuaauauuggauccucauugagacuucugguuauccuguuguugcgcugugucauggagauccugcagcuuuggaacagcagaaauggccuuuucauaugucccaaccauuaguaaaugauagagauuuuggggaggaccaauucagagcucuagaucuggaccugggcgguagcugcuggucagccugccaacucucucuuaacaguaccaccaaggagaacucuccagcacuucuccgacuagacuaccuaaugcuaucauuggcaggaggcagggucagcucuccugcucucaugcccuuggggccagcucacccacacccacaccuccagagucagcuccacuguauugccuaggcagugcccucucuucugagugcuacagccagugaggggacagggcuaacugucccccucucaugacccgcccaggucacucucccagguacuacaguugucauggaggaggaagagacccucaccccugcaccuaugucuccucccaccucauagcagacuaguguugaggacaguucucucaagcucugacccucagagcugacucaccuguucuccuacucugacucaccagagucagcucugcugugcuguccaggcaagaugcagggcccacuuaccugauuccuauaugguucuccugagcucaugguccuguggacagcuuuccugacugcuagagguguuaggagguagaggcaucacuucugcaccugugccaccccacagcagaggaguggcagggucagcucucccacauucaugcccucauguucuuuagugguaauaugaaccagggacaucaacaccaaccccugcaucuguauguagccacggacucagauacucagugucaacuugggcuaggaccucaccauggccccagguagcaggauugcucacuuauuaccggcuacuccucuccacucuagagucuccaguuucaucucucuucauaauguucaagcugcuccacuucucuuacccucccaugugaccaucacauacuuguauagcccugcaggcuggccacucagcuagugggccccugggugaugaccuccuccauccuugcuucgugguguggcagcaagcuggugucugugacccacgugugccauguguuggaggaccggucugggugacauggugguccucaggacucugucuuccuccucuugucuuguacuguacuguuuggauuugauuuuauuucauuuuauuaguccuaggcauaagacagcuuuggccacuaagccaggcaucaagcuaggaugaacaaaggacugccaucugcucugccucugacugauauaagaacaacaccaccaacaggguguuucuuuacccaucaccagggaauggaauaucuuuuuuuguuuucucagaacaucuaugaugauugaaaguuuuucuggguguaguagucugggcuggcauauguagccuuuuagagucuguagaacauuuguccagauccuucuggcuuuuagagucugcauugagaaguuaggaauaauucuaauagaucugccuuucuauguuucuugcucuuuuucccuugcagcuuuuaacauucuuucuuuguucuguauguuuaguguuuugauuauuacauagcaggggaacauuauuuucuccaacguauuugguguucuguuugcuuuuugugucuuuauaggcaucuccuuauuuagauuacggaaauuuucuucuaugauuuuguugaaaauauuuucugggccuuugaccuggaauucuucuauuccuauuauuuuuagguuuggucuuuucauagugucccagauuuccugaauguuuuaugucaggaauucuuuuagauuuaauauuuucuuugacugguguauucauuucuucuauuguaucaucaaugacuggguaggaauucguucauuuucucuuuuaaaacacacaucaucuucauaaguugguuuuaaggucuuuuucuugucuuucagcuauguuggacuauucauggccuuauguggugagacaacugggcucuggugaggacauacugcauuggcuuuuguugguuguguucuugcacugguuuagggugauuuuaggucuaggugucaauuucugaguuuguuuuuguugcauggauauuuuauuccuugguuucuguuuucucuuuggucuccuggcugauguggccuguaggaggcuggacuucugacagcuggcagggccucugauugaggcaggagguaugugcccaaguugcaggcuggggcacaccuccugaggaaagggcauuggggagggccaccaagagaauggggagguccacaggugggugaccuaucugaccuaucuggacuucuuguuugaccucuagucaagcaggaauucuuucuguuuccuuuuuuuagggugaauaaagauguacugaauaaucuuuauaaaaaugauguauggggccauuucuuuaagauagauuccuggaggucagauuagugaguaaaaauuauaauaacauuuuaguaaguuuuugauauuugacacagugcauucuguuauaauugcaauuuaagaauaauuugggggauuucuucugcuuuuccuuucuguguguagguuauuguggugguuaucuuauaaaauacuuguuugagagauaaaaugaguaagaguagauaaaaauaauauuaaguaaaauuauuugaguuccuucagcuuuucauuagaaguaaaaauguauacaacuuaaaauugauagauucuagccgggcguaguggcgcacgccuuuaaucccagcacuugggaggcugaggccagccugguuuacaaagugaguacagagaaacccugucuccaaagggggaaaaaauugauauauucuaaagggauaaauguuauaagggacucagcagugaaguauaacuuauaaaauauguucaauuaagauuaacaaccucuuuuagagaaaaaaagccaaugcaggggccuuuucuaucuuuacaguauugugguuguaaugaagugaaaucuuuaaggaguuugugcggcucaggaugugauuuacuguuugacaggaucacacagguauagagugcauucugauugcuccuuuucuccaaccccuguuggcaucuuucucuucuaagucccuuucccauguuuguaucuuuuuuuuuuuuuuuuuuuuugugaccuaucaaggguuuagaauugcucaguggaaccuagcaggaucaccaguggauacacaagugaagacagugauuucaguccccuaauuuaucaggagcuaauuaauuaguucaucagggagggguaggacccugaugauuccccccuccaguuuuggcugaaaauugacaaguccacucuuauucagccccagugcagauaaccauagcaccugugaguuccuguuugcaauagcugggccauguccaggagagagcauuuuuacaucccuuuucccuaucuuccagcccuacauucuuuccaugcccucuucuuuaguguucccugaaccuuggauggggguuauaaguaccuucuuuagagccaccaagaugguucaguggauaaaggugcuguugccaugccugaugacccaaguuugauagcugggaccaauaugguggaaggagagaaccaacuucuguaaguuguccucugaccuccacauacgcaccaugacacacaugcacacaaugaaaaugcaauaauaaaaaagaaugaaaaauagacauccuguugagggcccaccacacaaguaucccuugcuuucagcacuguaagcagccaggacucuguauucaccacugaucauugcagagaaaagcuucucugauugaagguaaacuggaaaggauacuuucuggcuagugguguuggggaagucucaauaaagaacuuaggaauagaaugcuaagaaauaaucccaaugagaauaaaaaggacauaguggauaaguucagggauuaacaauauuaucaggacucuuaaaaacagugaguuaagaccuaaggaaaauagucagagaguaaauuaaaauaaacacaaauucagccuucagaacugguccaauguuaggugaagugacaaaggagggcauuugccauauauaugggaaauuguaaugacauggauaaacaagaauuuauacaauuuuccuuaauggugaggaaaguuuuguuuaaacuauauguauaauauaaguauugguagaaggaacuuaaaaagaagauaaagaagguugaucccuaaacuggauuuauuuccuacuuucauacaucucacacugcaggagugagaauaucgcuaaaggaagucauggucacauaguuucucuuacagaagaaaguuuagaaucaaagguaauccuuuuuacuaaaugcuauaggaauauacucuuucuguuucaagugaaaaauaugcaauuugaaauuaaucauuuuuauuacuauagagcaauacauuagauuuuucauuuuaaauguaugugcgcuugugucagguugugcgugcaucacauauguaugcacucaaaugcacacaccccucuccagccagaggaucuccaggagcuggaguuaugggcaggucguaaacuaccaaauguggucucugggacucuaauuuggauucccugaaggaauaguccaugcucuugaccuccagaugaagaauuuugcacauucuccauuucuuauugggauggccuaaaacuaaggccauauaauuuguauacaauuuggccacuagauggugcacauacagaaugaauuuacuuacaugagacagcaguguguguguguguguguguguguguguguguuuucauuuuucuaaauaaauagcauucuuuguucacuaagauuacuaaauaugugguauuuuaauuauaccuaaaggcuucuggguuuauuuguaaguuuagaaauauguuuauaaauaaucaaggaccuauucuguauaauuuugaacuaucuuuacuucuguuuaauuuuucuguauuauaaaauacauauuacauuccuaacuugaauuccuaugauauucaaguuuugcauaauggcuauuagauauauacagugcuggggauagugcacaccuuuaauucuaugggcagaggaaggcaauucuuuaugaguucaaggucuucauggaguuccaguucagcuagggcuacacagugaaacaauauguguguccgugcacaugcauguauauuguauuggucuaaguucucuagagaaacagaacugcuagaaugaauacauauuuauauuuauuauaugacacauauauaagucuuacauuagauagauagauagauagauagauaucuuacaaagcuaugguccagcuauucuaacaauggcugucuccugacaaaaagucuuaagaauacaguagucauucaguccauaaggcucaauaucucagcuugucuuaagugcauaucagaauccugaagaaguaggcccuaagagugaaggaauauacuugccaauuagaagugagagcaagcagacaaggauuaaaaccuuacuucuuccauguuuuuuauauugcugccgucauauaagauagucuuucuacuucaaaugauuuagucaagaaaaauuucucacacuugugccuagaaguuuggcuuuaauuaauuucagauacaguuaaguugacaaccaagaauacacguauguguauguggauuuugcuuuacuaaugaagcuuucucuagcugcugagguuggaauucuaguguggaaugcuagugggaagauggcucaguagguaggagcacuuggugcuuuuccagagaacuugaguuugguucacagugcccugguuaggugacacacaaccaccuguauguaauuccagcucuagggucccaaagcugucucuucuagccuccauaggcacuagcacacauggcagacacagagucacacaaacauaugaauagauacauuuaaaggaaaaguuaaacuguauaaaauguuaauuucuggguauccuaagagguuaagagcaauuauuuuuguugguugcuuuagguggcauauuacuuuuauucucuauuucaaacaagcuuuccagguuuuucuauaaugaacuuaaauuuuguuuuagugagguuaaucuuucaguucuuuuguggaauaaauaaggcaacuguaaagcaaagaucuaucccuugacccaauuaugauguugauaagcacauuguucugugugcgugcacuguugugcagucgauggccuauaugaaucauagauuuuuguucuuuggguaacaagauacuuguuuguauagagcagcuuuuugagaaauuggaaguuguguaguaaauagauugaauaagcauacagcauauuuaguugugcuuuggagaaacuuggagugaucucuaaacuuugaauuguaccuaagcucuuugacuuucuaggaugaguuuguggacacugaaggauuauucuugugucuguauugauacuguuugcaauuugaugaaggagguuugcauuuaguauuuguauuguguccuugucauaauccauaauaucaaggccuguaucaaaacuagaguguuauguuuuguuugauuuuuuuuuuuugucagaauauauggaucaggacacauuuuggaaucaaacgguauauacuaucuauaugaacuauauuaaugagcucuuuauuaaauaccuggaccauaauaacauuuuguauuucaggaggucuuuuuuuguucuuuugguuuuuuuuuuuuuuuuuuuuuuuguuuuucgagacaggauuucucuguauagcccuggcuguccuggaacucacucuguagaccaggcuggccucgaacucagaaauccgccugccucugccucccaaguacugggauuaaaggcaugcgccaccacacccagcuuucaggaggucuuauucuuuccuucaaagaggauucuuagaucuguaucaacuuuuaauguuuucauauauuccuuuacuaaacauaaguagaauagaaucacaguuugcaagcugguuuccuaguccuuggaaauaaacaccaaacucuaaucucuuugggaaggcgucuuauuccugagaaucccaugugguucucugcucuuuggggacaugucuuagguaagguuucaaugagauacuauggacauuuuuucuucuugagccaaauuugcaauggacccaaggguguggcuuguaauacuauguccaguagguuacauuuaauuccugccuagaaguacagacauaagaaagauuuuguccacgucugaaaaauacucgugacugagccuggaguguguguuguguucguacaggacugaacauugauucaguuauuaucaaguagcacuuuuguuuacauauacuuucucaauggacaucuauuguaacauauacugauauagcacagcauggcuuauacuugagaaucugcuucuuaaacuugagaauguuaagaguuacuuagggagcuuuuuaacuagcauuccgggagcuagagagaugucuuagugguuaggaacauguuaauuccuccagaggaccugaguugaguuaguucaagcacccauaacaguuuccaaacaccuguaacuccaguuccaagggaccugauaaucugaugcccucuucuggccucccuggucacuugcagauguguggcuuauacacauacacauacacauacacugagaccuuuagagauuuuauaguaaaaaccaggcaauucugaggcuaacuacuauaaugaaaaaaaaacuacacacaacaacaaaaaaaaucauugauucuuuuuaaaugcuuauuaauuuagaaaucaagcagcauuacuucaugagccagaguaguauuuauacauuguuucauaaugaaaggaauuauugguguucuuuugcacauuauaaacucaaucuuauaacuuuaaggauuauuauaugccagaagacagugcauauuacuccuuaacaguucuuuuuaucauaaaaguuccaguggccauuuauguauuuuacugauuaaucuguucuaaacucaguaguuaaaacauuagaaauuaauacaccuuguaaaaugauuuugcuauauuauaaacaaauuucccuaacauuagaucuucagaauucaacacgguauuuucaaacaauuugaaaaccaaugcuaaauaauauaagauucauugcaauguuaaaauuuaugaauagcagauauucuuuuaaugagaucaaagcuguuagcagaaagaagccuuauauuuaaaauucaguucauauuuauaauuuauguaagcagugaagaugccauuggauuuuacacuacgcugaugggaacuuaguaacccgggcuuucuccacccagugcguuaaaucagucauccccaaagggucuugguagcccaguguuuauaaccuccuucuuuaccugcuaaucgaccucacuuccuggauuucaguccgggucuaguuaucagcuaacaaaagaacagcuuuugguuccugcagacgcuggugaaaaaauaaucacgagaaagaaauccaccuuaugucgucuuuuucugucugcaaaaauaaacucagccaccauacagcuaacagguacagaaggaagauacaggcucggucauaggaagaaacugcagagaaaaugagcaucauuucucaagguuuuuaucucccugaucuacaagugaugcugcuguaauuguagcugcaguuuucaccgaucauucaccacucagcagcugguagagaaguaagacugcuuggcaaccaccugcagggcugcagagaugaauuacauuuucggaaacaacacacuucuguacucucgcgccagucgaggaggcaaugcuagcucuagccauggcucaguaggcccuaagcagaaacacugggcaaaaaagggcucgucagaugaacugcaagccgagccagagccuucccgcuggcagcagauaguugcauucuucacucgaagacacagcuuuauugacugcaucucgguagccaccagcuccacccagguaacaggccacuuguugaaauuauuuucaguauauuuauguucauauuugcuuugcuacgaugucuuagugcagauuuauuauuaaaaaugaaucuacuguguuguuaucuuggcacugaaauuuuauguuuuuaguccaucuaugcaggucuuuaccacagaaggggaaaugaaaaacauuuucccuuauguuauguaauacuaaacaaaacagucucagauucuacuaaaugacuucucuaaaaauguaaagucauuaacaugugaguuaaaauacaaguuaaugcucaucuuauuuuuagaugguguuaaauguuaugaagaaugauguuugagcaaaagaaaaucaccuauuuaguuuuuguaugcuaguagauaauccuggggaggcauaguaagaaacaaaagguagcuuaaauguuuucauuuuuaauguuuugagaauagguuaaauguaauguaguuagcuaauaugauauauauuuaucuuaguuaaauuuauuuauucaagauauuaaugacuauccauuuuacaaauauauauugucuaagaauaaucuggaauuaguaaacuuguauaauugcauagucauggaauauuuuuaaaacauucaaauuuuaaagaugcuagcaaaaaagucccauaaaauuccuucuuuaaggggaaaugaauauugaauguaggagacaaaaauaaacaguugaaugaaugcuugugguuuaguauaaaagaagacaaaaggaaguauuaauauuuuaauauauauuuuagcagcaaaaaaaucaacuagugaaaauaaaaggguaaaaaauagucuaagaacaaauugagaaugguuuuuccuuuaaugucaguaaaucuuaauguguauacagaugcauauaugaucuuuugggccuuuaaaaauaaauuuccuuuaaagauuauuuuuucacucacuagaagcagcacaauaaauauaaauauaacugccaaccugauuauuuguuuugguuagaguuuucucacaauguuuugugguaguaaaauaucaacuccuaaagucagaaaaccuacccauuucuuauaugcuugagaugaaauuacauauauagucaccaggguuccuuccagccagaacuuacugauaggcagugacugacucuuaaauuaaaaagugacugcucugagcauuuuuuuuccugcuucugaucauaaaagaaugaaaagauuaaauguuagugcuacuaguuguuacagauaaauauuaaauaauauuuucauaacaauaaaaagauacccuagucuuuaugguuuuauaaauaaacuacuguugcauauacauauugauauauuuaauguucaucuuaaggacauacaugaaaagaccaauaguucacacauaaaacuauugaaagcagguuagaagacaggauuagaauacaggaaccuguacacuaaaaucguaaccccuauuacaccauugacgauuauuccucucccucaaaguuggccccuguagugucucucuguugaagaaagaggucguuucucuugcaaacuucuuaaccaaugcuucucuuggccuuuucauuaccuuuguguuucgagucuggaaguagaaaauccuaggccagagguuuucacuucugucuuuccuagaggagucacauugcacuuuucuaacugaugaguuguauaauuuauauguucaaguuguuaguuauaacuuuuugcuuuauaugauaaaauauaguggaacugagaagaggaacucaagacaugaucguaccuuauuuaacacaggagugcauuuuuauaauaacucagucuugacaguuuuguuuuguagcagcagaggaauuugcauguugcuguagggagcaaaguagaugagugaaaugucauaauuuguugagcauauacuauguacuuacuauggauauaguuuguacugugguuuguaaauagcaggaucuccuguuuugauguuaucugaaaugaacuuuuuaaaauauuucauaggaagguuuaacuuuuaaucuaaauuuucuuucacuggguuuaaaauauacuuuaccaaauuggggguuguuacuaaauuaaauuucaauuauuuaucucaaauuacuguucugauucccaaacacuuugugcuacaagugaaaagaaauuuuacuuacagauuuauuuuaaguacuugucuauuagaaguaucuauguucaaaacuaagauuaugugccaaguuccauggacuaucuggaacauuuaggaagucauauucugaaugcuaaggaaaccaaauuauaaagaccuacaagauaccaagugcuuggacgcucgguaaauguuuguggaauuagcgucuguuucaguucccuggaaugcuauucuuaauauaccgcacacagucuucacaucgaaauaucuguaguucuuuagagugucuugccuuuuuuuuucucuugcuucauauuauccucgggccacacauaucuccuguucuccuguuucccucaccccucuacccauuaccaguagugauaaaaauguuguuacauucuaucuccauucauuugguuuugccucagaaguuuaccuugugaguugagaaagggaacuuuuuaauuauuauuaagacauauuugucaugaauugguuuaccuugauauaauuuuuucuucagagacuucauacugcaaauaguuuuuaaguaguuuauguacacacacacacacacuuaaacuuugauuccuuacuucaucauucuuccuguuccuguaaguagucaccauggcaaccaagagaugcaguugaugucauuacuaguuuguggaugacuauacuucaucuuccuucuuuguucgugauuuaaaaaaaccaaaaacugcuuuuggggacaggccagugguggcucacaucuuuaagcccagcucuuaugaggcagaggcagacagaucucugaguuugaggccagccuagucuacagagugaguuccaggucagccaaggcuacauggagaaaccuugccuugaaaaacaaaauaaaacaaacaaacaaaaaaaaaccuguguauaaucucaagucauucgucuuuuaaaaacuuccaccaggaagaccaguacauaaacuacuuaaaacaaagacuacuugcaauaugauaucauacagucaguauuuccuuuuucucccuuucugggcuucugcaucucucuuaaucacugggacuuggagaguauuugaguaccgacuuaacgucuuuucccugcccacuauuuguauaaucauucuuaguuaauuucaguauccuuauauaaucuaccuaaaaucuugacuuuucuauuuuuuguuaucuuuuuccauagagaucuuggguuuucugucacuugaacaaucuacucaaaugauuguauugaagacuuuucaacaccacuuggcauaucacuucaaccucugauguaggcauuucacauggcuagcacuuuuccuucucggcucacuuguucaggccuuccacuacaaugcauuuuaauccucuuaagauccagggaccaggaauuuuuuuuauuguccuuugccacucguccaucccucauuaccuugcucaaaucuuuucauaaucucagcucucucccacuucccaccacucuauuggaagcauguguccuaaaugcagcuuugccuucuucaccaggccugagaacugcccauuaagccugcacugucccuuucuagggagcaccauucuaaguugauaaucuuccucuguccugccuggccugcugcaguaagcgaacugucuguuccuaaagcucaccuuucucucccgcucgauuauucaaggccucaucagacucguuuuucuucuucacugucauuugccuuuuucuguguauuaauuaauuuccaugagcugaaacaccucucacuaacauaaacagcugaaaccaccuucuuguacauugucaaauccacuggccaguuauucucuucaugugaccugcuauacagaugaguuuaacacaguugauuacuacugaagguuuuucaccucugacucuggaauacugaucuaacauucuacuagcuucacuuuccuuuggaguguuuuccuuuuucuuacugcuaaguaggguacagucuuguauucuuguguguguguguguguguguguguguguguguguguuuucauguaaucuuauccagucagucuugugccaucaccaucaaucaucaucaucaucaagaugucugucuuuagcucaaagcuaauccuguacaguaggccuuguauccguaguuuccuguuuauccaguguuuccacuuaaguaagcauaaaagauaauuuuaucuuuuuucaucacuauuauugacuuucuuuguuuucauuuaacuuuaaauuuuuuguuuguucauuuucuucuuaucauuguggucuuugauggaaagacaguacauguucuugcccgugcuaauaagcaugcccuaucacugagcuacaugucagucucgagagagcuuuuagccuacuuccuguucuuauguaugcugagaaacuaaaaacaaaaccugugggauugccuuuuuucuuuugcuccauuuccaagaugacagcagauccuguuggcguuuggugaggacaggcuucucguucugcucccugccugccugcccccagcuaggcagugccuuuccucgggcaucagucucacuuuacucuuauaacuuucuucggaguaguuaccuacaggcugauuuuuguuguuacagccuuuauuuaaguuaaugucuuuaaagauuuauuuuuaauuguauguguaagugugugcauaugagugcaggugcaguucagaaucuguuuugccuacuagccuggcaguucccuagagguaggauuuucuauuuauguuuaugcuaauccucagcuuccauaacauuauuggcaacauaacgacuacaacaagaaguuacuaaaugagggaagaaacagacaaaucaaccugaacucugaagagcuaguacacauuuuugucugucugucuucugucuuaaucucuccacgaaacauuuguguacugacuuaguauuuaguaagcugauccucugcuugguaacuccuuucuuacuuguccuacugaagaggaagaaaucccaaggggagggaaaaguuuugguuuucuuacagucaggguaacuaugcaacucucauaggcuuuagauggagagaggguacuauuaauaacuaaagagaggcaaucaguacaaauacauauuuccuaggcaaacaggcauaugguugguugccuauuuauauccauguaccuucugacuuacaacuaggcaacuggugucaguguccccaccaagacaucuucaucuuggaauacccuagaguccagcuuuguugcccauacauuuucauaaagcuggucccagauaagaaggaagggauagucuuuaucuuugagaggcuguuuauauuugguaauguguuuccuuugcacuaaacuggaauauauaccagguaaaucggcagccuuuuaaaacuaugguagaaaugccaacucugaucaagaguaggguuguuucuaagauaaaaaguguagaaauagucuguuuaacugguuacaaaaaugcuacuuugggcaggaacauuuauuuauuaauuccucacucagaaggucaugagcuuaguaagauuaauaucaugacucaucuuuggaaauguuuuacagcacgccuauauguguuuaguauuuaagaaccaauuauuaaugcagcagaacacuuuggaaaucacagacacugcacaaaaaguauuuguuuacaauaguuauagaaaucuuuacaaaauacauuauugaccauauaaccuagcagugauaauccuuaaaaucucuucaaauuuaguacuaacuuuuaugcagagaaaacuguagauagauguuuguaauugcuuaucauugucaaaaccuaguagcaaguaagauguacuucaguaggugauuagauacacuucugacaguggaauaguaucuagcaguaaaaaagauuaagccacaugggaggaaacuguuuccuacuaagugaagagaaaacgaucugaagaggcuuuauucauauuaucccaacccugugacauuuggggaaggaagucaaaaagaaaaaaugugggauuccuaggauuuuaagaggagagugaaacuauucuguaugauucuguaauuucagauacaugccaucacacacuuggaaaaccauagacucuccaacagcaaaagugaacccagcauagacuagacucugauaaugguggguugguauagguucaucuguuguaacaaauauaccacucuggugcaggggguugagugggugacuguacacauaugugggccgagggcaugcagggacuugcuguacucaacauucaguuuucugugaaccuaaaucuggucugaaaauuaaauucuauuaaaaaauacaaacuugcuaucuuaaauuuagauuggcuuagucuggagaacuaaauaggaaaauuuuuauguaaguuuucaucugugcagcuucuauauaaugucuugauauaguuggcccuucugucaaggacaaauaggcuaagagaaauacauuucacauuuacguauuuuaauauauauucuaggaaauuuuaaaaguuaacuuuuaaaguaaaauuuaaaguaaacuucuggaaaaggguggagccacauaucugaauuuuucaggcuucuugagcuuccauuugggcuccucuguuuaguaucaaguaguguuucucuucugagauuuagacugcaggcuucuuagcacaguuuuguucucugucaucugcugaacuauaagcuucauagggcugguccuauaaagauguucaguuucuuuuauauuccuagagccuagcauagugaaugccuugauaaauauuaguugaauaauacauaaauuaauuaauaaauaaaugaaggugcuuaucuccauuuaacauaauuguugcaaggagcuucucaauaugauuugaucauuauuauuuucacaaacuuuauguagaacuauagcuuaaaaauuggcacaucuacaccgaagguuuuguaagauaaaguguguacauugccaaaguacuugaaauucucugagggaaaaaaauguguguguggaaccaacacucaagagcacuggcuagcuggcagugguagggcacuucccagcauuugagggacagaaguaggcagaccucugauuuugaagccagccugguccacauuacaaguuccaggguagccagggcuacacagagagacccugucucaaaagacaaaaaagcaacaccaugaaaagaccuagcaccaggcacacacacguggugcgcuaauacgcacaaaagcaggacacuugcacauguacacugaaauggauaaagaagaaguauaugagguguuauacucuacauaugguaaacuuaaauuuguaucacuaaaacacauuuuaaaagaucuuuugcaauauuauaauccccaacaauguuauuauauaauuucagaauuuugagaaagguaaaaauaauuguucagaucauguagaaaacaguagucuauaauuaccaauuuguuuaagaaacuuuuaaauauacccacugauaaugaucauuuaacagugacauagaaauuaaugaacagaaauggugguccuaucuuauggaugguuacauaauuggccaucauaucugacagcgggggauuuuauuuuuauuuuuuguuuuuuugagacagggcuucucuguauagccuuggcuguuggauuuuauuuuuuaagugaaugaguguguacacaugccauguguguucaggucacugugaaggccugcagaggauguuggauaacauggaacuggaguuccuucacauugugagcugugugauguggaugcugggaacuaaccccucccccaggccuggaaggagcagccagugcucuuuacuacaaaccaguucuucaaacauagagcuagaauuuuauaaggaauccuagugcucuuaaaagacauugccacuauauucaucuuuagcagagauggcucaaaaguuaggagcauggcuacucuuucagaggacccagguuuaauucccagcacccacauggcagucacaaccgucuguaauuccauuugcaagggauccagugcacucuucuggccuccuugggcaugaggcuuccaagugguauguaaacauauaugcuuagguaaaagaccuguaggcaugaaauaaaagaaaaauuauuuaaaacauuuuuugucaaguaccaaguuguuugcauuucugaacagguuuuugguuuuguguaucauauuugugagacuuggucuauuaguuuagccguguagcugugaaaacauaaugaucauuguacaguacaaguuucuuaagugguuuucagaaaauaacuagugauuauaaucuggaauuuaaauuaaaauggauccuuuuuugauuuuuguauacucugacuauucuuuguaaaaccaucuacuauaauaaaagauuguaaacuugaaauuguuuuaagaguauuggaaaacgagugugagacuuaucaguggggugcuauauauuaccuucacugcuagugacugcagucaguaaggaucauguacggacagugcuucugacuucaguagcagccucagggucuugagucaccauucagcacagacauaauauggcuaccaccguuauuagcacuuccacaaaauacugugggauuggaaguaaggaguuugaaggaauugauauaauuguagaguaaaaaagaauucuguccuaauuuuuaaaaaaauuaaggaaaacagguagauuuuuaaccuuaacagggucaagccaagagcaaaaagcaaaacccacaauaauuauuccaagagagaacgcaacagaagauuaucugaacaaguaucagagcugggcaugguggugcaugccuuuagucccagcacuccugagacagagacaggagaugucuuuaauuugaagccagucuaaucuaccuagagcauuauaggccaucuaggguucaauagugagauaugucucaaauaagagaaaaauaaacaaaacaauaacaacaaaaauuguacuagagaacuaaaaggucuaaauuggaauaucacaguaaaguggagaguaacagugagaaacacuaucuaagagaauagguguguggacccaaccaugcagaaagaaccuauaguuggugucuguucuaaguacaacacuacagggaacaagacuaagaagagcauguauucaaaauccauuucauagucuguguugguagucacaguuuuauucaucccacacacauagcuuccugcgaugaugaacauaaagaaaaaacuuaaacagaaaucuuugcuuuugucaaccucauaucauaauagaagacaauauaauuacaaaaaauaugguauucugaaagaaaaguuaggaggaaaagaagaaagauauguggguagguaauaaaauugcugauggagccuuugauucaaaagugaucauuugaguaaagacaggaaaaauuccuagacuugagcugucuaagcaagaguauucuuggaagaaagguaacuagcaagugggaagguauggaguagcagaucaauguagcugaagcaguaaguagagggagaauguaagaucacuagcagagccugagccacugggcacuuagagaggagugaugagaacagagcagcugccauugcuacggaagcauuacgggagccuacuguggcuuaauaguugaugaaguccuuggugaugcauguuuaucuagccaguucugagaauaucaaugauaaaggcauaauacaauugauaacauccucccuguguuaauuauauaaccauaucuuuaaauucagucuuuaaggcucuguuuuuaaguuuguagugagugagucauccuuuuuugaggcuguuagcugaaugcuaauauaaauaccaucuuuccauaaggaagagagcagaaaccuuaauuuuaugaauuuucaacugaaaauaauagauucaugagcuaacuugucuguguaaacuauaaacaguuucgcaucuaugcuucuaaaguagaauuaauuacuagaucuauuuuccuauuucccacagcuauuuuaaguuuuuaaaaaauauuugcauuuugauacuuuuuguguuuuauuuaaaaauaagcuugauuuuuauacacucuucugagacauuggcauggaugucauacaugguugaaauacuuuuuuuuuuagcuaaacaaguuuauauuaaagauguaauguguuuguagugacgguggcaaagggcguaugaaucauaagaaaaauauuaaaccaugaaaaauaccuuuuguccugugauauugauccucucuugaauacaguaauucccaaguggaguuuguauaaaaaucgacuuugcuauauuuuauccucugcaaacauucaaaggcuugcagguuuugccugguuucuuuuuuuuucuuuuaaauagccgcuuugacauuuaaucagaagcaugccucauuauggcauaguagaucuuuaaacaaaggaccaaggaaccuggauuaagaauucuaaccauguguguacaaagucaggcucuuuagucaccagcaguagccuggaugguuacuuugguugccuaagauacugguaccaaaaaauuuguuaauucauauauuucacuuuuccuugaaaaugcaguauauuuuuagacauuggguuuuguuuuuuguuuuguuuugauuugauuagucuuaaguucauuuuacugaguauaagaagcauguuaauauaaaauguaaacauuagcuucuugguauuguaguuuuauuuaucuugucaguuuuacauucugaaaaucauuuuuuguuauuuuaucucuugauuuuauuuuacuuauuuauuuuuuccgagacaggguuucucuguguagcccuggcuguccuggaacucacucuguagaccaggcuggccacuaccacccggcuuugauuuuauguuuuaucuuuugauuacaggagacuaaguuuuaaacccaaggcuucaugcuuguuaagcgaguauuaaaccacugagcaaaucucuuccaguccugaaagucuuaauaaauaauuagcaagaaaaauaaauacuugaauagcacuacagcucuuucauauccaagucuaauuauuaucuaggaaauaauuuuuaauugcaauugugagaauuguuuuguuuuauuuuguuuuguugagaccauuuuauguugaccaggcuggccuugaacucacagagaaaagaucuuccugucucugccucccaagugcugggacaagaggcgcgcaccacugugcucaguugcggguauuauuuuuaacaguccucaaaucccaucgguucccagguacauuaacucuucucucacggguucuaucugacuauucaugccuauuuucaccagugcugccaguuggguuaugcuaggcucacaauguguguauauauuguugaaugccuaaaagugagggucgguauuacauugucauaaaugaagaugugcacauacuucagaugacauaagaaucuauauuuugagugcagguuuucuaaauuaagaccuuaaauuaguauaaaaaaauaaaccuauguagaaaauuaguacaauuuuguuaaaucaguuuaaacauuuuucagauaauugccagugugauauuuuuuucaaaaguacuugacaauguauaaucuauccaauuauuuuauagaaauguacaauuuucugcaguguuccuucagacaguguuaauauuauaaccucuguugucauggaaacaagucuccgaaggcagccuuagaggcuaaugauucugugguguugcuauggauagaaacaacugagacuguugcuagucaugugaccaagguuuuuaaaaacaauaacagaucucgauugagcugauuuuuaccgagugauacaaauagagcaggacaggaaugauguaagggucauuguuuccuacuugauuuauaggguuauagaagaguguuaagguuuaaaaugccauuauccacucuuuucugaaaauaaccuaaauauaaugauuacuuuguuuugccucauuguuuaaacaauacauguugaugcauuauuauauuugacauuuuccagcuuagaaucuucuacagcuccuaagcauuuuauuacauucucaaauguauuuaaauccucuucaucuccuugcucuauuuuguaaaaucaaauauuugacauuccuuaucaacuuucauuugauuauuaggguuuuuuagggcuguaauuuugauucaagugaauuaaauggauuuuguuguuacucugucauuuaugacuuggauauuuuauuuguuuaccaacaaauuauuaaccauuaaaucauuguugguuaaguauuuguaugcugaagagguagggacacauggucuuucacagaauucuuaauuccaggugucucuuacagacugagauaaggugucauagguuguuguugggagguguuuuuuuuuuuuuuuuuaagaaccaguauuuagaucuuguacuggcuguuuuugugugucaacuugacacaagcuggaguuaucacagagaaaggagccuaccuugaggaagugccuccgugagauccagcuguaaggcauuuucucaauuagugaucaaaaggggaaaggccccuugugggugggaccaucucugggcugguagucuuggguucuauaagagagcaggcugagcaagccaggggaagcaagccaguaaauaacaucccuccauggccucugcaucagcuccugcuuucugaccugcuugaguuccaguccugacuuccuuuggugaugaacagcaauguggaaauauaagcugaauaaacccuuuccuccccaacuuguuucuuggucaugguguuugugcagaaauagaaacccugccuaagacagauccuuuccaaagaaaguagauucuagaacagaacaggcuuugaaaaagaagggugcagugggguuuaaauguaacauaaagagaugucauaagggauauggggagcaacugacagugugugucugugugugugugugucuguguguguguguguguguguguguguauugugcuuggcuuuaaaauuugaggugaguguauagcauugccuaauuuuauaugaacuguaacucuuacccuaguauuaggacuccagugugcacuuacuaguguagaagugcucuguacuacuaaaccauuaccaggggauugauacagcucaggacuagaacaacaacaaaaacagaccaggaaucucuuagagaugauagauacauucacguucacaaccuucauugugcucauaaguuucauauguguuaaccuaugagauugcauacauuaaauuaaauauguacuguuggggcuggagaaacggcuuuguaguuugagagcauuggcugcucuuuaagaaggucuugguucaauucccacauggcagcucacacccauuuguaacuaguuccaaggaaucugacacccucuucugcccuuuucagguaguguauaugugugaugcacagacauacuugcagccaaaauauccauacacaauaaauaauuaaaauauguagaguuuauguuaguaugcuauaauaaaauugcuuauaaaaauuguacaauagccaggcagugguggcacacuccuuuaaucccagcacuugggaaggcaaaggcagguggaucucugaguucaaggccagccuguuuuacaaagugaguuccaggacaaccacggcuacacagagauagugaguggaacuauuauucccuuuucugccucuugauuccuggaccuauggaucuuggcuaugggggaaacuguaccauauaucgagcauauauucaaagcauauacugccuucugaagaacucugcuccaucccuccaugcuguugccaccuaauuggcgcuguaacugcugcuucaaaaggcuauuccaucuuucuaucagaccagcugcuucaggaugauggagaacaugguaagaccaguggauuccaugauccuggguccacuguuguacugugaaaugaguuccuuggucagaagcaauacuguguggaauaccaugacgauggauaaggcauucugugaguucauggauggugguuuuggcagaggcauuacaugcaggaaaggcaaauccauaagcagaauaaguaucuacuccaguaagagcaaaacacuguccuuuccacggaggaagugguccaauguagucaaccugccaccagauugcuggcuggucaccucaaggaauggugccauaucuggggcucaguguugauuucugcuguuggcagaucuggcauucagcaacagcuguagccaggucagccuuggugaguggaaguccguguugcugagcccaagcauaacuuccaucucgaccaccauggcuacuguguucaugugcccauugagcagugacagggauggcuggggagagaggcugacuguccacagaacgggucaucuuauccacuugauuauugaacuccuccucugcugaagucaccuuuuggugaacauuuacaugggacacaaauaucuucacauccuuuacccauuuggagaaaucuauccacaucuuccccagaugucuggaaaaacaaacaaacaaaaaaaaaaguacaaugauuuuuaagacucauaauuaucacaguuugauagauauggccaauuauuuuguagcauuaucacuuaguuuggauuugucuguuugaauagauucuauuaauuaauuguguuugggggaagaaggggauuggaugggggaguuguggagggguaacugggaauggggauaucauuugaaaugcaaacaaauaaagugauuaauuuaaaaaacgaaagaaucaccaaagugagugucagauaguacuuaacuucaguuucuccagucacagugauguuaccucuggucacuugguuaagauuguaucuguuguguuuauccagguuaguauuuugaggagcuacauuaucguguguguguguguguguguguguguguguguguguguauucugccuacauguaugccagugcaccugcuuccuacagcaaaagauaucagcuccccuggaacuggagucaccuguguggguaaaugagacucgaacccagguucucugaaagaauagucagugcuuuuaaccccuaagccaucucuccagcaccuuauuuuuuagccuuuuaaguauauaauuaggugacauuaaguauauauucacaauauuauacaaaugccaucccuucucuacuucuuugggggagaggagauugauuuucuuugcaucauuaacucuaauggcuaaaaaugugugaaaauaaaaugagagaaauucagauagccaaguccagcaauucuaguucauucaucaguguuaauauuuuuccaguuaauacucuuacugaaauucaaagugucuuuagagcauauucguuguguuugucuuguaaaggaugugcugauggaagaugguuucuuuuguguugguauacacagaucuucuaccucucgccaugcguuuauucguuuauuguuaucaguuggagaagucagauucaaaaucaaagcaagaaugggaacaguuacaauucugaccccagcuaauguuucaaaccuuucuucuauuuuucauaaauuucaucucucucaauauuauuagcaguauucuacuuguuuuguaaacaauuauagauuauuuuaauugcuucauaacaguuaauguuagaaguuaauuuuacuuaaaauaccuuugaauauuuaggauauuagagaauuccccaguauaagagcuguuuugagagaauaccuuagaagguuuuggggggggggacuuguuuuguuuuguuuuguuuuguuucgagacagggucucuguagcccuggcuguccuggaacucacucuguagaccaggcuggccucaaacucagaaauuugccugccucugccucccgagugcugggauuaaaggcgugugcuaccauuaaacuaagucagaguucagacauuuuuguuuuaaagacuguuuauauuuacuggcaaauuacuuuuucugagcuuuccccuccacucuucccagauuauuccugucacaugaaggcaaccagugcuaguguuagugacuucacaggagcaccaggcagacauucaggguauuauuguucuugguagcagaguuuuaauaguauggauuauuuuccaauaauacaaauucauuuuggaaauuuucuuuuuaauauuuuuucuguggauuuauaagauuacuugcauaguaggcuaauaauuuuuuuuauuuuaaugugaaaaguggaaauagucaaauaacuucuggaugcuagaagagcaucugucuacaaaacaagcccaucauaaaguagacugugauugucuuuauggacaugucuuacagaacagacuuucuuaacuguggacccuggcguuauacauugaugucauaguaauaauuaggauagucucaauacuuaacuaacuaaaguaauaucuuaaugaauuauucacuuauuauuuuauagagaacuauaauuuaccuuuauggugcaacuuucuguuuguuuuucuuuucuuugguguuuuuccugauuuuuguccuuaaugauuuuagcccacagaagcuguuccucccuccucucccauugucccugugaccccugcccugccagucccugcugagaguacugucguccugcccuccgcaccacagguuguuauugcuuucuuuuuucuuuauaacaauuuaauuuauuuucaauguuuuauucguaucuuuuaaaacuguggaaguauauguuguuagguauauuaauuugcuuugacuucaauugggauuuaagauagguucaacuuuugaccuuuuacuuggucgucuaugaauggagugcauucugaacauauaguagugaaccuuuggggguuuaacuuccuuuauacuuguaacuguguuuaguuuuauaaauuagucuaauauuuaaauguaaugguccuauuccuuugccagauccauucuuuuauauggcacuguuucuccacguauauuugucuccuuuggaaauagccagccuuuuguuauuugguuaaaucccauacuuuaaauuuauuauaauaaguuauaucucaauuuuaugaaaacuccuguuuuagagacagggccucacauagucuguguuagcuuugauccuggugguccugcugccaccacuuccugagagcccgaucucaaugugugccauggugcucuaugucuaugugagcuauuuacacaauuuucauaacuucugucagaacugcgacacaagaaaaucauagccaaauguuaguaaauuugauaaguuuuaauuuuuagaaucuuacuaacuguaaggagugguuuguugaaacuuuauuaccauugcaacacaguuuaauagcaguuuauuacacagcacacauuaauagugaguguguuauguauaauauuaaugaucuuucguugagagcuugcaguaucauauuaaagguaaauguguucguagauauuuuugcugaaauugagugacacaaaucuggguggguaaacaauguaugagaguguaaauagugugugugaguguaaauaauguguguggguguagucacagcaucagaugauccucacugagggggagaugagaacaauugugagcacucacauuuuagggcuucccucugcuaacaacugaacaccagucagaauagccacacuaccugagaucccaggauaaaucaucaggguuauagcgaggcuucacuaugcaaugacugggugauacuaauauuaugacuuucauuaugaaaccaucaugaauuaaauaaguaaauccagauacauauuauuucuauauugcagagagugagcagucagcaaucaaaguuacugaaacaugauaaagauacauguguuuuuaaaugccuagugguaugacauuuuccaaagggaaucucaaagguuauuuuacuugcuucuuucuuaaaauaauuugcuagaaucccuugaaauuuuguacaggacucugcucuguuuuuaauuagggaccuguccuuuuauuauuuugggggggugucuuucauuuauuuauuuauuuauuuauuuagugucccuaacagcaaucuacuguuauuguaaauuguaaacgcucauagucuuagaguuaaaaaaauaauuaaagguuuauaggucggucugacuuguuuugaacucauuccaaccauguacugcuauguaacagaagaguucacuucauagugauaaauucuuuuagcaaaucuguauugcuagagaggugauaguuccuacuugagagauucugcagugauaaagucuuaauauaugagcuuuaauauauugaauccugauuucaguucccagcaaaaaagaaacaagguguaucugcacaguaccuuucacauaauccccucaugcuagcugcuuaacuuuguuuuugagagagagaguaaauaaagaaguuuaaaagucauugagcugccagucaugguggcucacacaccuuuaauucccagagcuggggaggcagaggcuggagaaucucugugaguucaaagcuagcaugguacuauauagcaaguucuaaaacagccagggcuacauagggacugucucaaaaaaaaaaaaaaaaaaaaaaaaaaaaaagucacugaggcuauguauacaagaaaaggaacgcccucaguguguuuuauuaacaugucugauguccuuagaugauaguaauccaugcuguauaacaugagaagcucauggaguugucucauuuuccaagcuaaguauuguucucgauauuaaauauagcacauuuauuguuaaaaaacaguuaauaggacaccaaguucaaaaagcauauucuuuuaaggaauguguaccuuggaguagagggcuggcucaacaguuaaaagcagauacugcucuuauagaagacccaaguucaguccugggcacuaaggucagguggcucacaaccuauuuuugacucccaacuccaggggauuugacauccucucuacaggcacuugauucacaaauacacacaaaagcucacacacuugaaaaauaaauuaaaucuucauuguuaaacccuuaucagagaagugucuucuugcaguagauaggauuuagcacagagacccauaacuggacagugugcagucagugaaagacgaugaagcacuugacccuaaaugggauguccucaucaaacuccucuccuugaggcucagggaucagugcagaggaggagacagaaaguuguaaaagccagagagagaauggaugauuccaagagaacauauuuuagaugcacauaugaauucagagacugugacaucacuaacauucaagcaaaaucccagcagagagaaguagauaugagguccaagaaacuauuugcaguugauagcuguugagagauagaaaaucaguuuacccaguguagugacccuggguauauagccacacuccagggcagggccacucuuggaguaguugacuaacacagaauggaugccauggauuguugccguugcugcugcuguuaugguuuggcaauuuugucuauaguauuuauuuuguuuucuuggguuguugggcuuuuuguuuuguuacguuuuguuuguuuuggaaaaggaagggggggggacacauuaaguugaggaucaaaauguauuauaugaaaaaauauaagcacuuuaaaauauaaaagacuauauagcagauuucugaguucgaggccagccagggcuacacagagaaacccugucucgaaaaagaaaaagaaaaaaagaaaaagaaaagaauguauaacuuguuugucuuuuuagaggcaucaggaugguaauagaagcuguuuagucgggguuaguauugcugugauaaaacaccauaaccaaaaacaaguuggagagggaaggauauauuuggccuaaacuuccacauuguaguuuuucaauaaaagaaaucaggacaagaauucaaacagggcaggaaccuggaggcaggagcugaugcagaggccaugcaaaggugcuacuuacuggcuugcuucuccuggcuugcucagucugcuuucuuagagaacccaggaugacaagccauggauggcccugcccacagugagcugggcucgcccauaagucacuaauuaagguacuaccuacaggcuucccugcagugccguccuaugcagucauuugcucaauugaggcucccccucucaggugacuuuaguuuaugucaaauugacauaaagcuguucagcacagaaauagaaaaaauaguccugucuuugucacacaaauaaguuacacuuucaaaauguuauacuccucccuugucuccauauuuccuaguaacugugagguucaggucauaaccccaaaggaagaaagauacauagauuaugauuuuuuuuaaagacuauacugucauauggccauaauggugcauucuuuucauacuaacacugggaaggcaacgucaggacgaucccucugaauucaaagccagccuggucuauauagcaaguucuagacaggucagaaaaccacaaaaaccaaaaacaccuuuuugguguuuuucuuucuuuuugucgaaugcuuuuauauuuuacagagugcuuguauguugaacuuuauuaaagcuaacuacaaauggugcagugcaagauacauugaguggcuacauagaauuaauaauacaucgugaacuuaauagucugaucgaaacccauuaccacucagcaacacucauuucuagaugugagugccggagaaauuucucacguuuuucagagcuccaguuucccacaugaaccaaagcacaugauacauaguucuuucugccaaagaugcauccacucaucuuuacgcuucuccuucuuaauccagaggcauaugucugcuccagagcagacgcuuuagacucgauugucaaccugaagcacuagucugugacucauuuggcagcgcuuucguucuagugugcucuuggauguauucucaugccuucucccucucuccagacccgcgucucuuuugcucucccucacucuccucucccuuccguucuccuuuuccuuucccccuucugugcuugccaugccugugugcauguguguguguauuggggcagggauggucucuugaugcucagacacacacuuuacaauauguugguuucauucuuuuuucuucuuuuucuucuccacuucuuaccccucuuuuucuuccuucuccccuucugcuuccuccuucuccuucuaguaauuguuccaaucauaugcauuaauacccuucucuaucugaaauuugauuuucugcaguuccauuuacagucaaauuuaaaaaauauuaaguggaaaaaugcuaggagccauugagucaaauuuuacauaaccuuuacuuuacaauaguguuacacuuguucuauuuauuacuaauuacucuuaaucucuuucugugacuaauucauagauuaaaccucauagauaaucauagauaguuuuacacacacacacacaugauauaauacuucuacccaguuguuucaaguaucugugcaacauuccaaaagauauuccuuuuggaucauggaaacguaaguauauacuaauaccauuauugacuuccuacaagaacaacuauagaugagaucauuuagcaguuaauuucauuauggcaugagaguaauuucacucucuguagaacauccuauguaugaccucugaaccuuuaaaauuuuacaauacauaagaguauugagucuuaaauuuauuggaucaguaguauuguuugacuugauaaauuuucauuuuaugaguaaucuuaaaauaguaucugugauauuaucuggaugaaugucuuuguaauuauauucugacacuugaugaaaguuccuuuauucuacuuauuuuguugaaauuuuuuuaguuuuguauugggcuuuguuuucaaaucacuucagguuuguaaaguugcaaaauaguacaaagauguuucauacuuuuaccuagauauacuaguuguaaauacucacacuuaacugcauucacuuuauaauuucucuugcuguguauuauuuaucaucaucauuauuaaucaguuaaaauccuguagguuaauuuagcagcaaucucuacaagauacuuuauuaaucauuaaauauaucagcaaaauucacuuucuuuaacuguuaguaguaacacaggucagauuccuuacuucuaucagcuguuuuucuagacuaucacuugccauaggacaggguaccccuucccuagccucuaagagauugauggggcuuguugaaacacauacaaugcuguauuucuuaguaaguaaugauagauaaauaugugcacaauuuucuaugguuuaugaccuguuuauuacuucuggugggaaccuuauccaauccuuugguaaagaguuaaauauucauuaugguuaauauaaucagaugucaucgaauagcugugaaguugagaucuuggaucagguuuuggcauauagugucuuuugaagagcgauguaggaaguagguuuuucuuuuccuaucuaaaauaagaaaacagaaagcaggggcuacucuggccaacauaaggccuugaaacuuuaacaggacaagagguaacauggaaugaacaaucuugcuucaaaggaauacucugaagagucuguggggacuucauuuuaaguuuuuacugcaacuauauaaaacuaguuuauuuucuauagcuacacuuccugccuucuggaggaagcuguccuuuauuuugcugguagaguagcuuuaacuuuggugcuauauuuaucuaucugcauugugcauacaucuucuggaucaacucaauauuaaugcuccuucauucauuccuguuaccacaaauuggaaaaauauaaaacaaauacuauguucauaucuuguaauacauaaaauuagaaaaguuuacguugguagguaauuuauauaucaugauagaagcuuucauuuucuuccuacugauaucaccuuauauuuuaccauuucuuuaguugccuaaacgagguagucagacauuccaccauuugaacuucaugucuacaagcucuuauuuuaaaugaccuuuuacggcauuuuucuuucuuuauaauuacauuuuuaaauaauaaaauauaauaucaaacaaacacuaaacaugauagaacuggacaaaaaaaauuaaaaagaaaagaaaaaaauaaaaaaaaacaaagaaaagaguccaagggaaggaaugagacucagagccacucauccacacucaggaaucccauaaaaauacugaacugggagcuguaauauacacucagggaucuggugcaugcguccaucucugugaguucauagaggcuuuugaucauguugauuuagaaggcgugcuuguguguagguguggcuguguguauuguucuccaucuucucucgggcuccuugacucuuucugucuucucuucugugugguucucugagcucuaagggaauaaauuuuauggagacaucucauuuagugcugaguguuccaaagucuuucacucucuguuaugacauacuuuuuuucaaauugcuaggguuucuuaaugccgugauagauuuaucuaccagaugcuagacugauuuaaauuuuuuaauuaauccuuaauaugaacauucauguuuuuuuuuuccccuccuguuucaugguuuuugagguuucccuucagguauggucacucuuuaaauuuuaccuguaugcauagacaacuuauucuccauuguuuaauuuuuaaguaaauauaagauugaauuguuuuauauacauauuucaauguuauaaauuauuagauaaaauaucuguacaaugaugaugaguuguuaacaggcagcuagcaugguaaugauuaugguuaauauauuaauaacuuauggaaauuaaauuuccauaaauaucuacccauuaugugauugguacagguaagcagaaggaaccaaauggcuuucuuuccauagugguugaagaauauaauuucuuuuguaacuuuaaguagccuuucuuucuccucuaaaauuacuuaagcauaauacagugaagcuauaucaugaguaaguuaaaaauuaucagucugaauaaucucacuaugccccugagaaaugaaucauuuuacugucuguaaagucucagaugucuaaguuuugcuuaguaauaguuugcaggucgacucuucauuguguuugauaucacugaaucaucaaagauagucuacauauauaggguugaacauguuuagugcaugcuuucuuaguagauaacaaaauuuaagcugcuuccuuuauacauguagcccaaccagaaacuguucugccuauuuaucauaucagauaaguuguuggcugacaauaguguaucauuuaaauucugugugcagcucaggcugaucuugaacuugagauucuccaacucagcuacgugggggguuguaagcaggugccuccccacggguucacauacuaacuuuuuuaaguaacagaaaguugaacauagugguuuguucuuauaauucuagcguuuggaaggcugagguaggagcauugccaugaguuugaggccagcuuggacucuauaaaagaauuccagauuuucuugggcuauacaguuagacugccucagaauaacaaaaaagcacaguuuacauauuuggaagaaaacuuuuguguuacaauguauuuucauacaacugugcuauguaauugggcuuuuguuuuuuguuuuuccagacaagguuucucuguuuaacccugacucuaacuugcucuguagaccaggcuaaccucaaacuuagauauccaaacucaaagauccucuaccucuggaauucuguguaauucuuuagagaauuaauauuagcauuuaaguaucucucuuugagagauaaaggccuguggugccucacgccuuuaauucgagcacucaggaggcaggggcagguggauuucugaguugaggccagccuggucuacaaagugaguuccaggacugcuagagcuaaacagagaaacccugucucaaacuccaccaccaccaccaccaaaaaauaaauaaauaaauaaauaaauaaauaaauuuaaggauagucaucuuucauauucaguuaaaauguuucauuuagcacucuuacaaaaaaaaucuuuaaauauucugaaaaauaauguugagaagaauuuauuauuucugguuuguuuucuuuugauaguuaauuuuauuccuuaguaucagccauguaaaaaaugaacuuuaacaggaaaccaggguuuuggguuuuguuuuuuuuuuuaaacuucuauagaugcucauuguuuuacuucuuuugugcacuguaacaaauugcuguuaugugaauggucuaaaauaacagcaaugacaggaauuuuagcccaaaauaaucuagggucuuuacauggaaaaauauuccaauuuucuucaaauuugugacugauuucucuguguggcagauaguuuuauguuuguuuugaggagguucuuguuuuuuucuuuuuaagauuuauuuauuuuauguauaugagcacacuguagcugucuucaaacaccagaagagggcaucagaucccacuacugaugguugugagccaccaugugguugcugggaauugaacucaugaccucugggagaguaaucaguguaauguccaaauuuuuguuuuucuucaacauugaaacaacucauuguuggcagaauuuuuuucuggguugauaaaaugauuggaaauuuuauaggauccuuugaaauaaauuaccuggguuucaauacaucaaaguaauuuuauuucacugaagaauguuagcuuuaaggaagacuaugguggacuuuuuaaaaaauuuauacuuguaucuuauccgguagaacuagaaccaggggcuugagaggugacucugugguuaaaacacuugccauguaaaagugggcaccaaaguucagaucucuagagcccgucaaaauuaugauggcuuggcauucugccagcaauucuagccuucuggauuuaggcgacagaaagggagggggaaggaucccuagagugagcuccguagagcuagucaggccacaucagugagccuggguuuuaacgagaaagccugcuucaaagaaugccauggacgagcaguggaggaucaucccaggcauuaacuucagaccuccacaugcacauguucacaccuguaucacacauauguaaauaugugcuuacacguacgugaaaguucucagaagcaaaccugguuaaaacuauuuauaccuuauuuccccucauuuggcucucuugauuaacgugucucaccugaaugcauuguuuuuaauauguagaaagcucauuaaaagcguaacuuuagaaauggcaagccaaugaaaugcagccccugugucagaaggaucacaaguucaagcccagauugggcuacagcacaauacuccgucucacaaaaacaaaauuaacagcaaguccuuguuaagcuguuacuauuuagaacaugaugauguagcguguuaguuuccuugcugcacuaacacuuuacacuucuuucuucacaggcaaauccuccuccagugcuggucaacacagacagcuuagagacaccaacuuauguaaguucuacuucaccaccagauuuaacuacuucugacuuuguuguuguuguucaauuugauguagacccaaagaccacaacauuguuuucuauaauaaauuuuacuuaagaauuucuaccucaucaugaugguauaugccuguaauucuggccauggaaacaggggcagaaugaucagccugggcuauguggugaguuugaggcaagccugggcuacaugaaaccugaucucaaaaaauuuuuguuccuagcaguauauaauauauccauaauugguaguaaaugaaaucauacuaucuuguuuuguuuagguugcuauuguaauuguuuuaauuuugaauguaugaauaacuuucauuaaaugcuuuugcauacuuaauaauuuagaggauggguuuuauuuuuauuucauguguaugaguggcuggauacaggucuaugcacaccauguauguguaacgccugaagagggcauguaagaucccgccugaaacuggaguuacaggaguugccaccugccaugaggaugcugggaauugagcccagucuucaggaagaacacccagugaucuuagcugcuaagagcuguuucucuagaccaacucauaaugauuuuguguaguuauuuauauaauguuuguguuuauccuuguuauaauacacaucaauucucugguuuuguuuuuguuacuuuaguucuggaccuccauuucccagcccacccccagugccagaaauuaaacccaggcuaacacucuacagugagcauaccccacccuacuaaucgacuucuuuuaacugcuaaauaauauucucuuacauagacauacuacauuguguagcugcucuucuuuugggguuguugaaagaagaucacuuucuugcuuuuucuaggguguagcuucacuccuuguguugguguuugccaucuauuauccuuuguagggcuggauuucuggaaagauauuggauaaauuuguuuuugucauggauuaucuugguuucuccaacuaugguaauugagaguauugcuggguauaguagucuuggcuggcauuuguguucucugaggucuguaugacaucugcccaggaucuucuagcuuucauagucucuggugaaaagucagguguaauucugauaggccugccuuuauauguuacuugaucuuuuucccuuacugcuuuuuauauucuuuuuuguuuugugcauuugguguuuugauuauuaugugauaggaggaauuucuuuucugguccagucuauuuggaguccuguaggcuucuuucuuauauguauguuuaugggugucucuuucuuuagguuagggaaguuuucuucuauaauuuguugaagauauuuacuggcccuuuaaguugggaaucuuuacucucucuucuauaccuauuauccauagguuuggucuucucauuguguccuggauuuccuggauguuuuagguuaggagcuuuuugcaauuugcauuuucuuugacucuuguguuaauguuuucuaugguaucuucugcaccugagauucucucuucuaucucuuguauucuguugguggugcuugcaucuaugacuccugaucucuuuucuagguuuucuaucuccagaguugucucccuuugugacuucuuuauuguuucuauuuccauuuuuagauccugguugguuuuguucaauuccuucaccuguuuguuuguguuuuccuguaauucuuuaagugauuuuuguguuuccccuuuaagggcuucuaccuguuuaccuguguucucuuguauuucuuuaaggggguuauuuauuauuuucugaaguccccuuucaucuucaugagaugugauuuuaaaucagucuugcuuuucugguguguugcagugaccagagcuugcuauggugggagaacuggguucugauaauagugucuggauuugguaugugcaugugagauggaucccugggcagucccuguaauccagauaucugcagauauggaugucuguuauuucuugacuuauuucccugauuugaguuuucacuacuguauuuaguagaaguacuaaaaccacauauccuuauuuauucuuuuuggagguaagcuuucaguuuuucaauaugguauauuaaacucaauuuuaauuacagacugacacaaccucacuggcacugaacuucacuaucucuccaucguuuuauguccuugaaaaggaaaaauuaugcuggugagaugacuuguggguagagguucgugucuccaagccuaagggccugugugaguccccaguacugcacaguagacgucgagaaccagcucccuacaaguuguccucugaccuccaucacacacacacacauuaaauguaaaacuuuaaaaauaaaauaguaaaaauacuaauauaaagcaaaaggacccaaaaaauguagauuucuacaguuuucauuaaagagguaaaaggugaauuuguugaaaucacucucaucuuuucugucauaauuuucucuccaaacaaauccuaaaugcuaggaaaaaauucauucaguugagacuuaauaaauuucuuacaugauagucuucaguuuuuccauauguaguauaguugauaguuauaaguauuuaaaaugaacuuuugcuuuuugguuuuuacaaauauuuuauguuuuuguuuaaaucccagguauggggauauggggcugcuuugcagcagcuguaauuugccucaugcucuagccagagaggugauuugcuagcuagagaagguuuuugugauuuuugugacauuuggaauuuugggaacuuuucagagguuuauauauaaaugcuagggcccugagaggggagggucugguuggauugaguuuguuaguccucaugcucaaggaagaaacaaaaggaaagaaaugaaauucaaggaacuccucccuccagcucucccucccucauguccuccucucuccuagugagcggagggaguaagauuaggguaaaggacuggaaagagaagugcccacagagcagcagccaucagcuaccaacucagaaucaguaucuagggaaauuguuaagcaaacgcuuaagcguuaauuuuuauuuaguuacauuaauuuuucauuaggaagaacuuuugcuuuucuuuacauuuuaauuuuagauuuuuggcuuguaauauagguuuugagguuuaguuacucagauuaugcaauaugaaccaugaauuaugaauauuggcgcauaagaucuugaaugucaauauaauacuauauagaaagauacuauuaaauugaaccuaagcuguagcauauuaauaaauuaagcaucuuuguuagcguccuuuggccaagucuacacuuuuaacauaauaauaagcuuugucuuguuugauuuuauuagugcuuuucuaguuagaaaauuuaaguucgugucacugaagaauuaaguauaugugcuaaauguuuugugucucuuuagggccaguauguaccaguaucagaaaguauauaauuuuuaaauuuaucaggauguaaacaguaacuacuugaaaguauggauccauaaguuacaaugacaaaaguaugaaaugccuagcagucaaucaucuaaaaagaaaacagaguuuauagaagaagacuguaucugaguucagugccacccaaaaugcaccauucacuguaguuaguggaauuuaucuuuaggaugcaagggaaauacagcagauauuccuaccacaauagcacggaggcuugugaucaauagccauugaacauccuaaccguagaugaaucuuucauuucuaaauucagugcuucacaacauaugcaaccaguuaucuccauuucuucucucuucucucacucguuuuccucccccuuccuuucaucugugaaugauacuaugucagauauauagaugagucuggagaauaugaacagcuccaugaaaauucuauacaugguuaugggagaggaauuguaggcuuucucuuuucuucuuccuccucaugucucuuaaguagauacggauuucaaaauguccucaaaaaaacaugagcucguuucuggacagaccugcacuaaauuuacauauaaugaagagaacaaagggcuuaaguuauuugagggaugaggggaguggaggggggucuuuguuguuuuguuucccuguccuuguauaauaaaccacacuaaaagcuaguaucuuuuuuuuuaagacuuauguauuuauuuuauguauacaaguacacuguggcugucuucagacacaccagaagagggcaucugaucccauugcagaugguugugagccaccauguggaugcugggaauugaacucaggaccucuggaagaucagucagugcucuuaaccucugagccaucucucccacuccacugguaucacuuuuuuaaaacaguaauuuauuauuucucauaaaucucacaggcuaauaacagguuaauacuagaugacaagaguuuuggguggguuagugguaaauacuagaaagucuaaauuugccuuacaagcuugaauggcagguggugcuaucuacuugguuaagaaugaggcuaagcggggccuagcaaacacagaaguggaugcucacagucagcuauuggauggaucacagggcccccaauggaggagcuagagaaaguacccaaggaacuaaagggaucugcaacccuauagguggaacaacaauaugaacuaaccaauaccccagagcucuuaucucuagcugcauaugcaucaaaagauggccuaaucagccaucacuaaucucuuuccuaaucacuggaaagagaggcccacuggacuugcaaacuuuauaugccccaguacaggggaacgccagagccaaaaagggggaguggguggguaggggagugugugggggggggggcggguauuggggacuuuugguauagcauuggaaauguaaaugagcuaaauaccuaauaaaaaauggaaaaaaaaaaaagaaugaggcuaagacuaagggguaaguaccuugguuuuccuucauuugggucuggucaugagcacuuugaguccucaaauuuuaucugcuaugcuauaaggaaugcuaaguuguaaggcaaaaccaagaacugcaaguacauaagacucagaaccacccagcauuauugcuuaguuaaaggcauucacaggacuuaccugacucuuagaggaggggaaguagacuugucacuccuugguguuagacuuagggacacugcaagaguaaguggaaaggaagauaggggucaucuucagaaauaaaacucucaccauaucuuuugaccuauauugagcauauugccuagccccuauuacuagaaaugguaaugcaaggguuuagaccuagguuaagcugauugcaaggacacucaauaugggaaugcgucuaaagagacuagagaauacacugaccuuuuugauguaucucagauggcagcaggugguacagagccuuagcuguaaagccacagguuuuaguuuuaggcaaggggaauuucugagaguuuuggaagaaguguguuaacagccuggacuuuuaaaagauuagucugaauuaguuuaaaauguaaaacauuugagguaauggauaacacuaaucuagguuugauugguuagauggcauucauuugcaguguuccagaagacauuuacaaauggccugaaucaguaguaacaaugagaauaaagaagugauaguuuuucaaaaguuaaaauauuuaacuuaggaagagcugacagcugauuggcuauguggaucaagacaagaaagauggggcuguaagccauugguuagcagucaagagcuaucuucucuuacauaagaucuagguucaauucccaguacccagcuggcagaauacaaucacugagauccaaugucccccccccccccccgggcuccuuggacagucggaugcauguggugcauagccauauguacagcaagacagcuguacacacaagucauucaaaaucaacauucgaaauagcaaaagcuaaaugcacccuucuuauauuugaaagucaugguaguaauucuguagcacagucacauuuacacucucccauuccuuaucaguccuuucuaaagucacuaaaauagagcugugcuuuuuaaucaccaucaugguuaacagguuuucauuaauaaaucauuuagaauuaucuugacauuucagaauugucauucugaauuucuaagcuacuuuucuuuuuccucuguagguuaauggcacugaugcagauuaugaauaugaggaaaucacacuugaaaggguaaaaacuauuaucuuaaucuguuacuugagcuuuuaaauauuuguucaaucauagaauccaaagacgaaaugucuuucaaaaccagaaaaaugaaaaaaauuuuuuaaguucacagguaguaaaauuagccaugguguuuuuagaauguuuuuuuucuucaauaucuuuuaaauuuuuguagauuuacagaaaaagcauaaggguaauacagagaauucuaguuacaacuaauggaccaguguauaacugaagucuguauuucucauuccuuaguuguuaagguguuuuaauuuuuguuuuuuuucuguccaggguaccauccacaaaacuacauuccauauaguuauuucuuuaggauacucuaaacuacuauaguuugucaaauuugucucuuuaauuuuucugagaaaguaacaugcugucugggugguggcagccuuguauuccccaacacucaggaagugguggcaggagaccagaguucgcugcugaauucagggcagcuugagcuccauaagacuugucucagauucacaugcaugcauguguacacacauacacacacacacacacacacacacacacguauauacauugguauagaggaaagugaaagcaugugucugucugucugucugucugucuuauuuuagaaacacugccccugucuggcaaagcacuucagggaauuaaauguucuacaaaagcagaauaucuacauuuuaaaaacuaaaaucguagauaauuauauuuuguugaguuugaagccagaaugguugcccaggaaaauaaguaagacuaaaagggucuuucccacauguagccaucuucacagucuauguagcuucaggcacccauucagguuaggcaggucccucagugacacucgggacagcucagugucagucuaguuucauaugcugucaugggcacuguaugacgccucugaugguugacgccucugauuguggacucacuccuuuuaauccucucccagugccuuuuaaguuucuuauauuuaguuuucagacuguauauuuuucacugcuuagaaaacuugaauacuuaaauuucuuggcagcuuuccacaaucuuuuaguaguguugaaauccuacuuacuaauuuaauaugaaaaaaauuaauuauauugggauuuuugggacaaauagugggaaauuggauuuuuaaguuacuaaauaugaauaguuauauacccacuuauuugcauguuguaaagcuacaugcagaaaauaaguauuuucuaaauaugaauaguuauauacccacuuauuugaauuguugggaagcuacauacagaagauaaacauuucuaaguauauuuucuuagguuaaaguaauauuucucuuuauagacuuauaauagcaauaaaaccucuuuuugugugcaaauauuagaaguucagucuuccuguuuguaaaauaagcauaaaagaaagguggcaguugucaaaguucacuugccaucagaaaagcucaucgacacaaguugucagauugggcuuuaggacuaaaaaaaaugcuauuaaguaauucaguauauggcauaaugacaucuguuuccgaggcucaggaggccaaggccaggauuacaucaugguugaagugcucugggcuacaguuucucuaacauauuaauuaauuaacuaauuaauuaagcaaaagaucacaugcuuugucucuugagagagguuuacccuaucaacaugaaagagguacauuuuaaaagaaauuuguagugucaccucuucagguaguguaauuaacaaacaaauuacacauacuuggaaagaacuucaaacuaggcuucugaagaacuugggacauuuucuucagccucaccuacuaagcgauaauaaauacuucugaagacgucuuuccuuacgaagagcauguauauuugauauagaaucuuucuuuuaccugugcauuuccuuuuuaugauguaauuucuaucucaguauaauuucuagagccuaaugcuucgaucuuacuuucuggaauuuuccccucuauccuuagggaaauucgggucuugguuucagcauugcaggagguacagacaacccacacauuggagaugacucaaguauuuucaucaccaaaauuaucacaggcggagcggcugcccaggauggaagauugcgguacguccuaaacguaugcugugcuguugacaaagacaaggacuaauacaaagaagacguaggguaacaacuaaacggagguagauccucaggccacauuuaaaugaccaacucucagaucacuuugcucuuuguauuguuucugucuuuaaggaacucaguuuuaucuuagguauuauaguacugugaauaaugcauuuugauagcuuaaaugucuguaaccaauuuuauagaugucaugucuuugguguuuacaaauaaagucgcaaagcuaucuuauuuucuguuuugagaaacauaaacuuacauaggauuuauacgguguucuauuuuggaaacugucuuuuauaaucugugagcuauuaaaucaacaucuuauuugaagguucuuaguacuuuauguggcccuuuagauuuuugaacaaauuucucaaugguauggcagaucauauauuagugacauuugucauaaaaauuaggaacuggaccauccgugaguuuccuuccuagucuuguguuacugugcaacuguuugugcaaccuaugugacaauuaauacuguucuuguuucacugaagaacacacucaaaaguacucgucauuccuuuggguauaugguaucuuuacaaaauuuaauuagcuguagauagacacuugucaggcuaaguuuuaauaccuuaaauguguuuuguucuccuuucugauagcuugaaauaacccccauuuuuuuuucuaaugaaguuccaugcagucagagccaggaccagagcuaagcugaaaauauugagaauaggaacaaaaaaguuuuuuuaaacuuauaucaaauuauguuacuuauauaaaaggacuuugaauuaaaugaucugaucuuuaaguucacauaaguuucaagaaguaaguuuuuagcucuacaccucagguuugaaaaaauaauuuuuuucaucuuggccaagacaauuaauuucaguuugacacugucuucugagcuaacuagcuuaacugaccuuacguauucuugaacuucuuagucuuaaacagagcucuaucacuuauuuauagccuugagaguauuauauuaaaauucauuaugucucauuuucuccaugucuaaaguagguuaaaaaaaaauacuugguauaaguuguuuuaaggauuaaaauacuaaguaccuagcaugugguuaauguaaaauguuugcuaauuuuacuacauaucuuuaucuguacauaagaaauauacuaauauuuuuaaauaaucuauuuuucuuuucuuuugcuggcuuuugagaaauguauacauuggaauuuaaccuguagcuuauucauuuauacuuucuagaguaaauaauucuuuuaucaaaaagaaaaauuaaaaauugguaguuaauaucuucuuauuuuacauuuuuaucaggguaaaugacuguauacugagaguaaaugaagcagacguucgugauguaacccacagcaaagcaguggaggcauuaaaagaagcuggaucuauugugcgauuguaugugaaaaggcggaagccagcaucagaaaaaaucauggaaauaaagcucauuaaagguccuaaagguacauaagaugaaauaugcauuaaacauuuuuauacucuucagacugucauccuguuauccucuacagaaucugaguuggcucauagaacgugccuguuauuuccauugcucuuuuucucaaguacaguuuuacaguggcuguauuccuaccagggugguggcauuugcagcagcccuauaguaauucccaugugcucuuacacauuauacuguuauguguaagauaauguuauguguguauacauuaaagaguaugcucuaugugauguuguguguauguaguguuugugugcaugccguauacacaccaugcaugcacuugggcagguagcuuccucugucacuuuccguccuaccuuuucagacagucucucuugcuguagccuauccuugauacuuuuaaacaauagggagcagaaccucugcuugugaucacauuuauuuagucgggaaggagugguaugccauggugagcauauggaaaucaggacaguuugcaagaauuagcucucuuucucuguggaucccgaaggucaaccuagguugucaggcuugguggaaggcaccuuugccaguugauccuucuuaccagcccucuaauuuagaauauaucuguuuguguccauuuuaagugucauuuuguuaaggacucuuuuuuuuuuucugcuaaguugguuuguuguuguugacucuuacuaaauacuugucucuugaaaucauuuauaauguuuauaccaacuuuugacuaucugagaaguacucuaauagaguguagaucauauuuagaaaaagaauagaaaaguguaugucauggcacauaccucuguagugaggacugggaaagugguuucugaauuugaaaacacugaugggauaaguagaaauaguaauucuaguuaguacuuggcuuccuagaaggaggaggauucaaacaaagaaaauauggagaauuugguaaugaaaugggauuucagaacuguagaaauuguuauuuuauuuuaaacugucacuucaagacuauuggagaaaaguauccacauuuuaaagccugauguucuaccuuguacaaacaaaauuuugauuucgucucagucuuaugaaaaugcuaaaguauuaguaagacgcauaguuagguacgaaguagaaauaaggcaugaguuuauguuucuguucauucucaaauacuuuacagaaagaccuuaaggagaaaccgaaagaaaaaggaguauuuguaacuaguaacaugccugcauuuauauaaaaaucuaaguuuuuaaaaauaauuuagaucuauuucauguguaugaguguuuugcuugcuuaaaugucuguaccacaugaguaccaggcaagaagguggcguuagauccccuggaacuggaguuacagauggcuaugagcucucguguggguacugggaaucaacaccucugugggagccuccaguguucuucaccacugaccccucuccacucucuaaacuuaagauuuuaaaagcagaaaacuaaauaaauaauuuucucugugauggaaugaucacuucuaauuuucauucuuuucccucugggccuaaauucaccuuauugaugagaaucuaaacaaguguauuccaaccaggucuuggguucagcauugcuggagguguuggaaaucagcacauuccuggugauaacagcaucuauguaaccaaaauaauugaaggaggugcagcacacaaggauggcaagcuucagauuggagauaagcuucuagcagugaguacaagcaguguucugaaagucauucugaugucugcucuuccuucugaaaccaacccaggccugucagaugcaggaauccgugguguuacuaccuuuuccuuuagcagcccugugcucaucuugauucuuccucugucucucugcucaucccgcuuuccuaguuaaagaguugaaaucuugaaaugcacagacuuguuaaaucacagucugagguuacaguacaguguguggucaggugugacccuguuuuguuuuaacugagcuauuuauuacauaaggaaaaucagugaagucauuuacucauucccaaaacaagaauagcaagaacuguguguauuuuuuuucuucuuuucuuuucaacaauuguuuaaacagagucuggagagauggcucagugguugagagugcuuauugcuuuuacaggacccagauuggaguuugauuccaccuucucacccucgugagcaucaggcaugcucaugugcacacacauguacacaaaccauauaaaauaauaagaaaaauguuuagucacauauauaagucuaaauuucuuauuuggaaacuuucugaggcugcuggacuguguaguuucuucauacuuuuuucacuccauauggugauacuguaauggacccauauuccuagagcagaaacccauuaauaaacgauuuaacuuugugacuguaucaucauuuacccaguguccaucaacaaaugccuuacuuagucaucauacucccuacaaaaaugaaaccugaggaaaaguuaaggugcuggugaagauaagguccuaugaagccuagaaagggaagagaaagcuagacaugucuccuaggguuucuguugcugcauugacacaccaugaccaaaaagcaaguuggggaccaaaggguuaauucagcuuacauugacucuacauugcuguuuaucaccaaaggaacucaagcaggacaggaaccaggaggcaggaguugaugcagaggucauagagaggugcugcuuacuggcuuccuuaacauggcuugcucagccugcuuucuuauagaacccaggacuaccaacccaggcauaccaacccaggcauaucaccauccacaaugggcugggcccucccccauugaucacuaauuaagaaaaugccugccaggugguggcucacaccuuuaaucccagcacuugggaggcagagguagagagguaggaggauuucugaauucuaugccagccuggucuacagaguaaguuccaggacagccagggcuagaagggagggagggagggagggagggagggagggagggagggagggagggagggagggagggagggagggagggagggaaagaaagagagaaaaggggaaagagaaggggaaaaagaaaagaagaaaaugcccuacagcuggaucuuaggcauuuucucaauugaggcucucugcugacucuagcuuauaucaacuuuacauaaaacuagccaauacauuauuucagauauguuaacacuuucacaaauaugggcuccaucaucuaugcccaguccuaaacaaaauaggcuaagcaaacugguaaugguaggagacagaauaacagcaauaguagucugggcacugugcugaccuucaauaguggcagaaaggcucagagauguuuguaaagacauaaauaguguagaauaguaguaauuaugucauuuccacuugggaaauuuauuguuauaaauaguuaugguaugaagaauugcugugugcuccguuguacgaagguuucauugaccacuuaagcauugauuuuauuggcccauuagguauucuguuaguaacauuacuaagcaacagaguguuuuuuagacacuuacaaaacuguuuuuuuuuuuuucaacauuagcaauuuggcaguggggaacaggacugucuuugcucuugccucuuacaguauuguugccagucuuucccaaagcuacaagugauaguuugaucauaaauacccaucuaccagcauaaacagccuuccauuagauuucuuacuguguugugcauucuuuauucucucugucuguguauaggaauacagguacccauguaccaccacuguggggagggcugaggacagcuuccaagguuugucuuccaccgaggcagggucacucugaguuggcuggcaagcuugccacugagucuccugucucagaucaccacaucugagggguuuccugguucugaguccagggaucuaacucaaguugucaggguuguguaacuaguuuuuuacccacuuagccaucucuccagcccucaauuuuauuuuuuuuaauuuuauguguacaauguuuuauuguuuauccaaaaccaguauuguuagcaggaaaccaacaaccuaugcugauuuuucaaaagcaacaaaacuuuucauucugucucaaaaaauaaaaaaguuaauaaagucuuuguucuuacaacuauccugaaauuagacaauuugaggccucauuucaauugacuuuaaccuggugcuugacagaccuccaucacuccccacuuuucucucuaacuugauguucuucaucucacugucacuagcucucacuuuccugucuugucaugcucucuagcuucuagucuggaagggggauuuagaacucaagcuugugcguccuguuauguugguacauacucccaaauucauuguuuaaacugcaaaagaagauucuuugauaaaugucagauaacuuuugcucaagucuaaaacucugagaucauccuucuuuccuugucuaucuaaucagaguaauuugucagcucuuauguuacagaccuaauaguaaguaagaaaacauuuagugguguuugugccuauuucuacaaacuggaucaugcuccauaagaauagcuuacuuuuaguuuguauuuuaguacuguuucuccuuaaaagaauuaaauucuguaauacugcaucccugaaggucuuaguuuagucuuaauuagugagagaaaguugaggcuagggcaagaagcuagagucaaaagugucuauuucaugaacauuuguaaaaacaaucuccauguaucauagacaguaaagauguauaucuuuuuccacaucuugguuuucagugaaucacuuucucauauccuauaucauuuaggugauuguuuucuucuaaaaaccagaaagcauguaaaagugucuucaaauauuaucucuuguuauuuccuuguaggugaacaguguguguuuagaagaaguuacucaugaagaagcagugacugccuuaaagaauacaucugauuuuguuuauuugaaaguggcaaaaccaacaaguauguauauaaaugauggcuaugcaccaccugacaucacuaauuguaaguguguuagcgugucuuauuuucaugacuaugcucuuuauaauguuaccaguguaauaaaaaaaauucaacaucauaaaaauacuauacacauauaaacccagugaugaggagauggagacagacugucuuaaaagaaaagaaagaauuggcugaaaagauggcucagcaguuaggagaccauacugcgcuuacagaagccccaguuuuguacccagcaccccucaggugacucacagucaccuguagcuccagcugcagggauccacugcacuugucuaugguccucaggcaccuacacccauaugcacaaacacacauaaacacauaauucaaaauacagucuucuuugaaaacguaaauauauuaagacaaccacauucuuuaaucugauaauaaaaguaguuuucaccuugauucucaagcuuuucuguaaauaacaauuacucaguguauuuuuaaauaaugcaguuaguguuacauucuugaguacaaagauaaguaguuuauucucuguaggaaaacuuaaguaugccuuugguugguucauugacuaggcguugaaaaacacugacuuuaauauaauugaauuauuuccuuaaugauauuuagccuuucuaaucaacagaaaugguaugcuucuuuuuaacaaagagaacaugucaccucuugaaauucuugcaugaccuuggucuugugcauaaaguuaggacuuuguauauauuuauuugcauuuaaagaaucuggcucaucaauucagguauuagucucacuuugaguacugccucuuuaggacagcccaugugcacauuuaggacagcuuuucuacaaauugauaguugauguccuaauuuuaaucaaauauauauuacaaauacccagguuacuaccuaggaaaacauuaaacaaaaaauauuuuuaugaaauuaauucuuuuuugauaauggccuggcauuuuuuaaauggaagagcuaggaagcuggagaguuggcucaguguaagugcuuuuuaagcacuuauauuuauuuuucauaguuuuggcuuuccuaagcccuugccagaccucacauucaacuuacugccucuuuguuguauuauaaucauggaagucuccuuacagaucuggcuuuguucauuaaaauacuauauuaucuuucuugccacuuuuguucccauugcuguucuuaaucugcgcuagcucguguaaaccauggcuuucuggugucuugauuucuugcuuucucuccggcccucucccucggcuugaggaccuaagugcuucuagcacagaucuucucaguagcggucacugcagcgucugcaacagugugaaguccuucacagccuucagcccauucagucacugcuuuucuauccauucagccucuuuggacuucauacugacuucauuucuuugccuccuucucgcuugguuuuccuaauaggguuuucagcuuagguucugugguuuguugaugauucuucugcguauuuuuguacuucuuuuauccuuccuuccccacaguguucaaacaacugccuucuucaugccuguucuuuccaugcagaacauagcuggagauuugaaaauacaaugauaaggaaauucucuuaugggagauuaaggaguagguguaaaguaaacugaggugaggaaagacuugucagugagagagugaacaggacaaaguaccaggcagccugauucucccuuggucaggagugaagagauagcaugaaaucugcuuguucuagagagaaccuugucuaugugucuguauuuguuacuuuguuauauguagaucuuuuagaucuacuacuuguucuuaaauuucugugucuacccuuauaauuugcugcucuugcuuaccucaaaggugugugaggccuguguaguaucgguuuggugguuucuuuucuguucguuuuaaugcucuguaggaucccauuauaugcacguacaacagguuuucuauuuugcagcugggccauuuucauuugggauuuauauggaguauagcugcugggauacuuuugcaugugucucucuguccucuugugguuuuguuuucauccucaucuaucccauuacuaccaucauuuauuuguuuuugacaaaauugugcuauguagcccaggcugaccucagauucaugcugcuucugccuuggcuuucuugguucugauuacauauaugugccaccauguucaguuuauaguuuuuucuugaauuuguguaccccauuucucuuaagguugacauuuuuguguuacagagcucgugugucugugugugugugugugugugugugucugugugugugugugucuguguguguguuuguuuagcugauaaacaguuuacaaaaaauuugaugagaucauaugaguuuagggugguauggacaauagccaguuagcaaaggauucagaacacuuuguagccuggcuuuuugcaucuucaacucuuggaaucauuacuccuuaguuacagacguuaauggcuauguauugaguuauucauuaauuauuuucauacugaccuuuauuauuuuuccuggugauaagaaaaagcuagcugggcaaugguggcgcaaggcggauuucugaauucgaggccaguguggucuacagaaugaguucuagaacagccagagcuacacagagaagcccugucucaaaaaaccaaacaaaaaauagaaaaagagagagaagagagagagaaaagaaaagagcuaaagauuuauauuauauaaggagacgccagagaguauuuucuagguaauuaaugauguucaguacuuuuugugauuauuacuugacuaacaucuuuuaugccaugaaauuaaauuuuacauuuuuaaugugcaugugcacacauaugugcauguaaggaauacauaugagacuagaagugaauaucaggugucucucucacucuccacccugccuuuugaagguuucucgcugagucuggaacucauucaucuaagcuggcaggucagugaacuccagggagucauuggucucucuuacaagcauucguccagacacacagcuuuccuuguguauguggugggauccagguucagguccucagcuugucugcccggccaguacuuuauuaacugagccaucuccacaacccuacauuuuucaguuggcauuguuuuuuguuuguuuguuuguuuacugauuugaaggagguaguaugaauucaagaaauuacaaguuuuuucacugauuuuauguuuuauacuugucacgagauuuuauugaauuaaauuuuaaauuuuaauuaauugaacaaauauuuuugagccuucauuauuuuacuuaacagaagagacaacuuaguuauuucuagaguuuauaguguauuuaguauaaauaaggacuuggucaaaguaccuauugaaaauacaaaguauagguucaaaaagacagaaaaaaaauuuuuauucuauauuuuggucaaccuaaacaaccacuugugauggccuccaacuguaccuaguuaccuugugggaacgaccagauccaguagcugccaagccagugaggauaggcugagugcgcugugugaugagucugaaaccaacaucauuuuuccaggauagccagugacugcaaacaaauguucacuaauuccagaccacccaaggaagugugccugcucuaugagagcagggcuggucucuugagggucgcuggacaaagugagaugcuaaauuuuccagucauuuccugcaagaguaccaacuuuaaagguguguuuuaagcuugggccuguucugacuggagagacagaauagccucuggggccuacaucauaaaaccacauugcuucauucuuuauaaccacaacuuagcaucauccugaauauuccaguacuugucccaggaaaaugaagaaguggccucucugcuuucauuucaagcaccaaacccugcaugugugcucaucacuuagaccuguaaguucauagcuugcuuugggauggaauaccaaauucaugaaaucuggauggcccuucaaaacuuuacauucuuuguuaucuugaagaucucaauaaauagacugauuuuuuucacaucagcaucugaaguacagaguuugauuacuggaggcaagaaaucauuuugucuugggcccccaagcugcuccauuguguaaaguguuuuaugcugaauuucuucaauucuauauuuccuuccuaagacauuacaugcugaugacaacauauuacugccaccauacaugguuagaguuccugacucccccucuaccacaugcacauaguucucacagaccacagcauuucugugacaucucuuuuaucuuguauaucaaacucgagcccuuguaagccucaaaaagucuucuauuggcugucaugaaagggaggcagggaggcagccugagcacggcucuccucgacuaggccgacugcugcucacaccaucucugaagcaguuuguuuuucauguuacauuauuucagaacagacugaaaucauuuucuaugugacagucauggagggacuuagaagcuuuauggcuuuaccucugaccucuagaccugaugugcuuugauuucaucuuuuacauguaacauuuuuuucaaacauauaucccagugauccagcaccauuucuuaaacaaauuaugauucuuagcacugcacuauguugguaguuuuguuuguuuguuuguuuguuuguuuguuucugagacaaaagauuucuuuguguagccuugguuguccuggaacucacucuagaccaggguggcuucaaacguccagaaauauaccugucucugccucccgagugcugagugugugugugugcguguaugugauuuuauuauauacuaagagaauauauguaugguucuaauucuauuaucauauuuuccuauccauaaaguggcauauuuuuaugauacauguugauuucuguuuguauaagucuuucaacuuuguuauuuuuucaagauuauauugagucuucuuugcaguuccuugaugauuuuuagaauagaaauaaaugcuagagcuauggagauagcucagugggaaaguauuuguuaugagagcaugggguccuaaauccaaguguacugcaccauguaagagccaggcucagcagcgugugucuauaaccucagugcuggggaagccaaggcaggagggcuggccaauccaccaugauggccagcucagugagguguggugaaguggaggaagauagcagugucaaccuccuggccucuacgugaacacacaaacaugcccacauauacagacuuaaaccgugugcaugcaccacacaaacacacagaugaagccaggccugacuaucuugcuccuguaaucuuggcacuuaggagguuaagguaggaugauuucaaacucagcguagaguaagacugugacaaggaaaaaccaaaacugaagagaauagaaaaguauagugcuguuuugcaaaaacaaaagcugacuuucacccaguccaaacagauauuauacagauauuuuaaaaauucaucugagcaguauuuuguaguauaauagagauuuuauaguuguuuuaguuacauuuagccaauauacuugauaaaccugauauucaagucuauuauaaaugauacugcuuuuuaaauguuucuaguuuucacugguaaaaacaugacuggcuucuuuauuuugguuauaugaucuguauugcuaagaucauuaaaaguaccucagauuaucuuguaaaagucuguuuauucaaccaugugauuuguauauaaaauucagagguuuuuuucccuguucuuuaaacacucguuuccuuuguuuaucugaugacugauagaaccucuaggucacuguuaaaaagaaaugucaaggacuagacagauggcucagcaguuaagaguucugacuacuuuuucaggaaacccagguguaauucccaacacacacauccgcuugcaaccaucucuaacuccaguuccagaggaucugacaccuucuggccugcacggggaucaggcacacacauagugcccauacauauaugcaggcaaggcaccauacacauaaguaucaacuaccucagcaucaacucuagaaaaaccgcauuuugccaggacuuuuguauauucacauugucagguuaauaaagcuaauuuuuauuucugauuuauaguuuauuuuuuacauuuuuaauugcauaaauguuuuauuuacagagauuauuguucuuuuuuuauucugcuaacuugauaaacuacauugauacuguaucuuaucaauuaauucaucuguauauauuuggaauguuuagaagauuuuaguuugggauucaguuaaacuuaguaaugacaaauauggaacgcccauauuuucaaucauuuguuaccuuugcagaaaagugaauuagaugacguuugauuuaagagaugauuaucaaaguuuaggacagggauuuucuggaagaggcaguguaugagugagcagauguccaacuuaggaaacaguugauuaugagauagaaaaaaagucuuuugauaagaauguagaaggaaacaaguaauagugaacauggaaguccauuaauugggcaggcacaaaucaauauuucuaacuuaaaggcaaugaaaauagugauaacuaaaauggaguagacaggaauaaaaguaugcuuguugcaaaugaccaagcucaucuuugucugacacuggaacggcuguguguuucugucuucucacucucaguguagauucuuucuguugcacuuaggguccagccucgggcucuucucacuuucacuucguggucucuacuuccuuccuccuguccaaaccuugcaggucuuaggcaauuaguuuugauauuugauauuucauaauaaauuggguuccucuguucagucauuucucugugggauugguuaaguaagauuucagguauaagguaguaauguuuuauauaauccaacuucagguuaauagauagcaacauaaauuuuuagcccuugcugucagagagacuaacauggguuaaggucacaaaaagcauucacugcacaauggagcaguuuagaucucacagggaaaaguuacuuuuuuauaauuuugguauuuauuagaauuuuauguucacuuuuucuguuguauucuuaguuuggauuuuuguuccauaaaaacauaauacagaagaaaaaaaaaaccuuaaagaucaaaaaucaaugaacauauauaucauccaggaaagacuuuggacuuuaaagcugagaacuauuaguaguuagugcuuugauacaaaugugaaagauagcuuaggaacuaguuaaaaauuauuguugcuggggucugcacaccacuaacccuagauuauauugccaggagaaaucauacacgcuuccuuuuugugugugauagggaugcugauuccuuuuuaguagaauaugcguuuucuccuuauaccuuacaguucguuuucuguuguccuuuauucaaaucccuucauuucuuuauuuacagucgguggcacagcugcuauaguccuuugaacuaaugaccucuccacuuuuauauguacuucucacaggcuucuaccuauagaaaugcuuaguacuacaguguaacgaaaacuaaugguugauaauaaaaauguuagacauugcagcuaguuauugcuuucuauguauuuugccaaugauucagcuaauucaaggauggugucuuuguaaacaauagcuaaaaucuuucucuccugggucuuuguaagucuggucaggagugaguguugcaguauauaugccucugagcuaguuugucaaaagagccugugcgcacaggauacuauuguagaagguacuuuuuacuuuugaagguuuuuuucuuuuuaccagauuuccacucuugugggacuauuaaaaauaggcacagauuaguuugacaguuaauaacugauauaaggcuuuucuuaacuauuuuuagacuucuggucuccaaucacaauaaauugugaaaucugcauacucucuuuuuuucuuucucucuugcuuuaagucuacaaaugacuuguuagcaaaauuuacugggcuggagagaugauucaguaguuaagagcagcagcucaaagccugucccucuaguucuggaggaccugaccccuucuccugaccuccauggucaacaggcauacacauggugcacaaacauacaugcaggcuaaacagccauacacauaaaauuaauaauaauuaguaauauuuuuauuauuuuacaugauauuuuaguccucucugugacaaucuuugaccuuuccuggauuuaauuuugcaaaucagcuuauauaaaauuccuuuguguuuguauuuucucaaaagagagcaagugaaauaaauuagcuucauugaucuaaauguuaaaaccaguuuugaccuaaaaacugagcucaggccucaauccuagaugacauaauuugcuaaauuuuguuaugcaaagcagcaaaaauaaauuuacuuuagcuuucagauuuauauugugguacugagagaugauguucaccuuugauguuuucucaauuuauuuugaagcuucuucucaaucuguugacaaccaugucagcccguccuccugcuugggccagacgccaacgucaccagccagguacucacccauuucuaaagcugugcucggagaugacgagaucacuagguaaggagcuucauacucauccuugacauaaagccagcugggaagagacccaggcuuuuaagggcuaauacuaaauaauuucuacuccuuuauaaaaugcugcuuuuuacccucuuaaggcgagguauguugucaugucaaaauuagugugaauaguuugguaugcuaguguacaccuguaguuccaacacugacaagguugaugugggaagaucaucaguucauguucaaggcuagggacuuagcaaguucuggguuacagauaaaacccugucagaaaaauaaaaagggucggggggaagagauuagcuuaaauaaaccuaaauuaaaacauacacugauccauccauuaagcuaacucuguguauuuuuuucaauacaugucaaagaguauuuauagcaagcauuuaguuuguguuuaguuuagaaaucagcaaguguuuuuguuguuguuguuguuguuguuucuuuauauguauuguugauacccugacaccaaaacuuggcuuuuaucuaacaauaguaaucacgcuagaguuuauguguaagaaguuccauaggauucugauaagguagaaauauuuagcucuauuucacauuauugaugguagaaaugagacacuguauauuuguucuuugucauuucuacaaguauuuuauauuaacuguagcauuuaguguuacauguguccucaguaaugucugcuauauuuuuaucacuuucauuauuguuuucauuauuauggcuuugaaccuuuauuaaagacuagggcuggaaagaaggcucagugguuuagagcacugucugcucuucuggaagaacuggguuaaauucccagcagccacauuccggcuaacaaguucauuuaacuccaguuccagggaagccuucuccagcacucacacacacggugcgcagacauagcacauagcaaagcacccauacacauaaaaugaagauaaguaacucuuaaaaaauuaaaggucagaguuccauacuaaccagauagauguaugugcuuuauuacagcauaaagaauuuaagucuuggugcuaguacgauagcuuagcaggugauggaaacugacaccaagccugacaaccugaguuggauuccuggaaccaacaugguggauggacagaaccaguuccuacauguuguccccugacugccauuuguguauaaccaccccccaacacagaccauaauaaaugaguaaaauauaauuuuuaaaacuuaguuaaaaguaaacaaaccuuuuuuaaauguuugauauugcaggcuauauaguauucucaacauuuuucagcauuggucagcauuuuguuugcugagaacauaguauuccauaaaaaugcagcacaugaugggaaucuggcuaggaacacuucagggauuguugcacagacuguccugagcuccagccagauuucauuuaauggcuuguuuguuuguaugaaacucaaguuaucaauucaaauaccaguuuuuuuuuaaucaaggagucuaauacuauacaauccaaagauaauacuacauugauauuuauauacuaaggaagaaugguugugaaaaacugaaagucuuuuuguuucugucaguaaagcacugugauucuguaagaaagagcauuggguuucaaaugcacaucagccucaaaucuuccaugagguuuuccaagcaggacuugucaguaucguagcguggacacagaaugcauaugcgauacauucagaaaaaagacugcgggccuugucccaugaugcaacaugggcggcagcuaccagaaacacauuugauuuggaauuaauuuuuaguuguuguauauucaaaagucuuacuuuuaccaaagauuuccucacucccaagucauuguggccucaguguaggacugugugaccuguagauuaagaaacugggcuccgcgcuggagaggcugcucagugcuuuaaaggauuugcugcuuuugcagaggaucuaggcucaguuucagugcccauguggugguucacagccaccuuuaacuccagcucuagagaaucugaugcccucuucugacuucuguaagcuccaagcacacauguuguguacuuacauacauuugggcaagcacucauacauaugaaaugaaaauaagucuuuaaaaagaaaagaagcaaugaugucuccaaguacagaggaguuucucucacugaguuagcaguguuggaaacagacagguguucauuagcugggcuaguaaauaaugacuguucaguguuuguggucaguaagcguccuuccucagcucaucucuagucuugucauuugcuaauagugucuauuucuagaagaaggaaaaugauuuguguagcuuuaauaucuacauaauuugcaaauuaaaaaguaaguuuugcaauuguguuucauuccuguccccgugcaggcucucugcacaucucauaucuagaguauuuguuggaccuuuaacacagcagaccugccuauuucuaugcuaaugugaaaaccagauggcuguaacuaacuagaauuuaaaguggugugcauuauauaaucccauuugauaaguaugguucugugcccagauuauaaacuacaaaaaucuuugcccaaacauugucaguccuccauaguuugagccaaagccccuugagagguugucacagucucagcuccccuucagaaauaccacagcauauguuuaaugguucuaaaauucggagcugagcauaaacgguacauguccucaauccgagcacuugggagauagaggcagguggaucucugugaguuuggggccauacuggucuacagagugagugagaccuugucuuaaauacaaacaaaaaaacccauaacaauaaauaaaaauuuuuaaagauuaguuuuauucaaauacuuacauaccaucuuagacauaauaaguuuacggacggagcuagcgaauggcucaguuggaagauuuaaguuugacacacaccuccaagcuuccacuuuaaaaagccauguugguagcacauugcagucccagcacuggggaaucagaagcaggugaauuccuaaggcuguugagcacaccagcuuuaaccacugagcaaguuccaagccagucuuagaagaaaugaccugagacuuuccuuagagcugcacacaugacuauccacacacacacauuauaagucagaugugcagcuuaauaauuuguagugccauuaguuuucaauaugauaacauauguauauaucauaaaauuaaaacauuagucaugucacagugcauauuucagauacauuauauucaguaugugcugccauugcugcuugcuauuuccaaaaccucuuucaucauuauagaaucuacuccuggcuccugauaacuugagccuacucucagcuccguguauuugcuucaucuagaugagucauguaagcagaaccaugcaguaugucuuuugugacugauuucacagcacaguguuuucgagguucacucaugaguuagcauauauaaaaucuucaucuuucuaacugagugguagcccuguguguauaucugagugugucuguguguguacaugcaugcccauuaaugcacuuucaaaccacauuuuauuuaucacuugucuuagucagggucucuauuccugcacaaacaucaucacuauaaauaauucuuugguaaauacugacauucauguaauuuaauuccuguugugaaaacguuucuuaggaaauaagcuggguagaguuccaaaaccauauguaacuucucugugaguuagcuuugugcagaaccgucagacauacuuuacagucggagccuggcagugggggcguacacuuuaaucccaguacucaggaggcagaggcaggaggaucuuuguaaguucuaggacagcuagugcuacacagagaaacccuaucugggggugggguggggggagaaugcaaucacuacaugucaccugcaagaguucuagaaguaucucuugguuuaauuuacauuuuucuuaucaaacuugaaaacaaucauucuaugaaugcguuuugaagcaagauaggagcccugcauacugaauccucucucucccucacaugguacagcucaaaugugcccuuaaucuuacccugucucuccuuuagaaucuccaaauuacugccuuccuaaguuuuauuauguuuucauucauauagauguauguauacacauguguuucccuaaacauuuuaauuuccuauucuuugauaagaaaaguaauuucauaaacaccauaaaugaguuagcaaacuugauuuaacaugucauacaauuauuaaaauucauuauauuuaacucucagaauuauuauaaccaauugcuuccuuuugucuuagaaaaaaucguauuaaaacuuuaaaugcuugcuaaaauacucuauucuauuuaagaguaaugucugucaagugauauuccccauuuuaucagauuuaaaaggaucugcuucuggcacgucucucgucuucucagaagauagauaugagugauuuucacaucauucuuacaugccgagagcuguaaaaauuaccaacagagagcuacaagccagagaguuuugaugugaaguaauaagccggcaggguaguaguguaagccuuagccacaagcacgugggagguagaggcaagcagauagaucucugugaguuugaggacagacaagaugccuugucucaaaacacuuagaaaacacaaaauuguuugguuuggggcuggagagaugacggcuccgugguuaagaggacuggcugcucuuccaaaggaccugcauucaguuuccagcacccaacugcauuucacaaccgucgguaacuccaguucugggcuccaacauccuaacacauauauacauggaggccaaugcacaucaaaaauaaaacgaaaaccauaagucuuuguuguugcugcucuuguuuggaagugcacuuugucuccggugccugggugguaucagauccugauccuaaguaauucucugcuuuggccuuuccgggagcgagggcuacaggugcacgcagucacacccaggggucaaaggaggguucuuuuaucuaaaaguuuggagaugggcguuuuccaagauagcauggcaacccauaacuccuaggaggucucugauuucaccuucauaauugcaauauagcuaaaccaguaagaagauuuuauuaaggguuuguuuauuugaugaagaugggugauauaagaaaagaggguaggaauguguuuuuuuuuccuaugggaaaugacaaaacauuuucauuugucagauuccagaaaggggucaacccuguccuuagcaaaaugaaaugguuugugcucacuaguugaauggugucuuuacaacuaaaggaauggaugaccguacuucccgaaagcauguaugucuaagaaauagugccugugcaauuucucagacaacagugcacacaugucaaauuuucuugacagaaccuuuaaauaaauguacuacuuuuauauuaccuuucauacuguuuuuauuuuuuaauauucauagguguuuugaucaaauucacuccuuccauguucuucucagauccaucuguauuauuucuuacuuucgucgugguggugguggugauggugguggugguggugguggugguggugguuuugcuugcuugauuuuuuuuuuuuaccauuaauuuuuuguuuuuauauaaaauuagauuuuuuucuuuuauuucucuuucccuugucauuuugagaaggcuuuuauauaacguuuagguuuuaguuuuguuuuuuguuuuuuuguuuuuccauuagcguauguguauuguuuguuaauauaagaauaucaacuugguauagugauacaggcuuuuauuaucccaguacuuaggaaacucugaguuuagggccagauaguugaauugaagaucagccagugcuccauaguaggacuuccuccccucauaugagucaccaguaggaugcucuccuacugaaguucagguucuacauaaaauuucuaagauauuuaauuauuuuucuuuuuuguuguuuuuaauuuuguaauuauauuuauguucagaaaacuugguguacauuuaacccaaauuaguggcgacuucuuuagccuuucccuuuuccagcuuggcgaggcgagcuacagacuuaggacccaggacguugccuccccaguggcgacggaucucgucauaucugucauuauaauugguccuaauggcuuccaccagcuuagccagagcacccuugucuuccaaguuaaccugugugaaggcaauaguguugcauguuuuccuguggaccaggcaucccagccuggccuuucccuugaugaugcaguagggcacccccaucuuucgacacugagcaggcagaaaaauugccagcacaauggggucuaagucaugggcaaucaccaccagcugagccuucuuguucuccaccaagguggugacauauugacucuuaguugggauuccccuuugccagcagcuuucuucucagcacaugcaaguagccuucgcuucuucucuugcuuugucucuggccuguacuugugggcaagcuuaagcagcugaguagcugucugccuguccagggcuugggugaacugguuaguggcaggagguacuuugaaccguauaaaggauggcucuuugccacugcagccugauguagcggggccauuugacaaaguguguuacaucucuuuggggcuggauguccugccgaaugccggaaguucuugggccuuuucucaaacaaaggauugaccaccuuuuuggccuccuguuucuugacgacagcgggggcccaaaggggaccuucuucaccuuggccuuauuuccuuugagcuucuugcccagcuagaggagagagagcuuuaacuuuuuucuuaauuuuuagggaaccuagaaaaguuguucuucaucguggcucaacaggacuugguuuuaacauugugggaggugaagauggagaagggauuuuuaucuccuucauccuugcuggcggaccugcugaucuaaguggagagcucagaaaaggagaucgcaucauaucgguaggucugauaccuggagguuuuuauugucuauauuaugaccuguuaaugauuaaaaaugaauuuuuaaaacuucuuaaaaguauauuucugauaagcauuauagagcucagucuuguuauuuuggggguguuuuuuguuuuuguuuuuguuuugaaccaaacugacaugaucugcauguguucguugcuauacaaugguuacuacuauuuguggugcucaggcugaagcuaacaucuauaagguaaguccucuaccacugagcuauaucuccagcuggaauacaauucauauuucuuggagauuucagucucagagcaucuuugcuuuuuacccuagaacguuccucaauuuuuuuuuuacuucaguauugaguuuuuaaagauucauuuauuuuauauauaugaguacacuguagcuaucuucagacacaccagauugcauuacggaugguugugagccaccaugugguuguugggaauugaacucaggaccucuggaagagcaguuagugcucuuaaccacugagccauuucuccagccccaguacugaguuuuuaaacucuuuacauucaccuccaucugucauaauuuuauugaauauagaauuugucaacauuuuuuuuucacuucagcccuuucuaaaauuacugggugugacuaguggcgagcaugcgugcuaugcaucuuuccacuguguguccaggagaucaaguucagauugacaggcuugcuuggcuagugccccuaccugcuuugccauccugcaucuccuccaucagucauggaaggucugucagcaucucuguagaagacuccauaucuuuauucggcuucaugaaucuaacugucccacagaugaugcuauggucuuucuuguccucacauuugguuuucccuauguguaaguuucagccuggaaacuuguuuugacuuaggcucaaauuuucuauuucuuucuucagcuaauuuuacuauacuacuaagucuuucaaauaaaaucucucuagcaauuccauguggguuuuguuugguuuuuguuguuguuguuuguuuugggguuugguguuaguguuguuguuguuuuggugguuuuuaugccaaauucaucauccacauugucucuacgucuguuaguauuauucuaucuucaugguucuauuauuauaaucauuauuauuuuuaauaacaaggucucucagcugugguccaguguggccagccacucaugaguauccuuuggucucaguuuccuaaguauugagguuacuucuuuuugucuugacaaguuagauuuucuuccauuuuugcaugucuuauaaucuuagccuucaugagauauuuuuaauaaaauaauaaaugaguaggacagauaagaugguucacagguaaaggcacuugcuacugagccugaaguacuguguguuauuacacuguaacagaauaauugugugucggggauuaauccucggacuagggaaugauucaugguuuaggcuacaagagucaagcugugugaacacgaccuauagcugaguugcauuuuguuguagcuucaguuuacugguuugcuuguuuauggauuuugguucaugaacacaagauauacaaauuggggguccacuuaacuuguuuauguuuucccagucuacaacaaaccauaaaauauugaguaacaugauagcuagucuuccuacugccaucugguccuccuucccucaccauucugccagggacgggcauggccaugggugucuuccuuuggcagucuacauauuaguucacuugcaucucuuuaaauuccaguacuaauuuaaauuaguuuuuaugaacuuauucugaugguuuugauuguuaagguagaagagauaguucuugaaacuucuaugacuuagugcuauuagguagacacuauuguuaucuuuaaaaauauaguaaucaccauucuuacuugauauguccugccuuuugagucauuugcccuuaaacauagaaagguaauuuccauuuaacaguacugcauauauugauguuuuaacaucuaagguuauauauaauccuuaauaaacuauugcuugcuacauaucaaauaccuaaacuuucauccagcuaguuacuccagugcuauagaacaacuagacuaaaauuugauugcuauuucuuuuguaaaugaucauccauucuauacuagacuuuguccuuaaacuaugagaccuucaaaaggauuagaugcaggaauuauugauaaaucuuaagucugucagauguucaaucacacaguaagagagauaacucugaaaacuguauaaaaagauagacauuucugguauguuucuucuaucaugugccagccacauucauuuuucaguuugugcaguauuuugugacauuauuuauacucgaaaaguucucuauucauauauuuuuaaaugacauaaaaucucaauacuguauagcacuagugacccaagauagaggauuuacuuuuaaaucaucuaguaauaaaucauaaauuuaucucaaacucagaauaugucaguaagagccaauaauauaauggcaggccugugaggaaugagagggaauucuaauuuacauauaacuaaaacaggauaggcugcuaauccaccaucauacaaucagccuugaaagacuuuuaguuaaagaacaagcagacaauagcagguucaaguacuaaauaguauauuaauaaagacaaaaguaauaaacgugcaacagagaucagagacuacauuugcaucuuaggcacauuuccaaagaaacugggccuuuguaagaaagcaaaagcaaauuuuuaacagcauguucucuuacaauacuauaauucugcaacuaagaugugaaacagaaaggagguaacaaaagaugcucccauaagaagaaaauguuuaacaaaagacaguggaucaacugggcagacaguaaaagcaugaaccacagucagucuuacucugcaaguaaaaauguaauccuagguagauuuagacucaaauguuaaaaccuaaagccagcucuuucuaagggggaaaaaauauugaaaaaauaucugggcaaggcagcaauuucuugggcaaaguauagaggacacuaaucauuagaaagcuccauuugaaaauaaguaggcaagcuauguagagcuaaauauaucuucagugauaccucacaaaagacuuguacccaaaaauagauaaacgucuauacauccacaauaaagagcuucaguaacugugcuaguuuuaugucaacuugacccaagcuagagucgucugaaaggagggaaccucuacugagaaagugucucuauaagaucugacuggcgagaaggcauuuucuuaauugauuugauggggagugcccagccauuugggggacccaacccucggauggugguccuggauucuaugagaaagcaggcugagcaagccaggggaagcaagcuaauaagcagcuaccuucuguggccucuuuaucagcuccugucuccaggucccugcccuguuugauuuccucuccuaacucucuucaaggauagacuaugauauggaaguguaagccaaauaaacccuucccuucccaacuuccuauuggucaugguguuucauaacagcaacagucacccuaacuaggacacuaaugcucuuuuuuuuuuaacucacagaggacuuaaacagauauuuuucuaaaggggauacacaugaaaagauauuuaagaguugacuguacaaaacuacagaaccaguaaacaaaggaauuuggagauaucucaaaauacauaucccacugaguuggauggcuagaggauauuaauauauauuauuaaaggcaauacuuaaugggcaagagcaauggggaaacuguaacucauaaagugauguuauaagaacuuuggugaagccauuaaauaugcagguaacaaaucacauaaaauaaauuuugcccaagaaacaugaaaauauccacagaauauucauaauaauccaaaucuggaagugaucuuauucuguuaauaggaaaauaacugagugaauggugagauauuuuuauuauuuaauacuacauugcaagaaaaugaaacaaaauaacccaaauacaaaauaacauaugacucuuuuuaaaaauauuuuuauuagguauuuuccucauuuacauuuccaaugcuaucccaaaagucccccauuaccccccccccccacuccccuacccacccacucccacuuuuuggcccuggcauuccccuguacuggagcauauaaacuuugcaaguccaaugggccucucuuuccagugauggccgacuaggccaucuuuugauacauaugcagcuagagucaagagcuccaggguacugguuaguucauauuguuuuccaccuauaggguugcaaaccccuuuagcuccuuggguacuuucucuagcuccuccauugggagcccugugauccauccaauagcugacugugagcauccacuucuguguuugccaggccccagcauagucucacaagagagagcuauaucuggguccuuuaagcaaaaucuugcuacugugugcaauggugucagcguuuggaagcugauuaugggauggauccccggguauggcagucuccagaugguccauccuuucgucacagcuccaaacuuugucucuguaacuccuuccauggguguuuuguucccaauucuaagaaggggcaaaguguccacacuuuggucuucguucuucuugaguuucaugcguuuagcaaauuguaucuuauaucuuggguauuauuuccagcuucuggcuauuauaaauaaggcugcuaugaacauaguggagcauguuuccuucuuacugauugggacaucuucuggauauuugcccaggagagguauugcaggauccuccgguaguacuauguccaauuuucugaggaacugccagacugauuuccagagugguucuacaagcuugcaaucccaccaacaauggaggaguguuccucuuucuccacauccucgccagcaucugcugucaccugaauuuuugaucuuagccauucugacuggugugagguggaaucucaagguuguuuugauuugcauuucccugaugauuaaggauguugaacauuuuuucaggugcuucucugccauucgguauuccucaggugagaauucuuuguuuagcucugagccccauuuuuuaaugggguuauuugauuuucuggaguccagcuucuugaguucuuuauauauauuggauauuaguccccuaucugauuuaggauagguaaaagcaucauguugagcaaaacaaagcagauaucacagaaaugcacacuauccuugugugauaaucaugaguacuaauuucuaguaauagaauuugggaaaugauuguuauugauuuguacugacuauaaagugcccaguagaacucacaaggauggacaauggaaacaguauguauguucuuuaauuguagguucguggggugcauguuuauuagauccuuccauuuuaauuagucauagggcuuuuuuuuucuucgcauuuuacaagauauacuguaguucagucuuuuaaaaauaaguuguagcaugauaaggauaaauuggugguaaguguugucaggcaaauuaguuaggagaauaaaauuagcuuaggaccuucuucccuugauaccuucugucaaaguacauuuuuaauuugcuuagauuuuggugugaaaaccucagaacaaaaauagaugauuacaauauugccaacauguguuaggccagcaguacagccaaguucacucaggacuuucccaguauugccacugaaaguuccagagagugcaguacugcucacccugaggggugcuugacgacagcacugcuuggcaguauacaucaguaacauugagauguaaaugcuuacuaguuguauuagucaggguucucuagagucacagaacuuauggauaaucucuaaauaguaaaggaauuuauugaugacuuacagucggcagccgaauucccaacaauuguucagucgcagcugugaauggaaguccaaggaucuagcaguuacucagucucacgcagcaagcaggcaaaggagcaagagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccgaauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauaugccuucugaagaacucugccccagccuuccaagcuguuaccaccuaauuggcgcuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggucuuuucugugauucaccuacaggggccugccagaggcuccaaacagcaucucuaucagccacagacaccucaaguaccauugggucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauaggcccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaaguaguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuaugaacagguacugagaagaaggcauuugccagaucaauagcugcauaccaggugccaggagauguguuaauuugcucaaguaacgaaacuacgucugguacagcagcugcaauuggaguuaccaccugauuuaguuuucgauaaucaacugucauucuccaugauccaucuguuuucugcacuggccagauaggagaguuaaauggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaauuaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagaggaaccuggccaccccuucauucaagggguuccggaucugcaaacugucucaagucuggaaauugauucacuggccgagauugcuguuuaccacgaucuaauguagccuuucuuucauuuguuugagaauuuuucugcuuauacagaucaaacaaauaugcaguaggcuuccuauguauuucauuccuggaaacaccaugauugauuagccaguaccaaagguccaagugagucaugccauuauaaauuucaccucuccugugcugaccauuacuggguauguuauuauaaacauucuuuugucuacgcuguccauuauaauaacuaggaucaccuugucuccggcgauucaaugcugccaccuggcccuuguuaccucgggauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuauacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauauuugaaagugcugguggaucaacaagccaauuccaguauuuuaaaagauucauccuuguacuucuguuacucuagaaccacuccugguaccaacuucuguauuagucaggguucucuagagucacagaacuuauggauaaucucuaaauaguaaaggaauuuauugaugacuuacagucggcagccgaauucccaacaauuguucagucgcagcugugaauggaaguccaaggaucuagcaguuacucagucucacgcagcaagcaggcaaaggagcaagagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccgaauuguaguucauuccaaauauugucaaguugacaaccaggaauagccacuacacuagucuucugaggggaaauaccauuaaacaaaagagaaaaaucauuaaguacaagaggaaaaauauggggaacaaaaauacuucaaaacucaucaaauucuaagcccuccaggacaaauauuuaaguaccucauuagauaaaauucaaaagcacaaauaagaaaauauacuuuaaaacaaaaguuguuacuaaaaagaaaauguauuuguuuaugugcuuaaaauaauagcuguuagucacauacauaguuguucauaaauuugggaacauauaaauaaaucuguggcuaggaaggacacuaaguuccuaauaucaaagacuugggcuauaccuuuaugauaaagccugugcucauucagagucauggauuugacccugauaccaauauaaauguguauuuuaugguauguggauuauaugugugggguaagaaccuuauaguagaaaagccaaaaaccagacaauuucacugacaaacuuuuaaaaaauuuaagagacucuugcaaaucagaagaaauguaacauuucccaacucagucugugaggccagcacaagaaaggugcaucauuugugaauguagcuguuaagaccucaaaaagucauguguuauaccuaggaagacuuuauccaaggaaugcaugguugauucugcagagaaaaaaagaauuugaaaccauccuaauacaguaaaugacacagccacaugcucauucgguaacagaaaaaaggauuguaacaggaucauuccuuuccaugguuaaaaacauuaaaaaaaacaaaaaacaaaaaacuaagaauugaaaggauauuuccucacuuugguuaaaagaaaaaauaacucacuaaaaaaaagaaaaagaaaaaaagcaguggauuacacugaaugaugagcaacuuaaaagcuuaaauaaagaaaacaaagauguuuaaccuucuucccacuuguauucaucuuuguucugaaucacuuagccaagaaaaauagaauguccuccagaggacaaggagaaaaggaaacugcagguggccugaccucaucuguaaaggcuuugagaagcacuggagccagacagugcaccgagcagagccagucagcuccacaggguuccaggguagagggcugcuccacaccaugaaccacacaugcaggguuggagcauggcaugcugagcugacgggguagagacagaaggcucgcugacauguaugagacgagaccccagguuugauccuucuaucacugucaaaaacaguaaaauguuuuaaguguaaaguuaaggauggaaccgaaaagggcuuagugauuaagaccacuugcuguucuuccagagggccgaggucccagcacccaccuauuccagaggauacagugccccuguguggccucugauggcccaugccugccacgugaacauauuauguauguuuagggaaauagauaaacaaaguauaugcaugcaaugaugcauucaccaacuauaauaaggaaaaugcugaaauaagcuauaggcaugagccuuaaguaagaaacaccaagaagaaagauccagaaaguuauagaagcccacuuacuucaaauguacaggauaagaaaucuauaccgaaaaguagcuuaaaguggcuuagugggguuuuuugcagcuaggagagaccacugucuacauuugaauuuuguuuguuuguuuguuuguuuuuacuuauucacuuuacauccugcuuccugcccccucccagucacacccacacacacacacacacacaauucuuccccccacuuucuccucugagcaggugcuuccccaccccaccccacccuggcacaucaaguaucugcagggcuagguauauccuuucccacugaggccagacaaggcagcccaauuagaagaucaugucccacagacaggcaacugcuuuuggaauagccccuccuucaguuuuugauuugacguucuuucuggagugaaggaaauaauuugggauuagguaguugugauaguuuuaugaucucaucaguguuuaaaacaagcaacuaugcaguuuuaaaguauauguuuuaugguauuuaaaguaucucccaguauuuaaaauguuuguauuuuuuuaguauaucuaagacuauuuacauauauaugucuuucaguacauagauuuuuuuuuucucuuaaaacaaacaagaaaaaaaauugagcuagguuugguggcacacaacuuuaauucuagcacucugaaggcagagaagcaggaaggagcaucucugaauuccagcaaaaaggcuagccaagacugcauaguaagacugucccaaaaaccaaacaaaaaauccuugauaagacaucauaauuucauugaaguauuuacuaauauuuuggagaguuuaauucuacuauuguccagcagauauaauguauuuuugaguccacauagagcuccagucuucuccaaggaaaaaauuaaaaccuuuuuaaaaaaugguuuauugucuguauucaaagggcagagaacuagaccguagcuagaauguguuuucugccuaccgucauuacuguuuuugugugugcgcuugcuuguugcuuguggagggacauggcauguggucaaaggacaagucuucaggucggucuuccccuuccauguuguugguagcagggucucugcuguucuuuaagcccacugaccaugagcuagagauucucuguucuccauuucccauuuccauuuggcucauggggacccuaacaugagugccacugucccuagcuuucauaugagaucugagcauccaaacugaaguuacugaguuugcuagcaagcaguuguacccacugagccaggcugcauggugacucauaccuauaaucucagcacuaaggaaacugagucugaagaauggucaugaguuuugacucuaaccugagcuacauagagaguucgaggcaaccuguacuacagaguaagaccuguuccccccaccccaccccccaaaaaagucuuacuuuuucuccuacaaucuauaaaaguuuauccuucucuagacuuuuucccuaguuuacucuggcacuuggaauuugaaguguacauuguauuguaagaaauggugagugacguccccgcagcuggaguuacucugugauagcaauucucaguugcauuuagcuuuacauggcuaaaauguaauuuuuaaagguuuguuuuuauuuuuuaacuauggguaggcaugcaugugucugcauauggguaugugcagaguacaagugccuguggcagccagaagcaucagacccucccuagaacuagaauugugagccuacugacguggaguuugggucuucuagaagagcagcagguguucuuaacuguugagccauuucuccagcccuccuaucaauaauguuuacuggaaguccugagcacaguugugguuacuucauuguuauuauuucuuaguuuuuaacauuaaggcuuuauugcauucaauaauacaucugugaacaaugccuuaacauuugucuuagaggaaagggaguaaucucugaagguguaaugccuugcuucacaaacuuaaguguauuagugcauuccagggguaaaaauaaaauguaauaauucuucaggagucaaauugcacccgaugcaaguuccuuuauuaaaaauuauuucuggccaggcagugguggcgcacuccuuuaaucccagcacuugggaggcagaggcaggcggauuucugaguuccaagccagccuggucuacaaagugaguuccaggguuugagaaacccugucucaaaccgccccccaaaaaagauuauuucugauaguauuuacaucuauuguuguuuaaauuggaaauuugaacuaugcuuaagcaauugcuuucuuguuacagcaaaagaauggaagucuuagucaggaaggaaggaagaaaggaaggaaggaaggaagaaagaaagaaagaaaauuaaacugaguugaacuggaggguuaaaacugguacagauggcuugaguuacuagaaaaugaauuaugcagaauaauaacacuuguuauuaguuggguuguuauuagcuugguagccagccuucugaccuccaucugaggaaaugcuggacuuuaucucuuaacauugaacaacguguuuuuguuagugaaucggauuauuugaaauaaucauguauguuuuacuauaugauauauuuaaucaauaaagguacuguaaccuguaccuacucccauaaugggccacugugaugucuaaucaaagauuauauuuucuuaaguuaguauuugauuuuauuuacaggugaacaguguugaccucagagcugcaagucacgaacaagcagcagcugcacuaaagaacgcaggccaagccgucaccaucguugcgcaauaucgacccgaaggugagacgguuuugucgccuguuacuacuggacaguuuaguuauuugaaaaaauaaucuuaaauucuuccuuucgggaaugaauuuuauuuauuuuauuuuuuaccuuuuuuacucugcaguucauguagccaugguuauccuugaagucaguguguuccgaggauaaucuugaccugaacccccugccuccaccuccagaugcuggaguuagaguugauugccaccaugccuguuuucauacugugcugggcaucaauucacggcuuuuuauucacacuaggcaagcgcucugcagcugagcuucauuccugaagcuuaagaaugucuuguuuuagccgggcgugguggugcaugccuuuaaucccagcacuugggaggcagaggcaggcggauuucugaguucgaggccagccuggucuacagagugaguuccaggacagccagggcuacacagaguaacccugccucgaaaaaucaaaaaaaaaagaaaagaaaagaaugucucauuuucuaauuuuaucuucucuuauguguuguuucgauuugucaauuuaguauuuguccagucuaaacaaauucauuuaccaggucagaaauauuuuucauuagaauuagaacacuucaucugccaauuguugagauuguaccauuauuugaauuaauuuucaaguuucuuuuuaaucugacuuuuaacuaucuaacuaucucuuuuacuaacuuauugauucgaaagaguaauaaaaacuguaaguaaaaauaaugcugccaaagaaaaugauguuauucagaaucuuuuaaauuagauuauacuuauuaauaacagauagauacuuccuaguagccuuuauuguuauuuacaauagaagaauaaaguuuguggcauacugucuuucucgacaguaaagcaucacaacggaguuugacuagacuccuaggagaagaaagugaugauggaaaacuggagguagcccauagugagcaugcauaaggcugcauuaccaucagcauuacaggucagcaggaaagaaagccucagcgggauucaugcguuugaaaacccagaagaauacauuagaaacaugcucacuaauguucauaaacaacaugaggaaggaaaaugaggcggcugaaggagcaaaaugaagugguuuauaguuuaggcauuaaaugaaauacugaaaauaaauaauuaccagcuauuuugcuuacucuaguuuccuuguuccagcaaaguucaacucagaguaguaaguaaauuuaagagcaccuagccuggguguucauagcauucauaugaagguaauuaauaccgagcagagagcagcagcaaagcuuggcaacaggugcaggugacgugaaguucaaccuuggcuuccuuaacaguucacuuggcagaaacccugcgaaguguaagagcagaguuagagaugagugagugaaagcuagcacacccagacacuguguucagugcacacaguaggaagcuagaacaaaaagagagaaaagcgaaaauauuagaaguuuuggguuguuuggauuuuaguuuguuguugaguuuuguuucuugguuuuuugucuuucuuuuuuuggcuuuucaagacagggucucuguguaacagagcccuggcuguuguggacuugcuuuguagaccaggcugaccucgaacucucagagaaccgccaaguauggcaguguuuucaaaggaaaacaaauguaucuaugcaacauauacauaauuagcagguuguguugcuguauuuguguguugugugugugacaauaauauuaaaaggaagccaucaguuacagaaagaggaggacaugggagggcugagagggaggaaaaggaagagggguaaucauaauuuaauucuuuuaucuaaaaauccuucagaaaguaaauacauguuuggaauuucaauucaguacguucauaagaacuuccugcuagcuggaagcauugcuaugauggaacacagugcauacaguugaguuuuuauggccuuugaguuaccuaagccuggcacuggccacucagccuuuccuaucaucacugaguguccccaggaauuuccccuuuccucuuucuuuggugcuuaaucuuauuuugugauuucuuuuuuuguuuguuuuuugaguauuuugugauuucuaagcauguuaauaucaucuuucaaacugguuuuuuuuuuuuuuuuugagagggucagucuggcaaagcacuauucugaagaauacugagagauagugcuauuucuagucauaauuuuaaaaaaaccuuugaauaaaagagaauucuuuuuguuugguuauucaaguaguauuuaguauauguuucccauuccagauugguuucuuuauauggauuuaucuuauauguguuuaguauuuuccaaauuuuccugaauaccaaacuuguggauccuaaagugugaauggggcuaggguggcauuaaacauuaucucuccucuauaagcaugcacauucuauuuucauuguuucaaauaacuuuaauauguuauaugaaauaaaauaugcuuuaguccaacaguuucagaaaugcuggcaaacauuuucugugugacaccuagccuguucuuuccugguaacagcucugcuaagaguucgaaggauuucuaggacaagggugcccacgaccaaaaaaaagggaacaaauuucuccccagaggaaauauauccagaaugguuaauaguggagaugggaugacaggugugaacugauugaaacuaaaugaagaaacauugagaaauguguggaaaaugaucauaaagaagauuguacaaggaauucuuaguagugaugaccauaaauauaaaaaugacaaacacaucauacauuuaagaacuuagcaguaaucacuccagcgcccgaucguaaacguuuacuaguaccugagacuguugacuccuuauaaggaaagcgcucuccugccucacuguaaaaugggaugugcuucuuaugcagaaaauuuucaauuuucuaaaauguugaaugucuaaaauugcccaaggcuuaucauaaucagccccucaaguggaaaauaacaguggccuaccugaaauguagugaacauauuguuaaauauuguguagcucuuaaagccaugagaguuaucaaaccauccuaaaaaagugcuaacuuggaacuaguaagucacuuuccuucaagagcagugucugcuugaggggauuuugccaacuaauugugaaagauaggcuucugcuaaaaguaaaauuguuacaggguuuaguugcgucccagcgcugugaaggcagagacaugagucucaagcucaaacuguccucgacauagugaguaaauuaaaaaacaaacacacauauauauaaaaugcuaaaauauuuuuaaaacagaaguaaugcacuuugaaaaacccaccucuuguuuuugaggaugauugcuaaaauacuaaaagcacagaacgguuagagcugggguuauagugccugcuugguucuacugcuugcaagguuggugcaggacgauagcaggugugaggacacucuaggcugcauagugagucuguguuucagaaccagauaagccgcacaggaaacaccggagcccucagugacaucaagcacucguacaagaugcaaauuuaauccagagcccacaguugauguccucugaccaucacaugucauggcacguguaugcucacaguaguuaucaauacagucacuuaaaaaucagaagcauagagucaaugguacuacuagaaaaugaaaugguagauuuaaugccgcaugccccauaacuucucugcaccucuuacaaaauuauuaggacagcaaaacuaaaauuuauuaacagccugcaacaaaacuagauggaacucuucauaaaccccaaaauaaaaacuguuguaagcaagcuauaaagagcuaccaagcccugugauaucacccacaguacaggacaaagcaacgggagagacauaggguauaguguaauagcaggacaagguuuuguguagucuaccuacugcgugcaauggguuugcaggcaucgggccacaacagccaacuguaacucacucucuguuaauaggguaaauacauaaugaaauaggagaucucagcauauuagaucauaucuuugaacaauuggcagauacaaaaaaagaagcuccagucuagaagggugaaaccauuacaaagccuauccuaaauuccaaaauuuuagggaaagcuaagucagugucucucucuccucugucucgucucuuuucucucuuuucucccucucucucucucucucucucucucucucucucucucucucucucucccuccccccccacguuccagggcaauggguuacaggagacccuaucuuuuuuuuuuuuaaaaaguuucuagaaacuuaaauuuuagauaaaaaugaacagaucaagacuaaaucacauaggaaccugcuugaaaacugaaaauaagaaucagaauaauuucuucacaaacaaguacaugccagaaaacacaugcuuaaacaacugauguuacacuagaauuuacacaauagucuugggauaugcagagaacaggcagugacuucauagaaucagaauguccuaagaauaauaaaacacuguauugacuggggcugguauuuccuagggggaguaaggaaacugggaaacguuuuugaauugaagcuagagagcuuucucuuccacagccugaucacuuaagucccacagucauuaggaagaacagagcaaggcccacuucggggcuaguugggggcagggagugcuguaguaguucgcuggaccagcccacgagcagggcuuccugucgggcugucccaguuugagcgguaagcacacgcaggaaaguagugaucaugaugagagcagacagacacuugguuguguucagaaccauaaaggggauguacaugcuaagcuggcauuacccaugguuucuaugaguuuaaaugcagagaggaaaaaagcuaaauauauauucugugacauuggguuaaaacuagaaaauuuaguaugaacucaauuuucaguuucaguagauguaaauucaguuauagaucuaaacgucuuuaugugcauauauaaauaucugauaugccuuaccccugauacuacagucacaccccaguaguaaugagcauacauagccccuagaucuugcuuucugaucuaaaucuauucucuuuuaaaaacugaggcuuuuggaacagauggcugacuuccagauucaggcagagaaaauacauuauuuuaugauacuuugugccaaaaaauacaauacucaagcaaugauagaaacauaaccaaaaaaaaaaaaaaaaaaaaaaaguucaauauggaacaagacacacaaacugacaaugucuguuucaaauuacugauauacuaaguauaaccuacuaaauaaguuaggaguccuuaccaguguugguucaaugacuaauuaaaagcuuaaugggcuagugagaugacucaucaaguaaaggccugaccaagcgugaugaucugaguucagccccuaauucacacaguaaaacaagagagccaguguccugaaguuaucuuuugacaaguuggguccacacaggguccauggggucuguacacccuaccucaacauacaauaaauaacuaggcuuuguuuuuucagagucaagagcuguauacauauuuaauaacucacuugaaagagagagauaacccaucaggcaccccucaucaaguggucaaagacaauaacauuaucggacuuaguaacgagacagacgagaguuucggugguuacaugggggcaucguagccucagucuguguagacacaucagaaaaaaacaaaauuggaagauacuguacaucauccaaaaaagauacuguugugagucccagcuuuugaccaggcucacaguucagggggauagauuaaaauagccguugucaaaaaauuuuuaauguuuuuuagauuuuaugaauguuacuucugauugccauuuuugucauuucagcaauuuaaaaauuacaaaauaguuauuuacuccuauuggcugguuuggauuuuuuuccaucauuauucuauauaaguucuacauuugaaaguaagauuagcuaguuuuucuuaagaaaauuuuauccaucaagccgggcggugguggcgcacgccuuuaaucccagcacuugggaggcagaggcaggcggauuucugaguucgaggccagccuggucuacagagugaguuccaggacagccagggcuacacagagaaacucugucucaaaaaaacaagaaaauuuuauccaucaaagcaucugacuuuuuucauuaaaaacuggaauaauuccuauuuucuacuuuacauccaaaugaaaauauaauauaaaauugcuaguauuauuugauucauagaguugccuuaaaugugacuugaacaacaauauccucuaccagccaguucugguuucaguagcuagaagcuuacuacuguguuaaacuuccagccuacuuggucaauuuuaagacauuuuauauaguuuauguuuuaucauuaaaaacuuguuuuuaggaauauuuacuuucuuuuuuucuccaucagaguacagucguuuugaagcuaaaauccaugacuuacgggagcagaugaugaauagcagugucaguucagggucagggucucuucgaaccagccagaagcgcucccucuaugucagguaagugucggugggacugugacauaaucuaauuacugugacuaacuuggauuuacuauagaaaagcucagugcaaaccaauaaaaacauuuucaugagugauuuuucugacauuauacucuaaagauuuggaauauuuuaacuuuaauaacguaaauuaugugaccuuuugaauuaauagugguauaaaaaagaaaaaauaauuguagacuaucaaagauaauuuagguugauguuuuaguaaugacuauaugagcuugguuagauuguauuuccguguauauacuccuaugcauaaaacaacaaaauaaaguaauacuauaaaagacuaaaguguugagaaguguggaaagguuuuaccuucauuuucaguuuucagauuaagauaaaagaauagcuguuuaguauuucagucugauugccacaguucucucugguucucuccgccuguuugcugcgcgugcuugggaucacacuauuucccgcugguguucaggaucagacucacagccuugugcacacggggcaagugccccucaguccagcccuuucuuggacuuuuaagagaguuuauuuggacuuaagaauuaaguuuaaauauuguauauuaauuagcuaauuuccuuuuaacaaauuuugaagaacuuuacauuuuacugcuguaaauuaaauucauacaauaucuuuuaaaaauaacuuggcaauuuguacuuaauuuucauugauaaugacuuucaaacuaauuugcaaacaaguggaagaaguaauuagcuggcagaguaaucacuauauugauaccaacuuguauacuugcauaucuagcuaguuuaucuaugggugggagauuuuuuccuaaauaucuaaucaaaguagauaauaauguuuacauuuuauuuuuuagacuagcuauauaauuucucauuuacaaaucuaauauaguuuguuauauuuuaauuaaugaaauuugggggcgccaacguuuuuauuuuuauucuuuaucgugagauggagugucacuauguuaucaaagcucacccaggacuacuagacucaagcagccuccgugguagcugaaaguacagauguaacccaguguacccagggauuuuuuaaauuucccuuacacacuuuacuaaaccugauggaauccucagaacaacucuacagugugucaguuuuagccccaucuaauaggagggaaaagcagagggaagccaaauaaacugucagaguaaagcaaagggcagcauaccaggaagugcugaaucagcacugagaccacccucuaaagcccucugugucacuguccaguagaagccaugagugaaucacgugugucaguuucauuuccuagacaacacaguaagaaagcacuaagaagucacaucccagcaccgaggaggcuaaggcaagaagacugagguugggaccuguggcaauucauacacauacucauauucaacacagcaauucccagucucaaauaaaugauccagcaugcagucuauccuaaaacacugaaagcaauaaauaauagacuuagacuguuuccauuacagagugauuucugugguuuuguuguuguuguuacuaucuuauauauaauguaaaaucaagccuaaccuuuuuauacuauacuaaugacuucucuguacaaauuauauauacuuaggcaaucccaugaauuuuuagaauugguuaauaccacaguaacaggugguuaugaacuucuuucuugagucuagagcccucuuugauuaugacaagacuaaggacagcgggcuucccagucaaggacugaacuuccgcuuuggagacauccuccaugucaucaaugcuucugacgacgagugguggcaagccaggcaggucaccccagacggggagagugacgaagucggagugauuccuaguaaacgaagguacaugguguuucuuacuucuucaaaguagggcauuaauaaauaauuguuuacuugacauuucuuuuacugugcuguguacauacauuaugcuuagugaagguagccagauucagaaagucaagugcuguguuucacuucugugaaauauaaacuauucuagagguuacuggagguuauaauuacuggaaguuacaagagaguaguagguggaagaggaauggggagauguuggucaggagaugagguaguuucaguuauaagagaauaaauuccagaaugcuacugugaugagccauaguuacaagacugaaguguguacuggaaauuugcugagaaaguagagccuaaguuuuucaccaucaaagaauguuuuaaaagugauugcgugagagguuacugagguguauuagauucauuagcaugacuuauagcaauugcuuuacuguacacaucaauauguguaacaaaucaaacuauggguggguguguguguguguguguguguaggcucacauugcaugguacacguauggcaggcagggcaaucuuagcugucaguccuugucuucugcucugucugcagcaggaucucuuguuuauacugcuuauauugggcuagcuaguccuaugagcuuucaaagauccuccugucuccacaucaccauaggaucacuggagggauuacaaauauacaggaccuuuucuuguuuuauguugacucugaggaucugaguugugcaucaaacaguuuauucucugagccaucuccucagucuuguuuuuugagacauaguguugcuaugucucacaggcuuacuuugaauucucgauaccuuucuaucugaacccuccaaaugccagguaugcagguaugcauugcuguacuuaaauagacacauuuuuaaaaugcuuugagccccaugauuagugaauucaaacguuaagaaaggugaguaaaugaauuaauaucuuuucuugaauagugauucaaugcuuuguuuuccauggugugacucuuuacuauuuaauucugucacauuuaaauguaaccaguggagauucuggugagauagcauacauacucugugaguuccaagcaagucuaggcuacauacugacauacucugucucaaacaaacaaacagaaaaguaaccaaugauauaacuagaaaauacacugucaccaaauuaucuuuuagggggcuggagaggugguucagcaguuaagagcacugguuacucuucuagaggacuagguuugauuacccaacaugcaugaggccugaguucaaucccuagggcuggaaaaaaaauuuaauaggaagaggagaagaaaggaaaaucuuguaaugugcuuccugucuuuuuauuucauuaaccagacuuaugucgagguagcuagcaaacaugguauccuugcugguuacuucauucaccaucaaguucguugaugaguuggauuuauacuucuuuuaacugaaaaauaccccaaaucaucugucucucuuacguagcacaaacugaaauacuuuauuuuauuugcaguauuaauaauugagcccccagggcuuugugcaugcuauacaaccauucuaucacugaacugcaucuuaagcccaagagcaauauuaaaguauugccaggauuuguaauuacugguuggaggguuauaacuauuguuagcuagagcuauauacuuagcaagauccaucuguuguauaaucauaauaauguuugauggaaaauauuauuuuaggagugcagcuuuuggcauucuucuuuccuauauuagaauauaguaugcuuugauucagaaacuccucccugccuucuugauucaguagaaaccucacaucuuaaauaucaaaguuaaagcuccuaaaagcuguccuuugucccucauaccuuacaaaggcuuuaugugugcccucaaccagagagaaacaugcugacucggauggggaaaaaugaacacacgggauccaucuugaagugucuauccauucucugguucauaaauaguacuauagaauauuauguuucuaccguaaaauacaguaggaagacgcaacacauuugccauuuuauuuagacgugagauagagugguuuuuguuuaacacacuuagaugaagaagcuuucauucaaccgucuuuccuguggaaaacagagcauaaaaauacagccuuuugcucugcucugcucagggccuggguuuccccuuggccaaaugguguggguaggugaugggaggcucccucccauuauccuccugucacuugaugucaucaugcccuucaucauuuugugcccgcacacaaaaaagccuucaaaaucuucauauuuauacugcacucuuuugaccccugauagcgccaauuccauaugcaccuucuucuucuuccucaaaagcauggcacuaagagggaucaucaagugacaaucuaggcuaaugcccagccuuuucugcacacuaaagaaaggcauggcauccuccuacagugccauggacagcucuggacagcucauaaccgccagcuucagggggaugcaggcaccuuuauuguuuucuugaauauuuuuaaaauuuauguuuucuuaaauaaaacugucuuuuauccagaaaucaaauaccaugaagaguuauaauucucacacuucuugauuuuauuucaggaauagcaauuacaaauacuauaauuuacugaauaaaagaaggauuugaaugguaaauguuuauuuaaauaauucuagguuagugguacccucaguaaggccuggaacaaguuuacagaugacucagacucccgaggagugaagaacauggggcuuucaucuaggaguguuaagauucuccugcacccguaguaaaauauuagcuauauaguuuucauaggcuguucugcuaguuugccugcaauaugcuaucauacuuagaugcuguaauuuaaagguuuauaaaaaguuucauuaugugaaaccacauuugcaugauuuagauugaugucacuguaucuaaaguuuuggggggguuaauuugcauauuuggguaggagacccuuuuauuguuugaaaaacaauaaaauauagcccaaccuagcuagaacucacucugucauacagacugaccucaagcucacaauaauccuccugccucagcuucuugcauaaagagauuaugggaaugagccuccaugcucaauauauagacaaaagaaaauacaaauucaacguuuuuuaaaauccuuccggcaucuguuaaccuguucccaaaguuaccuuucccccucagagacauaaggaaugcaaguuaccuguuguucucccuuccaaaguacuuuccaacucgggcuuguagacuacuacuacaucuuuauacacauagauuauuggaauuaaacuuaaauuuuuuuccacauggucuuauauuucagagcuacagaacaguacaaaaauuuucaagauaauacaauauucauccaaauuguuuaguuuugcuacacuuacuuugucccucaagcuuuauuuucaucauauauguucuaugcuaagcuaguguuuaaaagaaaaaaaagaaagaaggaauccuggaaacugacuaaagucagaagugaugucugacuuuucaauguaauuaugggacugagugcauguaaguguguacuuguaugcugugguuuggugcuucuuaagagcuuucuucacaguaaaguagcucaucauuuaucugcaaguuugaggaauuuuagaauaaguggugucaaccaaggcucuuaauuauauuggacuuacuagggaguggugggguagcuuggucuauaaagugccacacaagugucacacccacauaaaaaugucagguucaggacaguacauaccaggaauuucaacagacaggacgaucucuggagugugcuuagccaaauugguaaacuguagacuuagugggaaaccugccucaaaaaaguaggaugagagcugaggagauggcucaguaguuaagagcguauauugcagaggacccaagcuugauucccaacaucuaagucauguaugcuuaugacuuuaguucccagaggauccaacucuucuauccuuccugaguaccucacacuuguccuuucuuacacacagguaugcaugcaugcauugcauacacacacacacacacauacauacauacauacauacauacauacauacaacuaaauguauuucuagugguagggagcaaguaaggaagacaucuaaccuugaccuuuaacuuccacauauacaugcauacauaaaaaucuuuaagagaaaaaaauauuauaaccaggaauaguaauguagaccuauaaauuccaacuacucagaaggcuaagauaagguuuugaaucaacaucuucacaucagucuuggacacaucguaaaacuccagcuuaaaaacagaagaaaaaaauucuagacaucaggacucggugcuagaaaauaaguuuaacauauauauggcuuaggauucagucuccaguaacaaagaccuucuguacuuugacagaguugagaagaaggaacgagcccgauuaaaaacggucaaauucaauucuaaaacaagaggagauaaaggggugaguauacaaaaucuuguacauuuacaucauuuuuauuuuggcucuauuguuaaaaugagaagacuuaccguaagaauuaacugugaacagcucuugccacagauuagaguaguaguaaucucucacuauaaggaaccuauucugcaggccuuuucagauuaugucauuugauagauucuuaguaacuuuuaaucaguauuauuuuuauaaaugaugcgaauuuagcuuccagugguuuaacgacuguguuaguugaguugaugaugcacacuuauaaucccauagagaaacagacaggagcaagcaucuuguaauugcauguauuuuggaacagcuaguugaaugguucuucuauacuguacuuccauuaaauauuacuaccugcugggcaugguggcacacggcagcuaggaggcagaggcagacagauuucugcgaacuuuaggccagccugcucugcauagugaaucucagauuaucaagggauacauaguaagaccccgagguuaucaaggguuacauaguaagaccccgucauuaaagagggcuggguguugggggggggucguguuuuuuuaacuuaagucauaguguaaguuuacaaguuguuacaggugaagccauguagagaggucuuugcucuguauccccuucaucccuuaaucaauuucuuacuagaauccaacuuuugauguaaagaucaucacaaagcuauaaucugggaauaaagaaagucaaaagaaguuguauacauaguggagaaauguauaaaauuucuuaaauauuuagauacuuauuuuuccauuuaguuuaaaacuguuuggaugugugaaaauauaaccugcugauagaugaguaagauagugcagguuucagcuauacuauauacacaauuccucauuaccuauaaccuccugcagugaaagagcuuuuacacaugcuacauugaaauacuuuucauaauguuuauaucuuuggguuuguuuguuuguuuuuuuaucugaagcaaauuuuauaagcuuuucauuauacuugaaauaaacagauguuuacagcaaguuacuucuguacacuaccaucacuggacaucacacaucaccaggcacucagugcucacagcuuuacuauguuaaagaaaugauaucuggauaaguucuauauaauucaauuuuucaaagugauaaauuucuauaaaauucagaaucauaauuacaucuuauaaccugaagcaauauuuaaguuaaaaguuuuuauuggaagaaaaaucccaaguaaauaucaggauacuaaauaacuuaguguuuucuguacuuauuuuauauguauuuaaaaagaagucaguacaguaagcuaucaaggaauuaaaaaagaggcugcauguuuuaacuuuccuuucauucugugagaaguuaacuuaauuaacgacauuuaaaucuuagucuuuguuuguugauguaaccagcuuuguacacagucacuguguucuaacacagcaccagaaguaugcaugguacugagugggguaaaaaauacgcuugccauugauacagaacugcgucucuuucuguaauguuuucccucccuccuuucccucccuuuccuuuccauacaugauggccugcacauguuuuuccauucugaccuuuaacauuucaguuccucauuaacaguuuuagcacucauuuggcuauuuuucaaaugcuacauuuggaaauuauauaucuauguuuuuaauauaccuaucaugaauuuguggcauuguaucauuccuuauguuuauugcaacaugacaaugauauuaaaaaauuaaagaauaauuucuauugaaaauacaaaaaagcugaagguuuuucuucauaucucuucaguuuuguauuuuccauacacuuuuuuaaauuauuugcuuaugcuacuuauauuugcacuuuuaauaaguucuucaccugggugacauuaaauuaguauaauuaauauauuucuuaacuaacacacaucuuucuauccuguauuacaguguccuugagauaucucuuuuuggcuaacuggaaagauaucaaaaaucaaaacauuuuaaacuacauguuucuuugguuguaugcuaggaaacugacucugaccacuauauaugcaguaaacaggguaaauaaccuuuuuuuaaaaauaaaaaucaauuuuauuaaaaacuacaagcuuaagccagugauucucaugcaaaaaaaagagagagagaaauuaccuuuuuuuccuucuaaaacuuaaauuuucuuucuaaaauuuagccucaagcaaguacuuuuaaucacaugaugcuacuugacagcuuauaaaauaccugcccaaccagacuuucugcaugcagcccuaguccucacagcagcaguuuuagcuucugcuuaagaguucucuuuucuccaguuccuucugaccuucauguuguaagaucauuuguccaguuuaugaaauuacuccucuaacuucacguauaaugauucccuaaguguucucaccacaugaauauaaacaaggacacacaauacagacugauguucccaggcguccagugauacacagcaaugcccgcucagcugaguagcaugcacuccaagacuauagugagcgccugaagccauggaugggaccaaaccucuaugugcugcaucucucuuacaggugcaugucugugacaaauguaauuuacaaaguagcacaggaaauuaauacucaauaauuauagcaauagacuagaauagccauuauugcuacucuugugcuuuagugcauuaaauaaaaugauguuuacuuuaacauaagcacauugauacuaagacacucagucugauaacagagacagcugcccaguuacuccugagucaauagggcauacaaaguggaugcacugggcaaaaagauaauucacauccagcguagcauaagauuucaccaugauauucauaucaaguuuaaaaaaaauaugcagcuuaagacuugggaguuguucauuucugaaguaguccacucuaauuccaaaccagacugaccagcagagccugaaacccugggaaguaaaugggggcugguaaagggguggaguagcauccucgggaacagcucagcuggaaaaaugaaaacagaauuucugucuuuggggcuaguaguguggcuuauuggugaaucacuugccaucccuagcauugccucccaaaaacucuucauaugucccuacuucagaugauugguuuuaaugucacagcuggguaaggucacuuccaccaagaaaguccagaacagaagaauugcucguggcucuuccucugcaguaaaugucgucacccuuugugccucacaagcuccagucagggacugcacaaaugucuucccgucuguaugucacagaguucagcacuuaccuuuuucucugaagaaaaaaaaaagcaauuuuuuaauuaggaacauccucaugauuauuuggguucgcuuuguuaauauugacugucguguuaauucauuauagccacaaauaaaaugcauaaaagaaaaauauauaauuaggacaaaguaaaauuaagauugcuacuuaauacaugaagauaauugagcagcaauuaacacuaaaaauaaugugauauugcguaucuaguacuguaccuuggaaauuuccuagaaaaauacauagucauaaaaauacauuagcuugguuucuacuauaauaauaaucugauuaaaucuuuuuaacauuuuugucaaguagcauuuauucuuuaagauaaagcugaaugugcucuaaaauuuuaauauuuaccauuuacaaaauaauagaacuauaaaaccuuacacaaaauuagaaauccauuuuucaugugaacaguauaaaauucaugcagacugcaugcaaacuguggucccaggagucagcuuccauagcugcuaggcugggccuuugugcacacagaaguagacaccccuuuguuuugccccuccuucucuucuucagcagucauucaaugacaagcguaaaaagaaccucuuuucccgaaaauuucccuucuacaagaacaaggaccagagugaacaggaaacgagugaugcugaccguaaguauguggcuccauuggucaacugagacuagaccguagcgggaccuacugcccugcaguuggcuguuaccauggagacaguuucaagagcugccacagguuacugaguuucuucgccgggaaaauuuaguacacacaaauugauuucgggaaaauuuaguacacacaaauugauuuguuugccagucuuaacuuuucuggcaccuaggaauucuugaaccgcaucuuaccuguuuaugacauauaaaaauaaauauaauucugugaaguaaggguucauauaagaagcacuuaacauuuacacauucaaagauuauuucugaggaaaaaaaagaagguaccugauuuaaagauauagcauugccaguuucugauacuagaucaucuggaaucauuccauuuuaucuuguuuccucauuaaauauaggaaauacacauuucacuuguaaaaugaccugaaaauuugccuuucuuuucuaauuaaccucuaaccucuaguuuucauccuuuguguugauaacauuuaguugguagcuuauucuaaacuuugaaaaaucuacaggcgugcuuuguacacuguguguaccuguaauggucuuggaacugucucuuauuguagcaccaauucuaugcaucacugacaacuauuuucuuugauuaucuuuuuauugcuugcucucuggggacuacucucuacaggagaucccugacgacaugggaucaaaaggccugaguaagugaucaaaauacucccaaguuguuuuaaccuccuaccguaugcagggacacugagguucacaguggggccuuucuggccugaggaggugugugcuuuagaugguuuuuaacaaacuugggauuucuaccuccgugauacaauuuuguuuucuuguguucccuuuucacaugccgcuugagaaacucgguuacauuuugaauuucauaauuuuucugguaauuacuuuuucuagaaaauuuuuaaguauaggcuuuuuuuuuaauuuuuuaaauacuaucacuugcccaucauacuagaauuauagauagacaugcauguuaagcuuuggaguuuugugucucucuuuuaaauacaaguuaaaucacuacaguuauguguuagaaaccccuugcuuaaaugugagaguauaagguguccaggcagcucuaggggaacugggagcuccucuucagacugugagcagcguuagagagcacacugggauucagugauccucccuuagccaagagcuuaguuauuuggauuuguuguuccuguuuuugcuguucauaacuuucaacuaacugacuagucaucguauaaagauuaguagauucugauauguagacggaaucuaauaaauaauugaguaagggccaagcauggugacaggugccuggaaccugucacugacaucaggagugggaggccagccuguucugcagagugagauacuguuuuaaauuggaguauuuucaaauugcuuaaauaugaaaagucaucaaauauuacuaaguugauuuaggugaguucuacucguagaaauaaacauucaggcuaaauuuuuuuguugaauugucucuuucauuuaaauuacuaagcauuuugaaaacuuucuuguagugacuaguuaaccuuccaagaaguuuaucauuaaauaauaaauauuacaauuuuuagguagauacuuuuacuuugaucuuaacaaguagguuugcaucaaguugaagagagugcacuugauauaaagaaccuccccugggcaggcuugacucugggcaagcuccucucuuuuuguguuuguuugugucuuguuaguuggauggguaggguccugagaggacuugaagcggagggaguacaugaucaaaauauauuguauacaaaguuuuuuaauuaaagaauacaauugguaguacccacagauuuccuaucacuagcagcagcuuuuuaauguuuuaacuuuggaaaaauuaucagggaaaaccuucacuaacuagaaaauauccugcacagagucccagugcucugcgauucaucgugagguugauagguuuuagagguuacgugaaucagcuuggaauuuuuuauucuuauugaugcuacuauauauaauuauagaucccauauuuuauaguuauauaugauuauaccuugcccugugucucuaauuggaaauagaaacauucuuaaggaaaauuugugaaaaauaaagauuaucaggcagugucauuuggggaaagauuuaauuuucuacacaguguauuauaauucacugaauuaugacuacccguuuccuuucacaggaauugaaagaauuuauuaacuuggcaaccuaaaggucaaaguuuuauucagaaaauauugaagaagcagaaaaauaccaguagaauuuuaaaacuggguaugaaggagguuaucacauaaaacaaacacauaagacauuaccggcugcuuguuauuauggaggaaauacuagaagaaggguacaucagggcauuacuuauuacuucauuaguguauauaugcugauucaaaauaagacucaaggugauaauaagagggaguugggaugcugagaagugaaguaauaacacagcuuaaaaacacauuuguuuuccguuuuuacaauuuccaauuuuacaaaaaccucaaaaacuuccucagauagccacauagguuucucguaucuguuuacuuucgucuuguuuuaaacacuuacauaaguagaauugugcaaagcucucaaguaccaaagccacacuugcuuuuacuuauguuguuacaaguaagauaucaaauaguugcuugagguuggcaguguagcauuuggagggaauaaagagaauaaacgugcauacccuaccaggaaggaaauauuugagaaaaaaagcuaaaaugugauuacauuugaaauaauuguguucaccaagcauauuaaaaauagaagagguuguggggaagagagaaaauuuagggauguacugagucgucuuuaauucccuucucagucucugaacaacacuguguagccauuauuugcacuauauuggguuuuauagacucaaaaaaauaagaucaaaguauacaggcgccaacugugcuccucugugccuacugcagucccaguaucugggacauuaggcucugugagaaggaguuuaaggacagacucagcugccuguuacaggacaguuagacuacaugaggcucugucuaggaaggaaaggaggagagcaggaaaugcaugcaaauccuacacguuucaugaagggacauucacaucuuacacuuaucaccuccgaguccuggaaccaaccugucuuggauagcuaggaucucuguucaggcaguuaguuuccagaauguuuuuacgacccacgugccuaaccgcagaagaugguucuggcugcuucguauccuugccuucucuuggcaugccuaguuuuguuguguuggaaguaaauguaaacaccuuuuaaucuauguauuagcuuuguaacuuuuuuugauaaauuauguucaaguuuuuguuuuguuuuuauucucucagagcuagggcuuggacuuaacaugcaugugcuucuucaugcguguuaagcaagugcaguaccacugagcagcuauagccccagccccaacacauuaguguuagaggaggggcacuuuaccuuuguuguuaguucaagcaguacugguaagugacuauccuagucuaaggcccacccucugaguagcaagguuucaguagagaggaaccacauacagaaaauauaaagaaccacagaaguuuauuacaguguacauuuuggcaguuuuaaagagcucaaggcgaguagguaaaauacaaaagaaagaauaguaacauuuuauucuauaguaugucagauguauuggcuagaauaguaaugcaguauucauuugccugcuucauaaucaccagcucagcauuaagaaauuuugucucuuucauacccacuuauucucauccugcagauaacucuuuuuuuuuuuuuuuuuuuuugguuuguuuuggguuuuuuugguuuuucgaaacaggguuucucugugcaguccuggcuguccuggaacucacuuuguagaccaggcuggccuugaacucagaaauccuccugccucugccucccgagugcugggauuaaagacgugaaccaccaugcccagcuaacuaauuuuuuaaugccaauccuaauacagacuucaaaaguuuuuguuuuuguggcauuccuauuucuuauaacgaauuuuaaagaaauaggauagguaaaaagugguauaaaugaagacauuuagaauuauuaauguuguagaaacaguuuaaaucaaaaugaaaugucuuaacagguaaauucgaauuuauaaauuaaaguuaaauugaauaucauucgggaauuucaaauguuguauugaaauccauguacuaacaugagaaaaaaaaaugggauggggcuggggcuaaagagauggcucagugguuaaagcaguugccccuacaacuauaaggagcaagguucuauccccaggacccauguaaauguuggguggguaugcuagccugccuguaauuccuaccucuaaagacaaaaaacaagguccccaggcaagcaagagacacagcaguguccgugugcucuagauugauggagaugcuggccucccugaagagcuagaggagcugcuggggaugguugccagcguccaggggggccuccagauacacagccacacauacaugggaagcacucauauacacacauaagauggaaaagaaaaagguuaauguaaacuuuaaaauaccuguuuuuacaugugcuagucauguaguagacaauucuauuucuacuuuuuagguguaauuauucuauugaaguuucuuaaguuguaagaaaaaucauuacagggcuggugagauggcucagcggguaagagcaccugacugcucuuccaaagguccggaguucaaaucccagcaaccacaugguggcucacaaccaucuguaacaagaucugacgcccucuucuggaaugucugaagacagcuacaguguacuuacauauaauaaauaaauaaaucuuuaaaaaaaaaaaaaaaagaaaaagaaaaaucauuacaaauuccuguuuuauccccugacaguuucaucaucaucauuauuauuauuauuauuauuuuauucauuauuuucuguuaauuuuuuguuuuucuuucuuuuuuuaaaagauuuguuuauuuuauauauaugaguacaccauugcuuucuucaaacacaccagaagaggauaucagauuccauuacaggugguuaugagccaccaugugguugcuaggaauugaacucaggaccucuggaagagcagucagugcucuuaaccgcugagccaucucuccagcccccugguaguuucauacauagauacauuuuaguuauuuucaccccaucauccucucugauccuacugagcccuuuuuccuuccuacaaaucucuccuucauagucucuuguuuccuuuuuacagcacacugacuugauuaggguuucuugagcauggguggggaggagucauuugguggcaacuuagaauguccuugaagaaaauggcuuuccuuccccuaauucuauuuuugaauuuuuaagugcuuuauuuaaaauauaaacugugauuaagaaacgucugcaaguuaagccugggaagcaaagugcuuuucucacaugcguggggaccugauguuuaagaggaaauaaggacaaacaaaccaccucacaaaauggcaugugccuguaacccuaguccuuaggaguaaugaauaggggaauuugucagacuuggcuggacuuaaccagucagcuccagguuuagugaaaaauaagaugggagcuagcagaaaagaugcugugcacaugugcacacacacacacauauacacacaguuuuuuuagagaauuacaucuuuuuuuucugcagguuaaaaucaacagguuuauuucucgcucucaugagguccagcagggcugucgauuuccaaaacaggcgccgcugaccuuagccucaaacacugucccccugaaauguugcucuucucucucccuaacagaaaacagggcuucccucuguccuuaaaguuuuccuuuucuuuuuaccugaauaaaauuuucgcuuuuuuucuucaaggaagauauuuauugagagaugagugaaugccuguuacuuacgaaugaucaaguuauaaaauggggccacuuuugaccagacaagaguuaggcggcuuuuuacuaauauuuguugggggcguuguuuuguuuugcaaaguaaucuuuuuucaaaggggaguugcuaaggaccacugaugaauuagaacguagucucacucagcgucuccaguccccuuggguugucaugacagcuuuggauggcuucugaaacauagguuuaagaggaagacagccugguaaaaccugaccuauuuguaaaucacaaaagcaccuuucccucaggcucugcucaaauggagcuuguccccuuagcuaccaaaucuauuuucucuuuugggauuuuauguguauguuuggacuaauacaagauuacauuguaucuaugccaugcucuaccuguuuuuugacugagaauuuuguucauaaacuacauuggaaacaagccauuuuccuuuacuacagguauuuucuugugacaguuuauguuaauuuaguugaaaauuaaacuuucuuuauacaaaaucuaaaaugcuuuguaaaaaauucugugaguauauuugguuuauaucucaacauuuauaauaccaccuuguuuaauuuugauaguuugcuuuuaucagcuuuuaaguucaugacacugguuuuuuuuuuauuuucauuuuccuucaauuucagagcacguaacuucuaaugccagcgauagugaaaguaguuaccguaaguguugcauguuacuuguucuuuuguuaaaaaguuaaaaaguauaaauauuccugggugauaugcucuaaaaacuaacagauuccuaagauuguuaaccaggaggagccaaguacaauagacuugagaaggguaaccaccugaagguugaguaucucuaacccaaagcccacaguguauagcuagcaacaaugugaugguguaaagguuuuagaucuuagaacauuuaguguuucaguucagaguugcucagccagguguggcuguguagauauuuugaaauguauuaaacucuaaauaugaaacauuuuugcuguaagcauuuuggcuaagagggccucaaauuccacauacagaaagguuaauuucaagguuuuaaugaaaauaaacccauuuaccaacuuauuuguguauacuauacuuaguauguggauuugugugcgccuuauaaaaaguaaguaucuguagaggaauaaacguguauuuuccuauuuucuuuaguaguuuuguuuucuaacauaagcacuaaaaggauauuuguuagugaugcuaagucauuauuaguucauuuucuuuuuauucuaugcaaccauugcaaaaaagcaauacuguuuauucccuugauguuuaguguuauguucuucauauuaauuaagcuauacaaaauaggauguggaaagaggggagauaugugaauaucaauuauagcaacuuaaaaauuaaaacuguuuuuuuaacucuuuuuacugcugucuaaaaugaaaguaaucuugauuacagaugaauauggcugcucaaaagguuaauaauucuguuacaagucccagauauuucauguuggcaauauauacuuucaacccucauucacuuguugcauauuuucucuacaugauagcuaugugauuugaggaagaaaaaugggaaaauaauuucuuucauuucagcauuuuauuugcuuauaaccagaauccacucuagauaguuggguguuggucuagacuacaaagaggucaugaaaguauauacugucuucucucaccguuugcaugaguuauuaaguuuugggauauccaacugcauguuuuuacaguauguaaaccauauuuuauaucuguaauuuuuguuuuguuuuguucuuugagacacuaaguguagcguugguuguccuggaacucuacauagaccaggcuggucucaaacucacagagauuuaaccuaccucugccucccaagugcuaggauuagaggcgugugccuagauaugcuacuaauuuaaacaaacaaacaaaaccaaaaaagcagcucaugaaguauuuguuuugugcuacuacaacagugagauuggaagcaagcacacacaguguccagcaaguacagaugugugagccacucuuacagauuuagcaccagcaucugcacaugcguagugaugugcacgaaucaugacccagucacagggcaguagaguuguuacagaaucuugauaaagagaauauuuuccaaauaccuuaucaguuuucauugcuuucauucagucacugaauauuuucuauaguacauguuaaaaguaguuucaggggcuggugagauggcucagcagguaagagcacccgacugcucuuccaaagguccugaguucaaaucccagcaaccacaugguggcucacaaccauccguaaugagaucugacucccucuucuggugugucugaagacagcuacaguguacuuacauauaauaaauaaauaaaucaaaaaaaaaguaguuugaguuauuuucgugguauucagauauaguugauaggguuuuucuuccauucauaauauuuccaaaguuccuuuaacuucugaaguguuuuugugaucaaaacaagauuauaaauaaauauagcuuuaacuaaauauauacucaguuggaacaaaaacaguaucuuuagcaacuuacuggguuuuucugauuucggguuuuuuggguuguuuguuuguuuguuuguuugcuuguuuguuuaagcagagucucacuucaugguucaggccaaccucaaaaugccaauccuccugccugagacucaaaugcuggaauuuggaauuauaggcaagcagucccacauccagcccuaguacauauuuauacuaaauauccuacaucccaaaugaagggguguuuguugguuuuugcuauugggaggcagcuuuguuguuuguuuuuuuauagucuagcgaucaaauuugggcagcuugccaguaaguuaaaucuccaaccagaaaugaagauuuuaauggauuugauuauguauaaauaagcacauaauaauuaacuuaugaaaaauagugcauuugucuuauauauuagauuuaccuucaugauuuaauaauuuccccuuuuauucugaggcuugccuuggauauucaugccauaaguaccuuuuuguacaucauguuuguuucccagaaaguccacacguaaggaguuagaugggugauguggaauaggguuucauuggcauuagcuaucuuuacagauuuucuuauccuugcuuuaacuuuccaauagguggucaagaagaauauguuuuaucuuaugagccagugaaucaacaagaagguuuguggaguuuguugauguuuuauagccuuauuuaaaaguauauuuugagcuggagagauggcucagugguuaagagcacugacugcucuuccgguaguccugaauucaauucccagcagccacauggugacuuacagccaucuguaaugggauccaaugcccucuuuugaugugugugugaagacagcgauaguguguucauauaaauaaaaauaaauauaucuuuuuuuuaaaaaagcauauuucagggccaaugagauggcucugugaauaagagugcucgcugccaaaccugaggacuucaguucagaccccaggaaugacaggguaggaagaggaagagagccaacucccaccaguuauccucugaccuccacacauacacaccgugucacacacacagaaaaauuaauuauaauaaguagauucauguaaaauaaauaugcuuaguuugaaaaaucagacuauuagaugcaaaaauauuacaucagaauuuugcucuuuuuaacuauauauguagacaauucuauaugaauauuaaacucauaaaauauuagaaucaagucauuuuauguuggcugguuuauugguauugugucccuaagcucacuguaucuaccuuuccaucccucugaccacaguacaggucugauucuuaccagugaucuuccuccuucagcaugacccacugugcgcucgcuagcucaucuuucuagaucacagugccaucguaucacuuccuauacccagugguuucugucuccuuuccucuuucuuguuuuuaucuucaaaaaccaucgauacagcaccauacuuuguuuuuuguuauaaugaaguguuagcaaucuauuacaaugucuuaagaugcugaauauaacuugacuuccaagauuuuaauaaggauuuguuuacaaaguaguacuuaguugagaacauaauauaaagaaagaaugaagaagaaauucuucauaauaguucagaaugguuuuguucucugcugaaauacacuguuuguuaaguguuuauucuuuuuaauacguuuauuuuuguaguuaauuauacccgaccagucaucauauuaggaccuaugaaagacagaguaaaugaugacuuaaucucagaauuuccugacaaauuuggauccugugucccucgugaguaacccacauuaaaaccuauguaacauuuucugucacuguguuugguagaaguaaauguaacugcuuuaaagacuauaguuaauuauuuuauuaauuauucuuccuuccucaauauuauuuucuuuuuuagauuuaaaaguguuauguuaaaccuuuuaaaaggaaugaauuaaguagaagauguauuuauucuguuuuuaaauauuaaacacuuccccaaguucuuuuuuauugaagauacaacuagaccgaagcgugacuaugagguggauggacgagauuaucauuuugugacuucaagggaacagauggaaaaggauauucaggagcauaaguucauugaagccggccaguauaacaaccaucuguaugggacgagcgugcaguccgugcgagcaguggcagagaagguaaucaccaggccacucagcguagagugucuaauaaaggcgacuugacuuuauuugcauugagaaaaauaauacagcuuacauagccuugguagcuuauuaacauuacugcuuuaguugaauaaauauuagauuuucagugaauuagaaaaguucaucuaagaacagguugucaagucugagaaugugauggucauguucaucuguaaaaugugggacgguuuuccuaaggcuuuguccuggcuaagucaccagugucccugagaaacgugaauucccaggaaggucuuuggaacuugaacuuuacucgaccacuacucaaaguggaagucuuauuccaaauaguuucuuguauuggugcaggugucucucuuauguugggauccaucccaggagcaacuuauaaaggcaaacaccauuaaagcucauacacaggcgcaggaagggcugcuggugguugguucaaguccaggcuugcuguggguaacuauaugaaacaguuauacugacuuuuaucaugacugggcacagaacauaacagaauauguaaucaguuguggcauuagaaaguuuuccaguaacaccagaaacauaucagaaaguuuccuuauaauggcaggcuauccagguaacugcuaccuaggccuuaacauuuuaccaaggucccaacaaauauagcuuaaauaucagacaucccugaauucccaacagaccuuuuuuuagaaauuuauaucauaauuauaagcuacauguaaaaaauucuagaauagugcucuaguuuauuucugucguugugauaaaagcucccugaucaaagcaucuuagagguuuauuuagcuuauaauuccagugauccuuucacugaugggaauucagaguggcaagaacucgaaacaacuacugacagcauguccacagucaagaccuuugcuuccugcugccuuucuuuucucucauacacuucagggcccagucuguaaaacugugccacccacauuuaacaguccagacaaccccuccauagccaugcccacaggcaaaccugauuuccucagcugagguuccuccuucaagugauuccaaguuuuggcaaugacauuuaaaaccaucacaaauagcuagacaguuuuguaaaauagcaaaguugagagacucauacuacuuaauuuugauccuauaauaauaauaauaauaauaauaauaauaauaucaucucaauaugaaaagagucauauagaucaaaggggcugcacauugaaguauucugaaauaagccuagauugguggugcacacaugcaauuucaacuacucaggaucgauugaacucaagagauaaaggccaguccuuucaacauaucaagacugucucaaucaaggaaaaaaaaaaaaaaaaaaauauauauauauauaaaaccuguaauagaccuauacacguggucauaaaagaaggucagaaaagaaggaauuccgugaagugguagauagcauuugaacaugcagugccagaacaauuaaguagcucccauucuugcuauuuacaaaucuaaccaaagaauaagccagaggucuaaauucuaaaacuguacacuugugagaaaaagcagaaggagaggccagugugauggcucagcaguuaggaguguuugcugguugcucuugugagguccugaguucaguucccagcacaucugacagcucacauccuccuguaacuccaguuucagaaaaucugaugccuucuucugacccguaagggcaguaggcacacauggugcacauacauacaugcuacauacauacaugcaggcacucauacauaaaauaaaauagaaauaaguaauuuaucaaaagaaaucuugacccuaacuuagacaaagauauguugaaugcauaguccacagaagaaaaagaugauagauuggaguucaucaaaauaaaaacccuacuccugcaaaacaccaaucagaaagaacuguugacagcagcugguaaauaccauccuccaccaagcaguucacgucuaggacuuuuccaaacacacaauccaguaauaugaaaaaugcauuugcaaagaaguugccgcuguggccuuaaucaaaguaugagauauuguaaacuauucaaugccaagacaaaguaauugaaaaucagaaauucccaugaauuggaguucuuuacaguuaauaaaugacagugaaauaucuaugaauugauuugcaacaugcagaggaucuaugacuuaauauuuuaaaaggagaaauaagaaaacacauccacucgguuguauguguaaacacaggaacugaucagaaccugaugagagacuaauuacuaacaaagggaaaguaggaaggacaggaaaguggaagacagaucaaagaauggaaaauuugauugucaaaguaaguuaauagcugauuauaaaacacagugcuacauaaaaaucaaguagucucugaaggcauaagcaagcacauggauaaagagguggaggagaagccuuacccugcaugcacugccugcugcugaucaaggccaagacaugacaggguugggaaaucauuuuugauaaucucaugguaauaauuauuuuagggaagaacauuaagagaugauuaaaauuauaucuuaaaauaaucacaguaagcgacauuugugagaaacaagauuauuuacauuccaggagaguaucuacccugaaaauaguuaaaaaggcaaaagauaauuuuauaauggagaacuuuuaaacagacagaaguaaggccuagccuaugaaaugcuccaagauugccaagaucagggcuagagagagccagcucacaggauaaagcgcagugcuuuugguuagaaugggaccuguguccccaucuccaguacucauguaaaagccaggcggguggggguugagcaggguggacacggccaaguccccauaaaaagugauccggguucaguaagcaagcuuauccuaaaaagcaaguaagguugaguggggugggggguggaggugggcaccccuuuaaucccuguacucagaucccugaugggucucugugaguugaagcccauccugaucuacagagcgaguuccaggacagccaaggcuacacagagaaacccugucucaaaaaauaagguagagagcaaaaacacuggacuuuggccucugcccucuacauucacaugcucaauauaugcauacccaacacaacaguaaacuaccaagaccuagaaucaagggcugagcuguccagcugcugccaguuagacauugucaguaaaacauacacguccuggaugguaacuugagccagcaacucuugauugcuaguucaguaaggagcauuagaugaccagcuagaauuauacugugauuaucuuuggguaauauagaccaaaggaauauuauuucugccguuuacaauaaaacuaauacauauauguaaggagugaagccagcauguuaguuuucugucacugugauugaaggagaacagggaaggauuuauuuuagcucauggucucagagguuucaguccauaguggagaagcagagaggaggagagagcagaacuauacagaagcugggcgugguggugcacgccuuuaaucccagcacucgguaggcagaggcaggcagauuucugaguucgaggacagccagggcuacacagagaaauccugucucgaaaaaccaaaaacaaaaacaaaaaaaaaaaaaaaagaagaagaggaagaaaagaaaagaaauaugcagaaaucccuuuagagucguauuuccaaugagcuacuuccuccaaugagguaucacuuccauugagcuaacguauuaauuacauccuuagucuaaauugaguaucuuuuuuuuuguuguuuuuuggggguuuuguuuuguuuuguuuguuuuauuuuguuuuguuuuuguuuuuuuguuuuuguuuucuaaggguuucucuguguagcccuggcuguccuggaacucacuuuguagaccaggauggccuugaacucagaaauccgccugccucugccuccugaguacuggaauuaaaggcaugcgccaccacgcccagaugaguaucauuucuuaauauacacucuagucuuuaaauugcaagguauuugugaaaccaaggaccugauuuuaaauauuccaauaaaauuuauuuaguucucauaauauaauuuucuguguaacuuggaaauacacagcuauaauaaaacacaaaugaccuuuugugucaguggauuugucaaaaaaguuauauaaaaccagaauuggguuuugcaaauugcaguuuaugguaucuuccagcccccaauaaaguaaggauuggaagcauggaauagugguacugaggaccuagaagauggcucggugcuuaagaguauauaccgcucucagcaaagagccacaucagggagcccacaguugcccccguguccucuucugcucuccuuggacacucaaagccauguacauaaauaaaaguacauuuuaaagaauagcggggggcuggcgagauggcucagugguuaagagugccaacugcucuuccaaagguccugaguucaaaucccagcaaccacaugguggcucacaaccaucuguaacgaaaucugaugcccucuucuggaguaucugaggacagcuacaguguacauuacauguaauaaauaaauaaauauuaaaaaaaaagaauagcagucgugaggcucugcagguuuacugaggagaaggcaugccacacuccaugugucuuuucaccuucugcuggucaugccauuuuaugaaugaaauuucauuagugcccuuuugauuuauuuguauauuuuaaccuauaugaauauauguguguguaugugugggucuguacauugaguauguagaggugcccauuggggucagaagaggguguuggauccccugaagccauaaugaccaauagcugguggcuacccagcaugggggcugugaacucaaauccucugcaagaggaaugcacacuuuaacugcugagccaucucuccacccacuuaaaaguuguuggucucuaaaaacuagggauaugagacuuauuugucuucuuuauuguuucuauuuuagggcaaacauuguauccuugaugugucuggaaaugccauaaagagguugcagauugcacagcuuuauccaauaucuauuuuuauuaaacccaaauccauggaaaauaucauguaaguguaaauguuuugaguauucucuuuaaaugcagaucagccagucuugaguuacuuuuuugucuucauucucuccaucuauaaaaugaagauaguaguauuuauacguauccuauaacaucaucaucgcccuccccaucaucaucauacuauugaaugggcaguguggcuaugugguaaccauuaaaaaaauaaacagaugguggcucucuggcugacaagauucaagauggcuccauuaaggcauuugcuacugccaccaagccugaagaccugaguucaauaucuaggauccacacagcaaaagaggacuccugcaagcugguaguugaccccgugugugcgcgcgugcgcacgcacgcacgcacacauacacauuugcauacaugaauguauuuuuucuuaguaaaauuaaguaaaaaagaaaagaaagugcaaauaaaaacaacagguagaacaaaaauauagucucaaugagucuaaauauccuguucauuaaaacccagaaacccacuaaguacuguucucaacauaugcaggauacauacugauuucaaacacgugacagugaccaaacugucugcuggaguacaauuuucaaauaacugaaaacaaacauccucugaccacagcaaaauuaaacuggaaaguaauaauaaaaaugugacucaaacgguuacauauuagaaacugagcauuauacuucugaauagguuuuuuaaaaaucacagaaaaauuaauaauguuuggaaguacguauaaaggcuggcaggcguaaugucauguauuuggugaaggaaguuacacagccuguaaacauggcguguugccagacccccaaucucagggcugaggaacuuaggaggccugcugcaacuagagucagaaaagcauaaacaaggagagaaguuggaagucaaccauaaauucagagaagccagaagagaaaucaguguacuaucaaaucagcauagaauggggaucagugggaagauggucugaaaauacgauaaacaguaagaaugaccaagaaacaaaguccagcauuuucauauuaacaccagaauggaaaaggcugaccaguauacaucagugaucauuauaguuugacacaugugacccaguagaaauuaggucuuggucagagcacacucucaguauggcacuggcuuuaaacaacugaaagccauaaugucaugauguuacuaacugcgcaucagaagggugaaagugaaaaaaggcagcacgucuuagauaggcauccagagcgucugaaacaacucagucuucaaguguaacuuggcgaaucuacauugcuuacuuuacaguagccucaaagauugacgcaugcaaaauuuaugauuagcccagaacgcuccguccuagauacaacaaaugcuugcuuauauuuagcuuacuuucuugauagcaaaagugcuguucaaauagccaccaccuagaaacuaccuaaaugcuggcaccaccaccagccagauacaucaauaacaacguuuucacaaugaaacagucugcaagaauagucaugagcagucuccagcuauguacaaacacauaagagucauauaauuugaauaaaagaucucagaaguacacacaccguacaguucagguuugacuauugcuuucagaaaccaaauggaaccuagccaugaggaugcucugagucccagagcacuggagcugcucuguuagaccugagugcugcgugcacaggugugugacagugugucaagcuguacauguaagucaccacacuugcauguuuuuaaaguuacaccacaaaaaaaaacauuaacuagaaaaggacaaaggaaagaaaagcuugcauaaugaccacaagcaagaguuuuucucuagaauauaaggcagauuuaauauuuaaaaaucugucgggaggcuaaagguccagagcagggcacuuguccagcauaaaggaaggguguaggaguuacauaggcuggacuaccaucaaagagaaucuccaaauaaugagcacaccaguaaccgacccacuuacacaguggcuucacugccaagaucuaucuaucuacucaaccuauuuuggaacuucgaagucuuuugaagccauacagcuuccugggguugguuuaaaagguuaauuucagcucucagcaugaugucaacucccuuuuuuuuuuuuuuuuuuuuuuuuuuuuuuagcccuauagcaagcaguuuguguacaauuucuaagaugccgcaaagaaauuggcaagguuuugcaagccccagugccuuuccccagaccugccccaccuccuugacuuugcccuuuuuuuacuuugguagccagugcaggacauuugaaagugucacauguauggauagaauuuauagauaauucauaugugagcguggaaagauacagucucagaaaauaccugaguaaaaucuucagcuuauaucaagcugccucagcacagaaaugcucuacaauaaaaaauaauuaaauuuuaaauaaaacagcaaagaucucuacaguugcugaaucuuaagaauccaaagugaaguuuuaacaaaacaaacaaaagaacaaagaaacagcaaagaaugguucauucaaagguaaaaaucagucccuggacggaucagaugucagacucacuucagacuguaaaaccacuuuagaaugauuuguuguuuuuaaguaaaaaauaucagguuuccauauaacauucucauguauuuauaucauauauauucagugcucauacucaucucuguuguccccucuuccucccuccuuucuguccuuauguuauuuaauguuucuaacaccccaaagauacauaaaagaacuaaaaggcaagaucaaagucaagaaaaguauaucugaacaaguuggaauuaucaauaaagagaaaacuugacguucuggaggacuagcaauggcucagcccuaagagcacaggauccaagucagguuccucuagggaacccaugcccucuucugccccucacacacacugcacucaaguacccagacccagaccacaacacaaagacacauaauuaaaaauaaaaauaaacaauuacugaaauaaauuuagggagauuuagagacaaauuugaacaggcagaagacccaucacacuuaaagauaggacaguggaaaucaucacaucugaggaacauuggagaauaaugaacagagcuuucaaggaacugggagguggcacugaguaggucaacauguguuaugaauuucagaaugggagcagggacagauuauuugaagaaaccucccagguuuuauuuaaaagauauugaguaaaguccaagcauaagaaacggaggugcccugacugaggcacguuacugucagacuguuggaagauaucgguguacacaguaugagcagugacucaucucacauacaagagaucuuccaggaagauuaucagcagaauccucaucagaaccuuugggggucagaaggcaugauugguacauuaaaggcacugaagaaaugaagccugugaauccagcacccuaugcccagugaggaugaggaagaaacccacugcauaagccugcuggcauggagcccaugcggaggaggggagagagaagcaacuccacagaguuguccucuguccucuacugaacacugguguguuugcccacgugccaugcacauacagaauaauaauaaaaaaaauguaaaaggaaauggaaguauccucagauugacaaaagcaguucauugccacuagagcuacccuacaagcagugcucaggaacccugaggguugagaaggcacugugccauagccaggcagaaugcagaaguagcgagagcuugcucucacaaguuggaaacagacuucuucccacaggcccaucauccagcugcaggaagacuaagcuuaugauuggcuugcuucacaccuagaugucugugaaauaaaugccacauguaucacuucauauguuauaauagcaauugcugaauuaaaacgucccacugaggauguggcuuuagccaacaauacuuuuuaagauugugucagauguccuuucuuguguuuuaucuguuugcagguuuuuuuccucuagccaucuaguucuagcuaagguuuccucaugagagaaaguuaagcuuuuaaucuaagucuuccuccuuguucuucucucucaccccacuccacuucacugaugaggaaacuaggccauuucagugucuccccaguauacuuucugauugguuuuuuuuuaaugugugcauuaaauaaauugggauauagaucugugaagugugaaguucauauagaucuuaauaugaagugcacagggaaacuaagcuaguguagaaagugccacaguccuguugucauugaagagucaggcagcaggccuagugacugcaucuguucccagugacagcuauaguuugcgcagacuugaaguacucauuauuuuauaccuuauauguccucugucaucuuuuuccaaagaauauuacaauaugguaaucaccaauuucuaaauguauuugcauagggaaaugaacaagcgccuaacagaagagcaggccagaaaaacauuugagagagccaugaagcuggagcaggaguucacugagcauuucacaggugggagccugggaggccugcgggaggaggccugcuguguccucgucugcuaggaggaacuaguucuguaguuuccaaaacaaacguguaaaaucugugccuuuguccuauaggaagcucaaagguuagccuugcugguaauggggaaucuuagacugcaguguaccuaguguugugugcaugggauaauacuugaccagagagaaauagguuugauuucacugcuucauugaaggcucugaccuucucuuacccuuuauaaauucuucccauuccuuccaggcucacuaagauagaacugacagauucccuaggcauucagaguacauagugggcuguauacugugaauugguuacugcagucauaguaguccaucuguggccacagguccugccugcuguguggcugugugugugucuauugugaggucacuugauaucuacuuuuguuaaugucauuaccaucucuacacuagaugcccagaaauuguucuuuuagggucuugggguuuccagugcuggaacauuagucuuugcacacacuaagcaagcccugucgcugagcuguggccauagcacauuuccuccuaaaaaagaaaugucuguccuuugaccaccauuuccuuauccuguucuacuccccuccaccagucucugggagccaucacugugcucccugccucucagaguucaguuuagagucuacagggaaaugaagccaugucagauuuauuuuuaugugucugguuuaauguagcuuaagaucuuguauauuuauucauguugucagaaaugaccggauuccuucuuauggcuggauaauguucucauuauagauauuuagauaucccuuauuuucucuguuggcaagcaauuaggagguuuucauugcucuaucuauugugaauaaugagguuaacagagaauugcagguguuucacugacacgcugauuccuuuccauuuggaucuauacccagaagugagauuguuggcuuagacucucaguguguuuucuguagacuggguauaagcaacaauuguuuagccagcagcugggaggacugggaauucuuagaugagaaggauggccuacaguagggugacaagcacacagagagcuagcuggagagacuaagugaccaacggccucauucuggcaacaacagcccaccgcuguaauaacagcuuagucauguguaaaagagauaggcucugugugccacgguggcccugaacuccuggacucaagugaccccucuacauuugcuacccaaguagcugggaccauauauacacacuaugccugaccucauuuaaaauaaugaucauggggcuggagagauggcucagcaguuaagagcaccgacugcuuuucuggagguccugaguucaaauaaaucuuaaaaaaaaaaaaaagaauauguaaaauaaugaucacaugagcuccaguaagaagcauagccauaugcugaaggggggaggggcaucuuuuuuuuuuuuuuccacacuuagaaggaaaccauaagaauauuaacauagaacggauuggcucacgccuuuaaucccagcacuagagaggcagaggcaugcugaucuacaaggccagccuggucuacagagugaguuucagacagccagggcuacacagagaaaccuuguguggggcaggaggcaugccuuuuaccuggauuucucagaugguaacauuuuaucuccagagcaacugagaguaaguuacaaacagaugcccuuuacuucuaaauacuuccacguuucaaaacguccuuuaaagaggauauuugaguguuuguucauaucuccccauggugagaguacugcugauccaacucaggaaauguaacacggguaaugucacccuuccauccagacuuucuccaggaguggcacuuguuagaugacaaaaaacagaaagaaaaaaaauacuggcaggauccacucuaggaacacauguugcacuggacuugucacugaucucaacccaccccugagcccuuacuuacuagucagucauuggcaaccuugacuuuuuuuuuuuuuuuuuuuuuuuuuuuugguggggaggggcuucagagaggguuucucuguguagcucuggcuguccuggaacucuuagaccagucuggccucagccucacagggaucccugugcuucugcccccaagugcugagauuaaaggcgugcaccaccaugcccaguuacuuaccuugacauucuuuaagaaugaaggccagcucuccuguggaaucgccuuagauuuggguuaguuuggggcaggcaugucagaggaguggcauugauucucugucaugcagugcuguggcagcaguguggaccauucauuuagugguguugguugucacagugauggcuaagguaucuugggcuuggccuccauucuuccaacccagggagaaccaugacuguuguaguaagcaaaguguguguuucccaguguacuucagcagcuguccuuccucagaagaauucacugcuugccacugugggccugcccuguuaagcgcugugacccagucacagaaacuggcguuugccaaauaucugucuucacagauauuaaaggacaccuauauguagcucaaaaugugaacuuucacauacucauaaacauuauaaaacuuaaaacuugauuacucaaacauucuuaggugcauagaagcucuuuucuugugcauaaauguuccuccguacaggauccuuaaccucacucgccaacguggacaguuuuacuuagcaucuccguuuggcauuuuaccccagacgucucaggcggcaggaaacacggugauuuccucacacccucucacacuuguugcuucucggccucaggaguuuacagaccugccugggucuccugagugcuaccuccuggcuccaugcugaauccuuuuuaguuguauuaacuaacccuugauccucacagauauggagacucuaucuaaauaauuaguucuuagucauuguuaccauuuguuguuguuuguuguguuuuuugaaaaaggaucucucuguguagcccaggcugaccuagaauuuauaauccuccugccucugccuuucaaguuguaaaauuacaaauaugcaucaugacacaugcuguguuaucuaucauuuuuuauuuacauauuauuucaggcaggaaauaagcuuucuaauguugauuuuaauaguuucuaacacuaagauacagauugaguucgauuugggcuaguuuggggcaggcaugucagagaaguggcaugaagugugucaucuacaugacacuucagacuucggcagagugcagacagacucugcuggcuuuccucagggucuaucuugccacugccacagaaguuuggugggaacucuguaguucccacaaaaggaaauaaauauuuuguauuaaaauaauaaaacugagcagcugaggggccuaaaucagagauagagcauacaguuagccuccucagucccccgcaccaucagaggggugagugagcgggcaagugggagagcuauucaagcucagugaucagcgcacuaaacaaaggauagcgacagugcgcgucucgcuugugguccgcuguguguuuuguacaaauaguaacacuaacuaaaugacaguuguuguaaacaaguagugcacugccaucuuccaccucagcagaaauguugauggcaaaggaggacgacuaaugugcugugcgcugugcuuucucuccuuacagcuauuguccagggagacacgcuggaggacauuuacaaccaagugaaacagaucaucgaagaacagucugggccuuacaucugggucccagcgaaagaaaagcuaugaagacggauguuguucuuucuuuuuuccauggucucaucucuugcccuguuguggagucugucuucgguguccuccacacugacacagauccccuccucauggucggcaguugugcccguuuuuugacaucugugucccuucauguugcaucaucuguacuauucuguguuacucuugguuucuggccacuuuucagaaugaagaugaauggccugaccagcuaucuaggguuuggggagaugcaaaauuguaaaauuccuuaauguuuaagggaaaguuaacuuuaagagauuuucagaaaagcuuuauauacauucuuuuccaauuucaguacaaaugaaagaaaagugguuuuaaucagugauuuaguggaccuugagcaacugugcacgcuucacucuaauagcaugguuuggccaguguauuagcucucaaguucuuuccucaauugacuucugcuauuaaaguaaugauuucauuaaaaacaaauaagaaaaauagggauuuauuucaaaauuaaugucugaguuaacucauaauuucaggaguuguuuguuauucguggcaggucuuuauugugugcccucccaugggacacgugccaggacuaaccauggaggugugcagcucugugggaagugaguggcucucgagccuuguccguacacugugguuacggcucugucgcggucaaagaacucacuuuacacacagaacugcagacaagaaaggguuucgguggacuuguagcaaucauggcagugggaaggaguccaauucauagccuaaaauuuuaauguaugcuuagggaggggucagauuuuaaugacuauuuuacccacaauaacugccuauuuuguuauaauaaaauauauauaaauauauauaaaacuuucuuuaacuaaacucuguaacuaugggaauuauuuucuuuacauaguugcacacacaaacauauauauauauauuuaaaauauauuuuucuuuugccaccuacuucuaacuuuuuguuugguuuuuaaauuaaauauuaauugaugagacuuaccguccuuaaucaugugaacugaagacaaguguccgguggcggugaggagaaaccucuaggagauuagguugugaguaggcgccaagccuguucuccucuuuccuacagaaguuccagaagguuccuagguuuccugucaguguuguguucuugucauggaguuugauuucgguccucugccuuuccuccuaguucuccucauuuuauuaauagacagacaaacuccauuuuugcgacuccccgagacacuucaucuugcguagcugcgcugaacuagaauugcacagguguuaaguaaacgacuugagaaagguuagugagaggcagaugccuucagaagucacuuucucuaguccauuauuaauaucauuuggcuucccuuugcucuuuggaacuguuuauucgauacgugauuuuggcaacucuuuaaaauuuccuaaaugaguacuggguuguaaagaauuauccauuccauuuaugagaaagaggagaacagcuaauaaacuuuauuguaaaauccauauguuaaaugugucuugaauuuuggaaguuucuguuuuuaauaagcugucacuuacuggggugguucgccgcauuacauaacaaguuagauuugcuaugucaugagcaguguauguaguucuuacacuaaaugccguaaauugcugaaaaacaaacucaggaagaaaaaggaaagaaguugugauuuccauaaaccaccucaccugcagagggaagcccagccuagccacucugacauguggccggugccaagcacugagggagcgggaaaggugccauucgcauacggaaaguuguguuggauuucuuuccagauaucuuuaagagauuuuuuuaagaaaauauaucuguaauguuuucuagauucuugccugaauauuaauaguguaacuacuaauugcuguauuauguuaggauuuuacaacaauuuugaagaaagaaccaagccucacuaccuaaggcuuaaaauggaauugccugauaggacguggcuggaagguggugauguggaguucagaacugcuccucuccaaauauguaucuuucugguaauucugugcugccucguuguucagccacuguucaguaaggcacacugguauaagcugucaauccgugucuaugcagauuaccacgccuagacucacacaguggcuagaaguaaguugcuccguggcugcugaauacauguggauuucgcacugucacacggcagugaugagugucuucagacgcauggaagacuucaucccaaguggguuauuuugucugggaguuucacguauucauacauacuccauguuuggaucuguuuccuacuguccuuaaguugaggggaaaugacuuacugugucuguucgcuuccuggucugcagcugccucaggcuccugugaauaggagaagccccuccaagccccugcugaauacuggaaucucuuaacuccaaggaugauaguuuggggauuucauauuaagcaaaauuuauuuucugaccuauuagggccaacaaccuccuaagacuccacccuuuguaauguuacaggucaugaaauagaagccuagaaauccuuuguccuacagaguucugcgcgucagcaaagcaggaccagagccccuugccugcugccuccugacaacgguuuucuuaccauguuggcucuuguugcuccuauggaagauuguccuguucucagacauaugaauuacugaaaguagaauaguaaaugccaagaaguugagaagaauucauagcagucacuuauaggacugcccgauugugugguccacuguuucggacagcaccucuccucccuccagagcucugcaguguaacaugaaagggaccguaugugggcagcuggguuugaauggcagccaucuacagcguaagccugaugcuugcuuuguacuaacuaaaauggagaaacuuugaggaucaguaagcccugaggugugcuaggucagaauacacuucuuuccuuuuccugugagaucugaaaccuagagucacccaugcucugugcguggaccugacccguggagccgagacgaagccuggacacccugcagggcucggcauuguccacacugcagucagcuucucuugcuggacguguuuacguccuugcucccgugcgcuugugcuuggugaccagagugccguccccugcccaucacccgugaagaaccuuccuuagacagauaccuuagacuguuacaucauuucagcccuuuugaucauuuucacucaucuaagaauaaauaucuuuuuggucaga

SEQ ID NO: 8204 - RNA, 1008 nt, Mus musculus
cgaguuuuuguggaaaacgcgcgcugggacuugcgcuugcaguguuuuuuucuacaacuguuggcugucgcagaggcagcauggaucucagcgagcuggagagggacaauaugaaucguuguugucugaguucuccuguaccuucugugugucucaaggagccgugcguucugggcguggaugaagcgggccgagccccugugcuuggucccauggucuaugccaucuguuacugcccccugucucgcuuggcagauccggaggcccugaaaguagcagacucaaagaccuugacagagaaugagcgggagaggcucuuuacgaaaauggaggaagauggagacuuuguggguuggucuuuggacguccugucuccaaaccugaucucuaucagcaugcuugggcgagucaaguacaaccucaacucccugucacacgauacagcugcggagcugauaugguaugcacuggaccagaaugugaaugucacucagguauuuguggacacuguaggaaugccagagacauaccaggcucuauuauaacagcgcuuuccgggauagaggugacagucaaggccaaagcugacucccuguucccuguggucagugcugccagcaucuuugccaagguaaccagagacaaggcugugaagaacuggcaguuuguggaaauuuuacaggaucuggacuccgauuauggcucaggcuaucccagugaucccaagaccaaagccuggcugaggagacauguggacccuguguuuggcuucccccaguuuguacgguucaguuggagcacagcccaagccaucuuggagaaggaggcagaugucacuugggaggacucaaagcugaggaggauccugagcaagaaucaccucacuucaggcagggcccacagacccucaggccccccacagauacuuccaggagcgaggccuggaggcagccagcagccucgaggaggcaacaugugcaccaccugcccuucuaacccaggaauaaa

SEQ ID NO: 8205 - RNA, 1008 nt, Mus musculus
uuuauuccuggguuagaagggcagguggugcacauguugccuccucgaggcugcuggcugccuccaggccucgcuccuggaaguaucuguggggggccugagggucugugggcccugccugaagugaggugauucuugcucaggauccuccucagcuuugaguccucccaagugacaucugccuccuucuccaagauggcuugggcugugcuccaacugaaccguacaaacugggggaagccaaacacaggguccacaugucuccucagccaggcuuuggucuugggaucacugggauagccugagccauaaucggaguccagauccuguaaaauuuccacaaacugccaguucuucacagccuugucucugguuaccuuggcaaagaugcuggcagcacugaccacagggaacagggagucagcuuuggccuugacugucaccucuaucccggaaagcgcuguuauaauagagccugguaugucucuggcauuccuacaguguccacaaauaccugagugacauucacauucugguccagugcauaccauaucagcuccgcagcuguaucgugugacagggaguugagguuguacuugacucgcccaagcaugcugauagagaucagguuuggagacaggacguccaaagaccaacccacaaagucuccaucuuccuccauuuucguaaagagccucucccgcucauucucugucaaggucuuugagucugcuacuuucagggccuccggaucugccaagcgagacagggggcaguaacagauggcauagaccaugggaccaagcacaggggcucggcccgcuucauccacgcccagaacgcacggcuccuugagacacacagaagguacaggagaacucagacaacaacgauucauauugucccucuccagcucgcugagauccaugcugccucugcgacagccaacaguuguagaaaaaaacacugcaagcgcaagucccagcgcgcguuuuccacaaaaacucg

SEQ ID NO: 8206 - RNA, 1474 nt, Mus musculus
cuaguccgucgucgggcguggccguccggaaggcgaaggcagcgagcgucggguuccguggcgcggggagagccauggucuuccggcggcugcuggcggcccugcugcacaacccgcagcugguggagcggcuguccgagucgcggcccauccggcgggcggcgcagcucacagccuucgcgcugcuacagcuacagcugcgcggccacgaugcagcccgccgccugcgcgcccucgcggaucagccgcccggugcccugcgucgccgcgucgugagguucaaggacacuuucaccgaggaacuccgccguggcguccgggaccguccagggcagcagaaggguccgggcgccaaagcguaagcacggacuggacccucccgggccgaggucacguacccgucccuucagugaucuacaccgaccucagcagucacgagucaucuccaggacgcuacgcugcuucgaauccuaacucggauuguccuacagaugccuaaagucaaauggacaugugcccgguaguccugcagacguaaagaccucgaggcccaccagugauagagaaucuagaccauaacagcacgacugagagucauggacaaucagaaagcaagccugccgucugcaagcaggacugaagcugaauuccugcugcugcaucugcacuggugcaggagaauaccaggggagcuuguaaauggaacgacaaccccgagguugccaaaauccuucauuaaauguguaagcugauuaauagucugaaugugguauuucucagacaaggaggaaugcgggggacucuaagaucuuguuaaugauaguuaacgcguuaagcgucuguguugguauuugcuuucgagaucuguguggcuugugacuuaaaaucccauucugugaagaaauggaggccacuuuccaaguagcccaaagccuugcagaguguagagagcccagggacuauuggucacucccuccacuuuacagcucaggaacugcccuaucucucaccacuaagcauuaaggccgcugaucccauagcacaugacguuucucuucuuccccauuuugaaguucgguuugggguauucacuauggucagcuaacugaacugugauuaguaauuguacuggcuuguugugugugucaacuugacacagcuggaguuaucacacagaaaugagccucccuugaggaaaugccuccaugagauccagcuguaagacauuuucucaauagguggugaucaaagggggaagggcccauuguggguggugccaucccggggcucauagucuugaguucuauaagaaagcaagcugaacaaggcagggcaagcaagccaguaaguaacaccccuccauggacucugcaucagcuccugcuuccuguccuacuugagucccaguccugacuuccuuuggugaugaacagcaguguggaaguguaagcugaauaaacccuuuccucuccag

SEQ ID NO: 8207 - RNA, 8283 nt, Mus musculus
caagcgcaaauugagagccuucuguugccuugggaacgauccucggggcgccuaggugggcccuuggaccgggcgagcugccuuaggaccgcacuccccgcgcucagccccgcuuccugcccacaaccggaugcgugcgggcugagcccccugccucugaguucaccccaugguuauuccuguaggcuauggcuaucgccguuuccugcagcgucaggcuccaccucgccucaaagucgaccuaagcuccucugugcagugcaguaggauggaaaccacccccucacugcuguucagaugugcacuuccuguacuucuucaaggguaaguagggucgccuugcauuggugaggacaugaaucgggaccucaguauucccuucgguguuguggggaacaaaucucuaguaggaaaaguauaucagguaaaaauacauuagguaaauguaaugucauuccucccagugcguuagcugaccuagugcuggugcugaacggcaggcagguuauggggucucgaaagugggaggauaguguaauauagcacuacaaacaugcuauuaagaaauauggacaaaaacaaaaaaaaaaaaaggccagguaguggugguguaugcuuuuaaucucagcacccgggaaguagaggcggucagaucucugaguuugaggccagccuggucuacagagugaauccagggcagcgagagcuucacagaaaauccugacuugaaacaacaacaacaauaauaauaauaaauuaaaaggaaaacucuuuagugaagaccuuacguuauuaucgacucuauucacaaguguggcccuuugcuuauguuuguagaccauauagugucuggaaaguuuacugacaucacacucuagugaggugaacugggaauagugucugggcauuggcucagaucaaaggcaaagcccagcaaugugaaaggcagcacuuuauuaugguugaccucauaggaguaaaaaucucacaucugucaguagggugagaauacagacugugauccuauaugauaaaucuaccuagcaaccauaaaauuugcauuuaauacaggaaaccguauguaugagauaaaacuaaacuguagucuauauauguauuuauauuuaugcauauauguaugugacauacauauagcuagaaaaaagaauagaaguuagaugaacauuucauuuucucuuucucucacuuuuauuccuauuuuucuuuuuuuuuuaagauuuauuuauuuauuauauguaaguacacuguagcugucuucagacacaccagaagagggcgucagaucucauuacggaugguugugagccaccaugugguugcugggauuugaacucaggaccuucagaagagcaguuggugcucuuaaucacugagccaucccgccagcccuaagcaauucuuguaauuaaguguacuuugccacugaggguagagauggaaagagagagcagaaaguauuaaucugaaaauaucugguuuuuuuaaagauuuauuuauuauuauacauaaguauacuguauuauuauuauacauaaguauacuucagacacaccagaagagggcaucagaucucauuacgggugguuguuugccaccaugugguugcugggauuugaacucaggaccuuuggaagagcagucagugcucuuaaccacugagccaucucaccagcccaugucuggguuucuuauaccuggaaaaauacuauaguaggacaaaugagcagagguaaaagccaaacaaacauuacuguuuugaauguggagaggcugauuaccuacaaacccccccacccccccuuuuuuuuuuuuuugagaaguaagggaccagaguucccaaacagcuguccuggaacucagggcaaucuugcuguuuuggccuucugaguucugagauuacaggcauaaggaacgaugccuuucagaucugccauuuucgcuauugauccuuauguuucgcuauugauccuuauguugucagcugacuggggucaguuugcucuagcuggauagaaaucaugaguagaaguucccaggcccuugaguguccaaggccuggacuagcacguuagaugaugacaguuccagacacugagagguagggacuuaggccuccugauuuagacgcuagugacgcauggcucugggugcucaggucagaugcuauuagcauccauuuggcaagcauuugccagauacuguaaugccccucguccagcagcugugagugccaccagaagacaacaucugcuggacuacaguugugacacuccauuccuacaauggcuaguaguaucgcuuaaggcccggaagcuuccugaaacucuucagcaucuaguucucauaacuuccgcugccucuacuccaguguuuccacuuugguuacuuacucucugggaccuucuguugcccucuuggggcuucaacugcuacugucaggauggaagcugcuaccagugugccaguuuuaccaucucuucuuccuugugcugauagcucagucuggucuccuaacacuaacgaucaaaagcaggaaagaaaaggccacuuuaaccgucuuuuaaugagccucauguuauaacacggaacacccggagcagcacaaugagggcguguccaggugaguccggaagugagcagccagaugugaggcaaggauguuugcagcaaucaugacacaaccccucaugcagagggauacuguggucugcaucggagccaccaccaugacugcuccucugucuagagugaaagcagaaggacuacuaaugcgcaccgaggcuccugcucagcaugcugcucucuaaggccugugcaggcugguggagugcucgcagugauggcggucuucagcugcgccuauaguauccucggagaaacagaaacagagaaagaaagagucuggacaguuaggaggaaaggaaugacugucccaccucaggcugcuauaagagaagggccugugaaaauguugcccuagauggucuuaaagaagccucaaugcaaacuaacaauucuagcaacaguuaacaguacuuccuauuauuuaacaguguguaacagcauuuaacuccuccccaaugccccagaaagauacauaguaaccuugcuuguauuacuacacagcauugaacaagauuacccuuacuauguuccagacuuguacugagagcuuaaugaaaauggacacaauuccugccuuccuagagcaaacagacuaacagggaagauaccugguaaguagaacuaaccucuugauaaauaaaagaacugguggggguaggcagugguggcacaugccuuuagccccagcacucgggaggcagaggcagguggaucucuuaaguuugaggucagccuggucuacagaguuccaggacaacaagagcuacacagagaaacccuaucuugaaaaaaaaaaagaaaaagaaagaaagaaagaauuugaaaagcacaaggugauuagaccuggucuaguggacuucucaacacuaaauguuuauaaaaucaaaaguacuggggguguggcauagccagugcagugcuugccuguuaugcuugaagcccuggguuccaucuugagcaagcccuaaaccaagguuaguagcacauacuguaauucuaacacuggcaaauagagacaggaggaucagaaauccagggucauccuccacuccauaacaaauucaaagccaaucuggaccacaugagauacugucuggaaaaaggaaaaaguuuaaaggaacaaagaggcugaaucagagauccuuuagcugaaacaucaaauuauucugaaggccagccggucaguucuugggcucccaggaggucaguguguagucucugguacgaaugcagcacacuaagggguccaggccgaaugucauuaccgacucagagauccaacgaacugagucaaaccuagaccaagacucacacuguguaaggauacaauccuggggcuaguccacagccagacccacggaggagaaggggaaaagguuuauucagcaggucccucgauuugguuguucuucuucaggaaauuguuguacaacuguccuauuuguaucagguuucuuccaguuuacccugaguuacacgagaagaugaaauacauugccaagaaauguggaguuagguuccagccuccagcugugaucuugauuuaugagaaugaaaccgaaggaaagagccgccagcguaucaugccuguccgaaacuuuucaaaguucucagguaccccuuguuuuaucuugccuccugucuaguucucuauuuauuuuuauuuauguauguauguaugugucuaugugcgugggugucuagagaccugaagagggcaucagauuccuuguagcuaacguaacaaaccugauuguugcuaaaguuggaaacccugcaagugcuccuaaccauugagccaucucucuggcccuugccgucugucuuaauuauuaagucacuuaauaaaaauaaccugauggggcuggugagauggcucaguggguaagagcacccgacugcucuuccaaagguccagaguucaaaucccagcaaccacaugguggcucacaaccauccguaauaagaucugaugcccucuuuugggaugucugaagacagcuacaguguacuuacauauaauaaauaaauaaauauuuaaaaaaaaaauaaauaaccugacaccaucaggucuaauaacauacaccuauaauaauccaagcaauguagacagcuaaggcaggaaaauugcaaaugcgaaauaagucuggauaacuugagauaaccugucucaaaauuaaagcaaaaaaccaaaaauguuuggguuggggaaggauguaaauuaguugugguacacugaccuagugggugcaggguccuggauccagucccacugagagggaaaaggaaggggagggagggaggggagagagagggaggagcgaauauuuuaguuuugugcaguggaaugacagguuccucagaguucaacagcccuagguuuaaaucaucagggacuggccugugauccuugugagcucacuaacuguucucaguuucugugcugguguuuuuaggucaaccugacauaggcuagagucauucaggaagagggaaugucaauagagcaaacccccaacagacugaucuguagcagaccugugguccauuuucuugauugauuacugaugugggagggcccagccuacuguggguggggccacuucaggcugaugauccugggugguauaagaaagcagguugagcaagccauggggaacaagccaguaagcagggcuccuccgaggccucugcaucagcuccugccuccagguugguuccugcccugcuugaguuccugcuuuggccuucuucugugagggcugucauaugaaaguguaagugaaauaacccuuuccuccccaagcugcuuuugaucaugguguuuuaucacagcaauagaagaucuaaugaagacaaucuccccaaucuauacuuuuuaacaguuacagaauuggugauuuaauauuuuagaauaguuauaugaguuaaaugauauacuacuguuuaaugauacuaaauuuccuucucucuccaaauauuuuuuauuuguagaaagcauuuuauuagugucacacagcugccuuuuaagaacuaugccuuuuuuuuuuuccuggcaggagggguagggggcuucagucccagcacucagaggcaaaggcagguagaucucugaaugugaggccaaaccuacuccuacagagugaacucuaacccagcaaaggcuacauugucucuaaaacaaauaaaagccaugccauuuuuuaucuuuagacauuuucuucaguugaaaguuuuuaacaucucuacuaaguaauuuuagguuaagaaaguaaaaaagaaaaaaagauuucuuccuuuucucuccacaccaaaguuagguuuguuuauuuauuuauuuaaaauguuguauuugggggcuggagagaugguucagcaguuaagaguacuugcuguucuuuaagaggaccuggauucaguucccagcacccacauggcagcucacagccgucuuccaaauccagcuccagggaguccagcacccucuacuggucucugccagcacugcacauaugguacacauaaauacauucagacaaacacucaacauaugaaguaaaaauaaacccuuuuaaaauuuauauauauuuuuuuuuuugagacaagaucucucuuuuucaccuugacugaccaagaacucaugaguacccuccugcuucagccuccuaaugcugggaugagaaacaauuauaaacauauaccaccaaacucagccuguuguauuuuuuugcuuuuaagguaggaucuaguuaaguaguccaggcuagccucaaacauucuauccuccuaacucuuccagaugcuaggauuacaggcauguguguguuauaugauaaacuucuccuagguugaagcaacauauuucuguguauuuauuucagauagugagccaugaccaaugugugaauaccauugaaguucaauuugaugaaccaacaagcuuuacugggguuaccaaaggaguauggguggggcuacucacaggagcagaaaucaccaaggccaccccagcauuggugacagcucacugcugggccugcaggcagcucaagaggauagagggugccuuuuguuuaagcuguuuggcaggucucaagagucuauugagaccgucccucagcaguuuuuauuguuuauccucggaaagggaggggccuggugaaucugguccguuuuagggcuuuccuggaguucuuuugaguugcuuacuucuugucugaaggaacuucccugucagguggaauguuucaaugugagugggcugccacguaacagccagcauguguaacugagaaguguuaaaacucaguugaucauaaaaggacgguucuaaagcguaauugauuuguaaaccccgucagccagugggcuaccuuggagccagugaccucaggguuuuggucuguuuuaguccuugcaguggugugcaaugggugugauguguguucuacauacgcuuuucucccuccuagauugcaccagagcugcggaacaguuaaagaauaacccacggcacaagaguuaccuggaacaggugccccugaagcagcuggagaagcuguuuguuuuuuugcgagguuccuugcaggggcagagcuuggcagaaacaauggaacagauucggcgggaaacgaccaucgaucccgaggaagaccugaacaaacuggacgacaaggagcucgccaaaaggaagagcaucauggaugagcuuuucgagaaaaaucagaagagaaaggacgaccccacuuuuguguacgacgucgagguggaguucccucaggaugaacagcugcuguccugcagcugggacacagcgucaguggaugacuucugaggaagcgcuccacguuuccucagagaacaaagaucaguucuagaaaacgcugaaacacuagcgaucuauaaaaccaggacacuuccaugugcuacguaggccuaugagaaacacagaaauacaaggugggaaucugccuucaaggcguugacaggcgacagcaaagggaacucaaggacuuguaaaaagauauuuuaauaauauuacucaggaaaaagauaagagccagauuuugacaaaggggaggcuuucccucagcggaaaggggcccaugcuuggcccugaaaugcuacagauguuuuuguagaaaucaagaugaagcaaagagggaagggugugguaaagagacaagaaaugggagaaucugagaaauggugaguaauuauaguuugacaagauuggaauuaaccuguguucuucaggacucuaugugcauuaacucugggguagacaggagcaccuguaaaugcagaacgucucacagcuacgaguacauguggcggauggcaggcaguucuacuccgcaaucaggaaauauggucuaacguuacucugaaacccagagccacuuccugcgaaaggcugguuuguacaguggcaaguccucccacaaugagugauagguacuacuguucagaccuguuugugaguuuagauguacaaagaucucggccucacaaauccucugugugcagauguguuuguucuuacuagaauauuaucugauugauagaaaucguauguuuucuacaaggaaacuauuauucauugaauaaagcugugaccguaagugauaagucuua

SEQ ID NO: 8208 - RNA, 17049 nt, Mus musculus
guuccuuguaugaaguuuuuaaugaauuaugagccaaugaacauuacagaauuaagccuuaauauuucuucuuuccuaugaaaacuuagguaauauaaccgccugucucaaguaggacagaaggccauagugaauaagaguaauauuaauuaacauuuuguuccaccccugcaugcuuccuuaugcaugacguaagagauuccuacagcaacaacaaauucaacgacacguuucccuggucacgguggcugcagcuggaaugugacagaugcuacacuucugcaccauuguucauccauaccgccaccacucccaguguucucuugcgcccucugcauccccgugaggcaaugaguggggcaagaacuuccuacuuuguaggugagaaacuucuaggucaaauucgacacaacugcucucaaccuuugguagcauucugaaaccagggcauuuuuaaauccuuauggucggaacauaucccaguucugacaccaggaucaggauacggacccauccacaguacuuuuaagccacucugagaucuggccauguuugaacagcacugacucaggugacucauacucagcucagguacaacugugucuuccaugugcucuuuacgcaccaccaagagcacgaccuccuuuaacacucagcaguuuaccuuaaugaucugggcagccacuacuuaucucacuaacaagauuucuaguaaauagaucaggcuauaaaugaagguucucuguucucuagaggccuguccugacuaggaacacucaaaucguugagcuaaaauggcuuguuguucugggaaugguagcauucccucuaaucccaguuuuggggagguugacgcagggagaucgcugugaguucagcuuuuaaaaaaaccaaaaucaaaacaagacacagaaagaguggguugguguuaaauuguuagacaauuauccgacucuaaguucaaugaggaaugaauaaccaugugauuuuguuuuccagucaccaccuucaaaaacuuguugcaaaugaacauuuaccaacaacaagacaaaaacagaaguucugagucaaacucaugagaacuugaggaacuguaauacccugaagaugcagcgaguaaggaccacccgcaccuuuuaacuagucagucuucauccuuacccaggucuuuaaucaauuuuuaagugccaccaaauugaguuguucuagagcagaaaaacaaacaaaaaacccacaaaaaacaagaaaaacaaaacaauuccugggccagcuaucuucccuaaaacguuuaacauauaauuccacuuuguacaagguuucuucuugauacagauuaucaaaaagaaucuuuaacaaauuucuuuuucaagcaacauagcaaauauacaauaaauacauguaacccuuucaggaggcaacuacagaccguccuguggccagucuccuguuucauagcaguuuugacaaauuuaauucucaaggaccccaagaaccccagcgagucacucucugucccuaauuuuauuagauuuaaaacaaaauauacauacagcaaucauguaaaaaguacaaagauuuuacuugccuucaucaauucuuauguaucuaaaccauauuaauuauacuuuuauacagaaagacguuucuguucuaacaaaaggaaaacaaccaacaaccaccucagcccauguguugagucacuccagagaguauuagugagaagguuacgggucagaauaggagcugacguucacucuugccaaggaagcuuucauggugcugccaaccugaagguuucagccuuaagucccauggggcaacaccuaggugacuaagaacacuccuaaccugggcucaggcuggcacugucucaggugggugaguaaacauuugaugacagccccaguggagacuuugaggcuucgauuguuguauaauguaaacaauaugaaauuaaaaauucuucauaacagcuacagcauuauaaaguuaagaaaugagagaauggcugaccauguguuuuccuaggguuuauacuaacagcgcucacacugaguucuguaagaucagcugagacuguucuguguggagaccaguuuucucagaaggccaaaaacuaagccagaugccaagaggcacguuccuaucuaucacuucugagucagccuugcuggcaugugcacaaugcuaaguagaucugcuuccccaggcguuaaccauugaggaaccuuuaucauaauccuguuauagccauggacuauaagcccaaaacacuaucaaaugaaccaguacaacaugucuccucuucuuuucucuguuacccuacuauccccaaaugucacuguaauuuuguaccauguagugauuuuuaagaaauugaaguagaacaaagcaaugccuuuguccccccccccuuuuuauacaguuuuuacacacauuauauauacaacuuuuaaaauagcugcacaauuuuauuucucauugcuagagaagugcaguccaggcagaccaugcuucucaauauauuaaaaauauuaaauaaaacccagccaguuucauacuuucuaagucaagcuggcuagaaauaaagggacuggagaaagaacaggcaguuguaagaugggaccgagccuucuccaucaacacuacauaaacccuugcgauucccuccuauggcaucucuacacgcucaccuuuaagcuggaaguaacacacugcuaacuuagagaagacgcuguggcaacaugcauaugucaacugcccacucaaccaacugcaacccugaggauuuucuggcccaguggaaagaggaaacgcuaugaucacucuguggcagagcugcuucuccaguucucaacuucacgugucuucaggauguuucuugggcaugcacacaugauacuaucacuucaugguucuacuuuccacaaguagaucucuucuccacucuucuucuuuccagaaagucacugucauccauccagagguuuuccaagauaaaccaaagucacuucuguguugccauauacugcagagacagcuggguauaagcaggcuuuuggaaguccucgaaaggcaacccccaggaacucauacccacgcucaaaagcuaaagucuuauccuccauguccaggaugacucggauucucucuccuaucuguaaauagacauuacaagguuagcaggcuauccagcaaaggcauggcuagaagaaaguggauacaaaucaggaaguggaaaacacacagagaaccuguaccuucuugaugaaagaacacacauuauucuccauacacauuuauuuuaacuuuguuucuuuucuuuuuuuuuuuucuuuuugauuuuuucaagaccagguuugccuguguagccuuggcuguccugaaacucaacucuguagggcagacuggcccugaauucagagaucugccugcucugcauccugugugcuggaaugaaaggugugugccuaugauacugugccuggcuuuaaaaaugaacagcaacacugacuguuuaaacugcaaacucauugcauccagcuguucucccauuuuaaaaacugaagcagcaagacugggucaucuuucuaguuugcauccauaaagaaggggugcguuguaugcugaagacugggaaguaggacuggccauggccgcgucugacaggcugcuugcccagcaugcaugacacuccggguucaaccccaagcaccacacaagcugggaauggugcauaguagugauccuagggccuggaugggagguggaaggaggaagauggagguuugagucaucacuggcuacagagugagagcaaagccagcuaagcuacaugagcuccugucuccacagggaggggaaaguaguaaguccuagauuuauaauugagauuuaacacuuccuaauuaugguaacuccugcuguugucaguaacuuuccuucauuuauuuucugucacaaaugaccgccaacaucggcuuuuauccacucuuugcccaacggaaccacuaacaaauucaaucucuuuccaaugccuaucgaacagaugcaaacagaacaaugcuccagcucuaucuaucaggcaccacugcuucuuauccuagaguccuauccucagucucaggggucagcagauuaagaugccacaacuaguccugcugacauucacaaguuugggucaccuuggaaccuacagcacguguauucagaguaaaggaacuggaaagcacaagucuccacggugugggugucaguggguaaaaugcucucuggagacagaggcaggugggucucugaguuugaggcuaccuuugucuacacagcgaauucugagacagccaggguuacauggggcuucucugucucaaaaaagaaaaaaaaaagaaagaaagaaaaagaaaaguggcugggagaacaagcagauaccguggaagggagcaaaagaagagacgagagcgaggauccaaagcugaacacaagcuccacccaagcccacuugagagcacagagaugcuacacaugaaagcuccccgggaaguggacugagcgcagaggcagaagagcagagcugaaagcugccgccgcauaccacaggggcgggaaguuuacagccuugagucccaagguacuugucuucccuuacuagaaaaucugcauggacaaaagaauaaggcaguuucuagaaaaaggaggccugucaggguuguuaauacaucuuacccacacaaccuacuuuuacuucaaaaagaaaaaucacuaggcuaaaauaggaaaaguaugacucucaaaguggugggaaauccaaagagacagacuaccuggaccuaggcuuucuaauuugauaaagaauucaaaguauuuauaguuacucugugugugugcaugugugugaguguguguguguguguguguguguguaacugugaaaugcaguuaagacauucuaaauauguccaaagaauuaaauaaacaagaaaucucaguaagagacauggagacagaaaaagaaaccaaauggaaccaaagcauacaguaaccagaacucaucagccugguucaccagcaaacugagacgguaaaauaaagcuagagcaauagaaacuaugcaaucaaagaagaggaagugccaaacaaccgaggugcacaccuuuaauuccagcacucgggaagcagaggcugguggguaucugugaguuccagcccagccaggaauauauagugagcccugucucaaaaacaaacaaacaaacaaacaaacaaacaaacaacaauaacaaaaagagaaacaaggccugcagaugaggaauaaaagcaucauaaaauacaggacacaaagacacuauuaaguugucuaacaauuauaguauaugcaaaugaacucaagagagagacuguaaaauguuguuaaauaaaaaagacuaaaccaccugcuauugaggggucccauuuuaauaacaggauagaugaaagcaaagggcuggaggaugaucuguaauuguagccuaugaaaaguuggagugacuacauuaaagucagacaauacagacucaaacacaggaauauggcagaguccaaggucauuuauaauggaaaacaauucgagcccuugagucuaugaagcaaaaacugauagaacaaaaagaaaaacagacaagcuagagagcauaguuggagacuuaaguacuuuucucagagaaagaauaagucaaaguauuaacaacacagacgacuuaaauccugucaucuggacuauucgaucuaagaacagaauuuaaguuguuuuuaagcacauauggaacauuuaucaaaagagacaacacguagagaauacaacuaguuuguauguauuucaagacaggacuucuccgguuagcccuagcuaucccagaacuugcuuuguagaccagacuggccuugaacucaagagauccaccugccucugccucccaaguacugggauuaaaggugugugccaccauuaucagcucaacuaguguguauguauauguguauguauauguguauguauauauauauacauauauauauauauaaagauuucuuuauuauuauaucuaaguacauuguagugugguugcugggauuugaacucaggaccuucggaagagcagucagugcuuuuaaccgcugagccaucucuccagccccuuaaccgcugagccaucucuccagcccaaauauauuuuuaaaguggaaauaaaauucaaaaugaccucugaaaacaaggauguaaggauuuccacugcaccugaagguagugauaagacuucauguucaaugauaaaacuacacacuccucucuguaggacauacacagaaccuaaacagacaacaaagaaauuauuuuauaaaagaaaaccucuaagcuuuuacacuucagaaaauggagauauauuuuugccuuuuauauuaguacaccagagcugauaguuuuauuaucauuauuuuuuuauauguacggguguuuuuguugaagguaugucuagccaucacaugcauggcagugccuguggagaaaagugcaucagaucacugggaacuggcguucucuagacuccagguugugagcugccauagauguugggacuugggaccucaggaagagcagcuagugcucuuaaccacugaagcaucuugccagccccuaaaagcauuauugaagcuagagauuugagcuaccugugguuccaaaauauauaaaaucuacauuuccucaagacuuugggggacuuuuuugagacaggguuucucuguguagcccuggcuguccuggaacucacucuguagaccagcuggccucgaacucagaaauccgccugccucugccuccugagugcugggauuaaaggcgugcaccaccaugcccaucgggagaccuuuuuuuaaaagauauuuuuguuuuguuuuguuuuguuuuuuuaaagauacaguuacacucuucuuuaaagguauauuuauuuauuuauuuuuuauuuauaugaguacucuauagcugucuucagacacaccagaagagggcaucagaugcuauuacagaugguugugggccaccaugugguugcugggaacugaacucaggaccucuggaagagcagucauugcucuuaaccacugagucaucucuccagcccaaaaaagauauuuuuaaaauuuguauguauauguguauaucugcaaauguauguucuuuggucuuagaggcccaaaagagagaguguuauccccuagagcuggagauacaagcaguugugggcugcccaaaguaggugauaggagcugaacucuggaaaagcaucaauucaccacugagccaacucucagcccaaguuuuguaaucuuauuuaauuuuuguucuacauucugcugaaucuacaauaauauggcuuuaagacacaauuuugauucuagagucaaauuuuguauaagauauuaagauggaagaauaggggaugcagagguggcucagcaguuauaacacugucugcucagguaguucaauucccagcacucacuuauuggcugucacauaaugucacauaaugccuguaacuacaauucuaggagaucucaguuccucuucuagccucugggacaccagacaugcacagacauaaaugcagacaaaacaucaauacccauaaaauaaaguuuaaaaacaaaguuaagauaugaaaaaaaaaaaaaaaauguagccgcuugccugaacuugucucuagagaaaacacuacuaccuccaaggacgcugaauccgaauucauaagaagcacaguaguagucauguauaugcacaugcaugcauuuguugugauaaggugagcagcaaaaccaaaccaaaccaagccccuggauguuucaugacacagcaaggaugccauccaugccaucgugaacuugaaccaauacacuguacccccuggccuaaugaggucugcuccagcacagcaugcuucuuuacucagucuccacagcugaugugauguuacgccgacagagcugacaguguuucugagacuugucaacagcaaagcccaaaauaguuacucuuuggccuguacagagaaagcuuggcgaccuccucuccagagcaaaggaggauugcucaaauauguauuaagaaauacugacauguaacauucuaucguauauuuuaaaaacugccaaaacaaagacaaaagccucuaguggcacgaacauuaaaucgugcaugcuuuaaacaagcugaggugugaugugagauggcccgugcugaggaagugcccuucucaccugauacuuuggugcguuguugcacugugggaagcugccguugacuuccccguuauguaguagauuauuguccaccagauuccagccccagcucuggucgucacuucccagcaaggccacauaaccuuggcacugcaugggggcccguuucguagcaaucccaaucacugccaccgugcccaaagggcccucccaccacacuucccaggcguggcggcccucacugaaaccaaucuugguccuugcaccaucagugcucugagcgaugggguuccgauguaauguaaaaccauucuucuugauauagacauuccuggagcagucauucgugcugaaggcauguuggaaagcacgcaccuaaaaacacaagaaacagaacagaagaagaagaaacuugauuuguuuuuccuaaauauuaaaaugcagcaaguuuaacgugcuggcucacacuugaucucagaucucaggacccucugugaugcucaaacagggcugaaaauucaaggcuagccugagcuauuuggcaacuaaaccccaucucucuccccugcccgaaaucaaaaaaacaaaacaaaacaaaaacaaaaaaucugaggcuuucuguuaacaaauaagauuauaaacuuuuaaauaacacuauuuccaaauaaugacuaaauuuucuggaugggaaacuaucauuagguauugcacccuguuaaaaauaacucccagcuagcacuaggcaugguaacacauaccuaacuacucuagaucacuuaagccagguuacaaugaacaagggaugcuuguuccuguccaaagaaagaggaaauggggguggggugggagguggguauaggagauuuucagaggggaaacuaggaaaggugauaacauuugaaauguaaauaaagaaaauaucuaauaaaaaaagaaaagaaaaaaaaacaaaaaaaaaagaaggcacuuaguacaauuucuacaaguaaacguaaaacaucaaaauguacacgcaacuaucauugcacuuuacagauauuacuaaaauguuuaugcauaaaauaacuguaaaugguaauugguuugaaacagcuagagggagaauggagcaaacaugaagccagaucuguccugagucaaugguacagcuugguguggacggcauauggaaauucagcacacugcuuucuuuccuuuuauguacacuuaaguaaugcaguuuccauguugucaaugcugugauuaaaaacaagacugauagccuagugugggacaugcuguaaucacugcuggggaagaggcaggaggagcugaaguucaagguuauccauaguuacauaccaaguuugaggccagccuggacuaugucagggcugaggucacuggaaguguucuggcccagcauaugcaagaggaaaauauauguguguguuuuauauuaaauauuauauaaacucucucagcuccuugguuuccucacuagguauuacucacacacugacaucaccacucuuuuuguuccaagccacauccccuacacagcacucaaccaaccagaagccaggcacugugguguaucacuuuaaucccuggaggcaggcaaagguaggcaaaucucugaguucgaggccaaccuggucuacagagugaguucuaggacagccagggcuacacagagaaacucuguugcaaaaaaaaaaaaaaaaaaaaaaaaaaaaaaaaaaagcaaaaaauaaauaaauaaaauaaaacaaauucaaccagaggacuuaaaaggagcagcuaucaagaggauagauuagcuggccuuucauaauuuuuuuuugauauauuuuuuaauuaaaaguguuuuuuaaaaaaaggauuuauuuauuuuauguaugugaguacacuguuacugucuucaggcacaccagaagagggcaucagagcccauuacagaugguugucagucaucaugugguugcugggaauugaacucaggaccucuggaagagcagucagugcuguuaaucgcugagccaucucuccagcacucaugaaguuuuuuaaaaaguuccuaacaugaaaacauuuuaaaaauagcuccuuuguucaaauaaugacaaauucucaucuuuuaaaaauauauaacuaggggccaggcaugguggcacaugccuuuaauucuagcccuugggaggcagaggcugggagaucuguuugaggccuggcugaaacacugaguaaguuccaggaaagccagggcuacacagaagggagaaaauacagauauauguauauguauuuacgcauguguauguggcuggagauaugguucaccaguuaaaagcaccggaugcucuuguagaagaccuaggaauaauucccaauacccugcagaccuaguuccagaggaccuaacagccucuucuggucucuguuggcacugaaugcaugcagaacacccacacauaaaauaaauaaaucugaagggagaaaaguggggggggggggccgaggcuacagaccuaaagggcaacagcaugcaggucacagccauaagagagccagggacccaguuacaauacccagcacuuuccugucucacuguugcugggcuguggaguaaguccuuguuucagguauugcuuccacaaggacaauggacaaacaaagcauucuugaguuuuuuucuauuucuguuuauauauuuuuuaaguuaucuguuggugugguauggugugggcaaucauaaaaguaaacaaggcagaaaaauauccauaaacaaguauuuucuaaaucaaaagaaugacaugaagagggggcuggugagauggcucagugguugagaacaccaacugcucuuccagagguccugaguucaauucccagcaaccacaugguggcucacaccaucuggaaugggaucugaugucucuucuggugugucugaagacagcuacaguguacucacauacauaaaaucaauaaaccauaaaaaaagaaagaaaaagaaugacacgaagagacccgaguccucaggauaguuacauuccuaucuccuuguugccuauuccuacucuuaaaauuccaggugcuuuuuucucucauuuucccuuugccccagugauacuaacaaccucuuccuuaaccuccuacuccagcuuccuauuuugcugaacugacucuaccacauucauuuauagugacucccuuccucugcccccuacaagucuacaaacuccguccuuaaccuuaaacucuuuccagcgcuuucuaaaacaguauuuccauugacucucacgccagcuaaagacuuuugauagcucuacacaaagcacuacagcaacugcuagcuccacuuggcuucagagccuuccagagcaggcugcccgaauuuccuuccgaccugccugcccggcuccuggugcccucgaugcguccucuccuugccuucucuugccaccuccaugaggguauucuuugacaggaccaccccauccccaucaucccucucuccugaauucccauucacuaacaucacacacaaguauaaggaucuuguuuccuaccacaccucuaagcacaugauuuuauuaaaaaguauuuuguaaaaaaacuaccagcuaaucaaccaaccaaccaaccaacuaaacagaaaucuacuguaaucucaauuggucagugcuuuacaguguagcaucuacaggaaccgggaaggagagaagaacaaccggaguaaacauuaaggaacguagaugguaaccaauaagcugaaggagcaggagguggcggaugcaaucaaucuguauacuguauacuaagccuuacaagaccuagagacuccuugucaaaggaacauauacugauuaaauaaacuauaaauuaaacuauaauauuucacauuuaugagacaacuuguauuaagaaauuacugucaguuucauuuuagagaugacaguaguaucaugauuauguuaugggucguuuuuagaacaaauacugaaauauucauaugaaaugaaaaaaauacccaauuaauaaauuuuaaaggccaaguggaccuuuaaucccagaacucaggaggcagaggaaguugggucuuuugaguucgagguuagccuggcuuauggagcaaguuccaggacagccagggcuacgucauaguuuauuucugaagaaccuagauuuuuuuauuucaacagcaugaagaccuagcccagcacacacuucccccuggcccacccucacucuccagaguacccacccuuucucaacaaacugaaauucugcuccuaaaaacaaaaauaaaaaaagcuuagcucaggauauaagucugaaaguuaggguauaauuagauacaaaauaucugggauaagugcuacuuggaaauaaguaaaauugaguuauuaaaaaaaaaaaaaaaggaacguuucagaacugcucagugguuaaaagcagugacugcucuuccaaaggucaugaguucaauucccagcaaccacaugguagcucacaaccaucuguaaugggaucugaugcccucuucugcugugucugaggacagcuacagugacucaucauauauaugaaauaaauaaauaaaaucuaaaaaaaaaaaauuauguagcucaauggcagagugagugcuaagcauagaucaggcuugguuuugggccacagcagggaaggaggagagaaaagguagggaugggaaggaagagaacaaaaugaaucaaccaaacacuucucacccucagccuucgguugcccagacuccuugggaguucugcugcacccaccuucccuaaucccacugggugcccgcagucaccuaugugaaguuguucucugggacagcuccuccaggcgugucuuuccucuacgugcccucugucucucauggccuaaucuuuuuaaagcacaguuuuacuucacuguucuucuggucaaacuuguauggcuuuuccaauugcagaauaaagcccaaagaauauaucaaagacuuucaaaaggccuucuuccauaauauagcuaguucccggacaccuuugcaaucguauuucccuucauucaauccaacuagaaauuccuaucuugagccuagacugccucuaauccuuggcuaccagaagcugccuaucugaaauauggugaauaucucaaaagcacuaugaauucugcucuuccacaagugaacuugcugucauuuuccuucaaacucucccucaagugauacuuagauuauguaagccaaauacuaucuacaagucacccuuagcuccucccuccucagcucuaguucaaaacuacugccaaauucuagucuuuaaaacaaaaaccccaaaaacuguuugaucccgcaaauuucagagaauacauagauaaucccaguaucuuaauauucucugagugaaaaaaaaucaauuuuaauuuaugaugaccuaaaauccuagugccauaucuaaaggcaauaggaggaacagucaucaaauucugcagcuucuauucccuaagcuuguccauuuuucuccaucuccuucacuacauccucucuaauggaucuaccacauuucuaaaaucaaacuccaaccuguucuccauaguggagucaaaacuaacccacaaacuggucaugccaccacuccccaaggccuuuguucuggcuuccaauuggaaaagcuucacuggagugugcgugucccaguccuuucaccuuacucaaaccagauggccuguacacucugcagcugcugacagucuucuuguuucucacacaagccagacucccuccucagaggcucuucuugcuccucuuggaggaacacuuugaggugucacugagcuuacgcaccaugucuuaugaggaagucucuuccugcccuccgcaccuaguuaaaaccuccccuacugacucucagacuagcaugcaacucucauucauaauauuuaccagauacaguuuuacaacuacagugaucagauucauagauauuccuccaggcuggggguguagcuagcauguauucaauccucaguacugaaaacaaacaaacaaacaaaacaaaaagaaacacgggcacgcaggcaggcacacacacaaacaaacacacaugcacuccacuacuuccccauaaggcaaaguguugguaagauuuuuucguuuuuagcugggcggugguggugcacgcuuuuaaucccagcacuugggaggcagaggcaggcggauuucugaguucgaggccagccuggucuacagagugaguuccaggacagccaggacuacacagagaaacccugucuugaaaaaccaaaaaaaaaaaaaaaaaaaaaaaagacuucuagcuuucugaguccuccuaaauuaaucuuccaucuucaaaauagucaccuaaaagaacccaggguaaguaccagccuaucuuguagcugcaguacauauagcagaaaguuaaaugaggcauuagagacuuaaaacuaaaaucucucuggaaauauacaaaacuaauaucaauuuaggcugcaguuaggagugcucccugauuuuccagaguaccagaauucaaucccaguguuggggggguggauauauguugcagggggucacaugcaucuguaacuccagcuacaggaguuggcacucuauucuagacucugugggcacugguauucuucgugugcgugugugugugugugugugugugcgugcgcacccauguguauuuuuaucaaauacaaaaaugcaaauuuuuuugccaggagugguggcacuuuuagacucagaacuugugagcugaauauugugacccugucucagaaaaaaagaaagacuaucugauaauugacauguucaacagcaguguuccuucucuuaucacaccaaaacuuguuuuaauauaaaagaauauaccaguagcugugacccaucuuauaaucccagcacucugaaggaacagacagaaaguuggcaaguuggagaccauccugaacuacacauugagacccugucuccaaaaacagacauaaguguauacacauauuuacaauaauacauguauauuaaaagaaauaguggauuuauuucacauuuaaaaaugacuuagacacucacugucaauuuagcauuaaaaaaagaguguuuaccacauuccaggucagacuuuaucaucucucauuuuauacagcccuggcuguccuagaacucacuaggcagaccaagcuggccuugaacucagagaugcaccugccuguggcgugcagggauuaaaggaaugcaccaucacaccggcuucauaugccuuugaugacugcucuccugaagagcuaccaucuaucuaugugagcuuaacccaaggccuuuuguuuguuuguuugggcuggagaauacuuggucuugccaugaccuguuuguuagcauuuuaauuuuguuaugaaagcacaagaagcgagaacaacaacaacaacaaaaccagcaaaacaggaaucaacauauuagaugccagaagagccaucaccugaguagaacuaugaaaaaguuaucaaucacagcaggacaaggcagugugaugaguuauauggugccaaugagaggaaguaauaguaaagucucuuucuuacaaguuaauuagcaggaugccuagucuuaucaucacuuggaaucgugaaauauuguggcccuaagagaacgugggugaaaauaauguucuuguuaaucagagcuaggaaaagggguagugaacgcaaaagaucccagcaacuagaccuauuuuaaagcgacaucgacgaacuaaugccuuaagucuacuuggaggccagaaaaaauacaugcucaugaguaucggcuggugaucugucuuuaagagcaaagacugucgaaaguagaaagacugcugaaaaugaaugaugggaaaccaccuaguauuuuaaaaagugagguggauuacgaagcagaacuucaauccaaagaaaagaucguuauggagaggaggggugagagugguccugacuggcugaagccgugggaaggcgggaugcugaggugaaaccucugacucaagcuuugaagauaaaccccgagagcggcgggcgggagaggagccgagcuucgacguggccccgggauucccucaccuuggccuuguagcugggcagguugcagaggauguccgugcgcagagccucuucugcuaggcugcgggcgcacaggcuccgccacaccucgcuguucucgucgccguggaggcagcgguaccagugcuugcaaaccagggcgcagcuccgcagcucggacagcuccagguaggagaacaccaacuccagcacccggcugggcaaccggccgccgaccccggaggaccccgagcccgcgcuggcgccgccgccggcaccggcgccgccaccacuagcgccgcccgaggcugccccagcccccgggcccggcgccgccaucgccucaccagccggcccgagggccgccgccgccgccgcuucgccccgucucggcgcgggaggccaagccucgccuacagccgcgagcggcucgcucaccgccccuuucagcgccagccgcucgcgccuccaccgcucccgccccugccccggggcguccgcugcgcgccccgccucacugagggcagauggcgcgagccgcucggguucccgccccucggagccgcucagcgcgggcgccggaaccgcccgccucgcccggccugcccgcgacgcgccccgggauccgccaugcgaguugagggcaagaagcaagggcgcacgcccagcucgcccgccgcgccucuc

SEQ ID NO: 8209 - RNA, 1370 nt, Mus musculus
agaaguaaauggcugcuguauuaaaauucaaaauacuaaaggaaaaaaacaaacaaacaaaaaaagacaauccagguguggucccacacaguugaaaucccagaccuugacaggacaaucaguagcuugaggucaucuucagcuacauagcaagucccaggcucgccuaggcuacaugaggcccuauuuugccucccacccaaagaaaaaaaguuuuauguuauuuacauuuuauuuucauguguacgcguguuuugcuugcuugcauguacaguauguguaguaugugugugcagagucuguagagaccagaagagggugguggagucucuggaacuggacauuggaguuacguugugagcugccauguguucuggaaaagcagagccgccuccgacuguccuggcuuuaucauuguuacaguagugccgccggucugacuccagccucccaagcccuccagcucauccagaaguggacuaauggggauaucucagagauacacacagcaguggaaguauuuccuccucagaggucuucaggguuuauccucucucagaacccaagcuccugauaguuuaagaagcaauaaauuaacucuucuauuacagguaguuucaguguucuccuacgggguauaaaauccaagcuugcuuccugguuuugaaaagucaccauugagcuuaaaaaaaaaaaaaaaaaaaaagacaacaacaaaccucaaucccugggcaucccaaaagcuaaggacaugaaaucccaccaauacccacccaggaaagcucuguguguguacacaaacucaacucuauauaaacccgucuucuugguuuccuacugccuuuugcccaagcagaggcagccacccucuugugucucucccaauaaaauauuuugugucagguuugugguggggugugacuuagugguauuucuuggcuccuacagccaggauaccucuccccucagauauucuauagacgcauuggguaacuucuccccuuagagcuuuaacaauccuccagggcuccaacaucaccccagugcacuggaacaagaaauuccucuugcuuuuugcauugauccuggcuccaugugguucacucaggggguccccgguaaucuauggcucccuggaguuuuacaccuggacuccuuacauuccuggcuuggaaucucuauggagacaaggauggccuagagcucugcaagaucuacuuggcucuacuucaggaacacuagaauuaagugcaugggcuaccacaccuagugcuuuguucauugguuuuuguuuuguuaaccagggguugcuuucagguaccuggugacucaaggaagcugcagacacccucacugaaaagcucacucca

SEQ ID NO: 8210 - RNA, 57199 nt, Mus musculus
gauguguaagaauguccaggggaaaaugaguaaggagguagagguggauaugaucaagauacccgauaaacauauaugaaaccaucaaaguauaaauaaaaacuauccuaaauaacugaaauuggucaggauuucuauuguugucaugaaacaccuuggccauaaagcaaguuggggaggaaaggguuuauuuggcuuauacuucuacauugcuguuaaccacugaaaaaacagggcaggaaccuggaggcaggagcugagguagaggccauggaggggugcuguuaacugguuugcuucccauggugugcuagccugcuugcuuauaaaagcagggaccaccaguccaggcauggcaccgcccauaggcgggcccacuuucacuggucacucacugagaaaauacagcuggaucucauggaggcuuuuccuccccugaggcuccuuuuucucucacgacucuagcuugugucaaguugacacaccagcaaugcaauaaguauuuagaauugugcaaguuacacacuauuaccuuauuuaaaaauaaaguaugaaaacuaagcuaaaugccccuuucuuuuuucuuucuuuuguuuuuuuaaagauuuauuuauuuaaauguaaguacacuguagcugucuucagacauucuagaaaagggcaucagaccucauuacggaugguugugagccaccauguaguugcugggauuugaacugaggaccuugggaagagcagucagugcucucaacugccgagucaucucaucagcccuccuaaugccccuuucaucauguuuuuuuuucgagacagaguuuuucuguguagcccuggcuguccuugucauucuguagaccaagcuggccucaaacucagaaauccgccugccucagucucccaagugcugggauuaaaggaaugugccaccacugcccggcucaucaaguucuuuuuuaguuguaacuauuaucgguguuuucaggaccacuuuccaguguucucuuuauuuuauuuacuguaucugcauauaucuuuguuuaaggauaaaaaacaacuccccccccaaaaaaccucccgauuuaauaucuuuagaaaguaagaaugagccuggggggagauauacugagacauuuguugaagaaaaacagagcgaacaaucauuuacuaaagucuacuauagacugguucauuuuuuacuaagcuauuaacuuacacuuuagaauuuaagaaacgucacauaaaaccaaacaaaauaccuacuuuaugugaaacccugagcguuucaucaagaguuugguauuucaggucugaagauucuuugggauguugggauucaaugcgguacuuaggaggauaucuccggaauucagagaaggcaccaaauguuucaaagaauagcuaccagccagcagcacaggcuucaaaccaaagcggcggcucgcggagaguacgccugcgcaaaacgcgcacagacagggagagggcggagcuucgggccugccagugcgccugcgcacagcacgccgcggagugggggagggagccccgugugugucuguguuguuguuccgcggcggcggcggcggcgguaagauggcugcccacgggggcuccgcggcgucgucggcgcugaagggguuaauccagcaguucaccgccaucaccgguaagagacgcgguuacgggaaggugaagagucggcuacggggaggcugucggggcugucccgggcuucgccucaccuuggugcauuccucacucgggcucuccccucagcuccugcccucuccugaggcacaggcgacgacggcggcggcggccggggucugcgguucaggcgggaggcagguuucccccgcccccaccccgcgcgugccccucagucccuggauucggucuccccuuauucccagacaggccccccacgcccccagccgguccaguacaggggaugggccgagcccgcggugccaggggcccgggaccugcgggccggaggaguagggggccgcacccgggccaccgcccucuuccucccucaucaccuccucucgguaucgugcugcccgcggaccaggcggugcaguccguuccccccaugccauccucucuucccggccaggucaucgucccugucccucggccccggccuacccuuccccucgcugggcccccccggagccuuggcgguggcccugccgugugagggccgucucgcuuuaacggugaggcggguggguucugcugcgccuucacacaucccgggggacuugccgccgggaacaaggggugcggaggggcaccuuagggaccgaggguuucacauaggaauagggggggggggaacccugagcuuagugugugugugaggccuaaaguaauccuggguggccuuucccaccuccucauaauaaaaccaaacaucgagacgauggcgcccgagucuuugcugauaaaauggggauggcggcagaaacuucuugcagagaaaucuguuucuaggugucaguauccgugaaaccuuaggccuagguuucucuuucccuucggaccccgacgaagggcaaacgcagguucucuuacccgccgggaggaaagacuuuaagccauucugugaaugcgcuaugucuuguuucucuccgauggugcugaacuuuuuuugcaugaguuauuagagggcggagcaaaugaugaaguucucuguggagugauuugagagaacaguacuccaugugccugagugugauuuugcuguucuaguuugucauuuugaaaagaggucagaaaguuaguucccccucucaacaggacuauccuuucuuugauaauaauuuguuugaugcggagaauauuucuaguuuguguucuuuuuuucuaguuuguguucuugagucugacguguaagaucuuuauuuuaaccaauacaugcuauuugcaguuuuauaauugaagcuaguuuuauuuuuuguucggcaacgauaauuaaguggcugaugcguuguuuucugucuugucacaugaaauaugucaaagcugguaaaacaagauuuguaauaaaauugaggugaaaaguaagauaacugaaauguuguuaagcuuuguggugggguuauuuuauuuauaauaacauguggauuucccagugccuuaccaaaccaacauuauggaaagaaacuagauuucuguguauacaaguuaauacugcuacauugcuugccuaaaaaaaaaaaaaaaaucuagugagucacacagagaaauauuaaucuuucuuuggauuuuauaaauauaguuuaaggucuuacuauuuaaccuuaggauuuuugggcaaguuacuauuacuuuauuuucaucugugaauuggaaacucaauuguuuuaaucucacauuauuucuucuucuucuucuuuuuuuuuuuuuucuuuucuuuucuuuuuucuuuuuugguuuuuuugagacaggguuucucuguauagcccuggcuguccuggaacucacuuugaaauccaggcuggccucaaacucagaaaucugccugccucugccucccgagugcugggauuaaggcgugccaccaugcccagcucucacauuauuucuuaugcaacauuuucaaaauauauacucaggacccaaaaugccuugaaauaaauuuaauacuaauuuguuugccaguuuagucuauacaucuuguuuuuggccuaguccucuguguugcuggaucagauugaaguucccuguagguaaugauuucugcaaauguacagaagaaaaaaaauccuucagagugauguuuuguggugucuaguuacauauauacaaaauuuacacauauagucauaauaauucaagagguaaaaagauagagcagguaaaaaaaugaaaggcaaacacuauuguguuuauaaaacgauaagggauguuugguggaggugucgucagguguggggaagggggugccuccguggacccagguugaggcaucccuucacccugggggacaagccaguauaguauagaauagaguuuauucagggcauggggaggggaguugagaggguaguagagacagagagagggagagggagggggagagagaggaggaggagaagaguaguagagagggcagccaugagcacauggagaaggugggggcggggggcaaggagaacgagaagagguagaucagaggacagagggagagcaagaaggcaagagggcagagggucagaggggcgagcagccccuuuuauagugagucaagcauaccuggcccuuguaggauggaucuuagacaaaaugcuaagcaccacaguggcacauacuuguaauuucaguacuuguucauggcugcccuccauuguauaaugaguucaagggcagacugggcugcauaagacccuuaagaaaaccaaccaaccaaaaaccaaaaaauagauaaaagguaaccuagcacccaaaaaauaaggauuaauguagacuagaaaaugggggcugccgggugaugguggcgcaccccuuuaaucccagcccuugggaggcagagucaggcagauuucugaguucaaggccacaucaguuugcuaaacugucagacccuaucucaaaaacgacaucucaccugugguggcacaugacuuuaaucccagcacuugggaggcagagcaggcgauuuucugaguucuaggccagccuggucuacaaagugaguuccaggacagccagggcuacaauagagaaacccugucucggaaaaaaaaauggcuuuugcugggugugauggcacaggccuuuaagacaguucaagucagguggugaugguacaugccuuuaacccagcacucaggaaguagaggcaagcagaucucugaguucgagacuacccuggucuacaagagaguuucagaacagccagggcugcauaaugaaauggagaggagggcuggauaauggcuuagugcuuaacugcacuggcugcuguucuagcauucaccuggucacuuauggcuaucuguaacuccaguuccaggggaccugacacguuuuucugaccucugaggaugcuaagcauguauacauguaggcaaaacaaaaacacccauacauacaacuuuugggggguuggguuugggagaagguucuguauacauaguuuugcuguccugaaacaguagaguauguagaccaggcuguuugugaauauuacaaagaucuacgugccucuaccucuauagugcuaggauuaaagccauacccaguccugaaguaaacuuaaaaagcaacaacaaaccuggagacugagaaguguuaagaccuugguagcugcugccguucugaucuuauuguagucauuugcuuguuuauucccaagugcaugcuuaugugaaguugucuagccaagguuuugccuucugcccuugguagaaucugucauucauugugugcugcuauucguccuugguguagguuuuggacaggaguuaacaugccugauuguucucuuuggaguacaucgauugcucgggcaggacuaggccuugugaggucuuuccaaagcauuauguauuuguagguuucccagguccgggauuaggcagcagaaugucaggguuugggagggucauuagcaagugugagagaggcuccuuggcugccccuugagccaucaggucuguuugacuccucuggggucuaucccuuuugauguccaggacaauguauguuggccaguucuuugguagucagagggcagccaggagguauaagauuucugguuuauuuuuguuuuuccuucagcaguuuaacaguccccuuucaugguguauugcucugugaacaugugcacuggcaaaugcguauagacugucaguguagauauuaaccccuuugccauugcacaauuugagugccucaagugagggcgaucaguucugcuuuuugggcugagaucucacucaggaggagagacacccauaauguuggguccagguccauuacugcugucccugcauacuugaugccauccuccuuguagguguuuuugugucgguuuacauggugcaauuuuccuuggacuaggguugaucagucaggucuggucaggguccaugaacaagguuuccaaagcauuauguauuuguagguuucccagguuggauuaggcagcagaaugucaggguucggagaggugcuaggagcaaaggacauucggacaaagacugauagugagucagccuagcacuugaaauacauugaugaaggggccuuuuaauaaggacucuuuuuauggccugagggguaguuauggucagaggcugcauuaggguuaguuuaucuacauuccuuggucagcugagcaguggcugcuuugagucucaaguaguuaagccauccugcugucacugaauucagcuguuuagacaggcaggccacuagucaucaccaagggcccagguuuuaggucagcuugccccuggcaaugcccuggcucuuuuccacaaauaaguggaaaggcuuggucagaucagacaaggccagggcaggggcagacacuagugcugauuuuuaagucacugaaagcucucucuugggacuggagagauggcucagugguuaagaguacugacugcucuuccagagguccugaguucaaauccuagcaaccacaugguggcucacaaccaucuguaaugggaucugaugcccucuucugagugucacugcagauagcuacaguguacuuacauauaauaagucuuuuuuuuuuuuaaagauuuauuuauuuauuauauguaaguacacuguagcuguuuucaggaacuccagaagagggugucacaucucauuacagaugguugugagccaccaccaugugguugcugggauuugaaccacucaggaucuucagaauagcagucagugcucuuaaccucugagccaucucuccaacccauaauaagucuuuuuuguuuguuuguuuguuuuucgagacaggguuucucuguauagcccuggcuguccuggaacucacuuuguagaccaggcuggccucgaacucagaaauccgccugccucugccuccugagugcugggauuaaaggcaugcaccaucacgcccagcuuauaauaagucuuuaaaaaaaaaaaaagcucucuuacuuucuucuauccacacacaaaaguacccuugcugacuucauagagcagccuggccauauuggcaaagcugauccagagucuucagaagucagucgacucuuaagaauucucacucauacuugguaccaggucuuaagugguuuaagaugguuucuuaauauuuaagaugguuucuuaauggauccaagaaagacugacaacccccacuucucuuugaguuggaagcccaaguaggucacuucaaggacacagauuugaaccuucuuggcugagaccauguauccuaauuucuguaagguacauaggagggcuuugguugccuucauacaacaguuuguauuagugacagccaagaguaggucauccguauuuugaaguaaugagauauguggcauagucagcugguacuggggccaauuucuauuccuauuuucuuuuagaugauauuaaacuguauuuuagaacauuguauaagaaaaaguugcugaccaggcagugguggcacaccuuuaaucccagcacuugggaggcagaggcagguggauuucuuaguucaaggacagccagcgcuaugcagagaaucccugucuugaaaaaagaaaagaaaaaguugcugugcucuagauaauaaaugaaccccccuggaauuucaauaacuaguucaaaaaaugguaacaaaguuugacaaaaaaaaaaaaaagaagaagaagaaaggaaggaaggaaggaaggaaggaaggaagaaagaaagaaagaaagaaagaaagaaagaaagaaagaaagaaagaggaaggaaagggggaaggaagggggaaaggggaaggaagggggaagggaaagaaggggggaagggggaaaagacagaggggagaagacaggggaaaagacaagaggggaaaagacagaggggaaaagaaaagggaagaaaaaaagggaagaaaagggaaagaaaaggugcuaagugugguguucaaggccauuaauccugucacuugggaggcugaggcaccaggucugaguagcaggccagccaggguuacaggaugacaccuuguuuccaaaacaaaaaagaaaccaaccaaccaacaaaaaggcuaaugugaaaacacuagggauagagacuucagagaagacuuuucuauuugaaaccuggaagagagccucuaacauguguagaggcuugguggugaagaggguaagccaugcagugagagaagagaaaguagguguauggaauuggugagaauuccaaaugaauaaggcaguuaaaagagggcuagagagauagcucaguggguaagagcacugacugcucuuccaaagguccugaguucaaaucccagcaaccacaugguggcucauccauaaugagaucugaugcccucuucuagugugucugaagacagccaguguacucauaauauaaauaaauaaaucuuugggccuaagugagcaggguugaccugagcgagcagagguccuaaauucaauucccaacaaacacaugaaggcucacaaccuucuguauagcuacauuuuacucauauauauauauauauauauauauauauauauauauauauauauauauauaaucuuuaaaauuuauuuaaaaaauuuagguaguuaaaagagcccuuaggggaucuuggcuuuauuauguguuugggcuuuuaaaagaaagagcuucuuagcuauaguggagaagagauaugcuacauacccguugcuuuaauacaagaaauguucuauuuaagggagcagagaaaaguaaacuuuaaaagauacaggaaagacaguggcugauguuaaugcaugccuuuaauccuagcacucaggaggcagaagccaguggaucuaucuaugaguuugaggacagccugaucuauagaaugaguuccaggacagcuagggcuacacagagaaauccuguuuagaaaaaaaauacagaaagaaaucugaggagucacaauuuaguuuaagaucugauuuggacaucuagauguauaacaguacuguuugugacgauacaacauuguagaauagguuugggaagaggauuagcuucaguuuuuggauaagugugggcugcuaauugguguuacuaauagagcuguuaaguaagucagugaauacuugggccuguagagaagacaaaucuggggcuagagagaugacucagagguuaagaguaccgacuguccuuccagagguccugaguucaauucucagcaaccacauaguggcucacaaccaucuauaaugagauuugauguccucuucuggugugucugaaagaaagggacaguguacuacuuauauacauaaaauaaauaaaauuugggaaaaaaaaaacaaaaggaaaaaaagaagacagaugugggccgggcagugguggcacuugccuuuaaucccagcauuugggaggcaggggcaggggcaggggggcagggggccugaggggcaggggcagaggggcagggggccugaggggcaggggcagaggggcagaggggcaggggcagaggcaggcagauuucugaguucgaagccaaccuggucuucaaagugagucccaagacagccagggcuucacagagaacccugucucgaaaagaucugucauauuaguggcugauaaggguauuauaaaagugacauuuuaaaggauagagcaguauguggaaaugugguuucuauggcauaaagcugaagcaaaaacaaggggaaacuaucaaauaaguguagagaagacuaaaccagagauguaggaaaaaagucaggagaguaaugacacuagacauuacaaguguggugguaucucagauaucagauaagcacugcaggaagucagaacucuauauauagaguugugcuugaaaugggcagcaugcuuguaaucccagcauuggggagggcugaaguagggaaauugcugcuuguuuguagcuacuugugguucaguaccuaguaccaggccagccaggauuagguagugaaaaugaccagagggaacagagguugggagauagcuuauuugugaaagcacuuguugcaaaagcaugaguuccauccuuagcaccuagaacuuaggaaaaaaaaugucagcauguuuguuauccuaggucuggggagacagggacuggcaaagaucccuggggcauacuggccaaccagcucccccacccccccaucccaagcuaaaugaggugugcagugagagucccaguuucaaacaauaaagcaaguggauacccacugaagagcaaaaccucaaguugaccucuggccuccacacacacaaaugaguacacacauucauaucccucuuuuuuucucacuagagaagaaggaaaaucuuuggugguuguggugguagucuggaagaucuuggaaaaucuugaucuauuuucuagguuauauaacuaagaaacuguuucagagaaguaaauugacuuggguuauauaugucuagaucaguuuuaaggcgauuucauuacuuugcacaggcugaccuugaacuuuuuaauguaauugaggcuggcuucaaacuuagaaucuuccugccuuagccucuuagccugagggauggcauggugguggaagucuacauuaacgauaaauccuggauacucuugcuuuuaaauuuuaguccaggaccccaccccauggcaugguacuaggacaugucuucuguucucagagcagccucucucgaaaugcuaucaaagauacuuagaaguguaucuccuaggugauucugaaucuagccaaauuagcaaugaagaacaaccaucacaaccuuauacaaaucucuacaggcguauuuauuggauauuuacaugaauaaauauaagaugcugccaaauuguuucccaaaaccugcugugccauuuaacauucugcugagcaguucaggagaguuccaguucucugcauuuuugugagugccaugugggugcuuggaauugaaccuggguguucuggaagaacagccagugcucuuaaccucugagcuaucucuccagcuccuucucuuuauucuugugagcacuugguauuuuagacugucuuucuuuaaagcccuuucuuaaguguguaauaaaguguaauauaguuguggauuuaauuuacauuuccccagugauuauuguuacaggcauuuuuauauacaguaauauuuaccauucauaaaacacucaugucucaacuuuuguuagauucaaaugacaguguuacuuugucaggcaguaaggcucucucagcaaguguguacuuuggguagcuguggucaagguaauggcagaaaauuuccuuauucuuuguuuccuugguauuuaccaucuagucacuggcauguugcuccuuagugcaguguaggauuggcuuuuucuaguuugauuuaauuguucucuucccuauacuuacuaaguaguuuugauguauacuuuuuaaaaauaaauaaauaaauaaauaaauccauuuuuauuuguuuacuuuuuauuaguuuaaaucugggagggcuacagcaucacacaaauucuuuguccaguggccuuugcaagaagauuacuugagaauguagcaggaaccuuccacuguuucaugggccugaguuaccuuucccccagauuacucugguuuuguuugguuugccuucagaauucacuguuguuuuuguuuuauaauaagagcauaucucuuguccaaguagaacucaguuucaucucagacugaaacaucuucaauuuaagaauucuguguuugggcuggugagaugacucagcaaguaaagagcacugacugcucuucugaagguccugaguucaaaucccagcaaccacaugguggcucaugaccaccuguauugagaucugacgcccucuucuugugugucagaagacagcuacaguguacuuauuuauaaaaaaaaaagaaaagaugugccauucauauuaaaaaaaaauucuguguucucuuugguucucaagacuucacuuaauagcuagcuuucuagacaaauuuuccauuuagaaauccuguuccuagcaacauucacaggcaccaagauggaggaaagagcuggcauauacauuuuacaaaauguuuuaguugauauggugauguuaucuauaaucuagaacucuggaguccgaguuaaaagcuagccuggacuauauaaugggaccuugucuuaaaauaaaacaacaaaaaaguaaacaaaagguuuauacuaaaguugucccucaauagaggaauggauacagaaaaugugguacauuuacacaauggaguacuacucagcuauuaaaaacaaugaauuuauuaaauuuuugggcaaauggauguaucuggaggauaucauccugagugagguaacccaagaagucacuugauaugcacucacugauaaguggauauuagcccagaaacuuagaauacccaagauacaauuugcaaaacacaagaaaaucaagaagaaggaaaaccaacguguggauacuucauuccuccuuagaauacggaacaaaauacccauggaaggaguuacagagacaaaguuuggagcuaagacgaaaggaccauccagagacuaccccaccaaacccagacacuauugcauaugccagcaagauaaugcugaaaggacccuaauauagcugucuugugugaggcuaugccagugccuggcaaauacagaaguggaugcucacagucaucuauuggauggaacacagggcccucaauggaggagcuagagaaaguacccaaggagcugaaggggucugcaacccuauagguggaacaauaauaugaacuaaccaguacccccagagcucgugucucuagcugcauauguaucagaagauggccuagucggccaucauuggaaagagaagcccaucggucuugcaaacuuuauaugccucaguacaggggaacgccagggccaagaagugggaguggguggguaggggaguggggggaggguaugggggacuuucaggauagcauuugaaauguaaauaaagaaaauaucuaauaaaaaaaaagacuggugagguuuuaauuguuaagaucucaguuuuucacaaugauugcccacucacauuugcacugguaaauagucuggcuuaccuuuucuuuuuucuguuuuuuaaccuuugcugggguaaacuugaaaccaaaaauuaaccucuguagccaaguggugguguacaucuuuaauuccaguagggaggcagaagcagggagaucugaguuuaaagcuagccuggucuacaaaguguuggaagaaggacuacacagagaaacucuugucucaacaaaacaaaacaaaaugguagccuuuucuguaugccuuuugguuuuguuaaaaaaaaaguuuguuauuaauccucaaaugcucuuuuuuuccuuuaccucuugagagcugggauuauggaugugaaccacuauguuccacaguuuucuguuuucuucuuuaauauuguuacacuuugguuucucaaugauaguuaaguccuuguauugauaucaaaaguaauacagcaaauuggcauaaggacuguauauauauuuggaguaguacuugauuuugccggcugugguggagacaugaacuguacagguguggaguuguuucugcauugauggaaaaggggagaaacuaagagauagcaagcaucaaagaagucacuucucauaaauugugugucccaggcuagguuaagcaaugcccuguuucacuauuagcaacccuaaaacauuggaaggaaaugucacauguggcaacaagcuguaggauauaacuuguacccuagauuauagaucccugggugcuauuuugcugcuguuuauaauacuaggaucucagacaaauguaaacacguuuauagguguuuuaaaauucucaaguuuauuuuauuaaucucaucaaaaucaaaaaguaugauuuuuguguuaacaauagagucuuaauuuuuagagcagcuccaccaaaaauuguuauuggggcuagaaacugaaaauuucauaaaguuuguuaaccuuuaucacauagccuccuacuuucuucacuguuccuuuuuuguuuguuuguuuguuuaaagauuuauuuauuuuauguauauaacuacacuguagcugucuucagacacagaagagggcauugggucccauuacagaugguugugagccaccaugugugugcugagaauugaacucagaaccucuggaagagcagucagugcuuuuaaucucugagccaucucuccagcccuucacugucccuuuucaauuaacccuuacucccuccuauuauuuaggaaggagaugucuuuuaggauuugagguaugaauuucuagugguguggaacuguugaaucuauuacaaaagacuuacucuuguguuacuaguuuccuuugaguaacaacauacugcagauuucaguauuuuaaaaugguuuaacacaccuuuauuuuuauaguuguugagaauuaaagccuaaaaugaagguguauguggugauuuggggagugguuuuucagucuguuauaacagcccagcuucucuacaauaaaugacaguauacugccucuuacuuaccaaaaauggccuuccauauguuuguuagauaugguagcucauaccugugauccugugguguucagagugaguuccaguucagucagaacuacauggaaaaauggacucaagucaggacucaaggaaacaaacaaacaaacaaacaaacaacaaaaagccaaguguaguggagcauacucagcaugccaugccagugcuggggagguaggggcaggagaaaucuuugguuuugcugguacuuccugucauuucuguucagagaucaaauguacuuaguucucugccucucugagucagcagguuuucaccagucaucugacuccugagucuucauugguaaacucaaaugguugggauuuuuguuuuuaaaacacucauacacauaaaauuaaaauaaauucaucuaguuuuuaaaaagagaaaaaauguacaugagggcaugggguacaguuuaauaucagagcacuaguuuagcauguaugaaguccuacauuugaaagcugacuuuccuacuccacagaagacccagaaggaaagagcucuuucuccuccuccaugcugucuuagauaccuuuaacuuaaaggcccuccuuccuguuuaguuguucauucccuaucagcugguugcuugcucuugacguaugguugacuuuauuuagcucuggauuaaagcuaugugcuaaagcugagccacaccacaauuccuuguuacaguaaacaaaaagcucuaggaucaaaggcugagccacaauuagaaacagauccuuacaguucacagucucaggguuuacaaugugaucaaauauccagcaacauaugaguguuggucugaauguauuacugugcauuacaugcaagcuuggugccuguggaggucagaagagagcauuagaacccccuagaacuagaguuaggauggucauaagccacaugugggagcagagaacugaacccaggucuucuacaagagcaagugcuuuuaaccaugagucaucucuccagccccucauaaugcauuuuuuagaaauucacaauagcacuucaugaaguugguagcauuuccaucuuauaacuaggagaacuaaagcuuagagaaauuaguaaguuuccuaaucauacaaccagugaagaauaugauuaugauuuagaaccaaguuuaucugaggaguuucccagcccuuuuuguguguuauacauuccuuugccuauguacagaaaggaauauguagaauguuuucccauuauuauuggguauagaaacuagacaugcaguuuuuagagguuguaacuuuguuuuguuuuggguuucucuguauagccaugucugucuugaaacuuggcugaauugguguauaaauaaaagauugagccacaccacaauuccuuguuuacaguaaacaaaaagcucugggaucaaagauugagccacaauuagaauagaccagaaucuacagagauccucccgccucugucuccagagugcuggaguuaaaggcaugugccaccacuacccagccugauucuaacuuuuauaccucuuuauccccaggcacuuuaguuucuuuuuuguuugcugccaggguuuaaacuuuuccacgaauuaaacuuccuccuccuuacaaacuuuuuaugauagauuuauuuuauguacaugaguguuuugccuccuugcauguauguuugugugugugcucugcguguuugccuugugcuuucagaaucagaagguaucugauuccuggaacuggaauugcacagauaguugggagcugacuuaaggaugcugagaacucaggcccucuguucuuaauugcugggcuccuuucuagaccuggugacuucuuuuaauuugacaauuuuuuuguuguuguuuuuuugguuuugguauuuugagacaggguuucucuauguagcagaguccugauuguccugcacuugcuuuguagaccaggcuggccuugaauucacagaaauccaucugccuuugcuuccuaaguucugggauuaaaaggccaugcccaauuugacaaaauuuuuuacaagacccuagguacauagguacauaaagucauacacagugaaauauuuagcuaguaaaucaaauuuauauugagacaaauaucuauauaaaucgaggcugaccuugaaucuguuauaugagaaugugaccuugaauuucugaucuuccugccucuaccuuccagugcugggguccagguuuguaucacugucuuaguuccuuuucuauugcuauaaugagauaccaugaccugcuaaggaccagccucagcuuggagagggguucugaggaagggguauacucuccagauagcucaucucuugcaaaucaaaagcucagucuuuuauuuaccaauucagccauuaccccagguucccucuuuuuuuuuuuaaauuuuuuauuagauauuuucuucauuuacauuucaaaugcuaucccaaaaguccccuauacccuccccccaccaugcuucccuacccacucacucccauuucuugggccuggcuuuccccuauauuagagcauauauaguuugcuagaccaaggggccucucuucccaaugaugggccaacuaggccaucuucugcuacauaugcagcuugagacacgaguucuggggguacugguuaguucauauuguuuuucuuuuaagauuuauuuauuuauuauauguaaguacacuguagcugucuucagauacuccagaagagggugccagaucuuguugguugugagccaccaugugguugcugggauuugaacucaggaccucuggaagagcagucagugcucuuaaccgcugagccaucucuccagccccauauuguuguuccaccccuucagcuccuugggugcuuucucuagcuccuccauugggggcccuguguuucauccuauagaugacugugagcauccacuucuguauuugccaggcacuggcaaagccucacaggagacagcuauaucaggguccuuucagcaaaaucuugcugguguaugccauagugucugcauuugguggcugauuaugggauggacccccggguggggcagucucuggaugguccuccauccugucgucuuagcuccaaacuuugucucugcaacuccuuccauggauauuuuauucccuauucuagggaggaaugaaguauccaugaguuggucuuccuucuugauuuucuuguguuuuggaaguuguaucuuggguauucuagguuucugggcuaauauccacucccagguucccucuugaucaucccaucauucagcaucccaugaccccagcuccuuuauucuuaggaagagacaccaagcucaagcauaagcacagaaaauaagauagcuggguggaaccccucccugaaaagaccauucuuaugaugccugggccuggacccaaacucccucuguccuaggcugaccuuaaacucaggaaucugccugucuuuguaagcauaaacaaaaaaucuuagcuaaugaguccuuaccuuucaaucaccgcuccuuaaaucucuuuacuucuuccuuaguaucuuucugacaagcucgcucauagugcagcugccuguguuccuuauacaaaucauauugagcccuuauauuuugcauaguugagaaauuacauauuuuuugaacucauguuuuuagcauucuuucccacaaccuuaaggacuguccugaaggucacagaguucucaauuuugcugagcuauuagacacacccucaccucacagacuccugcugucucugauuaucauggauacucagagggcauuugaaacuuauaaguucauuuccaguggcauaucuccuaauccuucccaaaaaguuguaccaacuggagaccagguuugcaaauauaugauccaaugacgaaugcucucauucaaaccaucacaugcccauguuuuguguggugccagguaucaaacucagggcuuagugccuacuggguaagcaccccuauguccucacacuaauaauuuuaauuacuauuacauauuauuuauuuauuguugagacugcacagccuugacuagccuacaacucagucacuauguagaccagguucaucucuaacucagggcucagguuaaaaguaugcaacaccuuccugaucuuuuugugucuguguugaagcggguuggaggcagggggaguugguguuacuuacaugcaguguguuuauagaggucaggugauaauuuucaagaauugguuuauccuuccacuguggguuauaggaaucuaacucagguuauuaggcugguuugacaaguacuuuuauacacugagacaucuugcugagccaagauacuuauuuuaaagcaauucuuuggcauacauauaauuuuuccauucauuaaauaugaaagcagauuuguauaaugauaugcuuaguuuuuacauaaauaagucuuagauggauacuuaauacuauagaauauaaaccaucuucagagcuuuucagaguugguuaguauuuugauucuguaaucaauacugacagugcugccucacaauauaucaugauggcagaaguaugaauagugccacuuuagaaauuauuagaaauuuuauccuaaucucaggccaguuguuuugggagauaggcaguccacagaguuuaggcauguuuuagggucggcccauuuugguuuuguuugucuauuauuugagacaagcucuagcucaggguuucuuuaaauuuuauaauccuuaaucugccucccaaauguugggauuacagguauaugccaccaugccuugcucacacugucuuauuuuauccagaaucuacaauuagagugucauuggcauucugguaggaggagauugugggaagguggcaguaaaaauucauaagcaguggucauuugucauuugaacguuuuccccaucuccuuccuauuugaauggauuggauuuugugguuuagguugauccugccuuagccuccuggcuaagguagaucucauauaucuuauaugcacaucaagagagauuaugauuuuuuuugaaaaggaaauagaaaagaaugacauguuaauuauucugcuauauaaaaaaauguaucaaggguacuggugagaugguuuugcuguaucuguuuugugacuucucuuggauauccuauuguugcccaaugucauggagauccugcaguuuugaaucugcagcccgacccuuucauacacuucagcagaucauacaugagguagauguuggguaggccuaggaggcaggugaguuggucagucugccagcuuuccaauguccucuggcuucuguugcuacacuaggguaaugagcucuccagcacugcccuggcuagcucacccagugcagcagcugacaaaggacaggguccucuuuccugcucuugggacagcuuaccuguuccucuucaugcacaccagcucagcacaguaucucaggcagcagucaaaaccagggacauuugccuggcuuuggcaguaacaugggccuggcacaucaacacagaccccugcugccacaggccuacacauugcuccagacauggcccaggcagcaaagugggccgugaugucccuacccucagaaugaccuccucauguucaccuuuuccucaccgucacugagccuccaguucugccuuccuccauaguguaugaacccucugcuuuguuuucucuuccguuucucccaucucuccaccacacacuuacccauuauaguggggcguacccauggcaggugcuugugugcuuucuucccaccucaggaauuucuugguacuuguaaaauugguuuuuuaaagaggauuaccaaguuacauuucauucaacagauuaugcuggcuuuauuuacaaaugauuguuuggacuaguuuuaaauaacaaagauugccauuucuuaccagauacuuauauuuuagacaaaacugucuugguuuacuucucuugguuugauaauaaaaauguguucugaguuugagcccuaaccuagcuccuccuuaaaaacuuuuugaauagauaaaaaaauuguuaaugcauucuuucuaacagaagguauuucuaacuuuuuagaauguaaaguuuaauuuuuccuuaucccuuuuuaguuuauuauuacugacauaauauaguucaucucucuuuuuuuuuuuccuguuuuugguuguuuuguuuuauuuuguuuugauggcacaguuucuuuguauaguaguccuugguuauccuggaacuugcucuguagaccagguuggccuugaacucagauauuugccuaccucugacuccuaccaacuuacaucuaccagcuuacaucucuaucucccucccucccuccucacccccuucucuccaggguuuauaguauaguuucaggcuggccuugaacacuuggagacccaccugccucugagucccaagugcuuguaugaaucacuacaccuaauaauucaaccauuuaaagaaauugcaaauagaacugaggagauguaaacaugaugacuugaguucaaauccuccuauguugaaaugagaggcuagagaauccccugaaaguuugcuagguagcuagcccagcauacauaguggcagcuaagagacugucucugacaaaguagaaggaagaacaguaccagauguaguccuuugaccuuggugcaugugucuugguacacucacauguauauacaugcacauccauacacauaugaaaagaaauggcaaauagccagguguggugccaguagcccauucuuguaggccuaguauuugaggcagaggcaggaggauuucugaguugaacacuagacugagguaauacaaugugagacuugucuaaaacaaacaaacaaaacaacaaaaaaaaaucugcugggcagugguggcacaugccuuuaaucacagcacuugggaggcagaggcagguggauuucugaguucgaggccagccuggucuacagagugccaggacagccagggcuauacagagaaacccugucuugaaaaaacaaaacaaaacaaaaaaaacccaaacaagcaaaaaucugcauauacacuaaaaaggaaggaaaaaaaaugucaaacauuugauuuucuugugauuguggaaggguauccuuuugccaugcuauugcgguuucuuucuaguucuuuauauuuuuaccagucagccagcaggacagaaggaaacuccuacugugagucauuuuuauggggggagggggagaggacuguuaauuuguuugggaauucuaugucuuaaugugagcuugaaucuaagaugucauuuuaaacuuucuuuucuguuccuuugcuguuccaggugcaagugaaaguguaggaaaacauaugcuugaagcuuguaacaacaaccuggagauggcugucacuauguuuuuggauggaggaggaauugcugaggagccuaguaccaguucagcaagcgucucuacugucagaccacacacagaguaugaauuuauuauuuauuguagcacuuacucauuugccuaaauuaacuagcugcauuuuuaucaggguuaggucaauuuucuaguuuugaagauuuuaaagguugaaagccucugaaaauuuucuguggaagauuuuguguuuaauauaccuuaaauucucuagagaacuguccuugucuacuugaucuucucuucuauucaguccuaaaaagaacuguggguuagaggcaggcagcaggcaggcaggcagagugcaugguacaacugcucgguuguaauuggccugagauugggguuuauguguuccacaaccaccagauauacaacaaaaauauuuuuuuagcuugggguuuagcucauuuguagaguguuugcuuggcauucaagagguucugggcuaaaucuccaauacuggguaaaaaccagacuaagugacaccugcuuguaaucauagcuuaggagguagagaugugaggagcugugguucgugguaaauugaagccauacugggauaaacaagaauauuuuuuaaaaagagagaacuuuauagauuggcauuauuauuuugccuaugaggaaacuagagcauggccauuuuuuccuaagcuauauagcaguuaaaaagcagauauagggggcuggagagauggcucagcgguaaggaguacugacuauucuucaaaaggacccugguucaucaauucccaguauccacauggcagcucacaacugcuuccaagaucugacaaccucacauagacauauugaggcaaaaacaaacaaacaaacaaaaaaaaacccauagcaauguucauaaaauaaauaauuaaaaaagcagauacagacuaauaaggcucacauuuccagauauagauuuuccuauauuuucucaggaaagugaauuaccuugaaauauuuucaagaacuaaggcugaagauauagcuaaguaguagauuguaugaauaacaugcaugguaccugaguuuuaagguguaacacugaaauguaacuguguauaaacaauuguguauaaacaaaauucuuuuaaauaguuaccugccuuaucacuaaaggcauccucaguauucauuucugagccauuuauauuugauuaguuagaguuugcaauaaauaacucucaggcaaaaaagcucaucagccuuugggaaguauuagugcugagccuugcugcagugcuaucagcaugggccacgccgcucagaugcucauuggcuuuuuguuuuugagauaccauugcuguguagccuaggcuggccaugaauucauaaccuuccugugaauuaggauucuggugugaccauaauuucuggcuaagccauuaguuuuaacaauaacaacaacaaauacacaaccuuuuaaagaggccagggcuuugugacuuuagucccauaacucaggaggcaacggccaaaaagaucuguaugaguuccaggucagccuggucuacauagugagacccugucuguaaaaaccaaacuaaccucccccaauccccccaaaaaaacccuuaauuuuaaaaguccuuaaguaagacucuaauaugcuuagucauuuguaauucucauaauuuaugagauacuaaacaagaggaaacacuuuaaauagaacaggcaaagggccaaggguuuacuuuauuuuauuaaaucauuuauuuauuuuaauacguauugguguuuugccagcauguaugucuauaugagggugucagaucccuggguacaggaguuauagaugcugugagcugccuugugggugcuggguauugaacccaguuccuguggaagagcagccagugcucuuaaccgcugaaccaucuuucagccucuauagaguuucauuuuuuauuaaauuagauguaaauuaaaaccaggucauuggggcuagagagauggcucaguaggagcauggacugcucuuccagagguccugaguucaauucccagcaaccacaugguggcucacaaccaucuguaaugggaucugaugcccucuucuggugucugaagauagcuacaguguacucauauaaauaaacaaaaucuuaaaaaaacaaaacaagaauuaguugguuguuuugaacuuugguuguuguuguuuuuuuuuccuuucuuuuuucgagacaggguuuaucuguguagcccuggcuguccuggaacucacuuuguagaucuguagaccaagcuggccagaauucagaaaucugccugccucugccucccaaaugcugggauaaaaggcaugcaccaccacgcccggcuuuguuuuuuguuuucuauuaaccauuuaucucaaguguaaucccauuccccaucauggcucaaaguuuuaauagaaaucaauauugagccagaugagauguuaaacaucuuuaaguacucuggaggcagauaagaggaucucuaaauuccugggucauucuuuuuguuuauuugguuuuugguuuuguuuuguuuguaagauaagaguuucuuuguauaaccuuggcuguccuagaacuugcuauguagaccaggcuggcuuugaacucauggugaucugucugccucugccucccaguuccugggauuaaaggcuuugugccaccaccauccagcuuuccuggauccuucuugaucacauagcacauuccaggcuaguaugucccaguaaaucaauaaugcugaagaauuauauaguugguagaaacuucaauaauagauauuuacauucgauuuaggggaccauauacacauuuuuucaaaacauacacauacaaacacacauacauauauauauacacauucaaacaauuguaucuaaaacaguacuuguuuuuguuuugagacugggccguacugccuagcuugaacucacuguguagaccagguuggucucaaacucagaucugccuguuugucucccagugcuaaaauuaaaggugugggccaccaugacuagcagcaauuugccuuuuuuuuccuuaaugacuuacagcucuucgugugccucuguguguguguguaugugugugugagugugugugugugugugugugugugugugugagugugaugaaacccagggcguaaucauugcucuaucaucaaguuaaauccuagccccacagcauuuauuuuuugagcuuauuuuuaucuauuuguugucuaagcuagucucaaacucauaagccccagacauuguuuugacucagcuuauaaguagcaaauuguccccacaaaugaauaccuucucuagcuaguuacaucaugauuuggguagauuguuuauauacuaacugauaaacauuuacuaguagcuccuaauuccuuaacuagaacuucccuuccaauucaccuucuucuguugucuuuaacucauuguaguuaacauuggcaaauaucuucagauauacaauaauucuuaccucauaggggcuuuuuuuuuuuuuuuaaauuguguaggugugugcuuguccuuauacucaggagugugaguacucauggaagccaagagauugucagaucucuuggagcuagaguugcagguguuugcgagccaccugauauuuguguuuauaauccuuuuuuauuucacuauuauguauuuggguauaugggugccauaucuguuaugggaagaucagagaacaacuugagggagucaguucucuccuuccaaaaguuggucuaggaauccaauaaguuggucaggccuugguggcaagugucuucccuacagagucauccuguuggccuauaugcuuagaagucuuacaaguuacugguuuucuaugacaguuaagcccaagaauauucagcacuuuuuuaaaaaaacauuuauuuauuauuauauguaaguacgcuguagcucucuucagacacaccagaagagcaucagaucucauuacagaugguugugagccaccaugugagugcuaggauuugaacucaggaccuccggaagagcaguuggcacucuuaacugcugagccaucucuccagccccuauucagugcuuuuaauauuugauuacaacuuuaaauaaacugauuguuuugguuugguuugguuuuuuucaagacaagguuucucuguguugcucuggcuguccuggaacucacucuguagaccaggcuggccucagaaauccaccugccucugcuucccaagcacugggauuaaaggcgugugccaccacuaccccgcuaaauaaacuaguuuuaaagauaacauaccauuuaguuuuuguuuuuucaagacagggucucuuugcauaauccucacuguccuggaacucacuaugcagaccaagcaggccucaaacuuacagagauccaccugucucuucuuuccaauaacugguaauaaaggcauaugccaccaugcccagaucccauuuauuuguguuuuuaauuuuuuuaugcauauaaauguuuccccccuucauguaugucugugcaucaucuguauaccuggugccaugaaggccagaauaggccauuggauccccugggaaugaagguagagauuucuaugagcuaccguaucagugcugggaagaacagugauuacacugugauuacuuuuuuuuuuuuuuuuuugguuuuucgagacaggguuucucuguauagcccuggcuguccuguaacucacuuuguagaccaggcuggccucaaacucagaaauucgccugccucugccucccaagugcugggauuaaaggcuugugccaccacugccuggcucagucaauacucauaaccacugagucaguugcucuaauacaagcagcuuucaaguuuaucacaaagcuuuagguuucaccuuccuagguuaaaaaaaaaaaagaaggaaaaagagaaaaaguuuauaaaauaaaaauuuuuacugagauauuggugaguaauuauauuguuucuauguugaaauuuuugaaaauaaaaaaaaaaaaaguauuuccagugcugggggucacacgcaggaccuuguagacauuaggcauauauucuacugaauauauuuuacugaacucuaucccuuacugagaauaggauaucacuuauuuguuuaaaauucuuauuauauuuaucacuguauguauggaugugcucaugucuuggcacauuguuggagguuagaggacagaauuuggucaguuuucucuuuucacuguguguaugcugggaaucaaauugaggccaucagacuuggcagcaggcauccuuacccacugagccaucuucuuaggcccagaauuucuauggcuagggagaugguucaauauucugaguacuagccacuuucuuuaacuucuuucuuucuuuuuuuuuuaaagauuuguuuauuauuauauguaaguacacuguagcuguccucagacacuccagaagagggagucagaucucauuacagaugguugugagccaccaugugguugcugggauuugaacuccggaccuuuggaagagcagucuggugcucuuacccacugagccaucucaccagcccucuagccacuuucuagaggacuaaacuuuuaccagccccagggcauccuaggggacuacaugcacgugaucugaagaaccacuuugaggcaagcauucacacacauagaaaauaagaguguauauuuuaguauauauuuuauagaaaauuacuuuucuauauacuaggaucuguugaguaaauacuucaugauuacacuaaugguagcuuuuuccuucauagaauaaaauuuauuaccuauuuguuuaagcuucuuugcuauauccuuuuguuauaauguaugauauagcaauaauuauaucaauucuacuaagccuauauuuuccauguuguucguuuuguuuuauguuuuguuuuuuugagacaagguuucucaguguagcccuggcuguccuggaacuuguucuguaggucaggcuggccuuaaauucagagaccugucuguuucugcuuucugaguguugggauuaaaagugugaccaugccaguuuuauucuuuaucuuuaagaauucagggaggcugggcauuggagagauggcuccacaguuaagagccuguaacuccagcucuagaggugucugucacuuauggccucuugguguaugucacuuaugguauguguauauaugagggccuugcacucauauauacacauacucccacauacauaauuaaacuaaaaauaaaauuuagggaggguuggggauuuagcucaguaguagacaaauugccacacaaaugaaaggucugggguuuaguucuuaguggggucagggaagaaggagcaaaaauugcauuaaaaaaagcccaaaacaacuacugcagcuuggauguaguauggaacaagcuuuaauccuagcacaugaaggcagagagaggcagguggaucucugugauucugggucagacagggcuacauagugggacuuuguuuggggguagggugggguggggagaggguugggaggaaggagagaaggggagagagaacaugugugccagcuuuguuugagacaggacagaugguucagugguuaugagcacauacucaagggcucaaguuccauguccagaaacuuugcugggcaguucacaacaaccuauaauuccaacuccaggagaaucugaggcuucaacuaugcaucuaucucuccuagaccccauaauuuaaaaaaacaauauuuuaaaaacuuaaagguguaagggaccugagaugaaaagagaucaguauuuuacuuuucuguuuauuuuuucuuuguaaaccauuuuaguuuucugugcuagauauuuuauuucagguaaucucuguggaaaucacuuacaacuuuuuuuuuuuuuucucgagacaggguuucucugugcagcccuggcuguccuggaacucacuuuguagaccaggcuggccucgaacucagaaauccgccugccucugccucccaagugcugggauuaaaggcgugcgccaccaccgcccggcugacuuacaacuuuuaucuugauuacuguaaaacaggugucauagugauaucuucucacuuucuuuuaauagagaagaaguucgugcuccaauuccucaaaagcaagaaauauugguggagccagagccuuuguuuggugguaaguucucuuugcuugcuuacccuuaucugacuuuguuguuaucuaggauuuuaauaaagcuaacugaaguuaacugagggcuugcucagagauugugucuucauuuauagaaucaguuuuuaucauauauuucuguauucccuuuugggaagcuauaauccuuaauggagaauaauauuguacauuaacaauugacaauauguuacagaaggccaaaaaguaggaaacuuuuugaauugcugggguuguuauuguuguugcuguuguuguuuucuuaaggauaucacuauguaguucuagcuggccuggaacucaggcugccugcucuauauucuaaauuguaggauugaagacaugcauuacuguaccuaguucccugccuuucccacucucuuuggaauugcugccuuuuauggaaaccucuuuuauuauauuaaaaaaacucuuaauuuuguguuauauauuuucugaauauacacuugacuaauaacucuuuauuguuuuguauaccguaucuucucuuguuuuaauuucuccaaguucuguuccuauuuuggacaguggaaaaaauaguccuuauugugugcaaaaaucuuguuaguaguguuggcauauucagaguaugcugaaguaugggguauuuaaucaacuuuaaagaacagugauaguuuaauaaguaccugcuuaucuguaugaggcaaacauuuuagguuuugcuuaaaaaaauagaugguugaaucuuacugugguugggcaaacagauggugaaauguauauuguauugagaacaccaguacaggaaaauaguuugaaacaggaaaauaagagauccauuuuaaauuuuguagaaauguuagcauagggaagaaaauuaaaauuauaggaucucacugugugucuuugacucaucuggagcuuguuauguagaccaggcuacucuuaaacucggagauaugccugccucuuucuccuuaguucugggauuaaagguauaccaggcaagaaggagaaauaauucuuuuaaaagcuaaaauuuguuagauguuaauauuuccucccuaaguagagcacuugccuagcauguguuggacacuagauuuaauuccuagcacugcagaaauuccaucuguacugaacauauauggacauuuuucuuaucaguauuacaaaacaacagaacaaacauuuagaaagcauuuacauuggauuagguauuguaaauaaucuagagauaguguaaaugauaaaguuuauugaaggauaugcucaugugugcgugugcaugcaugugaaggccagaagcugagcuccauccuucguuacucuucuaccuuauucacugggguaggguuucugagccaaacccagaacucucugauacaguugguuucccuggccagauugcucuggggaacucccuguuuuugcauuguugugugauaaaacuuuuucuggggaggcacaacagauauagggccuacuacagguacagauaccaccaaaguucaacuugaugaacuaaugaguuuuacugggguuacuuacaggaauauggcugagggguuaaaggaacagacuaucucaaaggcaacuaacucuguccccaaagcccaccuaacaugggugacagcuuacaaagcugggaaccuggagcucacugcacagccuucaggcagcucaacagguuggacaguaagauucaauccacucaguagguuggauaguuuccaagugccucaguuuuaaaccucuuccaggcagcccaacuggauuuuguuucuucaggcagcuggucugcucugagagucuucuuuguagcccagcuuuuauuguuaacuuucccaggaaaaggccuaaugaauuuggucaguuucaggaaguuuugaguuacuuuccugcuuaaggcucuugcuguaggguggaauguuuuaaucucugaggaaaucuauguaccuaccaccuaccaaggcugggauuacagcuggguugccaugccaauuaggcaaguacuuuuaaugcuaagccccauccugcccugacuauggagaaguauuagacagcuucauguuacaauuauaagauaguuaaguuagucaucuuaaaaagaggacuauuuuaguuauucuuggagguuuuaguuggucccuuugcuuguggcuaaacuauacacaucauagggagagccuaugcuguaagaaguugcuuaguucuuggcagccaagaaacagaaaaagaaauaaaagaaagcagggucucacacucccuucaaggguguaaacccaaaugaccaaagcuucuuuguucucaaaggcucucaauaguacuguguugggaaccaagccauuaacacaaucaccacccaaaaucauaggaagaagcauuucuuucaaagcuguuggauagagaugcuguauccucaguacaaagcaagcagaaaagcuaaagucugugggacugccuaugacuuagagcaaugaauuuuauugagauggacgauaaaaagcuaacugaucauagacuuugacuugcaaaaaaacauuuuaaaaagauuuuuucuuuuauuguuuguuuguuugguugguugguuaauuuauuuuuccuagacaaggugucucuagcccuggcugucccagaacccagagaucugccugccucugccucccaagugcugugauuaaagaugugcaccaccacuuccuggcucuuuuuuuuuuuuaauauuagucguguguggguguggguguuuauguacaugugcaugcaggaggguauggcgauauccugaagcuggcauuacaaguaagguguguauaugugcauggguguggguauguuauucuggaacugacauuauagguuaagacuuauuuuuuaauauuaccgugcgugcguguguguuugugugguguggugaauauguacuugugaguuacccaaggaggcuagaauagaaaaugggauaucuggaguuauuauuacagauaggcagggaugugugugcgcguguguguguguguguguguguguguguguguguguguguguguguguguuauccuggagcaaguauuguagguuaguauguguguguguguaugugcacgcagaaagcagugcauucuuaacuguugcaccaccucuccaacccagacuuagcacaaaucuuuaaggaaccacgaccaguugaauuuugguguagugucaagaauauucacguuuaucuaaaaugauauuguuucucucuuuacuacuauguuucuguguggggcuggaauguaauauucuuccuauauuugaauuuaaauaaagcaauagauuuaaacuuaugcagaugauaugaaaaucucagguguuuuucucuuaugcuagguauuaacagaaauuuauaaaaauaugaaacuauauugguucucucaugagauuguuuuuuucugccaguccuuguauucugcuaugaugucuagugcuuuccuuaugcaucuggauuucuuuuagcuuuuuauauagcuuagucuuuuuuggcuuucaugacuaucaugccuauugagugggcagaaggaagauucuggaggaauggcguuugcuuaugauaaaugguuugcaagagccaggggcacuuggaguaaaacacauggguuaaaaguguuauagcuugggcuggagagaugacucagcaguuaaagagcacugaccgcccuucuagagguccugaguucaguucccauuaaccauaugguggcucacaaccagcuguaauggggucugaugcccucuucugguguguuugaagacagcuacaguauacucauauacaaauaaauaaauaaauaaauaaauaaauaaauaaaucuuuuuuuuaaaaaaguguuguagcuugaagauugucucuuaguacagguauaaugggagcaaauagcagaugaucugcccaagaaaugagagaagcuggcuagaaggcuggcaauaucucccaaagggacacaugagggugauaggaagugcagggggcuauuagcuggccugcuuugagcaguuuagaaguagacuauuucccuauuacacuacuauucuaugucuagucauguaacaaacuugcuuuaacaguugguaggguuaaagucugucagucggugaguggcucagcauauaaaaguugcugcccaaugaccugaauuugauccuuggugcccaugauugaaggaggaucagcuacugauaguuguccucugacccacacacauggacuguggcaagcacucacacaauaauaauaaaaauaauaacccuauuauaucacuaauucucaaaggcauucuuugggggcuagguauggaaguacuucuaacacuuagaagacugaggcacuagauuuugaccuguauuuuaaaaaaaccaaaggaauaacaaaggcauugagccuaaaauacuccugcuacaaaauauacauuuuaaauaggauauauugauuaaaaauaguucaaagagugaaaagaaucacauucuccauuuuuaaaaaaauaaauaacuuacuuuuauuuuauguacauuggugguuugcccugcauguauguuugugugaagguguuagaucuuggaguuaauuuugagcugggaauugaacccagguccucuggaauuccuaaccguugagccaucucaucagccucucuaccuguuuuuuuuuuuuuuuuuuuuaaaguucuuuuuuuuuuuuucuaagauuuuauuuauuauuauauguaaguacacuguagcugucuucagacacaccaguagagaucuuguuacggaugacugugagccaccaugugguugcugggauuugaacucuggaccuucggaagagcagucgggugcucuuacccacugagccaucucaccagcccucuaccuguuuuuuuuuguuguuguuguuguuguuguuguuguuuuguuuuguuuuuguuuuaucuguuuuuaaacaggaaagguaagcaaaacaaaaacgauuagauucaauuuauuucauuuaguugagacagggucuuucuauguagcuauggcugaccuagaacuggcuauguagacugggcuaaccuugaacucagaucugccugccucuuccuccugaguccuaagauuaaaguaauguggcaccacugccugacaaaguucuauuuguguguguggguguauaugugcgcacgcacgcgcucucuugugcgugugugcgugcaugcaugcgugcaugcauguauauaaguguuuuuuuuucuugcacaccagaagggagaaucaaauucuguuacaugcauggcucacgguugugagccgccaugugguugcugggaauugaacucaggaccucugaaagagcaaccaaugauuucaacagcuaagccaaucucucuagccccugauuuaaauuuuuaaaauucagauaagcuauuuaaaaauguaaucccaaccauuauuuuuuuuuaaaucuauucuugaggguaauugugauucuuuuauuuugagacaguacagcuuugaaguuacuuuguagcucauuaugaccuccaaccuuugauuuuacugagauuccaggcauguagcacuaugccuggccuguuaacuagcauaaacauugguguguugugugugcuucuaugaaugacauaaacaugauaaaacaaugaaguuuguuuguuuuucaguaggcuuauguagccagcccagguugguuuuugaacucauauagucauagaugacuuuacauuucuguugugauuauaggcaugugccaccacuacaugucuaugaggugcuggggaucaaauucaggauuucaugcuagcccuaaguuucugauuuuugguuuugcguuuaaauuuuaauuuguguuuuuguguuggaucuccuauaguugugagcugacccccuguggugcuaggaccugaacaggcagcaacugauuuggacugaugagcuaucugucucucucccaccugauuuuguauuuuuaauuguuuugcuuuuagggcuagagagaugguucagugguuuggagcacugacugcucuuccagagguccugaguucaguucccauuaaccguaugguggcucacaaccaucuguaauggggucugaugcccucuucuagugugucugaagagagcaacaguguacucauauauaaaauaaaucuuuuuaaaaaauuguuuugcuuuuaacuuagugagucuaagagaaaaguaauuauccuaaguaaugaaaugcauacuuuguagaaaaagaugcuuugauaugggguaagagacuuuuggacucuuugccuucuaaucauuauuaaugugagacauugguuugguuacaugcuggccagacuuaccauauauaagucaguuuaaacuguuacagugaauuaguuauuuaaaaucuccauuuucuguuggccauaguggugccggcuuuuauaucccaacacucagauagauugaucuggcgaccagccuagucuacauugugacuuacagggcagccagagcaauguagagagaagggucccugucucaaaaagcaaaacagcagcagcaaagucuccauuuucuauguuguacaugagucauuuguuacuugucuuuuaaaguuugagaacauuuuucuaauggaagaugacauuuuaauaaagucauuuuaaaucuuauguuaaaaaguaugauuagccccuagaacuaaacugaauuaaaacaaaaaaacuuuuggggggguccuggucuuucuuaaccuaguucuaauuuucuuauuaauaugauaagaugauuguucauaacuugacuuuuuguuuauuuugaaaacagaacaugugcuuuacccacugagcuuugcuuuuuguuuuguuuuguuuuuugaaacagguuuucucuguguagugcuggcuguccuagaaauucauuuuuuguuuuguuuguuuguuuugaggggcggcacuauuaagaauauagaagcuuuaaaauacacugaggacuggagauauggcucaguagcuaagaguacugacuacuuuuugaaaagacacagguucaauucccagaaccccugugguagcucauaaccaucuguaacuccaguuuuaggacaucugacauccucuucuggucacauaguucacagcuuacauguagggaaauacucaaacacauaaaacaguacagaaugagaaaugcuuauagaagggauaucuuuagaauuuucaaaauuaauguuuuaauuuuuaaucaguucuguuuuuuuccuacagcuccuaaaaggagaaggccagcacguucaauauuugaugguuuccgagauuuucaaacugaaacuaguagguauuugugagccagucucucagcucucucuuccccuuccuuuuuguuaaaaagaaaaaaagaugauuaguauuauuucuaaauacuuugugguucaccauguuuaaaaagugaaauuugagacaucuagauuuuggguaaagauuacuggcuaccaagccugaguuuugaccccaggacccacauggugacaagagagaacugacuccugccaauaguacuugacuccacauaaauacccugacauccauguacuuacacacacugcccuaguuaugaguauuaucgcuaaaaugaaacaucaugaccaacagcaaguuggggaggaaaggguuuauuuguguuauaguuucauaaucuaugauugaaggaagucaguaaaggaacucaaaucagggaaggaaccugaggcaggaguggaugcagagacagacuauagugggaugggaaggaugcugcuuaacugcuuucuuaauagaacucaggaccaucagcacaggauggcaccaccuacaaugggcuggacccucccucccaucaaccacuaauuaagaaaauacccuacagcugugguuuagccuauggguuacaaccuccuuucagggagucucagauauccagcauaucagauauuugcauuaugauucacaacaguagcaaaauuacauuugugaaauagccaugaaaacaguuuaugguuugggguuacugaaguaugaggaucuguauuaaaggguugcagcauuaggaagguugagaguuacugauguacauuuuagcaauugaggcuccucucugaugaguaguuugucaaaucgacauaaaaccaguuagcacagcucauaccuuucuguggaauauguagaaguaucuuggcucauacuuguuaaagaauucuaaagaaaggucaauguauguuuauuuguucaggaugguguacaggccaugaugugcauuuuguccucuaacuggaggacagcuuauuggaguuggucuuuccuaccuggggaucaaauuggcaccaucaauuuugguagcaagugcccagacuuacugagccaucaucuagugucuaaggacaguuacuuuauauaugagaaauguguggacuguguuuggcuuuguaacuuagagugagcuggucagggcacagauagguccuguaacuuuaggaaugguugaaagugauugcuuaaguugucaaaggaaucuaugcucuuucuucuaguacaugguaccagcaguguccauagccucuacugagagucuuuaaaacuaggagcuagacacagaggaugaguuaggauaacucugagaguuagagcaaugguucugaaauuuuucuucuuuugcuuaugaauaugugaaaaaauuugaguugaugugcuauuagggaccaaaucuaagcaaacacucuaccacuccggugaauccucaucucauagugaauucguauuuguuuuuaaugaugcuggggacuaaacacagggagggucucauguauacuagauagguacuauuagcuagauccccaacuagcuuuucuucuuauugugagguagucucucaguaaguuggguggagguuggucuugaaccuuugauuuuucuuguguuagccucccagguagcuuugauuguaagccuggcccaauaugacuauuuguaacuaauuuaauuuucucuuuuuauccuuuggccuagagaacaaccuuuaaauccugauuuuauuuuuuuuaacuccucuuugcauuuuuuuuccagucaucguuagcuuuuuguauuugaggccacgcaugcuguucaguauucuucagucaauagaagaucuuugguuuauuauguaacuuagcacuuacauuuuaugguuaauuaaaacuucuccaucuuucuguguugcaguuaggcaggaacaggaauuaagaaauggaggagcaauagauaagaaacuaaccacccuugcagaucuauuucggcccccaaucgacuugaugcacaagggcagcuuugaaacaguaaguuguuaagagauucuguguuauaacuaugaaucguuuuuaccauuucagugucuuauuuguuuuauuuuugagacagugucuuaucauggggccuggacauauuguauagauuaggcuggucaaaaaaucagagauuggccugucucuguguccucuauuuaacuugugucuuuguuuguuuugguuuugguuuuucgagacaggguuucucuauguauuccugacugucuuggaacucacucuguagaccaggcuggccuuggacucagaaaucuaccugccucugccucccaagugcugggauuaaaggcaugcgccaccacugcccggcaccuugugucuuauuuucuaggagaaaaaaaaaucauuuauauaaaaaauugguaucuuaacuauuucugcauaauauacuuaaggguuacacugacuucuauuucaacuggcaauaaaugaagaauggauuauguaugaaauuaugaagaaggaaaaagaauuuguacuaguuuugcugucaugccugacauuauaaaaguuuggucucaguguggcagugcauuaaauuugugcauauuugcuauuuguuguuucagaccuguaaugggaauguuggaaguacauguauguguaucuaauugcagaauacauucuccccuggucuuccuggcuuuagcuuuccuaaaggcagaggaaaacuuccugggacuuguaacuguuagggguuuucuguguccuccaccucugaauaaagacaggaagacuuauauuuauuaauuauuaaugcuuaagguuuuuguguaggccucuuuccaacuagcuguuauaacuuaaauuaacccauauauguuaaucuguguucugccacauggcucauuaguuaccugucuuuuagucccugugugcuucuuccucugugucugacucccauaguuccugucugcuggaagucccaccuauucucuccuucuuugcuauaggcuaucagcauuuuauuaaaccaaucagaggaugauauaggggguauuuauaaaauaugauguagccagaaauuagcauuuguauaauaaaaaacagucuuuauacaguacacaaaaagauaaccccaaaaagggcagguguaguugauuguaucaccauagugagaauaucugucaucaagaaaacaacaagggcuagagauauggcuuagcaauuaagauuauuuguugcucuugcagaagacccagguucaguucccagcacccacaugguggcuuuuaacugcagucccaagggauaugaugcuuccuucugguccccaaagccaggaggcacguacauauauacacucaaacauauaaaucuuuaaaaacaaacaaacuugauaaaaauuaaaacuauuauaccuucaauauauuugacauuucuagggaagguuuguugagggggaagacuauugcagaaaaugggcagcacaguuucauagguggggcacaagcagcuagcuagaagccaagauucuuagauucucuucucugcuuuauguacuaacugaaguuucuaaaggggcagagucauuagacuaucgugcauguuauuggcugggagggggugugugacgacuucuuagguuagcuuaaugguaaaaguuggugguucaacaauagcuaucuguauacuagagaaacagaacacagcagcugcucaauccaagaagcuaugucucagcuauuccacucuggugcugaaggcuuacuagggagcuggagucuaaugauccaaugaccacauguguacauggagaaagaaaugggcuuauggacauauauacacuucuuccuccaauucccauccaucuaguggcuggugcuggcuaacuucagagugggccuuuuuuuccuacucaugugccacagaucugugcuuucugaaguacagcaaagagacaggaacguuucaccaguccuguauuucuccuaaaccagucaaguugacagccaccacaagaauuaaacguguaaaaucguacuguauaauaccaaaaauucuagauaucauuuuaaaaguuguauuauuuacuugcauauguguguauaaauaaacaugcaauagaaguugccccgggggccagcagagggcaucagauuuccuugagcugugagcuauuggacauagguuguaggaaccaaauuccauuucuccaugagagcaucaacuacuuuuuaacuucuagacugcagcccagccucuagauauuuuuaaaacuauccuuacuaaucauugauaauuucuuuugggggagacagcaggaugugagacaagguuucucuuuguagcccuggaacucaguauguauuacaugucucugccuacacagugcguuuaagguguguacccucuuagaauuuguuacaauauauuuuuaucauauuuauccccuauuucucuaacacacagauucacacucaaccugggcauuccucuuaacuuuuguagccccugucucugccuugucaacaaccaucaaguccaguaugugcuauucuuacccugaugguccagaggacauccacuggagcauggucacucuaccagggaugauagaauugguucucccugccccagcagccaucaucugucaguagcuccucaguuggggacucauaucuuuuccuucauaccccaggcuagaauguuguccugucaugguccggaagauaaauguuguagucugguccucuccaaugucuggcucuuaaaacuuuaacucucucuuucaugauggucccuaagccuagcgcuaggagggacaguacucuagaugucccaugugugccugagcacgccacugaugcuugucuccucacuuuggccaauugugaauuuauguauuaaccacugugcucugcacagagaacugaugaguccucagugucauuuuuaaaagugugcuaagugucuauauggaaauuuuacucuuacaggccaaagaguguggccagaugcagaauaaguggcugaugauaaacauucaaaauguacaagacuuugcaugccagugccucaaccgugauguauggagcaaugaagcugugaagaauauuauccgggaacauuucauuuucuggcaggugagaacaacaguuaauuaaagcuuucuuaguauuuguuuuuauaguauaggauguuguagaggcagaauggggcuauaaacuggaaaaagugaguucaaucauacuucaggagcaccuugacaagacuaucuacagcuccacagcucaguagaaacauaguuuaagccacacaguugacauuucucuagaaguaccaucugaaaaaaauucaagggaaaagggaaauuaacuuuaaucauauguuuuaagucaauguaugauagaacauuaacauuuuaguggcauuauguuucuguuuaacuguguguguuaaauucucaaaguaagguauguauuucaugcuuauagcacaugccaccuuaaauuagacuauuuuaucuauuuaauagcuauauaaggccacuggcuguguguaaaagaucuuagggcgcucgggaaauauuaagauauguuuucuagccuguguuuuuuacucuuuuacuguuuguucuuaacauaguauuccuaaguauuccagcuauaauagcuuuuuguauaaauuaucuaguuaaaacagguagccuaccugucauaguuuggguuuuauucuaugaugagacaccauaaccaaggccacucuuauaaaggcaaacuuuuuuuuuguuuuuguuuuguuuuggagacaggguuucucuguguagcccuggcuguccuggaacucacucuguagaccaggcugaccuugaacucagaaaucugccugccucugccucccaagugcugggauuaaagguggguaccaccacugccccaaaggcaaacauuuaauugggacuggcuuacaguuucaaagguucagucuauuaucaucauggcgggaagcauggcagugugcaggcagacguggugcugcagaggagcugagaguucuauauccugaucuucagccagaagacgccccuccacccccuaccccccaccccuguacuguguggagccugagcacuaggagaccucaaaaccugccuacacaaugaacaccuaacagugccacuucccaugggcccagcauauucaaaccaccacucuaccacuaauuucccuuuuguuucauucuguuuaguugguugguuuuuggagaggcucgcuacuuuggauucagccuggggccaccuacaagcaaaucuucauccuccuuaguuuauuuaucauuuauuuauuuuuagguuuuugggacaguguuucuuuguaucccuggcuguccuguccacuugucccagcuccuuuuuuaguguuugaaaccaccacaaauaaggacuacauaaucuucugaugucagccaucugaguaguuggggguuauacccuaggcagauccaguuucaauuuccuuuucuuuucuuuucuuuuuuuuuuuuaaauaauuuauuuauuauauguaaguacacuguagcuaucuucugacacacacaccagaagggggcaucagaucucauuacagaugguugugcucuuaaccacugagccaucucuccagccccaguuucaauaucuagguuuugguuuuuuuuuuuuuuuuuuuggguuuuggagacaggguuucucuguauagcccuggcuguccuggaacucacuuaguagaccaggcuggccucgaacucagaaaucugccugccucugccuuccaagugcugggauuaaaggcgugugccaccaugcccggcaauaucuaguuuuuaaaaaguuacuggccgacagugaucugaucuacagagugaguuccaggacagccagggcuacacagagaaacccugucucgaaaaaacaaacaaacaaaaaaguuacugaagggggggaggguaugggggaguuuuggaauagcacuggaaauguaaauaaaauaucaaauaaaaaaugaaaaaaaaaguuacugaaaacaacuaaguaaacuuaucuaagauguacuacuagugccauucauuuacccgcuuguguuuuacaucugguaaauucagugggauuuuguuuuuauuauaaauuuguguauguauuauaugucucaaugugugguguggugguuugaggacaacuuuuggaaauuaguuuucuccuuccacuguagguugucaggcuugugcugcaagcacuuguaucugaugagucaggccuuugcuagcuuccaggauuguuucuaaugucagaguuccuuuuauuuuagucgaauagugacugaacaucucugccuaauaaaauguuggguucucaagcuuauaaucuuaauauauaugacuuacuagaauacaaauacagugcuagacauuguggcacacuugggaggcagagacagggaucucugugaguucaaggacagccugguuacauagugagcuccaggacagcuagagcuguauagggagacucugucucagaaaaaacaaaaaauucacagauggacuaacacaugaaaaggaaguuacuacuaguaccucuucugagcugagaaaggaggcauggguugguguuuaugauguucucaaaagggggcaagaguaaggugugaaaucugaaccucauuacuucugcuuaaggggguaagaacuuaacauguuugucaaggcuuguuugaagaauccauugcucuuaauagauaacaagauuguggucuuuuuuuaagacgcuuuuuaaaaauguuauuggcuuaacagguuuaucacgacagugaggaaggucagagauacauacaguuuuauaagcuaggggauuuccccuauguuuccaucuuagauccacggacagguaaguuacagcaaauuauagccuuuauuuuucacaacugauuaauuuuugacuggaucugguuucagcaaugugauaguuaagagaagucuuguuguguaaacaacuuuggauguguuuauuuagggaaucugguucuggaaacuuggggguaacaacauuuuguauuuguacauuuuauucuuucaaagaaaaacugauauaaucaaucaccuuuauugggucuccuuagguuuucuauuauuaaauugaugagauuguuuuagguacuugucguauuccucuagagaacuagagggugagcuguuuuaaauuauugauuauauuuuauuuagauucugcuauuuagauuuuugcuuuguuugaaauucuuccuaaaugacuacaaugcaaacagauaguuuaucugaguuuuaauuaauguugucaguagguuauaaagauacuuugugacuuuaguaagaaauggggauaugaauuuguagcagacuuuauguauaugucaauuauuuaaugacugugauuagacaaguuauuuuauguuuauauaucuugauuuuuuaauuuauuuaucucuaggucagaagcuaguagaguggcaccaguuggaugugucuucuuucuuggaccaagugacaggguuucugggagaacaugggcaacuggauggacuuucuagcagcccccccaaaaagugugcccgaucaguaaguauaagugaugggcagcuaaguauaccuguaucuuggcauuuuuguaaaagguuuaauguuaaaaugguauuuaugacaaggaguagagcuggcuucugguaguacacaucuuuaaucccagcacuggggaggcagaggcaagcgcagguggauuucugugaguuugaggccaacuuggccuacaaauugauucccaggacagagaaagccuauuuuaaugaauaguguaaguaaugaguaucuaugucuucuggauguacuacaucuuagcuaucuuauuuuuugauaguuuucuacagaagaauuucgucuucuuaaugaagucauaauauguaugugugugugugcgcgugugcauguguauguauguauguauguacaguuuuauguuucgugagucucuucuauggcaggacauugauggguccaaucuuguuuaggacuuaggcagguggcauagcuacuguauguuuaagagcuccauguuuugucauacccagaagucacuguuccacaucccuccaucccaucccucacaucuuacauucuuucugcccucuuuuccacaauguucccugaacccuggaaaggaugcuauggaugcuguagucccauuuauggcugaacauucaacauguauuuucugcauuuuaacacuuaugagucuuggcaguuaaccauuguccacugcagaaggaagcgucuguaacugcagcugacagcagcacugaucugacugcuggaggcucucaguuuccuaccccagcuccuggagacuuaucccaccacuagaagugucuaggucugguuauauauuuccuuuuuugaacucaugugugugcauuaugucuguauguuuauacguauguuccugucuaugggugugauggugguguguguguguauaagcucaagguugacauuagaauccuuacucauuugccuuucuugcccuccuccuuaaucauugaggcaggcucucaguugaacucaguugaaucaauguggcuaauuugguuagacauuguguuauggggauccccugucucugcuuacugaaugcuggaauuauaugcugccaaguccacugagcauuuauaaggguucuggggaacugaacagugguccucaaguuuuugaagggagggcuuuaacuacugcuuaucucucucgucauguuucucuuagauguacuuuaucaggcuaaugagguuuucuccuuuuugaagacagggaaccaaggugggcucagacucacucuguagccagugguauucuugaauuccugauacuacugccuuugucucuuaccaccauuccuauauuccuuuucuucuuaguuugcagggggucacauggccagugaucccagcacucaggugaccaagucaggagaauuacugcaaguuugaagacaaagcuauauaaugaauucuauguuaguucaggcuauagagugagagcugucucaaaacaagucauagacaaaauaagcaaauaaaaacuauagggcaaguaguacauagacuuuuuuaauuagacguguuuuuauuuaaauuuuuuguuuuguuuuauguguaugagugauuugcuuauauguguacuacauguguacacugcccucagguaccacaagaaaguguuggguccucugcaacuggaguuauggauggucaugagccacuauaugagucuuaggaacugaguucagcucuaagcacccacauuagguggcucauagccagcuccaggagaaucuugacaucucugguauccgugggcacuugcacucaugugugcauacccacaaacagacagaaacacaaacacaacguuaaaaugauuaaaaaaaaagauaacggguucuauuaaucugaacaacucuguagcccuagacggcucaguggguaggagcacuggcugcucuuccagagggccugaguucaagucccagcaaccacacgguggcucacagccauccacccguaacaagaucugacgcccucuucuagugugucugaagacagcaacaauguauuuacauaagguaaaaacaaacaaaccccagaaaagagugaguauuggauugaaacaauuaacuacucaaaucaaucuggggguauuggugcauuccucaucugccccaauguucuagguuuccaaaugaaagacacacauacacaaauccuuuuauuuuaauaugccuuaaacagcucaguggcugggccacuuccuaaccuccaugcagcaaacacacauuccaacauuccugacucaucuuuacuaaagccuauauuccaucuuggcugccccgaacccagaucugcaccucucucugcaccacaaucccugacucuuucuuaaaugcuggcuguguucucucuucugcaccucuuaggccuggucuucacuccuuucccagcauggcggcucucuccugcugcugcuuccucaguguuuugcccggggauccuaaaguccucccucugucucccugcccauccauuggccacugcaacuuuauuuaccaaucaaaaccaacugaggacaggguccauaagcaucuuauaugcagccauacuauguaauuuuggggaccaaauuaauauaaguugcauuagaccaaauccacaacauuaacauggugcugucugcuauauaauguuacuacaaaucuagucacguaagccauugcaugucccauaaaucuaccugcuuucuaugugugguaaauuaggcuuauguuuauuguuuguuuguuuguuuguuuguuuuuguuuuuguuuuuuaagacaggucucugucacauagccuugacuaucuuguaacucacucuguagaccaggcuggccuuaaacucacagauaccaccuaccucucccucucaagugcuggaauuaaaauugugugcuacuacacccauauacuuuuuuaaaaaauuauugggcuggugagauggcucagcagguaagagcacugacugcucuuccaaagguacugaguucaauucccagcaaccacaugguggcucacaacuauccguaacaagaucuggugcccucuucuggagugucugaauauagcuacaguguacuuacauauaauaaauaaauaaaucuuuuuuaaaaaaauuauuauggagcaguaggaagaugauugacccuucuccccccagaauaaguguggccauuuuguuccaugccugccagcuuuuuuauauuguugcuguaacaugccuuccagucacugacacagagaagugacuuggcucaaggauaugcugaccacacauccugcuuuguuguauguuuugaauguucuguaugagguuugcuaaucucuuuuguuguuguuguugguuuuucgagacaggguuucucuguguagcccuggcuguccuggaacucacuuuguagaccaggcuggccucgaacucagaaauccaccugccucugccuccugagugcugggauuaaagaaaggugugcgccaccacugcccggcaugagguuugcuaaucuuacgaaacuccacaaagcuuuacauaggacccaucacaucaaaggucaacaugaaugguuaugucugaaauacuuugagucagagcugacuccgggcagcccuuccuguaccuacauuugagcucacuaugguuuuuguggcugacucuggagaauguuacuaauaaaccaaagguugugaugauaauacucauucucuguuaccucagugcucugaaaguccccuguucaccacacagcuaccacccuccuucccgcacucaggaccaaucagcuuaaagguuagcuaauaauaauuugucuaauaagccaacuaccccccuccuugcccuuuaaacuuuggaaccuguuuuuuccuauaaaagccuaccugagagcagacuggcaccacaauuaguggaacuguauguacaguauuauggugugcgcgcucaguaaacuauucuugcuugacugagaaugaugcauguuaggauugugugacaguuuucugaauaccagcauuaaauaaauaacuucaauucagaagguccauaguuugugauuuuuaaaaaugaaaucugugauguucaaaacuuuaacaagaaaauauuagaaauuugcauuucucuggcuguuaaaaugguaaaggcacuuccuaccaaaccugaugaccugaguccagucucuacagcccaaaugguaggagagaauggaccucugaacacuguccguggacacugacugcacagccuuaaacauaagcacaguuuaaauaaauguaaaagaauuugcauuucuaguuauuauaaugacguuuuucauuauaauuauuaagcuuuugagaauuuaauugucuagccccaaacauccaaauguauucuuuuuuuuuucugagacaagaucucacuguauagugcacacuaggagucaaacuuacaaaccucuccugaaguguuaaauccugggauauagcaugcaccaucaugccauauuuugguaauguuauuuucuuguuuugaaugucaaaucauugcauuuaaugaaaagcaaggaagacauguuuuuuugauguuuaaucauuuuaaagaauuguaguuuggcuuuaaacuuuuuuuuuuuuuccucgagacaggguuucuuuguguagcccuggcuguccuguaacucacucuguagaccaggcuggccucaaacucagaaauccuccugccucugccucccaagugcugggauuaaaggcgugcgccaccacgcccggcaggcuuuaaacuuuuuuuaaagcaaaaaauaauaagcuauuuucuuggcuuuguucauuuugaugccaaaaaugccugaacuuaaaaugccaguguacuaguuuauaugagagcuuuguguuguuuauuuuugauuuagacagggucucacuguguaguacaggcuagccuaaaacuucaagcaauuucacaccucugcuucauaaaugcuggcauuaugugccaccguaucuagcuuaaugauaguccuuuauuuuugcuuuugaaauacucauugcaguuugucauucugguacuaaguucuugcccucacaugguauaagagacagauuccacuuuggcagaaaaucauaauggcaaguuggcuaguuuguuuuuuuaugcacuguuugagugguuuuuuguuuauuuguuuguuuuguuuuuguuuaacuauucuuucaacuuuuguuuuggcugcaccuuacaggagagccucauagaugcuagugaagacagccaacuggaagcugccaucagagccuccuugcaagagacacauuucgacucggcccaggcaaaacaggauagccgcucagaugaagaaucugaaucggaacuuuuuucuggcagugaggaauucauaucgguuuguggcucugaugaagaagaggagguagagaaucuugcuaaguccagaaagucuccucauaaagauuuggggcauagaaaagaggagaacagaaggccacugacagagcccccagccagaacugagccuggcacagccacaaaccaucaaggauugccauccauggauucugaggucuuggagaugucaccugaaaagucagauggaauaguggaggggauagauguaaaugguggguuaugguauagaccugcuuuaccuacuaaacucgaacguacugaaugacuugcuuaauuaaucucccguauuaaacaccuguguauguguauaacucuucuuuaggaccaaaagcacagcugaugcugcgguacccagauggaaaaagggaacagaucacucuuccagagcaagccaaauuacuggugaguuuaucccauugaaacauuugcuuaaagcaaagaaucuaauuguuugugcugcuaggggucaaacccauaagcuaugcauguuaggcaacccccugcuauacuguauccuuacuccagaaaacagagccuugacuccugacacagagaguuuaucugauaccuaacugcagacucaucugacaagaguccuaauuuuuuuggguuuuguuguggucuguuacuuguuuuuuuuguuuagguuuugaagcagggccuuacuauguaagcuggcuaaccuguaauucauagcaauuugccugccucagcuugauuaaggguguggagauuuugaggugagaucucacuucauagcccauguagccugaaacuaaagcagucuuucugcuuagccucccaagugcugaaauuaaaaucaugagcuaccaugcccugucucauuuuuaauuauuuccuucuaauuauuuuaggcaagucacaggccagccaaagcuuuucaguuuucaguuuuuguuuguguggaauauacuuacuucugguggucuggggguuguuuucaaacuuuuuccuugugugugcgcgcgcacguguguuuuguuuuugaggcaggguuuccuuuuguacccuuggcugcccuggaacucaguuuguagaaacucagagauucuccugcuucugucuccugugugcuggaacuaaagcugugugccaucacaccugguggaucuaggauuucuuaguugcuguuacuaaaacauaguuaagagccaaggucguuguucugugucucuucuguaaucuguuaggauuuuuuucuugugcuuuugacuuuauuccauuccucucauuguuugccuaugaguuuuauuuauuucuugauuuguacaugacaucaccuaucauggugguuuuaagggccuauuuauuuaaaaauuguugagcaaugauucuuuuuaacugcuagaaaagaggagaauuggucugacuagcauagcuuaaccuauggaugguccucacucguagcccacuuuggucaguaccuauaccuggcuugguaccaugccugggauuagucagucacucuuuucauuucuauaacaaaauaccugauauaaacaacuuaaggguuucuuuuuggcucuugguuucaaagagauuccauuucagcccuccagagcaggauaggcauggcagugugagagcauggcagaggcuccuugucuugucauaggaacuagagacuuguuuguguggcugugagccaggaacagagaacuagaccagagcuagaggguuggauaggaacuucagaggccugccuuuggugaccuacuucugucagccuggcccuacacccuaaaagcucagaccuuaggggaaaggccauuuaaauagaaccauacagaagauacuuaggcugauuguugaagacugacaaguaauaguuucuggcuagugccagacacuaaacuaccauuguuugaaaugggacaaaggacaaauaugauauauaacuaucuuaguuagggcuuuacugcugugaacagacaccaugaccaaggaaacucuuuuaaggacaacauuuaauuguggcuggcuuacagguucauagguucaguccauuaucaaggcaggagcauggcaguauccaggcagguacaggaggagcugagaguucuacaucuucauuugaagacuggcuuccaagcagcuaaggacaaggggcuuaaagcccauguccacaguagcauacuuccuccaacaaggccauaccuccaaauagugcuauuccccugggccaagcauauucaaaccuccacagugccuuucuccaucuucuaguucugcuagcaaacuuugguauagaaguguuaaauggaauauuccagaacaauucguaacuuuuaaauuacauacuauucuaaauaguacaaugaaaccuccuaccguuacauuccaacaccuaggaugugaaccauuccuuuuauccaggauaaccagacgguauacccgagagacaauagccaucuuaguuuaucuaaugaagguuauaguuacugccagguuuucuggucaaaguaacuucaagaaacuuuuaaaacuuauauauuuaaguuagcucagugguuaagagcacuggcucuuacagguccugaguucaaaucccaguaaccacaugguggcucacaaccaucuguaaugagauccgacguccucgucuggucugucugaagagaacaacaguguaauuacauacauaaauaagucaaugugaguguauguucuugcaagcuguucaguaacuuuuagugauggccccgaagcuuaagaggauuaaugcugacauuuuauuacaauauauuguauggcauuuuauuauuaguuguugucaauauauagaggucuauacuauuauuagauaucuaccagugaucauggugcauauuuucuagggacaagggucacuccuaaguagaccauucuuuugagaaguuuaguuggaaaacuagaagacaguagguagaggaaagaugacugauugcuuaucugacgagaaagcauuuauagagaaggaagugcugaagaaauuguaauagacaguuaugagaucauaguugauuguagacagaauguaaggacauaacucuucugaugaaggaaaaaacugggugcuauauuuuauaaauguugccuggguuuauuuauuaggaagacaguaaugacuuuuucaguaucaaucacauuguaauccuaaguuauuggauauagauuugucuuacuauccaaaggguuauguuggcuuucuguaagcuuugauuauuugaauuaaguuacuuuaauaugauaaaaauagaauacucauaaacuagucgucauggaguuuauuuccagcuaacaguuuugucuuccucuuguuuuuuguaggcguuggugaagcauguccagucuaaaggauauccaaaugaacguuuugaacuucucaccaacuucccucggaggaagcucucucaucuggacuaugacauuaccuuacaagaggcuggccucuguccucaagagacugucuuuguacaggaaagaaauuaacaccauggccugaccucucucagcuuaccccuuuuucucuuuuccugugagauaccaugucacuaaguaugcauuuuggcucauaggacuaacuguagagccaaagcugggcaagcaagucaccugccuuuucuuuaucucuuucugucacguguaaaucagucuccuucccccuuaucucuguuuucuuucuuccuccuuuuucucaguuuguucuuucuuaccagauguggugaccaaauggaaguguaugaauaagaauaacaucucuccuaguacugguagcacgaaauguguguucuaacaagugcucuuuugcaugacaccuuuuggggaccuagugauguuacuacuucuagacucuguugacaaagaauggcuagaaucagaauuaaaaacagcccccauuuuugguaggaaaaagaaauucuuuuaacaugcauuuuguucaucauguaggaagaugucauaauaaaauguccaggcuuuuguuuaugugggaaaagcauacuuuaauacuguuggucaucguacuuaaaauuucccucaaggauucccaucuucuaguuacaggcuauuuccaugauguguguuauuggcagaaucagugcucaguguauuguguguagcacaggguggcuuucaauguccuagccugagacaguuuccuuuauuauuacucuaucaauuauauuccucuuuccaguccuaggaugaaacuuuaguaagaauauugugucugggcuaggaaggugcuugcuguuuuugccugcacagcaaauuaguuccuuuggcuccauugucugagucuaauguauucuguaggaaggcagguguucaauaaucauguagugcaauggcuuuguaauuguaacugcaauuacauuaacaauuacacaguaacacugguuauugauuguccuaugugcuuaaggcauacuuaaguaugucccagcguugaguggggugggggguggggacaaaagccugcagaugagaguugcuaacaauguucuuuugguuagaaauauugaucguuuuuuaccccaauuggaauaauaucuaaaaugcuuugggaacuaauugacuuuaauuccucaugcuguuuuauuuuuagaaaagaucaaaacugaaagucucuaagaggaagaccuucaaauuugguucauacgacaacaguuauuaagagagauuucuaguaaucuucagaugugagguuuuuuuucugccaacaaaagucacauucaaauuguauuuggugaaagcuuuuuucaguauuacuuagaagaggccaccugaaucuguauaguccuauucaucagcuucacuguaugcucaguucuuuccuugagcuuuaaguagaguucucuagcagggcagguagugauuuggugggaaaaccaaaacuugauaaacugcuuauaaaaccauuucuacagaaugaccuaucuugucaguuggagauuuuucagugauccuugaaccuguacacaaucuaaauugugaugacucagaaaccuuuggaugccuguguacgugcagaucucucucggcaacuaggggguuaaaaagauaagcuuaagagacgugcuaguaugcaauuauagaaugugguuguuaauggcuggauuuugagggaccucccuaaagaaugaguuauguaucuccacaaggaaaucauggaaaauuuuguuauuuuucagugaguccuuuugaauuaauguuuuuacauuuuuuucuaagucuguguaagugcuuauguauaaguauauaauuguauaaauauuuauaaauauauuuauauaauuacaauuucauuuauaccuugagucaaaguucucucuuuugauuggugacugaacaauaccacuuugguguuuuucauagugcuugagacuuaaccaacaguuuggauuuauuuagcaagcauguuaauuccucaguuguaucucugaacuugaguaaaaucuggcugucugaggaauagagucuuacaggcuuaaaaaaccaguagucaaggucagcagucuuaugcuucaggagccacaggguaaaacgugagagaguacccagcuucgccacuugggcaccaucuccucugcuggcacagguccagcuaaagcccaaguccaucagaaauaugaagucaagaauuuucccuuagaggacucugcugcacccucuuauccuguuaaauuagguucucuauauacaguaaaaccuaucuugagaaccugaggcaggauguucagaagugagaggguguauaguucuuuacgugcuuagcacuggcaaauccauuuaugagaaaccaaaguaagauaagcaaguauauaugugaguuaagagaagaacaugguguuaugcaccuauagagcuuagucaggaugcucagcuguaggggacuuuauuuaauuuugacaaggcguaugauuaucaaggcuggcccaugggaggaaggguuauggauuauacaugagagaaguaaguggggauauuuccuugcuugagaauuuaaucugcauaaggaguuugccuuaguuccucugcaaguuauuuugcuuucaagggagagcuuucacuggacagucaggugaggucugugagguuaguuaaauguagugacucccuauauguaguagaaacagcucaaaaguuguuuuuaaguaaggaagaaagggacaagauagacuugagugacauauagaagguauggaaacuuguagggaaagugaaaggagagcuuuguguacuggggggagaacagugccaggggaagggagcagcuagcaugugugguguguacucuguguguguuuccuccuucagucuucauaccgucccuacacaguauauaugccuucuacucauuuauaaauguggaagaaaacuagaauuuauacagcguguucaguacgucgugcuaguaagggccaaauuaaaauuagagcccagagu

SEQ ID NO: 8211 - RNA, 274 nt, Mus musculus
acguuuugaacuucucaccaacuucccucggaggaagcucucucaucuggacuaugacauuaccuuacaagaggcuggccucuguccucaagagacugucuuuguacaggaaagaaauuaacaccauggccugaccucucucagcuuaccccuuuuucucuuuuccugugagauaccaugucacuaaguaugcauuuuggcucauaggacuaacuguagagccaaagcugggcaagcaagucaccugccuuuucuuuaucucuuucugucacgu

SEQ ID NO: 8212 - RNA, 3589 nt, Mus musculus
uuguuuuuuuuguuuuuuuuuuuuugaaaacuggaauugaacuagauuauuaguucuuugucuuuucaagucauaggacuuuggauguuugaaguuuugaccugaauagggagugcuagggccaacuacuaacagagucaauuucauggaggaaguguaaaugugcaccuggagucacagcccuacaaagaacuauguccaccccaaaguuuuaagcaucuaguuauuuaaugacauccucagacuaauuaaaaguauacaaacuauacuugcuaaguuuuucccuggauucaaggaucuuuuguccaaucuuuuacagaccucauuguaaugacugaaaucccucaguacaguaguuacagaacuagugaucuuuaaacagccaguuaucuauuuuuuaaaacuuaauacuguaagcuuaaugaauuuuaaaaaugucuuaaauguaaugaaugcagaacagauaaugucuccaauacuggagcuguauuugugugcuuuaagauaaggacuggcaguuacaaagcugaauugugugaguugugaaguucagaauugguuugggcagaugugaccuuuucaagauuuucaucaaguugauauuuaaaaauaguucuugucccauggaauggaucuucaucucaccuuuuagagcuccuucauuuauguacuugauaguaaguuucagaguacaaaauuaugaguaaugccuuguguaaaacuaaaacuugaaaaguaaugaggguaggaagagccagcccugugagggcucacacuuccccggcagcuuaaaccgucaggaguaggcugcuucuaggcaaucacucugccucccgaguuacucccagccccugaacagacaccuaaaggcccugugagcagggagccaauuccagcgccacugguuugccuuacagaacauuucgguucuuuacugugaaacuuaagagucccuaguccacauuagaguggggcaaaaauguucuucagagcucagaauaaccaaagaguaccauucuaauauauugauuucuuguauaacacagagauuuaaaugcuucaguggugaucauuuggauuuuaaacucaccuuugcgucaguucucauaaugagacagcuuagaauuaaagguauuuggcuuauuuaagaacagagguuaucauagcuuuggucaaguuuuguuuguuuuguuuuuagagacaggguuucucuauguaauaacccuggcuguccugggcucgcuuuguggaccaggcaggcugaccucaaacucauagagaucugccugccaagugcugugacuagaggucugugccaccacaccuggcugguuaguuucuuuauuaaggaacucagguggcuagauuauuggauaugaugaaaccugaaguagaacaucaguuuaauccuuuauccauuugggggugggagugucuuuuauuuuguuuucaaacguucuuacauaguucaggcuaaccucuccucucuuuuuuuuuuuuuuuucuuugagauaaguuuucuuuaucuaguccugguuguccuggaucaggcugaccucuucagugacuguguaguuaguugaacauaaccuugaaccucuggguccuccuuggguuaaagugagccacaugccugucucuucuucauucuuuacuuaauuccucuaaaauuggucaugaaauuuaagacacuuagcuaugcuuuuaaaauuauauuucuaagccuuaauguauauuucucauuuuuauaaauuaauauagaagagaauauuuugaggcaaacaccguuuuuacaacucauuucuuccuaaggagaauucuuguuccaaguaagagaauggcuggcucugugauaaaccucuaagguaguugguuugguugguugguuacagguugcccuaacuaaaucucaccauuuucauaaacauuuuguuuuuuaaaaacacaacuccugaaccaguacuuaguuucaagcacauucauuagcccagacuggccuggagcucacuagcccuagguuggccuugagcucuucugggauuaagccacuacaccugguuuaaccugauuaauuuugaccauguuuuuaauauggccuguaugccauauaauuccaaaauaaacuugggugauccauauaaauuacuuuauuaagcauaaugaagaaguuauuaaaauuugcuugugggauuggagagauagcuguuagcuuagcagguaagaccacuuguucuugcagaaguccuagguuugagucccagcaaccauauagcugcccacaacugucuauaacuccaguuccaagcaaugcaacuguucugagucugaggccaccaggcacgcacacaggaaggaagcugaggcaagaggauugcuaguuccaugucaaccugaaguuacauaccaaaaccuuaacucaaaauccucuuugucucucccuucuuuaauacacccgugguuugcugugccguguguuuguacauugcauugcucuucuaaccccaauuaaauaucacuauccuuucaagaauuacaauuaaagcuauuaacaugccacaugcaggugucuacauuaacacaagucucauugcucugaaagaaaauagugagauauagaagcauugguuuauauuuugcuuaugcuugguuucauaagaagccagcgggugagauggcucagcaguuaagagcacuugcugcucuuguagaggcccuggguggguuuaguucucaguccucacacagugggccaccaccauccauaacuccagcuccaggggauccagugcugucuucugaccucugaagacuucuauaccacuagacaugcaggcaaaacagucauauguacaaaauaaauggaaacaaaacauguguuuaaagacuugcucguauauuagggaugugaauccaaugguaguauucuaccuaagaacagucacauugcucuauagguaugggaaguaaauugcugcacuuaauucuuuggcaguaagcagcagaccuuuaauguguaaugguacgucuagcaacuaagaucuuauaugccuuaugaggucacuuagguuuuuaaaugagaaagagaagagucaagcuaaacuagaauaauaggacauaccuaaugagcugucuucaccagacgagaagcuaugggcugguguguagcucaggacccuuguuuggauccccaggguuacuaagaagaaaaguuuuuaaucuaacugggacagugagaguccuguauuggccaucaaaaauugggaacuguuuuaaaugagauaaguucugaccuaaaauugaauuuuccuuuucucaaaauuuuuuauauuuacucuuauucauggucucaucugggaaucuuaacuaauagggagccauucacuaacuccuugguuucuuuccugcaucaagauaacugaugguauaguaugugucaccagaaugauuuucaggcuaaugacauuagaauauuuauauucagcuggaaaucuuguuuucaacagaaugaguuuaugguaugcuuuucucaaagcugcuauguucucaaugaaaaauaaucaauaaauacuaagucauaugacucaaaaua

SEQ ID NO: 8213 - RNA, 1164 nt, Mus musculus
cuguugguuuuuaaagaaauucuaagcaucuaggugucuuuuuuccccccuucucuuuaacuguuaagaaaguugucuuuccgguguuguucuauguaaacuucaggaguauuuguggguuuugcauguuuuguaugaguucaguuuaaacaaugcauuuaaaucaccugggauguccgauucuggcacgucuucacuguuuguguuuuaaacauguuucauguguuuccaaaccucacuugguaucuuacuugagaucauugaaguugauuugggauauuugcuuuacaaguguuuuuucaagcaguucuuaacacaguguuuagauguuuccugggcuguuuauaugcucaguuugcccugaacaaagugguggucuuacuaagauuuaaauucuuaauauaaaacaaguucuacguuuaaucuauaguucagcuuguugcugaauccaagacaaugcuaaugcuaauucuugugguguguuccugaccagugcccucuaguaugcuugugaguuuccagguuucuucccacagugcuaggagaucauuuacuguuacaaaacuuuuccaaaucggaaugaaggcugugagagaagcaagguggggaaaucacaccauccacugcaguuucuguucaaggugcgugaaagacccucccaaauaucuagugauuguaaaggugcuagggggagccugaauccaaaggaacacacaggcaggagagcuaggucuccuggcuaagacucccuggacuccacugcacccucuguaccuaggguacguuagacaccucccuauuauguuuccauggacacacauaggcuauuauaggcacgugcuuucugaagugaggaucucgcuguugaagauuuauuuccuaguuugggcuguaccaaauugugaauacucgcuguguuguacccaguugcuuuauauuaauacugcaacuugaauugggguggguggguggggcagcagggugugggagggaggguaauggaauaaagucuuuugaagacaucagcucacacugugcugagagagggaccaaacucaaggaaaccucugaucuauaaauucaacugcugcauuuuuuauaaauacauguaaauguccuguuguaauauuugaucuuggaaauaaaaaaaaaacuuuucaguau

SEQ ID NO: 8214 - RNA, 9213 nt, Mus musculus
caugaauacccaggcaaccgcuacauaugcaggaccuucccgacccugcaagccuagccggcuggggcugcccgaggggccaagguccauuuugaagagugucuccuccacuuucuuguucuccuauccugauucuugccaucacaaacagguaagaagagaugagaggguccucuaaaaugauauauccuagaccagcagggcuuagccguuuagacugccagucuugcgauaccagcucugcugcuuaaccacugggacuugaggcugucucucagugaacuugucuuggugaacuucaggccucuguaccugccuagaauaccuuucccauccagugccuccuuaauaguuaaguuuugccaugacagcacuccuuccaggagcccuuguuguuucaggcaagggucaagcaguccugugagagagcuucugcccuuuauucuccuccuuuuucucuguuccccuagcucuauaguccucgagggaagggacugcuuuguuuugauuuucaccguuuucucccuagguucuagugcaguugucuggcuuaacaucuacuaaaggaugcagggagagaugggaguggggaaaccggacacagaaauugugcucuuccucccaggcaagugcuccugggcccagacaguggcugaugauugguucacacggccugcaccucagguucuagggagggccuccucuacagccuaguuuuaagauuugaccuuugggggaauaaugguacauaccuucggucuuaucacuugggagguggaggcagaaaaaucagaaauucaaggccagcuucugcuacaagagaccccgucucaaaaaccaaaccaaaccaaacuugaccuucugaucucggcugccucuacucacgagaaaaugggcucuuugcuaaucugacucacauguuuggaaggcugucucggggcguugugguuucuaagggaacagucucagagaggaagugaaaggcaaaccgagucacagcauccuuucucuguagauggaguagggcccucuugcucuucucagggcaggccagccaaggguuacuagugacugagcagggccagaaccuucagggacagacucuugucuuaguuccccuucaaguuauccuuuuccuucauuuucaguuaaaauuuuauguugcaagcugagcaugcccagagacauuucuguucauugcuuugacauauagguaccauccuccucgaaaaauuccuaguuuuccauaacaacuucauuugagcuugcucagagugccuuagcugagcaugcuuguguacauauacuuagaguggggccaccccggucugacugugaauuaagcccucgaauggaauccucuugcuccguuugcucucuuuggcaguacguauaaacauccuuaccuacuucuuuacgccuuggccacgcugguucuggcuuggcacucacugagacacugugagccuguugugucccguuaggugcucucugaauuccacucacccaaaagaccauacucggguuugcaguuuuucucuauuuguuuaaauuuguuuuguuuuguuuagccuaggcucauguagccuagccuggccucaaauacacacuguagccaaggcuggccugaacuguaaaucccuuguuuccaaucccaugugugugcuagcauggaggcacacaccaccaugccugacuucaagaauuauucauuuguugauuaucuaaaguucaguaauaacuuugagucuuuucuuguuuguuucuuuguuugcuuauugaagcagggucucuuguagccacaguaggccuuaaacucacuauguggagaacagccuugaacuccuaaucuccuugacucuaguucccaaaucugggaccauaggugugugccacugggccuggcgcaggcucacucacuauuccagcccuuccuuugguuuucccaagagaaaacagcacaaggagaguuugguuuggguacuuggugggcucucuaaacaguggugugguaugagcagaugcugaaggcauuccugggccagguucaaaauauguuccuggauggccaguagcaaccuaucaguccuucagucgguccuucccaggccuggaaaaaucagucuucugagaggcaguggguuaaugucacaaguggaacacugcccuuaaauggcaagguaaucugaggagggaagacugcccagaucacaagaugaugaggaacuuguacaagggggaaaccccacagccuccagcauggcagcgaggaauauuuuguagagggccuagucucuccauagcuggacaagggucagauccucacaggggcuucgaagcugaaucuggagcucuucaccacucccuucccugcaggucucaggugaaagcuguucuccacccccacccccagcucugcuagcaagacccagacauccuuucacuuggaaggagcuacuuuauucugugugcaagggcuugguaaaggccacuccccacacagaacaggaaaauggcagcgggaaguaggugacuggggggagcggggagaacauggacugaggggaaucacaagccaccaagggcaguggggaccagcugaggagagagacugccucuaaagugcuguuucuggcaaccaucuucuuaccauaaacuguagcuugcacaagcuaacuaggcaagguauaaccggugaugcacucccaaaggcagaggcagacugaucaauucgaguuugaggccagguugaaauuuaggucaaccaggcuaaauagugagaccuugucucaaguaaaacaaacuucuggcuggguggugguggcgaacaccuuuagucccagcacuugguaggcagaggcaggcgaauuucugaguuugaggccagccuggucuacagagugaguuccaggacagccagggcuauacagagaaacccugacucaaacaaacaaacaaaacaacaaacaaacaaacaaacaaacaaaaaacuucugacaagugcaggucuucucucugucucucugucucugucucugucucugucucucuuucucucucucucucucuuucucucucucucucucucucucucucucucucucuccuucucccuuccccuccaucccuauccccagguuagcauuaaacaccugggcuuauaugaucuuccuucuccugccucaccuucccaugcaggacuacagguaugaacaaccaugcuggcauuggucauucauguuuuccuuuucuccacaaagcucuguaauucuuagcacauacauccuguacccauuguuaaagauauccauggauauuuuuguuuuaugcuauuagagauaucuuuuaaaguaaacauuucaccuugucuacauauaggauaggauauaauauuaauauucuguucuauauccuuugcuaaauucacuuauuauuuaaguaauuuuuaguagacugcuuaggauuuucuaccuauauaaccagauuaucuuugaauaauguuacuuccugucugugaauuuuuuuuauuacacugaacaaacaauaagaacacuacugacagccagguguggaucccagcacuugggaggcagacagaucucuuugaguuugaggccaacuuauuguacacacuugaccagccaagguuacauagugaggcccuguuucaaaaaacaaaccaaauaacacaaacaacaacaucgaaauaauacaacugacaagaagcauagaaaaugggcaucuugaugacaaccuuuaaaagcuuuauuaaauagaaaaauaaccauuggacuguugagauggcccagcaggugcuugccaccaagccugacaaggugaguuccaccccuagugagagcccgccuuggaacuucccaugaaacuucccacugggccuuagaggaaguccuugagacccccucccuucccagccaaucaauguaaaggucaccagaacaaccaaucauuaugugccuaguugcugcggcuauaaucugcccucaaaaauuguauaaaaagcuuaugaaagaaagagaaggggucgccucuccuguggguacaggaugcccccagcaugcuggaaaaaauaagccucuugcuuuugcacugaacuuggaacuccguucucaguugggggucuccuggaagcugaggcucauuuugucucuuacacugggguccccuccccaugauggaaggagagaacagacuccuaaaaacuguccuuugggggcuggagagaugacucagugguuaagagcagugacugcucuuucagaggaucaguucccagcacccacacaguggcucacaacuucuaacuauagucuuuaacuguagucucaugggaucagaugaccuauucugguauaaagaucgauguacaugcagacaaaacauuuauauacauaaauaauuuuucuucaaaggaaguugagugggguggugguagcacguaccuuuaaucucaguacuaggagacaggggcaguuggaucucugugaguucgaagucagccuggucuacagugggaguucuaggacagccuaggcuacacagagaaacccuugucaaaaaaaaaaaaaaagagagagagaaagaaagagagagagagggagggagggagggagggaagaagggagggagggagggagaaaggaaggaaggaaggaaggaaggaagaaauggagacaaagaaaccaagaaaaauuguccuaugaccucuaaaucuaugauguaugcccauuuccccuuuccuaaaugaguaaaauauaauacaauuuuaaaagaaaaauauagagauagccuuacuguuauaauagggcacacacaaaauaugguggacuguggaaacaugugucagagcuuggcagaaaauauauaggaggauguaacuccuguauauuggggaaggcuuagaaggggaacacguuuauaaagcucugccgcugcccuugauaggaucuguucacagaagccaucuccacucuugucuuauaccacaucccguuggcaugucugcccugaucugccgugaccuucuuucauuguuucaggaugcuguccuuuucccguguggugaacugcucacggaccuguucucgcuuccugggacugagucuggggaccgcaucccugugugcugcuggugccaacaucgcgcuccucuuuccuaacugggaugugaccuaccugaugaggggccucauuggcaagcaugccaugcugggcucugggcucuggggaggaggccucaugguaugugucugggguucagugaggaggaauucccaaagccucuuuaggaauggagcugagaggugguguuggauccauaaacagcccaaagagaagggggacuugucauggguugcuggguguugaacuuggauccaggaagccuggaucaauguuagcaccuacagagucaaaucaggcuaaaccuucaaccugggcccuaaggccauugcaacagcuguguguggcacuagaaaugcaaaucacucagucucuuguagagccauuuauuuuuauguguguggguguuuugacuguauguauguauguauguauguauguauguauguauguguaccgcgugggugcaggaaauuucagaggccagaagaggguguuggauuucccuggaacuggaguaacagguuguuagccacagugggugcuggaaaccaaaccuggguccucugaaauagcaucagcaucuuaaccagggaggcaucccucuggccccaccuggucuccgguaacagacuuccuugcucuccagguucuccuggcagccacccucaucuccaugacaggcagcuucaguaagagugcacccugccugcagguaagcaagguccccaccccuuuaacacaacuccugcauuuccugcucuggaggcagagggcugggugggugggugggggggggcaguuuuagguuucaggcuggaagucagauccuaacugugcccuuuaacaacuccaaacucuugacaagccucguuacuuuuccagcgcaucuguaagaagggaguugccucagggcaaagaaggaaguggcuaaugaaccccagaugcccacagaaauaugauaaacuuauuuucucugauacacugauuaguaugaaugaacgucaaauuuucugaaggauuugcuaaaacacaaaucacucagucucaaccuggguuucugacccagaaaaucgggauggacuggagagagucugcauuucaacacacguucccaagugacgugcucuugcugcacugggagaaccaagaugcugggcucugucagauuaagccaguuugaguccucuaacaugagagucaacuccuugucugcccccuuccugccuuuuguguacuugauuugaaaaggagagaucaagaguaagaauuuuggagcuuuaaaaccuugucacuagaggagagaaguggacgugcaauaaacagucugccaacucagagcugagacacugcaguagaagggcaggagucucaaccugcucaaagguccaaagacccugugcagugaggagaugaagauacaugugucugucugucuggccuuucucaaaaaccucaucuugacucuacccagcaacagaaacuuuaucagccaugcguggacauauguuaagggugggggaaugccuggccaccagagaaauuagacuuggccaugucaccccacuccuccccccugaccacagcucugugugagcuagguuucugccuccucugcaggugcucauugcucuuuugucaaguggccuggcucugcuuggggcugugauuugcuuugucacuucuggaguagccuugaaagauggucccuuuugcauguuugaugucucauccuucaaucagacacaagcuuggaaauucggcuaucccuuuaaagaucuacacaacagguaacagucacucauaagcccagucccgugauuugggccaggagagcccgacccuggguuuucuauuggaguuccuugauugucuuuucuucuuuaucaaccccugaccucuuucuugggucuaggaauuaucuguaugaccguucacuuuggaccuccguuugccuggagcccucuaaggcugugguuuggcacguggccuucuucuccauccuccuguguaucagccuccuccagcuucucuugguggccauccaucuugucaauagcauccucggccuguucugcagcuucugugagaagcacuagguaacggaugcccucucgugaauuggcgcgcucaggacaagcuucccccaaccuuuucugcaagaauaggcugugaauccccuuuagaccuucuuauaggaugacagggcugccuugcucacagcaacaaagucaugcugcuguauaaaugaucucaguucaaccccuuaaaaaccucauaaaagggcuggaggaauggcucagagguugagagcacugacugcucuuccagaggguccugaguacaauucccagcaacuucaugauggcucacaaccaucuauaaagagaucgggugcccucuucugacaugcaggcauauauucaggcagaacacuguauaauaauaaauaaauagauaaaucuuuaaaaucucauaaagguuggccacauguuaagacagagaagcuggggcucuugcuccuucgccugcuugcugugugagacugaguaacugcuagauccuuggacuuccauucacagcugcaacugaaccauuguugggaauugggcugccgacuuuucccacagucagaucacgagccuguacagucgcuucacuagccuggacaaaggggagaacgggacucucagccgggaagauuuccagaggauuccagaacuugccaucaacccacugggggaccggaucaucaaugccuucuucucagagggagaggaucagguaaacuuccgaggauucaugagaacauuggcucauuuccaacccauugaggauaacgaaaagagcaaagaugugaauggcccggaaccccucaacagccggagcaacaagcugcacuuugcuuuuagacucuaugauuuggauaaagaugacaagaucucccgugaugagcuguuacagguacugagaaugaugguuggagugaauaucucagaugagcagcugggcaguauugcagacaagaucauccaggaggcugaccaagauggagauagugccacaucuuuuacagaauucgcuaagguuuuggagaaaguggauguagaacagaagaugagcauccgauuucuucacuaaagggcagagaccaaauuauucuugcuuuccaguauuaugaacugaaacuuguguccuccagccccaccucauccugucauccccuuuucccagaauacuacagcucuugcaugacaaccugaagucucuccuguccauacaaacuugccuuugguguauaaacagggcguuacagaaugguacccucugucugcuucuguucaguaucuacccaccagguccuuaguugucaguaccaucuuccccuguuugcugcugagugccaugcauccauccugucuggggaaaugaaccagccagcaaagcucccacuggauggggaccauauccaugcugccuuccauccccgcaucgagccuccaccauguuucugugaccuuguguccuuuugucuuugugucuguuacuuccuaccucucaaucauccaaccuucucuccauucagucuuucagcugcccuccuguuguugagauucccugcauuuuacuugguuuugggcucugggcucugcuguuaagccuguuucugauguggcaggauaguuaguggucuggugaguuauaucuaccuucugaugugucucugggacguugccuauccaggagcuuuucagcaagcaguacugcucuuggaaacaugugacucccuugguccccuguauugcucuguugucgaagggcuuaugagcagacauguucuuaaaagguggucauggugaggcuuguagagccauguuuccuagguggcuuccuaggucucucuaccucugacuuuuaauuuucaaacauauuuauguggcuuuucugguuacaguguugacauucauuagaaaauauucuaaugccugccacuuugcuucucuuugggacauugucaccacccaagugguucuucugacaauaugguagagggccuucuuguaguuuucugaa

SEQ ID NO: 8215 - RNA, 44524 nt, Mus musculus
ggacuuccgguccgcaguccggucagauguuucccgggcgucuccccgcaacccauuugacuucgcuagucggugacgcggcgcggggaagggauccgagggggaccggagccuggaggaguugagguaaggaaacuccggguagugggugcuuugcgaggacaaaggcgggcugggagcgugagggggcugcgacugaagagugggccagugacagcuagggaaagugugaagcaggaggcuacugugaccgagguacaaugacagccaagaggacugugacccagggguggccgcuugugaggggucugugacccccggagcaguaaaugcgagggacucugaccucggagagcacgaggcagaggcugcgacgggaccaugaccgaguaaguaugcagcagugacuacccggggacugacugaucgauggauagugacugaggggauugauccgagggaccaugaagcagcggcugcgagggcgcgcucaccgacaagcagcgacuuugagggcugacuuggaggagaauguaagaucaggaauuggggguggugcuuugcacuuguguuuguguacaaagugugagugaaugagcgagggacccacccggcacaggucuuacgaagaaaccgcacuggugugagaccagaccagaguuugaauuuuacgggcaaacuuccgugggugagaaacuuaguucaccacugagcuagugucuucgucaguaagcggaaaguucagaguuggauuaugccacccaacucugagucccaguuuacuauugggcugugaagacaguuuaguuggauggcaacuaacuaaauacagacaacuggucuacaauagaaauccccgcuguguucacauaguaaggauuuauaaaauagguuucagguguguuugcaaugaugcuauaaaguuagcuuccuacaucuuacuacguaugcaguaaacgagcuaaaguuugaaaacuggguguggugauacacaacuagaauucagacacccaggaggcugagacaaguauuuucaguugggcuuaaaaauuuugguggacuuaaaguguuuugguuuuguuucuuugcucuugcuugugaguuuguuucuucaagucaaggugucucuauguagcccugguuguccuggaacucccucuguagaccgggcuggccuugaacucagagaucugccuauuucugccucaccagugcuggcucugaggcauuaauacaggaucucacuauguauagccacugaccuggaaccaucuagaccaggguggccuugaacucacagagacuccuggccucugccucaagauuaaaggugcaugccaccaugucuagcuuuuugcuguuguugcuuuuuuaguuugagaaguaguggguuuggauuauuugagguuuuucuuucuguaaugauucuaugauuaaggaacugcagagaaguaaguguagagugaguuaggaacugggaccugugcuggccacaggcuccaacagauggccuuaacuggagaaagcuauuugaccguaaucaagauagcuaguuaugauugaggacuaaaacacaauuuuuguugggagagccaaaagcuauauugaaauagggauggugauaguuauagaagcaauaaggauauaggcguuuguuguggagaaacugccaggaauaggcauugaggaaggagaaacuuugaggauaacacaguuuaagagcaaaacugcaaacccagaaaacaguuugcuaagaauaaaauagaaguagggagagauagaucuucauauucuauucaaucuuuaugguuggagagucuacaaguaaauaggauugcuauuaaaaagguauugggucaggugugguaccaaaugucuuuuauuccagcacuugggagguacagauagggauaucucugagcucaaggccagccucaacugcaaguggaguaucaggacagccaggauugcauagaaagacuuugucuaaaaaaaauuaaaaaaaaaaagauacugggauagggcaugguagaacauaccuuuaaagaccagccugcucuccauaguaagcuucaggacagucaggagagagagagagagagagagagagagagagagagagagagagagagagagagagagagagagagaaugaaugagaaugaauaucucaaaacaaaacaaugguaacaggaauuugaaagcuagcugugguuguauauauccuaucauuugagaaguugaggcuggaggauggugaauccuagguuagccugggcuguuuuaacuucacuacaguguauuaaucugguuaccuaccuaauagccacccuucucacuguacacuuuacaauagggaaugaagagucagaaagguucuuaaguggaaauugcugaggguuuggaggacuauucuggccugaccaguuacaccuuuaggacuaaugcuuauguacuugacacauauuuuacacaaccagaaggaacuagaagagaaccugcuucaacuucacuucucuagggaauuggcuaguuuuucgcuugugcuuguuuguuuuuguuuuuaauuugggguuuaaaccaaggcugauuugccgauuucuuucaaagcaagcuagcaaaauggcuggguaugaugguacaggcuuguacguucagcagcugggugguaaaggcaugaggaucacaaguucacggccauccuugaacucuuuccuuggcugcauagagaguuugaggccagccucagugagaaccaguauggugacuuuauugagagagaaugagcuuaugauuucuccuuguauaaauauggagaguuugucguucuugaggaccuccucauaaggaacauggucucacuggguuccaggcugcuuuuccugauguuaacacuaacucacucugauuaugggaaggauuauuucuuuucuuuuccaacauaauauuuuuauuuguuauuugggaguuucacauaaugaacgccaucacguucacaucccagucuucccaauccaacugcuacccuugugaccucccugagaaaaaggauagaaaaaaaggucagcuuuguguuacccauagacucacuggagcauggucaaacaaccaguaggauuauuccauauacuuauuuuagguuuagauuuccuaaauaauugaauuauuguuguuuauguuuugaauuucacuuucuagguagguguacagcagggcauccucccacccccaccccaccucacuccuucugguuaacugucagaaccacaaguuaaaaacuguauucguuugaggcuuucuucguuugaacuagggugagugccagcgaacgaggggagcccucuccuucuggucugcaaagcuguuacaucacagccacagcuguuuacuaaccgcucuugacacgagggcugcuaaaaauagggacaugggguuugcucuauacuugagaaaugagaaguguaugacucuuaagaaagggguggguuugguuuuguauuugagaucuaccuugaaugugauuauuugcuuacuuuauggucacagaacaggguucuuuuuugugguauaauggaaccucaugaagucuguuuucagaguaauguuuuuucuuuucuuuucucuuucuuucuuucuuucuuuuuucuuuuuuuuuuaaauuuagguaggguuucuuuggguaaccuccgcugucuuggaacucgcucuguauaccaggcuggccuccaacucacagagauccaccugucucugccucccuaguguggggauuaaaaguguacacuaccacuacuaggcauguuuuccuuuuccugauuuucuucucucucucucucucucucucucucucucucucucucucucucucucucucucucucucucucucucucucucucucucucucucucucucuuuuuuuuuugaagcaggauuucacauagccuaggcugucuuccaacuugcugaguaacugggaaugaccuugaacuccugauucucuugucauuaccucccaaaugcugauaccacagacacaaaccaccacacuuagcuuaaaguaaauuucuuuucuuuuuuguuuuucugagaaugagucuuacuguauagcccuggcuggccuggaccucacuauguagaccagacacauagagauccaccugcuccuaccucuuaaaugcugagccagaagagagcauuggaucuccuggaacuagaauugcagacaguuuugagcugccacaucgggucuaggaguugaacccaaguccucuagaagagcagccagagcucuuaacugcugagccugcaccacaucaguggaauacuuuucuuacauacaaaauuaaaauacauaggauuauaaaaaagucaacuauauugcaaguuaugcuuugaaauucacuuuuacauuuagaacuaauuaaaauuagaaauuuagauguuaagccaggcaugguggcgcacgccuuuaaucccagcacuugggaggcagaggcagguggauuucugaguucgaggccagccuggucuacaaacugaguuccaggacagccagggcuauacagagaaacucucucucaaaaaacaaaacaaaacaaaacaaaauuuagauguuguuauaacuuuuuagucucuauaaugugauacauacaagggaguuauauaaauugcacuaacccuauauuagaaguuaagguacauuucuuaaaaacauguuacuauuuauuggaguauguguguguguguauguauguauguauacauacauguguacauccaugucacaguagagguguggaggucaggacaacucuggagauuuuucuucuuccacuucauguggauuguaggaaucaaacucagauugucaauuugcucagcaauaucuuuaucugcuuagcuuuguaguaaucgcuagcuuuauaguauaauuuauugaaauaauucuauuucuauacugucuuuuaccuuagauuguauaguccuagguaaaauuugucaacagaugauuuguuaaaacugauucugaugcuggcaucaugauacaugccuuuaaucccagcacgcaaaggcuaagguaggagaaucacuguggugaguucaagaccagccugguucacacagcaaguuccaggacagccagguuacgugcagauaccuugucuuaaaacaaaccaaaacaaauggaguucugucuucaucuacagaucugaguuguccaacuuguuuaguaugucaguaaauauuuuggguuugcaggucacaagucucuuuugcaacuauucaccucugcugugcugcauuaaacuuauagaagcaggcagggccaucacaggccugccaaaaagucuguucacucccagucugggaguucuggguuguuuuuuccuuuucuuuucuuuuuuaauguauuuauuuauuuuaugcaugugugcccuaucuguauguauaccugcacgccagaagaggguaucagaucccauuacagaugguugugagccaccaugugguuucugggaauugaacucaggaccuuuggaagagcagacagugcucuuaacagcugagccagcucuucagcccuggaguucuaguucuugcauaaaguccuucuuccuuuuggacuagucccaucuucucuuaaacuucaaaagacuuuccagaagcaguaauguggcugcugaaaggccugagugcacaguaaaggacaugauugacgaauaucgagaguguuaggugcaugccuuagaaugcacagaacuuauuaagguccagcauaguagaacagguaaagguuccacauacagaauaagaagcuggcugagaugacaaagugcugagggaagggucaucucucuuguuuugcauaguucucucugguaaucagucuaauugcugaaguugggaaagguaugugugguuucaguuuggaauuaauuaggcugucacauacuuuuggaaccacuuccuuuuuugcccuggggugcuugcuaagucuaauaacaguuaaguauaauagaaggguugggugagagucucuaaaacuguacuuauaggggccuuucaucuugaagacacaaccaugugcaugccugaacuaaguaagguuuugucucccucaggacacucgucuugaaaaagugcuugguaagacaaguucaguggacaaaaauaauccaauagauaaagguguugucacaaaaccugauggccugauuuccaucuaugggauccacauuggaaggaggggagagaacuaacucugcaaauuguccucugaccuccucacauauacagugguacaugcacaccaauauccaugcucacacacuugcaugugcacacacaauauuuaaaaaaaaaacuucuaaaaauaaacuuuuuaaauuaaauaaagauaaaaagacuugaggaagaaggucauuccuuaauauccccucucuguuguuccaccccccgcauacacauuucuacauuuuuagcugaguccaugaguccaagaaggcauguauuggaacagugaagaacagggcagucaguguguccugggaggugagucagcagaagcauugccagguaaugugcuucugaagagagauggacagcaggcacagaugcugcacugugucuugagagcacuugggagacacuaaugcagcuaguaggcugggugggaggaggugacauugauguccacauuuagaauguguaacuaagaaggugacaggcaggggaggcagagguccacuguuggucccuguaucuuuguuacagcuguuugggaaaauuuuucugaaggauacagcacuaggaaggagaaaggcaaugucuccugggagcuggagagauggcucagcaguuaagagcacugacuacucuuccagaggucuugaguucgauucccagcaaccacaugguggcucacaaccaccuguaacagggaucugacacucucuucuggggugucugaagacagcuacaguguacucauauaacuaaaauaaauguuuucuuuucuuuuuuuuuuaaaguuuguuuaaaaaaaaaaagaaaaagaaauguuugccugucuucauagagcuaacgagggaguucuauauugucugcaacuuauuucuuuccugacucuucccuguugaauuaacuaagaacugaauguuuccugggcacuagagaucauuacuaggcacugcauuaugaguuuugaaucauauuuuaauuuuuugcaagugguaaacaaaucgcuauuagcugacuuaggcaaaaggagaguguauuuguuguuguaauaaauaguucugggucuggcucucaccaucagguccucuuuaucuacacugacuuccuagccuuuccucccaguuuuaagauggccacuaaguuggucccagggucaaauccauaaaaucaggagugauagcguuugcccaaguguuuucaucucuacagucccauuucuuuuguguggacugguuuagguuuuguaccacugcccccaccuccuucccaacaucuuguagcugcggggcuugauugcugauugguuuagguuugccacaugggaucaauugcuagggcgagggagaaggcgcagggaggaaaugaaccuccaaauguaaaggaggucuuuuuuaggucauggagauugaauguguggaaaggcaaacaacaaauguccaguauaaucaggauuuauagucuaauuucuuauuugaucuuuaccaugacucuggaauuaaguauauuuuauugaagccuuucuuaaucacaggaagaaacucccagccuccuaagguuaagcuuggaggaccuagaauuaaaucucaauuuaauugggaccugaguacuugugggaagggagccuaguguuuaugaaaagugaaguuaaauccugccugacacuauaguauacaaaagcaauacaguguucugauucagaacacagacuguagacacagaauuccuggguucagauguuuuugaaagggauccaguauaucuuauguacuggccaccuaugccuuaccaaaaaaaaaaaaaaguuguauggaguccagaaagaaaaauccugcuuuuccccuguguuagaugggcgagcucagugaaaucaugugaccucacugagcuucagucuccucaugcacaagguggggaugagggccagcgccguggcauggggugaugaggauggucacauuauuuaauaugcauagggggcuuauaacuuccugacacacagaacacuauuugcuaugauaauuguaauuaguguuauaacauuauaaucuuuggggcugccauguaggaauguggauuguuuguuagcacaauaaaauagauuuacauccauuugaacauacucauuaagaauuccaaauauauccuauauuuuaucuauuaauuuauuuuguuuuuucaagacagauuuuucuguguaacaguccuggcuguccuagaacuggccuuguagaccaagcuggccuugaacucagagaucuacuugccucugccuucugagugcuaggauuaauaguguguaccaccaagccuagcugauaaaacucucuuauuguauuuuaucuaagggauauuagggugcuuuuggaaaggauggcucuugugauguaucacauuguuauaugaggcuaucuguuuauccugaucaacauuuucaguagugccuuaucuauuaaaaucauaaaaccaagauuuuuuggcagaugugguagcuugcaccuauaaucucuauaccugaaaggcugaggcaggaggauugcuauucacuuuuaaggcuaaccuggacaauauagugaguuccaggucagagugagacccuguaauggcuauucuugguuguaaacuuaacuauaucuggggugaucuacaauccagaauuggaaggcucaccugugauccagaucuugaggcuggaagauacaaguuucuaaccuggaucuuggcauggagaucuugaggcaugguggcuaugaagcccuggagacuaaggcaaggagaucucuucuucuccugcuugcauuuacuugccagcacaucuguuggagucuacuagccuugugggacugaacaacuacuagauccuugaacuucccauucacagcugaccauuguuggggaguuggacuacagacuguaagucaucauaacaaauucccuuacuauauggauagagauuauccauaaguucugugacucuagaggacccugacaaacacagaccuugucucaaaaaagaggcuggguguuagugguguguaccuuuaaucccagcacacaggaggcagaaacaggcagaugucugaguuugaggacagccagggcuacacugagaaacugucucaaaaaaaccaaaaggaggagcagaaggaggaagaggaggagcagcagcagcagcagcaacagccacuguugcccaaguugcuuuuuuaauuuacugaauaugugaaguugugguaaggcucacaugguagauggcauucagauuaaguuaucucaagagauuaaaacaaagaacagcaugagccuuuuuagaauuaugauuaaaauuaacuuuaaaaggaauaagucuauuauaaccuuuuagauguaaaggucaguugguauuucuguaacaccacagauaauggcugugagucucuguucuagguagagguguuucuccacgaacaucugaccuuucuuuguacuacaguaguaucucuagugaaaaucuguucugaaaugccuuguguugccccugaggugcccaguccauuggcagauaauuccugaaaagaguuuauuauauucaauuaaaaccugucucucagaugggaaguggugaugaacaccuuucauuccagcacuugggagucagaggcagacuaaccugguguaggcauaccugguguacagagugaguucuaggacagccaaagcuguauagagacuccgucuuacaaaaccaaugugucuagaaccuuccaguaaguaaucuacuuuuuguugccuggcccuucagaguaagucucugcccuguccagugugacacaucgaaguagaaacuuaaggguccuguggagagucuguuauguuggaugguguguugcuggagcaagcacaugaaagagugcuucagaaaaguggacacaggugaagggcuaaggcagacuugugaaggaacguuuugcugaagcagauauaggagagaggauguccugcuaaagcaagcaugugaaagaacacgugaugaaggauucuucacuaaugacaugcauguauugaucugccugacauugcauaguugagauccauuucuugggacuccauagagagaaaaugcacuaaaaacuucugauggugugcugcaguuucuuguugcuucuguugacucgguuugauuggcagaguaaugucagcugagacagagucaggugcugagacaagaccuguggugaggcaagacccauggagaacacaugauguuuggaggguauaaauaggacucaacggacaguaacggaggcugagcucugcuugcuuauagagcuagcuguauaacacuuguugguuuugagucuucaccaaucuucgcuuugcuuagagaggcacugcagagaacuuguguuccugguguuccuauuggcccuggucccuccugcugauuuguacccaggcugaagccuggcugucucugcuagguuagugccaggcugcugacuccuguuugcucucccgacuaccagaacuggacugcugaugaucugugaauuguuugcaagaggauugagcugccacuauuggccugugaacucaacugucaacaacacagaggggaguuguuccaaaagaaccauuucuaaacagguccacuucccccguauccacuaccucugguggguggugggcuaaaagggagguuaaagcaucuaaaaaaacaccuuuaaaaauaagauuuaagcugggcagugguggugcacaccuuuaaucucagcacuugggagguagguagaggcagguggauuucugaguucaaggccagccuggucuauacagugaguuccagggcagccagggcuacacagaaaaacccugucucagaaaaaaaaaagaaaaggaaaagaaaagaaaaauuaagguuuaaaaaauuguuaaacacaugcauauauauauauaaagauaauuauuugguaccuuuuuauaugguugaggauugcauuaauaaauugucuacuaguguuuucugauaccaacuuauuuuuuuucacuuacuuguuuacuuauuuguuuguuggucaagaucuuucuauguagcccuagcuaucaugaaauucacuguguagacuaaguuggucuuuaacucacagagaucuaccugccucugccuccugaauacuuggauuaaagguguugauagcacugggcauaguauugcaccccuuuaaccccagcacuugggaagcagaagcggaucuaugugaguuccaggccagccuggucuacaaaucaaguccaggacagccagggcucuguaacagagaaaccccuuaucucaaagugguguguguguggauaggucaaaggguuguaaacacugugaguuuuaauaauuuuaaagugccuuuggcaggcaguuguuacauaaaugcucagcauuaguaaagguguucuuuguuuuuggagacaggguuucucuguguagcccugguuguccuguagaccaggcuggccuugaauucacagauaucuaccugccuuugccucccagauaccaagauuaaagguguacaccaccacccucuguaaauaaaucuuaacaagaaaaaagggcuauuauuaaauuggccuuugaaucuccaaacugugaacuagcaucuauauaaguuaaugggucucagguauuuuguuauaguaaggcaaaauggacuaauacaggaagucgguaugaaggagugagcuuguuaauauuagaccucagacucuccuccuggagaaggaucagccauauuuuauguacugucccugagcuaccuaguguagcagccacuucaagagaacacuaggauaugcuuccuaaaucuuguauucuaccuuuacucaucugcugaacucagcucuucccuugaaaauuaagaaauuuccuuuguucuauggguuauuugggccucuaccucaguauccccaacugcaagugggaaucauuacuaugggauauuucaccugggaucuaucuuaguguaucccuacaucaaaaaagaaauguguuuuuaaaguuuauucccucucccuauuccccaucccucucccauguguguguguguguguguguguguguguguguguguguguucacaugugcaucaugugugucugucucucacuggcccaggaaugacuuucuauuggaaauuggaugaaaaaccacucuugucacacuguagcaaagaaguuaccagauuggguacuucaccuuugacuauggaaagcuaaaauuaagaaugcuagacuacuaacugaguauaacaguaugugccugccuuuaaucucagcacuugggaggcagaggcaggugcaucucuguaaguucaaagccagguuggucugcagaguaaguucuaccaaggcuacauagagaaacuuugucucaaaaaacaaauaaaagauuaauuuauuugguaaaagggauucuuucuuccuccuucuccuccuccuccuccucuuccuccuccucuuccuccucuuccuccuccuccuccuccuccuccuccuccuccuccuccuucuucuucuucuucucucucucucucucucucucucucucucucucucucucucucucucacaucucuuuuucauccugugcauguucugcaaacacucuuauuacugagccuaauccccagcucucuuuuuacuuuuauuuugagacacuguuuuacuaguuaucuacucuggucuugaacucacuauguggcugagguuggccuugacuuuucaguuuuccucucucauuuucucaaguagcugagacuacagaagagauuuuuuuaaauuauuuuauuuuauuuuauguguauggguguuuuaacugcuuguauauuugugugcuaugcauguguagugccugaaagaggccagaagaggauaucauaucacuuggacuggaguuaugauugugagccaccauguggguacugggaacugaacccugucucccagaagaacagccaguggcuuaaccacuguggugguuugaaugggauggcccauagguuuaaauauuuaaguauuuaguccccaguuaguggaacuguuuggaaaggauuagaagguauggccuguuggaguucgucaaaagacccuuacucacaaagaccacagagaucgccaucgcugcaaaccacaugaggaguuuuuauugauccaacaugcuggggacuccccucucagcaugcagaccagaggagagacauagaacauagaaagaacacacuuuuuauaccuuuguaaggggcagacuugggaaauagaguucucauugguguagcaaguaacccuuucaggcauugguugguuugcauagugacuaccuuuggccuagugacucacuuugcuugcccccaugguggguuauuaugauuuggucagcaaaguaauaguccauuuugaacuuaugggucauucacagcuacuaacgucacaggggauccuagcaaggucagggugguuuguggucuuucucagaauucaguguggggugggguaggggaauuucucuaggaacugcuaucuuguuaugguuauuucucugagaacagcuaauauuguuuugguagcuguagucuuaaucauuuugaccgcuaaaacuauguuuuuacauuuguuuagucagccagcuuucuuaucuggcucugcacuuguccugcuaguauaguuuggaaauuccuuuucgaagggugaagguacuggguggucuugaauucauuuugaauauuacagccuuguuggaggagguauaucauugagugggcuuugagguuucaaaagcccauucgagguccaguuucucuuucucuucccugugccuguguaucaguguguaaagcuuucaguuauugcuuggcacagugccuauccacuuuuucaugauaauugugaacucacccucaaaaacuuuaagcaagccccaaauuuaaugcuuuauuuuauaagaguugccuuggucaugaugucucuucacagaaauagaacuguaacuaagaugcuggguagugguagcauaugccuuuaaucccagcacucuggagacagaggcaggcagaucucugaguuggagccuagucuggucuauggagagaguuuuaggacagccagggauacacagagaaaccuuauuucuaaaaaagaaagaaagaagaaccguaaauaagacaaccaccaaucucucucuccagccccugguagaagggauuuuaaagcaaguaaguaucugggcugagaaacaggaguuauuaauuuuacccagauuacagugaaucuaaggagcaaaggaagcaagguggaaagauuuggaagcuaugcagccagagaaggaacaaaggaacaugaugagaggauguguacaagaagcugagugcuagagagugaugcuuagcauugggauaauuggaaaaggcuaguguagcucagaaaucaggcuauuccuccaucacaggcccagagggcuggcagaacagaauuacugcagcaagugucuuggggaggaauugccuuaaauucauuucccugguucagacuggccaagcacuuggugucugaggcgugaaucacaugggucuagguacagcuuguacuuuagugucuaugugcugaguaugcagguaugcagaaugcaaggguuauggggucaugguagcacccacccagauuucaaaggaagccuccuuaggaggucaagcagaaguuucucacaggguagaaacuuccucagagagcccagauaaaccuuuucugguguagucaggcauguuggguagcaguugggacccccaaaagguaacaacugucagcagugggccugguaggcagagaguuucuggcagcauggaagacuagcccaggugauaagcagcaaagucuuggggacucacuccucagcaaagugugagagacguggccuugggcuucauccauuagugucuuccuugcugccuuuucagacuggcuuuggacuacuuguucuuucuacuuauugcuagcuuucuuuuacucuaucccuauuccaccauuuuuaucuuggguauauguaacuugcuuauuguuuuaaagggaaucacauauagacaugauugcuauaacuguaauuuuggcuacuuuuuugauuucuuuuaccuaccacccuucuccaccccaucccuuccacacacuguccccccgcccccaucccaccaaacacuagguaggagaaaaggaagguuagagggaaaaggaggcaucgaucucauuagacuacuuccugcugaugaggggcaucaaguuccuuggggcaauguugaucuuagcaauugguucuuugcucaugacuucuugauaaacugcagcagccucuuggagcucuggcauuucuaugcccucucaagaguccccagaauugcaagaaccacgccuuugccagagcaugagacaaaucacaguuagcuucugugcagccugaggcagccccaaaccccacaggacacaacuguuuuaagaaaccaacauucucacuacagguugccuugaguuucagaugagacuuugggccuuugcuuaucacuggagcuuguuaugacuuuuguggagagaaaugaggaauuugcacugugaggugauaaggauaugcauucacaugacuacagucuugaguuguagccaccaugucugcuuccaaguaaccauuuuuugcucacuuucccagcaaaucauaaauggaugaaagucacuagagucacaugugucaacuuaucauagggaccuuugaucuagggacacuccugacucguuacuauuaucuuaagauaaagcaaguacauuccagccaugauagucauuuuugucuugauccauaaauaacaccuaccccauuugacccagcuugcagguucuaacacucacaguguagcuuaugaccauacuucucucaaucauccuccaauaagcuauguucuauacagcuuaggucuguuugcuucuuuccucagucucaugguacccugggggcugcacuggguuguuucagaacagauagacaugagcauagacaugggcaacaggcagaaugcugugguuuuauagacuuugaguggaucccuuugggguucauuugugugggggcaugguccuugguguaagaguguaaugaaugaaccuuuaagagauagagccugggcuggagagauggcucagggguuaagagcacugauugcucuucugaaaguccugaguucaaaucccagcaaccacaugauagcucacaacuaucuguacagcuacagugugcucauauacauaaaauaaauuaauuaauuaaaaaaaagagauggagccuaaugggaaguuucugggggcucugcauucucgguagguauuaagguaugucuauggaacccagagucucuucagaaacuugucuagguaaagcagccucucccugggaucucugccauuagaauguguuuccgucauugugaugccaucugccauuagcucucaggagcacaugacuaaaucaguguuaaaccugaggggaagggcaggcuacaaggugguauaaggaaacuugaagguguuagaaaugcuggaguucuuuaagucugauucaauagguauguuaaugugcagucugugugugugugcauguuaguuuuuugagacaaagucuauguagcccugacuguccuggagcucuauguagaccagguuggccucaaacgcagagauugccuuugccucccaaguggugagauuaaaggcauguaucaccacacaguuauuaguuggcugaugugaguccugggcacugaacugggguccucugggagagcagacugcugucuuaaucacugcauauucuuccaguucccuugugcagcuuaauauaugucaauuauacuucaauagaguuguaaaauacagcaugcauuauauagcaauguuauguauguguguguauauauacauguuauauaguacaugaauauguguuacguagcacguguuaggauucaacacauuaggacugagaaggaacuaguuucuugagacuccagagaugaucccauauaagggcuggucugugcagaagauuguagagauuuuuaaaauaaaaaauuuugaaaagaaaauaaaguuguaggaauacugagaugaacuucucugugcucagucuagggucauacuuuaauauuuucucacugugggauccagcacaggaccuuguggcugguaggcaagugcuugcaacugagucacacuucaauucugcuuuuuuauauuuauuguacacauuuucuuuguuuucccuuccucuguuuguguuggggggggggaauguaugaaaagugaaacccaucaugaaguucaggaauguuaaaauaaacucccauaugccccucugagauucauauguugcaaacauuugccauagucagauaugauauuuucuuucuucugcuucucuuucuccuuuaccuggaguaagcuguagacugugcuuuucuguuucaagacacuucaguguauggcuccuaaaagcaaguaggguuaguuugucagucuuccauggcuuuucaugacuagcaguuuugaagacuacaggcucuugugagauguccuucaguuggggucugucuuucuuucuuucuuucuuucuuucuuucuuucuuucuuucuuucuuucuuucuuucuuucucucuuucuucuuccuuccugacacacuuugaaugggugguauaucuuuaguaccucaggacaggagggacuguggaugguuuuguggagugauuuuuccaccccccuacuauuaaggugacccuuuccccuuuguaauuaguaaucuauggagagauguuuugacauuguguaaauaucuuguucuuuagcaaauggucccaggauagguuuggauccuuuaucagacauucuaauggugcaccccugcauguggcuuccuuguagcaacugaagccuccuuaaaauacuugcuaccugcauuuaauuuuaguacacuuauucauuuuuuuacuucuucauugauuuaugggaggugugugcauguguggaggucaaagcacaacauguagauguugguugucuccuuccaugugggaccuggacauugaauguaggucaucagacuuggcaguggguacuuuuacucacugagccaucgacaccaugauuaugugucuguggugcucaaaguuggaccaaaugccuuugcaugguaggcaaguuuaccacugagcuaccuuuccagguuugccuucuaugagacaaggucuugguguguaacuaagacuaccauggaacuugcuguauagaacaagcuggcuuugaacucauucuucagccuuugaugcucaaguauugagauuacaggcuuguaucacucuccuggcauacugugauguuuuauauaugugcugguuaguuguugucaacuugacacucacacauacacacagaagccucgguugaggaauugaacagaugcuuauagaagaggccugcaauaagcauguaagaaacuggacugacuucauucuuaccaagccucucagaucagugcacauuuuuggaagaacaguuguuaacugugagaauucaguuucuccagacacugcaccuuguuccaugccaguuugcauuuguaaggaaaggcaguuucuggguguguuccccugccacucuagacugauaucucucuaggucaggcuccugcuuagccacgacgcucagggcguuaccuuaagccucuuaagaaccuggccagguuucuuguagaucuugccacauuuacacauggacuugaacugcaggaagggaaggaaaguggagcuguagcugcucagagaauggcuuguccaggagggcuuccaggaggcauggaggcaaaggggauggccucagucugucugucugucuuuucuuuuccccugccguucauuaccuuagguagaaaugacaguuaaucguagagcuuacucucucucucuauuccaggagagccuaacaguucaucauuaaaagaaaucaguucuuccaugcagauuuuauuacccaagaaaaaugcaaauuuggggcuaacagggugguucuuuggguuaaaggcacuugacaccugacaacuugaguccaguucccaguacuuguaugauaggaaggaggaguuagcucccauuaguuguccucugaccuccuccacauauauguguacacacacauacacacacacacaaaaauaaauguaguaaaguuuuuaaaaaaagauuuauuuuuauguaugugaguacacuguagcuguacagaugguugugagccuucaugugguuguugggaauugaauuuuuaggaccccugcucgcucugguuggccccacucacuuuggucaacucugcucacuuaguccaugcucacucaggcccaaagauuuauuuauuguuauacauaaggacacuguagcugacuucagacacaccagaagagggcgucacaucucauuacagcugguugugagccaccaugugguugcugggauuugaacucagaaccuugggaagagcagucagugcucuuacccacugagccaucucaccaggcccaguaaaaauuuuuuuuguuuaaugcaaauauuuccacugggguuggcaagguagcauaagcccauaucuaaacaggaacauucguucgcauucucaugagagguagguaccagaaacucucuguuaaguuagacagaaaagugaauuuuucuuuuggaaaaagagaugugguguguuuuauuagcuggaaauucugaacuaguuagagguagugaccccgaaagaagaaauggcaugguggcucucagcuguaaucccagcacuagaaggcugaggcaagagcauuuuauuaaagacagcucucacauugcaccucuguauuucuauagaggauuucuauaguaugagcuggaaguggggugcauuccuguaauugugauauuuggaaggcagaggcaagagaagcaucacaagcuugaggccgcccuggucuaacuauaggaugagucugaggccagugcuacaugaugaaacccugucucaaccuuccaacacauacaacacacacacagucucuguaaguugaauauccucaguguguuaagaauaauucagauuucacagugguuuguaguucauguuuucagguuaggaauuuguaaucaguagucuaaggauaaauagucccaacuggucacaaacauuuuagcuaauuugauuugaauugguaucuuucuuagcccaguuauuacaguccucugcacacagccaagauaugaaaugggcuguguguaggcugcaguguugggaggaguuucaaggucaggagauuaacuguggccauuguugcacagugguguuuuaugaauccuuguuuuugccauuggcucaucuuggugaaauuuauacuuuuuaauuaauguuaugcugaauguauuugugucucugaaauacugguucagacuuuuuuucaccaccacccccuuuuuuuuugagcaguuaaaagaagauggaugcacagaguucagcuaaagucaauucgaggaagaggaggaaagaggcaccuggcccuaauggagcaacagaggaagauggaauuccuuccaaagugcagcguugcgcaguuguaagugaagaguugugacuggcaacacccuggugguggagggagcgagcaauaggacaucgaugacguugccaucgcugucgcuguuaguguucuuaagugaugggcagagcaaaccgugagugggaaagcuguuagcuuucuugccacaugaacuacaacucaguuguaggagcuguacauggggauugagaaaaauggugggaaaauuuggaggaugugcccguauugggcuaaaagucaaaucugugguaacaaagucaaagaauggcgguuccggcuagugauuuggaauguguccuguguucuucgguccuuccuaugucaauucuucacuuuacugcugggcacagccaccacugccuccuauauaccuccaucucugggacauuacugccauacuuccuagacuacugugagucuuaggugaaggacaucauugcaaacuuccuaucuugucucagcuugguaccuuucuaaagcuuccccuaaaaacauaccaaaagacacuugcagaucauuggaguuaauauuaaaccauaggaggauuauguucuggagaguagaggucugaaguggguguuggggcuaaaagcaauguuggcacagacaguaguguggagaaagucauuuccuuuguuuuccuccagcuuccagaggcuguucauuguguggcacucggugcuggccggcgcagugacggggcucuucucacuggugcuuccaccaucacguugcucugacuugcaauucccugccuucucuuucuagcuacaaaaacuuugggauugcauuugccauguccauauuauccagaauaauuuucuugcccugagagccugaauuuagccguauuuauaaaaccucuuaugccauguaagguaacauuuucacagauuccauagacaaaaacauggacauuuuaggaagugugauucuauaugucaaagaagacucggaagauggcuuaguagccaccaaagcuguguucagucccaccacaccaguacuucuguacugggcaggcaggcaucucugaguucaaggccagccugguuuacaucagaguggaggccagcaaacacuacaaguaggacacuguauccaaaaagcaacccaaaaaguagugcauuguuaauuucugaaaguuucucagugaauucagacuaaagagacuguggcugaagcucagcuguccgucuggaguaaggacaacuaauaaccccaacgcuguagucgcugugcuggggagcagagccgaggcuuucagucuguucggagaaaagagcuuugagaagauugaaauuccuugguccuuagaacuggagaauuucaugacuuuaaauuacuuugcuucauagauuucuguaaaauguuuacauggguucacugaccugcuaugccaucuccuggguauacgccagcugauuagccuuggccaaugcaauggcccugaccccucacccagcacgcugacugacccuagagggaagagcaucugccuguuugcuaucgccacuguacaccuguacuuucaacuccuuuugagcucuguagcaaaagcaaaccaaacuguucuucucuuggaacagcuacauugaacuguaacugauauaucacguaacugucucacagccccgcaaguuagucguuuuccguauaaucauagauuguuuuuuuagucaccaucccauaaccaacuuuagaguauauuuaccaccacagaagccuuguauuuacuagcaaaucaaucauuucugcucagcuuuuggaaaccacuaauguuucugucucuuugguguugcuuugugcagacauuauauaaaaauggaaacauacauuauguggcuggccuuuuucacugaauauguuuucaggauuaacucauguugugguauauggcacugcuuaauuucucauugcuaaauaacacuuguaucuuguacaaguggaaugccacauuuauuucugcacuuacauguugauguuugaguugagcaaacaguauuauauugcauaguuauaauaugcuaucauggcaguagacacuagaacagugguuuucaaucuucaaacugagcagaaaugcugcaacucuuuaauacaguuccucauguuguggugacccucaaccauacaauuuucauugcuacuucauauauguaauuuugcuauugaugugaguuauaauguaaauaucugacauguaggaugucugguauacauuccccaaaggugucaagacccauggguugaaaaccacugccucagccuuguuuaaaaaaaauuaggcaaaaaaccuacaacucacaucaaauguaaugugaagauucacgacuccccugcuacaagacuaggaaugaggcuaggauauuuaucuucucccuucugcucaguguuguacuagacauucuaauggcaauauggugugcuaaaaagaaacaaaccauccagauugaagagagcuggauuaaauuguacuuguucacagaugacaguauuucauguacagagaauccuaaggcaucaacaaaacaugacaaccacuaacacuaauaggugaagccaagcaugguggcacacaccuguaaucccagcucuuaggagguagagacaaaggaucaggaguccagagacccuuucucaaacaaaacaaaccuagagguugaguuaugcaguuacaggaccaaggaaauauacagaaguccauuguagucaucaguuacaucucuguauacuaagaacaaacaaccgaagugcuuuuuuaaaaaguuccauucauuauaguauccaauagaaauaaaaauuuaggaauaaauuaaacaaaaccucccaagugaagccauguacagagaggcaagcucgcccacauucugguuucagcuuugcuucuuagcacauaugguucucauaacuucccugccccuugcuuccucuguaaauggaugcacacugugguaguccuugcuuccuagggagcacuggaacauaaucacagcagacauuaagcagccaggguuccacugaggagcugcucgccuucccgcucucuaguugaggagugcagagguuuugucacaggguccaagguuugcuguuccaccaugcuguggggagccaucuuuccagagcacugcuugcuucccagucagacugcucgguuuaacccugaaauggccagaaagguguuccuucuucaccgcacaguuaacucagucugaagaaggcugcaacguucacucuucacuuuagaauacuuuccuuuccuucucaguguuaugaaguuuuagucacacgauugaauaacugacuguccuuuaaagguauaucgaguacuucagugaacaccauugaauuuaacuuaauuuuuucuuguucaggguuuacggcagccagcuccuuuuucugaugaaauugaaguugacuuuaguaagcccuaugucagggugacuauggaagaagccugcaggggaacuccguguaaguaacugcuuaacuguuuuauuugcuguaguguucagcaugcuagucugccucagugcucugcuggaggggugacuucuucacucuauaaaacucuacauuguuuuccuuguuaugcauuuguuucguggguuguuggcuuaguggucaugaaacagaaaaacaaauaaaaaauaucacaacuauuagccugauggcugagaaugucgcucauugguagguugccugccuaguguguucaaggaccuggguuugauccccgggguggcagaaaagacaagacaagaaucuugcuagcucuagcugaauuaugacuuguuugcuuauuugguuuuuugugaggcagagaaaucaaaccuagagccuguauuucuugcccugugauuaugucuguuuuuacaaauauccaaauaauuaauauacugucauauacuuuuccuagccucagcauuuuuuccacaauucuuucucauggugucagucaacuacaauuacaccuguaaucucagcuuggaaguagaggcaggaggaucauuucaaaucaucuuuggcuaucacaaagcaaauuugaggccagacugaaguugagacacugucucaaaaagccacccaaccucacagaaaaaaauaacuuauccauugucuuaauuaggguuuuacugcugugaacagacaccaugaccaagacaagucuuauaaaggacaacauuuaaguggggcuggcuuacagguucagagguucagucuaucaucaagguaggagcagggcagcaucuaggcaggcauggugcaggcagagcugagaguucuacaucuucaucugaaggcuggcuuccaggcagccuaggacaaaggguauuaaagcccacacccacagugacacaccuacuccaaaaugccacaccuccuaauagugcuacucccuggcccaagcauauacaaacaucacacccauugacuccaguuucagggacuugacacccuuuuuggccucugugggcagugcaugcacaagauauacagacacagcugggugugguggugcacauuuuaaauuccagcacucaggagguagaggcaaacauaucucuaaaaucaaguacagccuggucuacaagagugaguuccaggaaagccagggcuaaauagugagacccugucuugaaaaaaaacuaaaaccaaccaaucaaccaaccaaccaaccaaacaaacaaacaaaaaaccggaaagacauauaugcagguaaaacacaaaaaacaaacaaauaaaaggaacaaaauagacuaccuacccacacaaaugaaacaucucauaagcauuugugguaaaugcuaagucauauaagcagucaggcagcuauuccuucuuuuuuauaaaucucccauucuuucuuuacuuuuuucuaaucuuuuuccuguucugauuaccaugauaaguaugcuaucuauucuaccaauauagggcugaacuuaacuccaggcaagcacaaagaguaagaggucauuacaaccacaauacagucucgcacauaugcaaugaguuuaugaauuuuaccucucauccuuguuccugguuggccuggaacucuguagaccugaccaggcugaccuggaacucaaagagccaccugccucuguuccuugaccccugugccagccuugggauuaaaggugauuguaguuugguuugguuuguuuuugacagugucucucuguguugccuuguaacccacagagaucugccucccaaguacugggauuaaaaguugugcacugugauuacuucuuaauuguguuuaugguuuuuuuucuaaguaaugaauaguaaagugugacuggaaauggugcuagacaaugucauucuggcuaggggaucccaggacccauuggcuguauuuauuauuauaauaccuagaguccuaaaacaacaacaaauacuagccccugagauuauucuuuuuaugcaaaaaguauuuagccgggcgugguggcucacgccuuuaaucccagcacucgggaggcggaggcaggcggauuucugaguucgaggccagccuggucuaaaaagugaguuccaggacagccaggacuguacagagaaacccugucucgaaaacccaaaaaaaaaaaaaaaaaaaaaaaaaguaucuagauaugacucaucuuauacuaccuuucuaauucaugaagcgaauuuaauuaauuuguuauuuaaugggacagguuuucacuauguagccucuuaaauuuuuaaaaaauuacauuucucuacuuauuuuguguguaugucuaugugugcauguugagaugagggacaacuuucagaaguugguucucuccuucuaccguaugucuugggaacugaacucaaguugguaggcuugguggcaaguaccuuuauccaccgagucauuucacuggccuggaggucaaauuucaaaaugccaacggacaguucauguuucacauucaaccaugggauaaaaucugaugagucaggaacuuuuuauguauagcauaacgacacacguucagaauaccuuacucagaucucugcacaguuacccagaguguuguuagauuauccacauaucaucuugguaauuucaaaaacugaaaauauguguggugguaggcugagggugugacgcugaggaagagcacaggcuuagcucuccucagacuguggguucaguguguagugacugauugacagaauaucucaguagacagugaauugaaacuggguuuugccuggcuggggaaggcaucugcuugcuuagcaagaguaaugcagccaccuuauuuauaaccagagagugacuggcaguugcucucaacaagaugagacaguugccaaucaggguguggcuuauuggugcuugcuucuccggagacuuuugcaacagugaccccuucugaccauuuggcuaaaauggucaugcguauugcuccccucagagccuggaggugaggccuuccucaggauacugcugcgguggagcacuuggaaggggcacugcagaaguguaggugcguguugcuugggaaaggucagcuguguuuuauugugcuggcaaauagucuuccugaguaacauuccgcuuuucccucccuagacagugauuacucggccagaccaccccuugcuuugcuguggcuauucuacaauauguucguagcuuuuaccgucuagucugccuuuuaggaucaaguaaaagggugucauagccccucaagccuugcuucagaaaacccaguguuaguuucuucaugaauucuuggauuaaaaguagauaaaaaaaacaacucaugguuuuuguuguuguuguuuuguuuucgagacacgguuuccucuguguaaccugggcuguccuggaacuuacucuauaaacccaggcuaaccuuaaacucaagagauccuccugccuuugcaggaguacugggauuaaagccaugagcuaccacugcucagcugauucucaacucacguuuuauuuuauuuuguccuguagguaaauaaaccaaguuuaaaaaggaaggaagcugguugacaacuugagcuaaccuuuacguuauaggacaauaguaaauaaacaucaauaggacaaugccauagcuccaugguaaagcaggugcagggaucccuggguuuuuaauucuuaguaucaaaagaaaaccacagcagguggcagcagcacaaaccuuuaaucucagcacuccggaggcagaggcuuggaggaucucgcugaguucgaggccagccugaucuacagaguaaguuccaggccagccugaucuacagaguaaguuccaggacagccagagcuacacagagaaacccuaucucaaaggaaggaagaaacacacuuauuauuuucuauuauauuguccuguuuuacuuaauucuaauguuugggccagcaagauugauucauagguaaaggagcuugccgccaagcccaucagccugaguucaguccccagaccccacacaguggcucccacaaguguccucuguucucuaugugucuccauggugugcuugcauaugcuugcucucugucucuuucuuuuauacccauacacacauacuagauaaaagcaaaaauuucaguaagaauguauuuccuguauuauaaccugauguggcacccacagcacugaaagaacgcagauugagaagucuuccucucagccugucuccccgccaucacgucucucuuaacagcaaccaggacgaucagcuucuugugucuguccaaguaccuagcuuauggcuccugcaccaugucaugggcucaguuuuccaguaaaguguugucuccacaccuuugcuauugcaaacaacgccacagugagaguaugucugaaagaccguguccuggagugacaguggcuggcucgaaggagccaagcauuugccauuugucuuugauaaagguugcugaauuauguuccuaucagcaauguaugauuucucaguuuaaauauuacauguuuauggauagagcuauuuuaaaaaucuaaaccucugggcuggcgagauggcucagcagguaagagcacugacugcucuucaauaaugagaucugaugcccucuucugguguauuucaagccagcuacaguguaccuguacuauacauaguauaauaauaaauaaaucuuugggccugagcgagcgggccgacuggagugagcaggguugacuggagcaagcagagguccuaaaaauucaauucccaagaaccacaugaaggcugacaaccaucuguacagcuacaguguacucgcauacauuaaauaaauaaaucuuuaaaaaauuccaaaccucuuuuuaaaaaaaagauuuauuuauuuuuauuuauuugaguacacuauagcugucuucagacacacaccagaagaauguaucagaucccauuacagaggguugugagccaccaugugguuguugggaauugaacacaggaccucuggaagagaagucagugcucuuaaccacugagccaucucuccagcccaaauccaaaccucuugacaaccauuuuccuuuucccugauccacagcccuuaagaggcuuuuuugauuuguuuuguuuuagugcuguguuuuugagacagauuuucucuuuguagccuuugcugucuucaaacucaaagaaaucugccugccucugccuucuuaguguaggauuaaaggcaugcgcaaccaccaccaggcaagagguuuuauuuggcaguaaucaugcccuggauaaaccucacuggcugagauacugcugugcaaagcuuacagcccccgggacaaggggagaaguaugucuccaggcuucaguucugucaaucagacgggacucugguccuucuuuccuuaagagguggccauguuccuacugcugcccucugcugccaccgugaaauaaguuccucuuuuaguguccuuaggcuccuggacuugcucauuugaaacacaaugagcaauauguuuauuugacccuggaauuggucucaugcacuugcagaugauuuccuggcuuuucuuuucauaggccacuacaguuauuacaaauaacucaacagacaguucuuuuuuauccuaauuaaugggaaaaggaaaagaucugcuugucucggccuuccaagcacugguauuaaauacaugcuuuaccaugccuagcuaggauuuauuuucaaagcaaaguguuacuuauuaguaaucaaggcaaacugaaaaugagaauguuagcagucagagcggaguuuuacauucuguuuaaacaaaccugaaaugucguaaauuacagggagaggguuagggagcugaagagaugguguagugguuaaaagaccccaguucaggucccagcaccuauggugggcaguucccagucgccuaggagucuggcuccaggcaguuggaugccucugggauagguacuugcauuuacaugcacacaccuccuccauacauauauuaaaaguucaucuuuucuuaaggcaaggauuuugaaguucaggauauguauucauugacuaaauauuuaauauaucuuagguggcauuaaagaaaaacuacucaguccauauaaaaacauggaccgcaaucuaaauucuagauaucagagauagaagucgccaccuuuacuaagggaauaauaccuuagucuuugggccuucuuguguuugguucaggcaauccucuguacaguuggacuauaaaacaauuaguaaaauggcucauguuuauguuuuauauuuaauagaaguaggcacugaacuuagggccuuauucaaagccucuacacuauauauacauaugagauguauauugaaauauauauauguauauauacacauguacauaugcauauguguauuuauaucucaguaggguuauauaccagacucuuuuuacuuuuauuuugagacaggcucuuauuacguuguccagacuggcuuugacuugaucuguaguucaagcuggccuugaauuugguaaucuuacugccucugcuuccaaacuggcugagguuacauggcugugucaccaugccugguccuagagaacaucuaacaagagaggcucuguuagaaugaaagucacacagugcuauuugaguuugucaggugugaggcacugaguaaauauguuuuuguaaugaguuuuuuuguuuggauuuaggugagcggccugugagaguuuaugcggauggaauauuugacuuguuucacucuggucaugcccgggcucugaugcaagcaaagaaccuuuucccuaauacguaucuaauugugggagguaagaaaccuaauacguaucuaauugugggagguaagaaaccauccaucggcuuuaagggucguccagaaaaagaguaauuucccuccuguuuguguguuuggcccgggucuccuuuacuaaaggaaugaaguuucugucuuagauucagucuguguaggacaggcucacugaaguccuagaugaucucgcuguucgcagcugagggucuacaguuguauaccguagcugcauucauccaguugucuacuuaaaaacacugcgucuggacuuugcugcaucaauuuugaaucaacaaaagaaaauucugucaagcaaaugcuauauggucaauuccaaucuuauaaaaugaaaauaggaaagaaaacauuaaaauuuuuauuuuauguauauggguggguuuuuguuuguugguuggucuucauguguguuucuguaccacaugugccuggugcccaaggaaacuagagaagguaucagaucccaugggacuggaguuacagacagucgggagccaccaugucggugcugggaaucaagcucagguaguuuauaagagcagccagcucuuagcugcggagagaucucuccagcuccaauacaguuuuaaaacccucacugguguagaaauacagagcgggcucauuucaaagucaagaucugaguuccauauuuuacccuuuucaaaagugugagccuuacuauagcaaguguuaauccugaagguuagucuuagauuaggaaggacauugucacccaggcugagguacauacagaagauccuucuccauauugguugaagaugggguaggcauugucacagaccuagaaaguaggagacgaugggaaggguuguugacgaggaggguuagacagggaccuugacuuacaacugugugaugcugugaugcagucugcagugaugagcuaacgcacaacuucaagggcuucacugugaugaacgagaaugagcgcuaugacgccgugcagcacugccgcuacguggacgagguggugcggaacgcccccuggacucugacgccugaguuccuggcagagcaccggguaagacuggccgcaaguaaucauuccuaguuccaacacccccucacuguuugggggagaaggcugguuuuccauuuguuauacuucauuuaugccuucuauguaaguuucacauagagaugacgacuguguuauuacuauaauaguggccacugcugacauuuaugugagaucugaugguuuacaagcacuuuauugucacuguguucuaguugcuucccacagcugcccuguggggauaguuaguaucuccauuuacacauggagaacaaggugcagagagacugaacaaugagcuccagguuacuguuacaggacuuaaaugagccgucuaacuacaagacgcuuuccccacucaauagguguguccuccuuuuaugguguggcaaucucuggucuauucauaguucuaggcuuacacaugaagcuuaucucucuggguuaguaagguggcucagcagggagaggcaguuaguuggugccuggcuugaugaccuaaaguugaacccuggacccacaugcuggguccagaugagaucuuaacuccugcaaguuguccccuggccuacauacacaaauguaugaacaaaugaacacauacaaaauaaauguaaaaaaauauguuuauauucuaaagccaagggacugaagcaggaaaguuugaggccagcuugagcuacauaacaaagaccuugucucaaggaggccaagagauggagagaugcucaacaguuaggagugcuuucauccuuucaaaggccagaauguuccccgcacccacacgggguggcuuucagaggcuuguaauuccagcuucagggcuuccaaugucuuccaggcuccauaggcacugguacauacauguacguguacacacacacacauguacaugcacauacaaauaauaacucugugauuaagagcacuuucuauucuugcacaggaccugggguugguuuccaacacccacaugguaguucacaagaguguaacuccagucccagaggauccagcaccuccuggccuccauggauuccagggacacagacauacauguguugcauaaacacaaaccaggcaacacacucaugcauauacaaaauauaaaaacaaaaccuuuuuugguuuuuuugagacaggguuucucuguaaagcccuggcuguccuggaacucacuuuguagaccaggcuggccuagaacucagaaauccgccugccucugccuccugagugcugagauuaaaggcgugugccaccacgcccggcuaaaacaaaaccuuuuaaaaaacaaaaaauaaauuaaaaagaggaaagcuucacauuuuaagaaauagugcauuuucuaaaagauuuguuuauuuauuuauuuuauguauguaaguacacuguagcuguacaggugguugugagccuucaugugguuguugggaauugaauuuuuaggaccucugcccacuuggucagccccgcucgcuccggucaacuccacuugcucagucccugcucccugcggcccagagauuuauuuauuauuauaaauaagcacacuauagcugucucuagacacaccagaagagagugucagaucucauuacagcugguugugagccaccaugugauugcugggauuugaacucaggaccuugagaagagcaaucagugcucuuacccccugagccaucucaccagccugcauguuuucuuauguuaauuuuacuuucagcuuugauuuggggcuaggaauugugugcaaucagaaaccaaggguguuuuuacucuuauuuaagaaguaaauaauuauuuuaaaacucccaggggccuuugaguucucccacauaaagcaugccuucuacaagggugggcuuuaaagaaauggauuuagggcuagagagaugacucagagguugagagcacugauugcucuuccagagacccugagcaaccacaugguagcucacaaccaucuguaaugagaucuggugcccucuucugacaugcagauauaugugcagaacacuguauauaauaaauaaauagaucuuuuaaaaagagagagagagauggauuuauuuuuuuggguuuuuuuuuuuuuuuuuuuuuuuuuuuccgguuuuuugguuuuuuugguuuucgagacaggguuucucuguguagcccuggcugucuuggaacucacuuuguagaccaggcuggccuugaacucagaaaucugccugccucugccucccgagugcugggauuaaaggcgugcgccaccacguccaacugagagauggauuuauuacccuaguuagagaccuucaagcuugaaaagccagugugcacauugucacgucucugcauggguguggaauuguugcaggagaauuguugagugcggcaggcaggaagagugacagccgcugugcaucugaagcagacaguguagauuuacuguaacuguuuaccacauuguauuuacuauucuguguguguggggugggggcauagcacacaugggaagguuagagaacaccuuguggaagucaguccucucacggacagaacuggagguaagcccagccuucaccugcugagccaucucaccaguccuccaucggcacuuaacagugguaccaaaggugacaggcagcgucacucucucagcacagcuggccuggguaggggugugggagaagaacuugcaacauccucuuuccccuuguaagcaguaaaucucaaccacgcagcuugcuucccacuaagucuugucuuugcuguccuguucuggggggauagguuugguugagugguaauuuuuaaauuccccuuuucucaggagcugagagaagaagcaguuaauuaaacaguaaccaaauccuucaugcuuuuagaagccuuaaugugacccauuguuauagaccugggaggacagggugauucccuucuuucuaggcucuggcuucccagaugcccccgggucccccugaccacagcgugcugacuguacaaagggaagguagcacuucucuuaggcuagagagaaauagcuagagaagaaaccuguagacuuccuguguuugccauaagccauaaaugaucagguugguaguuucugaagauuauaaaaugugugaaccaagcaaaaaguacagagaaaagguuguucugaggcauagccccugccaguuucccuuuuucugagcucaagaauauuuacagguucuuuccaaauggcaguuauccugggguuuaaaaugaaguuuucuuguuuucagauugauuuugucgcccaugacgacauccccuauucuucugcagggagcgaugauguguauaagcacaucaaggacgcaggugagugagccacgcccagcuccacucuguggggucuugggcgacuauggagauucagccauggcccugcugccaguggaaaaugugauacugagauauuuaacauuuuucuggucaaacuguggacaacauuguaagugagcauagccucaacauuuguugauucuugauuuaaacaucucuuuaauuuuaggacaaguucuauauuuuucuaggauaagcaauacccugugccuccuucuagucuuucauucugucccuugggugucaggaucucuagaguucuccuauaguaauaacagagucugcuuuuuccuuuccuuuuccuuuccuuuuccuuuccuuuccuuuccuuuccuuuccuuuccuuuccuuuccuuuccuuuccuuuccuuuccuuuccuuuccuuuccuuuccuuuccuuuuccuaaaaagaaaaauucugucuuggaacucacugugaaggccaggcuagcuuugaacuuacagagauccaccugccucugccuuugauguggcaggacaucacaguuuuugucuguuuguguuuuucuuuaggcauguuugcucccacacagaggacagaagguaucuccacaucagacaucaucacccgcauuguccgugacuaugauguguaugcaagacggaaccuacagaggggcuacacugccaaggagcucaaugucagcuuuaucaacgugaguuacagccucgccccauagcucccugccgcuguagggcacaugugcuucucgugcugugugcucugagcucacuuuucagugugcugugagauugucauuccccagagcuaccucaugucucuuauaaagaguauagcacaaaggcaggcucuguccucacggucuaaugucauaauaucaacauauggauacaaggacaggcauggugguggcaccuuuaaucccaguguucagaagcagagacaggcagaucucuguguguuccaggauggguagggcugcacagugagauccugucuuuaaaaauaaaaggaaaggaaaaaaaagacauacaaagcaauuuaacaaauaggaauauauaauuaugcaugccuauaaucccagcauagauacaucuguucuagugaaaggacuggaggaaagaggaucagaauuuugaggccagccuuagugacacucugccucaaaagaacaacagaaguauaaguuauauagcaagcacacuaugucaaaugaagaguggcucuuaacugguuuugcuuuuuuuuuuuuuuaaauuauguguucuuuugagaauaaaaugaaaacuacagaucucucccuauauggcuagugacauacagcauuugauauauaguuucuccacaugggcuauuuagcaaguccugucucacacacacacacacacacacacacacacacacacacacacacacacacacacacacaaacacacaaaaccacacagguacuuuugauuaauauugccuuuuaggaaagauguuaauuguauauauaaauaauguuucaauaagguugauuuaaacagagcaaaccuacuaacuauauuguaugcaauaauuauuuacccaaacccuuugcuuguucccagcucugugaaagaauuagauaaaccagaauagggcuuagugguccaucccaucaucccacgauuugggaggcaaaggcaggaggaccacuucaaauugaagguuucaggucaaccagggcuacauaggagacccuguguuaaaacacaaacaagagcagggcgugguggugcacgccuuuaaucccagcacucgggaggcagaggaaggcagauuucugaguucgaggccagccuggucuacaaagugaguuccaggacagccaggacuauacagagaaacccugucuugggggaaaaaaaaaaacgcaaacaagaaaaaaagguaaggugagccaagugugcaucccuauaaucccauuuuagaaggcugagucaggaggauuucagauuugaggcuaaucuaagcuacauagcaagacugucucauaaaacagaaagaggauagagagauggcucaggaguuaagaacacuggcugcucuucuauucccagcacccacguggcagcucacaaugcuagagcacauguggugcccagacaacgacaaaaaaagaaaggggaaaaccaaaaccaaaugguccccgcucuguuucccccccccuuccccccacccuuuaucuuguuaucuugugcaaccugcaugccucuuucuuccuuaugguugagaaauuaagaaacuacuuuuuuuuuuuuuuuugcauuguuuuguguuuuuaauaaaaaccuuucaaguuguagcccagacugaccuggaacuugugaucuuccugccuuggccuccugaguacugggguuaccuggcaagugccagcauguucaggcaauauagugcuuuacauuugacuaaauaucacuucuucuccauuagagcauuuauaccauuuuacacuaauguuuagggauguuggcaggaccaacucuuugccauuuugcaaaugagcaagcagaucuccaacuuauaaaaggcaaaacauggacugagaagauggcuugguugguagaguggcugccaugcaaguaaugaccugaguucugauccgcagcaccuaugucaaaagcuaggugugacagcgcauccucuaagacaggaagaucccaggaacccaguggccggccagccuaguagaccuggugagcuccagguucagugagagacccugucucagaaaaauaagagggagagugguuaauuaaagaagacaugugaugccuucacacacacacacacacacacacacacacacacacaaugaaagucaguuuaucuaaaaucauggaaugagcuagugaugggguauccaaugucaugaauuaauuaaggaucuaguauuucuguuucgacucuggccuauuugcuucuuggaauugcugugugaugaucuugugcaugcacucuuccauuugaaagagccuuauuggauauaucucuaugucguuauauuagauuuaucuugacaaccuugacuuccuuugguugcaugcuaaucuauuucugcccucacugucauaguuagaaucaccacacuuucauauaaggugacuggcuagccagagauuauuuuuccuguuauuaugcuaaauaaacaacagagcagauuaagcaaagcagaauuuguaauuuugaaaacaguagccaaauuuuucucucuuuuaugguaggcaaagucaaguuggguauucuuuuuauaaauuaauauuauuauuuuuuguaaauuauguguaugucugugguuaugugcaugugaguacacgugccugugggggcagagguguuagagcucucaggagcugcacauacaaguaggagggagccaucugaaggucaugcugucaaucaaacucgggcucuccagaggugcaggauguacucagccucuaagccaucacucagccuggguacuaguucuuacaauucauuugucuccugucuaggagaagaaauaccacuugcaagaacgaguugauaaaguaaagaagaaagugaaagauguggaggaaaagucaaaagaguuugugcagaagguggaagagaagagcaucgaccucauccagaagugggaggagaagucccgagaguucauuggaaguuuccuggaaauguuugguccagaaggagcacuggugcgagccuuucuuccugacacuugagggaauguuagggaagggaagggggcugcuuuuuguuccugcuauacuggcauugaacccagggcagaguacacaugcuaucaagcacucuaccacugagcuacaucugcagcccuauauuuguugguugguuuauuuauuauuuuuuugagacuagaacucacuagguagccuugguuggcuugaaacaugcaguguagaauaggcuggccuagaacucacucuuccugucucuaucuaucaacugcagggauuaauggugugugccacuguaccaggcuuauuuauuauuuugagacagggucucccuaaggccuaaacuggccuugagcuacguguguagcccaggcuggucuugaacuuguaauacuaauagcuucagccuccagucgauaaacaagugaauucaagagaauugcaaugcugugaaguggaaagaaauagagaaucuuugagcagaaaggaagaucaaaauuaacaaguuaucaaauauaguuacauauuuccuaguaauguugucagcugcuuuaucagccuugacaacuuguauguuuugguuuauauugaaaagaaggaaaaacagagaacagguagagaaagcuuccucucugaguaucugcuauggguccccgugaggggaucuguccugaggaauagaugaguguucucaaaccaaauaaagaacuccacuagugagccuuuguuuuugcuggcguuuggacugcacacuaaguagcccuuagaugccucugacagaagucaaggcugggcuaacuugugagcagguggagaccgccuaggacacaguuacgcccuccucucuucuggagucacguuagcacaucaggggcuaggggaacaagucaguggcagaguguuugagauuagaaugcuugagaccauagcuuugaucacagcaaugagaaauaauugcagagagagccauaguaauuugagguuucagaggcuccagugguggccgugggggcuguagguaucuucuaacucuuccuuuuggucuccuccccagaagcacaugcugaaggagggaaaaggucggaugcugcaggccaucagucccaagcagagccccagcagcagcccuacucaugagcgcucccccucccccuccuuucgguggcccuucucuggcaagacuuccccaucuuccuccccagcaagucuuucuaggugcagggcugugaccugugacaucagcgaggaugaagaggacuaacuuuucaucccuguucccucucucccccacugcccaucaccuccagaagcucucugucgaauuccauuuugugaucccaacacuaaaccuaaggacaucuacaaagaaaagacaaccggggcaagaggaccugggaauggggaaccaaaacagcccaugcccugagacauucucagccacaccaaggaggcugcccauaccuuagaagccugcucugcauccaucuucccuccccagaacuuugcuuuacuguuuaugcucauguaaucuugacagggaaauugucauuuuuaucaauuuuuuuuaaaaaguagucuuucaaauauaguaaguagaacuaauuuuuugccccugaggaaugggcagaagaaggaagcguggaaugcccagaggccuuuuuuccugaacacuagugcuugccuucuguucugaagcaaaguggcuugccagauccuucaaacagggagccaugcuaauggccaauuuggggacuaucauaauuuuaacuucccuaaaaaaaaaaaaucucaaagcugaauuagcuccagauucccugaguguccugccggcccaugugucagcguggcugugggagggaagagaucugagccuaacuuuucuuacucccugaggaguuucuuguuggacccaaugggguccaugaagacacugauggggaugaaaccaaaccacagagcaucuacugcaguuuuucugcuguguucaucuucucagaaaauccuguugcccaauuauuugggagcucuugucaaucucuuuccugcaccccaccuguaaaggaagggacauuuugagggcuacugugauuggagagaggagugggauaaacucagucuaguacaagggcaguugagguuguuucugcugggcaugcguuccucagccugcagcugcccucucagcacugcgcccagcuuuguacaaaggaugcuuuguaaguguuugcugcuugcccuugaccuauucauugauccguguugccuauugccauauucagcacuuagacuuucacagagcaugcaggcaaaagcaccaggaaacacugaucucugaaacacucuccucaaccuuugcucgucuuagaauauucuugggucaaaagaguaucacauggagacucuuugcuccaagagcugcaccgagcagggacuuccuccagugcucuuccagaagcaacaggcauggguuaaaacugcuagcacacagagguccaugcccucuugucugccugugccugguggccccaagaggaaacagaauuuccaauggaagaguacugacucucaacacuuacuauugagcaggagcuggugcuugcaguccccuggcaccccgugucacuacauggcccagcacguucaucaccauccauuauccuguagcuggauuuagggcaaaguuguuuauguccaggaccuacuaguugucacucauaaauaccccuuguggggguggagcuuucuuguuuucaacaaagaaaaccacauuuucuuuuuccuuguaccuccucacugguccaugcugggacuaugagcauuuacaguccucccuggacacuuucugguggaagcugugcuacugccuaagggucugaggcuaacaccacacagcgccugcacagcagaacuaccuaggcuccuaaacuauuucccaggcaaagcugagcagagaagaggggcaaagaggccccacucguguuccaguggcccauggaaacgccauugcuaacuaacuccucaugaagggcugcuuucacucagaucugacccauauggccuuggccuggaauccuuucucugaaccuguugaaauuagucuuuucucacauuauguacugcuguguggcucacuuuaacuuuucuacuuuagucuucucuucggggauccguuucucucugccuuauucucccagguauacagagguggugaugucacugcuggcacucaccuacuuguucucucagugcaugucacccagguguacccuguggaaaugcaaagggagccgcucaugugcgauuuucccccauguagucauucaagucuacugucugggucccaaacaugagagcgucuaugcugacaagauauguaacccagcuaggacuagccuaugcucauauucaaccuuuacuaucuccuaacacucugacucucagauaguuuagacauaagcaaaaaugcuguggguguggcugcaugcuagguacuugagggucagugugcuccucggugcuagaaaaaggugcugcugacauagcgcaccgucggcuacguguaucuaguuaaauguggguaagcuguauaacgcuguugcugugacuguaguccacaccucuugugcaaccugggcuauagagcuguuuccccaagucuacacgaaagcaagcagcauggaagggccaggagagccguaaguuguuuggccucauagccucugugccuuaggaggaggcuugaagacaggagcccuggagcugguauugaggaggagccagugugacaguuaaccuuggcauggacgggaggcugaaaauagagguugccacuuagagacuguagaaauggagcaccagugccauggcagccacuccugggagcuaagccugagacccuaaagugaggaagggguggaguugaggucgagaauccugacaagaaaaauacugagagaaccuuucuggucacuuuucucagcagcaccuuaguuauucuuaaggccgcucaucugaccagcugucuaggaugucccuccacaguggcucuucuaagugcuuugucacugucuccagcccacguucgcuuguguaacucacguucuggagccuguugucuuugaaaucuguucuuuaucaaccuuuuacuccuuuccaaaaucgauucuguuucuugcuuugguuuaaucccccuaagccauaccuucuagauuucugucagcauaugcgucgaaauugaacccacacaguucaaagaaggcuuccuuaacaauguuuuaagacuaacgguauuuuuuuuaaaacauaccaauauaaguauuuuaaaagguauuuuucaaagucauaacaaugauuguuuucucucagaauagauuaucaugggauaaagaguggucccuagcuucuauuuuucaaaauaaguaggacauguucuuggacuuaaucuauuaaaaguuagcucuccuaaaagaaaaaagaaauaaguuugccagaacuuuuugucggcaggagauugggguagagaacagaaaugccaggauuaacauuuagaugacccagguuggguuucacuagguuugaagugagcuccuuccacccuauuggagaaagugacuguucugaacaguuagaguugguuggcugaguguuuugcaucaaggcuccugaacagaaaacacuguuggaaagagucacccaugacauuaccagugcaauggggaguuugccuccgaguucagugucucacguuacugucuaauacuuugugcagaauuguauuggcuuuugucauucagccaaauaaaggccauguguuuuugccugguguuucaauuuccugugguuuugaccagacauacauguauguaauguuuuaaguacugggggcuuuuauuuguauucucaguuccuuugauuuuguguccuaauuuucuguccucaauaucaauaccuccgcaucgcuaccauauuaacgagcguucuguucccaaaagaaacuuuucaguucuuacugaaaagucaaaaggcuggcacaaagggaccucagaccucccaauagucaacugaugcuccuaaggagagaaggauuccagugcagagccaagcuuggggaagcugggcuggugcuguugugcccggcuaaggucuacucccauucuuauaucagauaaaccauacaucaaccaugua

SEQ ID NO: 8216 - RNA, 2977 nt, Mus musculus
cagauggaacccagggccccagaggcacucagucccacccuacugguaagccucagacagcuccuggcuuugccaagcugccaggggcagccuguuaaaggcacacacuucuagcguacacccuaacggggaacccacagcugaagccucaggguagucgucaaaaacagaugaagaugcugcuuguggaugaaguuaaccccaaaacggucugugaagacagagauagcccaaagcccuccagguacacccccaagccccagcccuggcagcccuggccuucagcuccuccccaucuuacccuucccuuccugaaccuccuaaacggcacagccucuugccccuagcauacaaagagaggguaggagcccgaggggcccuccaaacaccucccuguccauuuuuagcccuggccccuucucuggguuaaccauuuggcacugucugucucuauccucccuggggagucggcugcccuucauccugcccaggggagaagauaauuuuagucugagguugacccaugaguauguguuauguguguguauguagugcaaaugaagccagucuuugcuggagaagggccuggaaagacagcuggauuucuggaggggcgccuagagccaagggcugagaaggaaggaagacuagaggggucuccaaggccuguuuuggagaaagaagggccaaaggucaagagacaggaagaggggggcuaugaaggaacucaccuggccaugcaaucugacuuggccccuccacugggcaucuaaagcucuagugccaggcuacagacucuucucguugcccucagagcuggccaaccuuacccgugugugcugagugauagguucuuucuccccagcuggugaagugagccaacucaagccacauuagaguggucauggggaaaguggggguaugggcggaaaagagaaagaaagagagggugugcacagagagaagaaaggggcgggagggagagaaggagauagacagacagacagaaagagucagagagagauggaaaugucuggguuacuagggaagagccucugggagaagggcagccccugggcuggaaaguucugaguugggggugggggguggggcgggcagaguaugccagguagggacugagggaugcugggagacccuggaggccaggucugcuuugguauguaaaauaugccccucagccccuugucccgaaaucaaacacuaagggcagcucaaaucugaggaccuguuuggacuuuguccccuccucccaguauuuuccuaauauuugccaauaaguucaauuuacaagaucuacuuucgccacugcagccacgaggcccuuugcacaguccuacaugguaagcuggguaauggagccaaugcugguuuaccaaagacaugacaauuuuagaaaggaccacugaucacccagagaccuacuaugaacugggguaagauccaaaauucccacacugcuuuucucuauugucaauaggucgccacacauucauccucugcaaaaaccugggcgauggaccaggacuguguccccagaaaaggccacaggcucucaagagacagccccuuugccagacugcagccagaaaauuucuacugcccaaucccaguccagcuguucugcccugcucaccccucaccccaguucugaggccagaaguagagagagaggcccuggcuggcucacuuccucucucauugucuuccagacaaugggcaaaguuccacugagucagaucagggacucacaacacuaaagacccaacuuaggggguggggaggagcuguggggaaggaagcugucagcagagccagaugaccacaggaaccugaagagcggagagcacagggaaguguuggggggcagacagaacaaggcaaagauguccagacaguccccucuaccccuuucuggacacuggccugacacucaaaggaaggaacacuuaucaacaagucccagcuccggcacccagagaggcugugaaacccuuacugcacacaggccguucaccggucugucuguggcggagacagacacuuagccaggcagcaccacaaguguccugucagauaagagcuuggaggaggaaagucuguacaaagugugaggcaaucggugagauuauaccucugggcagcaggagaaggcuccugagccugccagcagcgggaggcccuugggugccccaccacccccucacacccuucucacacacaccuugcucauccaugacuugcguuugcacauggccuuccuccucuucacggccucccacagccgccucuggccugcaagcagggaaagugaacgaggucugucagacagcucucacacccucccaacgaggcugcuauccaccuaacugacuuccucaguuccugggacaccacucaacccaaugccaccaacgggaucaguugccaacuaggaauuucauucacccaaucucuacacucuaccucuggcuggagguguuuacucaucaaagcagaaugagaaguggccaguuaccucgccaacucuccagacaacucagguaaggagauacacacauacaccugucuccauucuaagguuuccuucccuuaaaauauucuuacacuacugacaucagacgcugugcuggcuaguuuuaugcuaauaugacacaagcuagaucagagaagaaggaaccucaguugagaaaacgccuccauaggcuguucacacaccugcagggcauugucuuaacuagugacugaugggggagggcccagcucauuguccgcggugccaucccugggcugguggcccuggauucagcaaagcaucagccagccaguaagcagcgcccuccauggcuucugcauuugucccugccucuagguuccuguccuauugagagcuccuguccugacuuccuucaagaacagugaugugaaaguauaaacuaaauaaauccuuuccuuagca

SEQ ID NO: 8217 - RNA, 5683 nt, Mus musculus
ugagccugaagccaugugguuugccuuucuccuccugcuguggcugggcccugugauuccaaaccagaaggcaggugaggagaacugagcugaccccuauuugagaggucaaagagacccuguguuuguucucauuucauuuagucaaucaauauuauuuauuucuggucagauacgccaccuucugauggcuagaacccacucacugaucugaucagguaacccacuuacucagacaucacuuguauccuaaaugugcuugguguggcuucuggguguguccacacagcugucucugcagcaagcuuggagccugcuugggaaggcuguggagucuucagaggugguucugguguguacacuuuuggaggaggcaugagggauuaggagggauggugagcguaaaaagcccagguccagaugaacagcagccugguccaucagccgccacccacuaguugaucaggauggcuaaaaauauaccuggaaguacagcaggaaauccaugacucuuauuguuguuauuguuuugcguguggggggagguguuguuuguauguauguauguauguauguauguauguauguauguaugaaugaauguaugugcacuauguguguuccuggugcucccagaagccagaagauucuuggaacuggaguuagagaugguugugagcugccacaugggugcugggaauugaacccggguccccuggaagaucauccaacgcucuuaacugcugagccaucauuccagcccaggaaauucaauaaagguuucucuucccaagccuuucugcugcccugcacccccuucccacacuccacacccccuuccauaccccacaccacucucaccuucucuagaaacuugccaaagccuugcucuagagggagccaaccuggcuacccuggguucuucacauuuuuaccuugcuuuaaaguuugagacagggucucacuaaguuacccaggcuggcuugagcucacucuguaguccaagcagccaauggauuugagguucucuuuccucaggcucccacagucugugggagugccuggugauauguuucuuuauuuguuuguuuguuuguuuguuugcuuguuuguuuguuuugaaacagggucucacuauguagcuccggcuguccuagaacucacuauguagaccaggcuagccuaguacaaaucugccugccucugccuaacucugcccccugagugcuggaacuaaaggcgggcaccaccacgcuuggcuacgauguuugauuuuuauuuguuuguuugguugguuuuagguuuuggguuuuuuuuuugagacaggguuucucuguguagcccuggcuguccuggaacucacucuguagaccagguuggccuuagacucagaaaucugccugccucugccucccaagugcugagucauuaggacauuuucagacaaauuuaacauuccuuaaucuccuucuauuucccuccuccagaucccugucccuccucccuguccuuccugcuuucaugucacauauauucgauuaucccacucacuauucucuuuccuucccuccccaacccuuccugaagacuucuucucccccugucauggugcccuuucuaguuucauaacugacacccacgcccacauacaugcacauaugcagucacuaaaaucuaggcucaacucguagaggaaaagauguguuugucuucacuuagcacagauauucuccagucucacccacuuuuccgagaaugucgugacuguauuuuccuuuauagcugaaggaaggcuggguucaagugugaccuugauauguaagaaccauuucugcuaauggauuuggacaggccucccaagcugaugacacagcauacaccaaggcucagaagcaggugcaggcaaggugugacacucuugggagcggggugauaggaaagccagaaagaugcugcuucuccagguuugcagccagcucaagcauggcuuuggguaccauccuccaucuauagaaugagagccucucucuagacuuucaggcuuuucuggcuccgauccauuuuuacaagcauuaauuguucugugaccuaguucacucauccauggagcuaaggcaacuuuuaaagcaacuuauucuuguauuuaaugcaugcaggucuauuugguucaauuuaauucugccuggcuccauuccauccugugucacacugcccaucagucacaguaaaguaaacaccaucggauugaucucugauucacaaacaaggccacccuucauuuggacgcuucucccacccuugcucuuuaguugauucuuggucuuagaugcuugagaagagggauggcuuagggauggaguaagccaccaguaggaggccccugaacugagugugaacuggagccugaggcucagccagagccccagcccugcccacucuuacuuugagaggucccggaccucugcucucugcacuucagacuccuguuuucacaacacuuuggcuuggccacacccagccuugcuuccuuucaaaggccagcuucuguugacccugucaacucugaaaguccucaaguuuauccuuaaacaaggccccuggcaggugcuaagcuaacaggaaucaauugaaaagaaagcaagcagcauuaaaauuaaaauuaagcuaucugggcccagucccaugaaccagacucuccaggaacauaccucacccccgccugcccaguuucauuuuuuccuaucucuuaaaagaggugcaccugcuuauuugugguuuaauaaacagauaaccacugaguugagcaacuuagggaaaugguuagggaagcagagcugacgaaacuuacacggauggugccuagcuuccacucuacagagauucgcucuuccuuuugugcccguuccccucaaagcaccacaguuaagucuuacuuacagucaggccugggagcuggcucagaugccuuuccgucagugguuugagguagguguuugguuucagacaagggauagaggaacaaccaaggcacaccuggccuccagguucucccagcauccuucagucuaccuggcauacccugcccccauccuugaacuuuccagcaaagggacugggcugcucuucccccagaggcucuucccuauauaauucagucauuuugcacuuucccuccccccucucccucccucccucccuccccucucuuucucccuucucccccucccccucucuuccucucucucucucucucucucucucucucucucucucucucgccucucuucccuuucuuccuuuuccucuucucuucuaauaugcccuuucucccuuucucucuccccacccucuuccccauggagauucuccugaccucaauccuuugggucagcaaacuugcccaagagcagcuucccaauaaaccugccuuuaauauaaccuaaucuggcuugaauuggcucauuucacuggcagugaagaaauaaccucucaguaggaauccaaagacacucuuuggcauaugcaugcacguucauuugugccugcaccguuuguaaaaccucugucuuuuuaaaugucuccucuccuccaggcaguuguucccagccccagccucucugcugccccggagaggauuauggcugcaagagaggaaacugcuauugugauaaauucugccgugugcuaucagacugcugcccagaccacgagacccucugcaacuccagugaccugcaugcaggcucucuuccacccguggcucagcuggaugcuguaacccacagaggcaagccuggacuuuagaugguggccgcuauggaguggguggcaccacauccugaugguccugcaguucuuauagucuaugcauuucacgcucaaaacuucuucacguuccucucgacucccuucaccugcugcucucccccaagccucucuuuaggucccacagggagaggcugagcuaucaguggugaaaaccaggcuaggaaagguggugggcccaaccuuuucuugcucuauguaugccgcuuggccuugcuuggagaugucagagcagaagaguccucagagagguguuggggauguugaccagaagugggcugggggagaggagcacggaugaagacaaggccuucacccuguguuccagccuuucacacucccaagauggugcuacagauggugcugaggaccgagaggccacucgacucagccaggaacaaucaagauuugguacaaaacauggugagugcccugagcgggggugggggggugggggguggguguguguguguggggggaauuccugccucucuucuaggacucaagggagggggggauuuauaaaaaaaggagaaccagggauauguuuuuguagagcgaaguauggugagaugggagggggugccucaguaggcccauguugaggcaucccuucccccgaaguacuaaccauaugacauaguauggaauagaguuuauuuagggcgugggcaggggaguuggggagagaguagacagagaugaggguguggguagaggaagggacugagggagggacugagggagggauggagggagggagggagggagggaggaagggagggagggagagaggggaggaggaggggagaggaggggagaggagaggagaggagaggagaggagaggagaggagaggagaggagaggagaggagaggagaggccagcuaggaacacagagggggagagagggagaagggaaggggagagaagggacagacaguaagaggcuaagagagugagaagggggcaaaugacccuauuuuauagugagucuaacauaccuggauguugccaggugacugugggguaaagcuuagaaggaaugcuaaggagugggguagggaaggaagggagagaggaagggaggagagggggaagagggaagggcuccuuugagcuggggcagagcuuucuauuugaauugcaucucauuuucacguaucauaaacuuuucuuuuuuuccuccaccaccauuuauaaauacacaaaauauucuaaacuugugagucguacagaaaguggcaucgugccaaacucgguagcuuguguucuaaauccuccucuguccaacucuuuccuucugugcccuggcccuaaaguacucaacccagcauagagagauacccuucacugcuauuacacaagaggaaggagugugagggcccccccgacuccgagcacuugcucccugggaacuggacuugacuccucuagcugcugagcccgccugcuuggguggcagggacaacucauugaaagcaagcauggagaccauugcucuugcuggcccaagagaugcuuagaguaugagaccacagaugucagcaacuuggaugagguuuguugcuugucagguucugcagcuccuccacagccucuccagaaggccacucucggugacuaugaagggaaucaggaagagagccugagucuuucuccagcccuggccagcaggacccauggaacagaggucaccuuugguuuguuggggccaacauggcuggcccagcccagggguaucugucucucagcugccauccuauuagcccccacauuggcuuggccuggggaaaacugaaaccugggauuguuguaaacacauuuaaaagugcacagaauuagccauaaaaauua

SEQ ID NO: 8218 - RNA, 4000 nt, Mus musculus
acuaaaaaucuagaauggaaaucacgcuccuauagguuacucauauaacccagcucugcuccagcauuaauuaacagaaaacuuuuccugagacaggcucucacuauacaguccuggcuggccuggaugugagcaucugcacugaagguauaugucaccucacccaggaaaacuuuuugucuaauacuauuacauagaaguuccuugcacuccaaaacugcuauacaacuccaaacaccuuaacaaagagaaacucaauuuaggacagaugugaaaaaaaaauacaagagcacaaaucuacuuuuauuuauuuacucuccauuaguuuaaauccgggauggguacagcaucuggggaaaaagaaacagaaacauuaggugaauaauaaauaucacauuaccguauuacucaucccaaaaugcaccugguggcuuuauccugauaguaaggaggcauuugcacagcaucugaccuuauguaauacucauuuuguacauggucaucuacagugacacguacauucuugagauggaacggucucucucucacugacugccccacagauucucccauuucccaagggcucaaauuacagacaugauacugcugugccugucuuuauguggcugcugggggaaaaaaaccucaguuuuuccaacugagccaccucccagccucaggaaccagcacuuuuccccccugguacccaagaccaagggucaugaaugcuaacuauaaucaggacuccgaacugaccuaugaacccuagccccaaaucaaagcaaucaaaacuaaacaaaaauacucaagugaaauggcuuaguggauacaggcacuugccaccaagccugaccacauggaguuugauucuugcaaaugccacagcagaauagcugacuccuacaaauugcccucugacuuucauacacucuugugccauguaugcccacauaaaugacagcccuaaaaugcaaguugucgagugggguaugguggcgcccaacauucccaccauuagaguacacuauaaauggacccaagcgaaaguaugacaaaaaucucaacauagcaugcccccgugggccaaaguccugaaacaugguaugagcaugcuucccauguacaggauaaagucacugucuagucuggcaggacugagaugguagacauaacaaaccauaacaugccccccaaacaaggcacgacauaagaugagcuagguagcauuggccugaaaucccaccuacuuagaaggcugaggcaggacuuaaguucaagaccagccuugacaacuuugugagaaccugccauagucaaauaugagccuuguguacauaacaaguuccaggacaaccgggggcacaccauaagacuuuggcacaaagacacaaauaaauccuguccaaaguauuucuccucccagguugcuuuagugauaaugaaacuuaaaugcuauucauuugcgggccacccucgccugcuucacccugccaguucuguuuuuuuccacuuaagucagucaccaauucacagaacugguuuauacucuggacuuuuacacucacaagucuugagguagguaguaaguaucaaaagagccauuuauuuugcuauuggcacucaccacacggauucuguguccaauggccuuugcaggaagguugcuucggaauuuggcacgaaccauaccgcuguuuccgugggcccgaguuaccuuuccccagaucacucugguuuuguuugguuuaccuccaggagucacuguauugcugguuuuuaaagacauaagcggcaugagcuccaacacggacauaaacaugacacuaacucaguuauuuccuaggguccaggcucccaccucuacucuccacacagaacaccuugagaaauuggggggaacaauauucauucaacaauucauauacauaaagccuauuuccaggauagucagaagaaucuguguacuaaaaccauuaagaguaaauguggaaagacacagcaaugacaccuacucaggauaaaagcugaaaacgaggaccugaaagcacaggcuaucagagacugagaaugauggcaugaagcaaacgacugaggucucaaccaggcugagccucagcuacagaccucacucaggucugccuccugaaugcugggacuaagggcaugcaggacucacacacauacgcaugcccugacagugcacacaagggccaauuucuguauggccuuauguucaauucccaguaggaaaagagggaccagagaaccaauauagaacccagcuuaaaacaagcacacaagcgcgcgcgcgcgcgcgcgcgcgcgcacgcacacauacacacaaauauccagguccagggaaucuggcacccucacagcuauacaaacaagcaaacaccaaugcacauaaaaaauuaacuaauuuuucaacuaguuuuuccaaauguaaccucaauuguucuaagucagggugcaauagacuguuuguucacagagcagagcagaaucaccuaacucaauauagaugugggagcaaauaaauuguacaauaacaagaacaaucuauucuaguaauugucauuuuuaguaacuaaaacaaaucaagauacauugaaaaguacuauauaaacccuuucaaaggaaaaugaaagguacuaagagcuguaaucuuuguuuuuaaccauguuagggacuuaacacagggaacuucuacacuuguacuacgaaccaauggugccuauauaguccauaccaccgacaaaaagaucccucucuaauuuccucuaagcucuucacgugucuaggaagacucaaccacaccaauuucucacuaacaccccuaccuuuucaguagaaaaaacgagauuagucaaccaaaaauuaaaaggcaugggagcauacuuacuuuuuugccuuauacacauaagcacaucucuugccuaaguagaacuccguuucaucucgggcauaaacgccuucaauuuuaagaagagccgugugcucucuuugguuccggagaccucgcuuguagccagcaaaaauggccuugcaccacagccuaagacaacguuaagaaagacaugaugacuaccccguuacaacuuuucauguaucuuuuagcaagccaccaugauuugcuuuguagcaauuccuacuccagcuaucuacagcagaccucucguuccccucccgcauuacacugaacuuuagcuucgcguuuaauagaacgaaacagaaauggagaaaacgacuauugugagaucgcguaccuuccagacauacuugcuguuagaaguccuguucccagcaggccugaaaaacaaaaccgagagcucaaccgagagucaugcagcacgcaucccaccugucacuauuucccggcgcgagagauggcuucagucggcgucccaaggauggggaccucuuaccuacgcccugcccccuauagaggcagagccuggcaaaauacucagggcuccgacaaccaaugacaacgaacgacucggaaucgugggcaaaggccgggugggaaggcgacucacccgagacuuaacuucucaaaccccaaaaggaacccggaggcgagcucaugccuccaucaguacagaaagcagcuaacacaggcgagauccggcucugugcggggaacccagcucccagggaccaccgcuccccgggccaguaagaccgggggaaaugcacccauucucuccucccgagccggagaucgaccgagaccagcgagcucuccucccccggccggggccuccacaccaucagcccgucaucgccuccaucccgcccuccauccuccuggaauccccagaaaccucuggcggucggguucuccgagacgccagguugucucggugagggaugaaacuaaacgcaccccagcaaucgggccccaaagcucagcagcaggaaccccccucaccuccacaggcgccaagauggcggaaagaggaaggcaagccccgccgcgcggccuugugggacg

SEQ ID NO: 8219 - RNA, 1823 nt, Mus musculus
ccggcuucuagcuuuuauuuuuaaacaaaacaaaacaguagacaauaauauggucuccuucaggccuuacaaagccaggugucauuuccucguugucacccacuggucagcucacaacgaacauccugccggcuuuaggaucuaguuuucugagaucucagaaacugggaaaagaucacaagauaaugagaacaaaucuauccuugugugauuaauaaaauagucuucugccggguggugguggugcacgccuuuagucccagcacucgggaggcagaggcaggcagauuucugaguucgaggccagccuggugaucuacagagugagcuccaggacagccagggcuacacagagaaacccugucucggaaaaaaaaaaaaaaagucuucugauuuaaaaacauguuuucuggggguuugccggaccuaacuaaucccuggcgaacaauaaaauaccuaaauacauaaauaguccaggcucuguaaggaaggaacagggaaaggauaggagaaggggucccugcauuaaagaagucuagagucuagcuggaggaagcuggauuuagaacaaauuauuguaaaauaacaagagaaagugcuuugagcaugaauggaacuuugccaccaagccagggagaaaacuccaggaggaagaaauugugcuucacaacccggaaaaggauguuuggcaagaaucaguuuugguccgagaccagguuuuguacaaaaauaccaacccaaaggucccauauuuaggcuacagucagugaacauuucucuucaggucaccacagggaaucuugccaagggguagguucaggaaauuacaagagacuuguagaaaauuaaauugcuuuagcgucuaaaguuuaaacacuuacuuaacaauggcgcucuccagccugcuucagccaucuuaccucucaaaucuuuaggcguuaucuuuugcugaaugcguuacucaacucucuaaaaguuaauaauugaugcugcucuggucuuugcgaggggaaacggaauugugaaugcaagguaagggcgauggucacaagacaaucucccuuucuuuuuaaugacacaauuacuugaggggaucgccaaucugaguggcuucugcacuucuugaguucacuucacuuuaguuucuuuaugucuuuaccggcucucccagauuaccaguuuuguagccaacccucuguagucgcccuagcuuuccccuaccucccucggucgcaggucuuggcuggugguccagcguucuggggucuccgcugccuaggaggaguuucugugggcaggggcgggacuaccgagagcgcagggcggagcuaccacaagcagagggcggggcggcuggagucaaggccccgcgcaggcgcacuggacucgcggugccaaacuacagcuauggagcaggcaccuccggaccccgagaagcucuugcagccuggaccccuggagccgcuggguggcccuggcgcugugcuggaggccgcggucggugaggagaacgagggcacccgagaagacggcucaggggucgacacggugaggagaggggcggcggaggcuuccggucuggggccgggccuagcgggccgggccgggccgcccuggcugggucuggugggugcggucccgagaccggaggaugacccgaugcggaguggaaauggacucacaggcgcggcgugccggagcgccgcgugggcguugucacgcguguccgugguggcguggcccgcggugucagugggcgcgucccccggggucuggcccugaagaggcucgcugcuguuuccggccggccgagggggucgcug

SEQ ID NO: 8220 - RNA, 1823 nt, Mus musculus
cagcgacccccucggccggccggaaacagcagcgagccucuucagggccagaccccgggggacgcgcccacugacaccgcgggccacgccaccacggacacgcgugacaacgcccacgcggcgcuccggcacgccgcgccugugaguccauuuccacuccgcaucgggucauccuccggucucgggaccgcacccaccagacccagccagggcggcccggcccggcccgcuaggcccggccccagaccggaagccuccgccgccccucuccucaccgugucgaccccugagccgucuucucgggugcccucguucuccucaccgaccgcggccuccagcacagcgccagggccacccagcggcuccagggguccaggcugcaagagcuucucgggguccggaggugccugcuccauagcuguaguuuggcaccgcgaguccagugcgccugcgcggggccuugacuccagccgccccgcccucugcuugugguagcuccgcccugcgcucucgguagucccgccccugcccacagaaacuccuccuaggcagcggagaccccagaacgcuggaccaccagccaagaccugcgaccgagggagguaggggaaagcuagggcgacuacagaggguuggcuacaaaacugguaaucugggagagccgguaaagacauaaagaaacuaaagugaagugaacucaagaagugcagaagccacucagauuggcgauccccucaaguaauugugucauuaaaaagaaagggagauugucuugugaccaucgcccuuaccuugcauucacaauuccguuuccccucgcaaagaccagagcagcaucaauuauuaacuuuuagagaguugaguaacgcauucagcaaaagauaacgccuaaagauuugagagguaagauggcugaagcaggcuggagagcgccauuguuaaguaaguguuuaaacuuuagacgcuaaagcaauuuaauuuucuacaagucucuuguaauuuccugaaccuaccccuuggcaagauucccuguggugaccugaagagaaauguucacugacuguagccuaaauaugggaccuuuggguugguauuuuuguacaaaaccuggucucggaccaaaacugauucuugccaaacauccuuuuccggguugugaagcacaauuucuuccuccuggaguuuucucccuggcuugguggcaaaguuccauucaugcucaaagcacuuucucuuguuauuuuacaauaauuuguucuaaauccagcuuccuccagcuagacucuagacuucuuuaaugcagggaccccuucuccuauccuuucccuguuccuuccuuacagagccuggacuauuuauguauuuagguauuuuauuguucgccagggauuaguuagguccggcaaacccccagaaaacauguuuuuaaaucagaagacuuuuuuuuuuuuuuuccgagacaggguuucucuguguagcccuggcuguccuggagcucacucuguagaucaccaggcuggccucgaacucagaaaucugccugccucugccucccgagugcugggacuaaaggcgugcaccaccaccacccggcagaagacuauuuuauuaaucacacaaggauagauuuguucucauuaucuugugaucuuuucccaguuucugagaucucagaaaacuagauccuaaagccggcaggauguucguugugagcugaccagugggugacaacgaggaaaugacaccuggcuuuguaaggccugaaggagaccauauuauugucuacuguuuuguuuuguuuaaaaauaaaagcuagaagccgg

SEQ ID NO: 8221 - RNA, 146810 nt, Mus musculus
augguauuugauugacuuuuuaauuaaaaagcauuucuccaaacaguaacagcuuacaaauguacauccccagucacccuguaauucuccuucugagaauuuaucuucagguauccuucacgacugugcacacaaacacagugacucuuugcagaagcggcuguaauagcaaaauaucagaaugaagcuaaaugccguccucgugaggcugaguauauaaauuaaggcacauucagacauagagacauaaggaggaaacuguguaagcaucuucauggaaaugcuucuauggcagauuaagggagaagagcgggauguagugcauuguaaacagagcugcauuugcagaugggaggggucuguaaagagguggcugauguuugcaugagaagugguugccccugugaugggggacggacaccaaacagaugagaaacagggagaaggggguuucuauacucuguggcuugggaaccaugugaguguaguuaguauacauuacaaaauaaauaaaacaggggagggugcuggagagauggcucagcaguuaggagcacugacuguucuuccagagauccugaguucaauucccagcaaccacaugguggcucacaaccaucuguaaugggauccgaugcccucuucuggugaugcuauuuucugucugaaaauagcuacaguauauguauauauauauaauucuuuaaaaauaauaaaaaauaaaacaauaaaauuaaaaagaaguguuuauuuuggccccuuagaauaagaaaucucguuuugauucuccacauuugguugucuuggugucaccugaucauccuggugccuguggacucuucagguugggcacacguggaagccauagucauaccuaguaucuggcuagacaugccauuucagaccggaaugugauuuccagcguccaaggcuguggugggaagaccagucuuggguuuucuuauugguagaagcaacuuccaaagguucugaggcuugggucccccaucuccacagcggcuucuagaaaggugggguccagcgagguccuaguagggaggcaucaacugcucccggcucaggaaggaggaguggugguaacgaucucggguggcgaagucugcauuguccuggguaagcugagucauugccaugucaaccuuggcuggugauggcgccaagaugauuugcuccugggcggaccucaggcuccuuugggggagacauaggauggggagaggggaagaacagguggagaugaauuaugggagccaguccaccccauggagauacuguccaccccauggagauacuguccaccccauggagauacuguccaccccauggagauacuguccaccccauggagauacuguccaccccauggagauacuguccaccccauggagauacugugcaaacaccagcugcacuaacauuuaugucuuuaaauacuuaaaagauaauuguugggaacuacaacagccuaugaacucaaaguaggagauacaguaucaagugaagacgguaauauugaccauuguuaagugaaacacuguaaaacuauaccuucuaauaagggaugcccacccuaaagacaguuuugugagaguucuguaacuuuucuuuguucuuaucaaaugagacaauggcaggacuaaacuacagacuggagaggaauggaaagagaaacugcuuggcuucauuagaaagaaaguugaggugucccuacaccaacccugcauacuacaaaaccacccuucuaggcaaaauaugccuguggcugcaauaguagcaggaaagguuaugggguuaacaacuguuuuuugauuggauuucaggccuacuccacagaaaagaauuaagacuugguaccauaauccugaucaaaaguaauggcucaggagguuaugggcccagcgaggaacucauuacuguuguuuugcuaaagaacguauugucaagcugccuucuaaaugauuauugcuuauacacauagauuagcgcugcccucaaccuuagccagagaagcuucugucuggagugcgcagcaguuaauacagagacaaaaccagucagagcgcugagaauaagugucuauugagcguucagccccacacgagacauccacauccaccccugucaccaaggcugagggaacuuaaggaagaggggcagaaaggagaagcagagaacagggaagacuacgaaaugcuguccucuggagacggaauggccacugcucgugguuuaugagcucauuguacauaugauuauucacauacaaucaagucagcaagagcaaucaagauuccaacaggcagcgcuaacuggacucaguguuauuacacaaaaagaaggcaugaaauggaaggggugaguguugcaggucccuggggagacacgguauacaugacagagaugcauugcuuaugugugugaaaauaucaagagauaaauaaauaaaagauauccuauaaaaagaaaagaaggaaggaaggaaggaaggaaggaaggagggagggaggaaggaaggaaggaaggaaggaaggaaggaaggaaggaaggaaggaaggaaguugagugagcagucauuucuagguugccaagguuacucagcaagcagcuaagagguaacgugccugugcuuuggguuccaaaauagugaagaacaagagaaucccagauuuaaguccacugguacagucucuguacaucuggguggauacacuaguggagaucacggucaaugcugugucugugucagaggaagguaucagaggcugaagaaggcagcgcuguucuuagcucugucccucaacaguucauggccucagaaggccucugucuccauagucuucuguucucuugccccuccaucgcagguccacagccuguuagguccuugaguucccucagaggcacagauuuccgcugagcaucuucccccccaaaagaaucagcuauuucacucagauuaaucuucaaguguucaaaaucagggauguaaaacaagauauaaagagugauguaaaaagagaggccugaggccauaagucuguagaacugaagcagcagcagcuucagccgacccuggcaaguaccaggucacaugaaucuaaauuagucaggcuaagaguuccugaaaacugggcuggagagauggcucaguggguaagagcacccgacugcucuuccaaaggucccgaguucaaaucccagcaaccacaguggcucacaaccauccguaacgagaucugauucccuuuucuggagugucugaagacagcuacaguguacuuacauauaauaaauaaaucuuuaaaaaaaaaaaaaaaaaagaguuccugaaaacugaauuugccuuaaugaggggaggaccugcaaaaaagagguggccaaaaagacuaaacaaaacaaacaaaaacaaaaaacaagaaaacaaaccccaggaaaaccuacacauucuucuggauuuagggaaaucagcuuccuagaauugcugcagagcccuucucuggacaguugcuuuggcuccaagcuaaccucacagagucacuguaacguacagauauaauagagaauagaacauagccaaaucuuucaacccaaacacacuucacugugacucgcccuuggucuggaggacauacuugaaaaagucaaaacuacacagcagaaagcacagccaucaguuucuauuuuuaagccacuccuuggcccuccccucggcccuccccucaucuaaaucaucacaaaacacacccaggagccaugguguggccagcaaguuugaugcugacuuggccaaggcuccacaagccacuucauuaguccagagccacgcauugagcaagggguuguguggacuagcuucuguccaaucaaagcguugccuuuucccaggaacacccuccaaaacagugaccucagugaccuuggaggugacauuccaggaaaucagaguacagcucaaggagccgugcugaacccuguggucacucuuuuaggcuuucaagccagaaaugacuaaauauauucucguaaaucagauuaugccagauauccccacccacacauuugaagcucagacuuuuguaggcagcuucugugccaaaccuaauuccacuuaaucuacuuucugucaguccuagguuggggagggggaaaaaaaucuauguagauauucugugaccugagccacccagccucaugccucagacaagaugggaggcagggguuaucccauauuuaccacagcuccaaggacagguaaugcaguugaaagcauuuuuaggcgauuccccuccuccaucccuggccccucagcucucucggccccucccuuuguuuccacaccucuacacccuggucuuugucaucucaagcuccagcaccaaaucucacuucuugugccaacuugaacagauugucacuauuugcaaagagcuaccucaaaaggaugcugggguaugggccggagacauggcucagaggugaagagaaaguaccgcucuggcggaggaccugaguucucuuccuggcacccaaguuagacagcuuacaacuuugccuguaacuccagcuccagagaaaucuaacaacuccagccuccuagggcaccuacacccauauacuuugcucuccgauacacauaauuuaaaaaccaaagcaugcaagggaaugcagagcuacagcucaauggacauggaguuucagcucugcagaugagugaugauaauggcuauaugacaauaugguuuuauuuaacaccaugaauauacacuuacagauaauuaagauuauguuaugugugucuuaccacaauuaaaaaaaaaaaacuuagagguggggagacacaaagagagcaaaagaauucuaagcuuacaucugagaucaguggaaacggauccuaaacuucauuagcaaugucuggguguggaagaugcagaugaagauguuuauacauuuaaggcaaguauaaacuagauaucuagaguuucaaagucaaaccaucaaaaugcaacccaauaaacccuggugcgcagcuuuggcuucaugcugcuguugaaaggggacggacagcagaaguucccagaacccugaggccuuaaaggaugaggaaguccuggcuuccuaugagagugggaaggagucacagggaagaggcuacagggaacauugccuucgugugugugugugugugugugugugugugugugugagagagagagagagagagagagagagagagagagagagagagagagggagagagagagagagagagagagaauggcagucacacagcagccucccauggccuuucauuuguggucacacuuggcuagagugucaccagggcaguggcaccaacuaccuuuggccugagaggagaaguaggagaugcaguuucacauucccuugggcuuuggucuuaggcgugauuaaguaucagugggaaugugucucugacuguaaacucacugagaucaacucgggugacccaucacucgguaaucagauccuagaugaaggcuuggcucaugaggaaagaggauuugagccuauaggagguucugaugagcuaaagcuggcaaagaagugaaguggagcaagagggccaagggccugguacugaguauggaugacagugauggacaugaacuggguacugaguguggugaggcaguguggagcaagggccaugcacugagugugggggacagugaggagcaaacaccaaccuccuggagcuuccccauugucagguccaucccacaccacagucuagguccaagcacagccaagaccgcuccguaccuccccagccucugggacacucaucccuccuuguaccagccccagugggcacagaccugcaggaggggaccaagaaggacuucauccauuggaaaaagcugaaguuugaugcugauccugugaagaagguauaggcauagguuuuugaggcuuucacaaaaguagacaucuugaaucccagcuucaccgggggcugauauaccccuaaacauacucacagacaacuuucacguguguguacauacacagaacaagcacacuguuccacucaaaccaaacaacacucacucucuuacagccuggcagcagccugacuugugcucauguaugguuuccaaauacucacaucuaaacuacaaacaucuuaggaggacuggguggagccuacuguuaagacaagagaagacgacugacugacuuuugucucaggaauggaaauacauuucaugacacucaaaccuccauucauaucugcguguguugaaugcaugcugugaaauccuccacuaggaccauacacugucugagagcagagaacacgguuucucaucccuacaaccucacaggacuuagcacuuaggcaguuuuauaguucagaguggagaaauguuugaagugagggguuuuguuuguuuucuauuacuggccaaauaaccuuugaguauggcacacugaucugaguaaaguucaaccuuaaauauacauaaauagugaaauagauauauuuaagugauuauuauaugauauauauuuauguuauauuuauguguguauauauauauauauguauauacacuacauggaaacaugguaguaggcaggcaggauaucuggaccagcaagcugagaguucacaucuuaaaccacaaucaggaagccgagaaaucaaacugggaccagcauguggcuuuaaaaucuuguguggcuuuagaaaccucaaaggccacgccuagugucauacuucuuccagcaaggcuacaccuucuaacccuaacccaaauagaaucaccaacugggauggaguaacaaaugcccaagacuaugagggacauuucauccaaacugucccaaucuugguauaguacgguauacauaauccacccaucccaccaagacagguuuucacgcuggccuaugauagcccugagcuuacuggacuuccuuccucugcauuccaagugcuuagcucaaauuauguacaacuuuggaacaauuaaucaaacuuauuuuuagaaaaugcauuccuuagccagaaauggugguacacaccuuuaauccuagcacuuggaucucuaugaguucaaggacagccuagucuacagagugaguucuaggacaacuaagacuaacacagagaaauccugucucaaagaaccaggaaaaaaaagcaugcaucaauugcaugaacagauauacuugaaauugacgagucagaccauguuuaaugugugauuaggaaaucagcaguaguugaagaugcucauguuaaaaucuuaucuugguauucuguaggauuccugcaguaaaacagcaaauauugcugaucuaccuuaguguauacuuccuccagcaagacuaccuagugagucuuaguaucagagaggcgaccccuuauauauauucuauaagaagcuacaaaaucaaaauaagacagcuauuaacugaucuuacuucuacaaucacuuaaauucuaaauuaucuaaauuauagacacugaccugaaauuuuauuucauacuuuacugugauuggauuuuugggaaaauauuuaaauuucuuaaggugaagcaaucauugauauaaucauuauguuaauuaaaauauauucuaucuauaaaauuaaauuacacaggaccucuuccuagcauuacugguuuucuaagacauuauuuuuaguauaugcuuucacuuuagauaucuaaagugcauuucuguaaaaagacauauaccguaaaucugaagaaauuuuuaguuaggacuugauauuaauuauuuuuuuccuuuuugauaucgggucuuacuauguagcucuagcuggccuaaaacucacuaacauagacuaggcuggcccuugaacucacagcaaucuaccugugucugucucuggguguugggauuaaagauauguaccaccacaccuggugguauuaauugcuuuauuuuaaauuggagcaucauagauuauucuggaaaaagucccccuguguguguuugucuguguguguguguuucuagggacugaaccuaggacaugaccuugggcauacuaggcaagcacucuaguucucuaacacaucucuuuaaaaauauuucuuuuuauuuuuaacaaugucuaugugugugggugugcgcacauaaguuaaggaaagauaaggacauugaaucccucggaccuggaguugcaugagguugugaauugcccaaugugggugcuggaagauaaacuugggcccucugcaagcauagaaggugcuuuuaacugcuaagccauuguuccagucccucuucaacagaucuuuuaaaagauaauauuuuuauuaaauauuugagcauuucauauaaugaauuuugaucauauucacuguucucaacuccuuccagauccacccacacuucccguuuucuucuucuucacacccguugaauccgacuuaugcugcccacugcucuugggagaaaacuggcucucagccuggguauggugguguaugcuuucaauccccaaacuggggaggcagagguagguagaucucagagaauucaaggacaguccugucuauguauugcaaguuccaggucagacagggcuuuuuccaaaagaaaaaagaaaaagaaaaagaaaaauuuauuuucucucucccaguagcuuucacauagcauuggcaucuuaucuaguggugggacuuugucccuaccucugucuguccacacuggaauuuuggcugacuugagcuugcauagagucuugugcagagucacaagcauugugaguacauaagcacaacugcccuguugugucuggaagagacucuuuccuugaugcuaucaagcgccucucuuaacagucuuccugccucugucuagaaaagauccugagccuugaagugaggaguaaguuauguaugucccauuuagggauaauugcucuacagucuuauucucuauauguugaccaguugagggucucuguuaauugccaacuaguucuagaaccuagagaaaaaguuucucuggugagggcugauaggaucuauggauguagcaauaggucauuaggaguuauuuuaaugcuaugucuacuuagcaguuagguucucuccuggggccucucccuaacuaucuauccacaguuucuuggccccaauuacaguuccauaagcagguuccaucucauggaguggacuuugggucaaucaaaaagugguugguuccucccaugacauuugugccauuauuguccuagugggcauauccugcugggucaguuaugacuguagcucauaggguuggcagcugggugggacugaugguuacuuuucucuuccaguagcaugcauaacaccuuccagcaccaugaaagcuggccagauucuagaggguaacaaagaacaguggaaaucaccuauaaugguugaggguuuaugggaccucacuggccagugauucgaaaagagguaacccauucugguaccuggguuauuaauuugcaugugguaucuuguuggaguauuaucccaucuuagggcaauucuauuuuaaauuauuuuauaugucuauaugaauauuuuaugaagccucuacaauaguaagaaugcuuuucucaaaaguguuaguuauccuucccuguaauccuucaucuacccugcucucccaucuccuacuuccuuuaauccuuccuguucccucauucucucuuccuccuuuauaucacucuauucuguguccccucucuuaaaagcacaucccuaauggccccuuacuacuuuccuaaucuccauggguauuucaaaugaaucauacgaaucuaaagaguccaagcuaacauccauauguaacagaaaacacguaacacuugucuuccuuagucuggguuaccucacaaugauucuaguucuacucauuuaccugugcauuccauaauuucaucuuuaaugucuggcuaauauuccauugugugaguguacaauagccuagauguccaucaaccaaugaacaaguaaugaaaaugguacauuuacacaauggaguguuacacagcuguuaauaugucuuuaaaauugcuuuaugauagaggaaaacauauaaauuacgugcucuggcuugaugucucccccagugauaauauguggaaacuuaaucucuaguguaaguguugaaagucaaaauccuuaagucguucagcuauucugauaaccagagugauacucugugggacaguggaacaugccaggaaacuuguuacaguugagugaguccaagacccuggcacccagguacccaccugagacaguaggcaucuuccugcucccuaccagauuccuggaccagagcacaugaccacauuccccacugucagucauguagcccaaaacagaguucuccaugcuaacgaggcaucuagagacccuaagaguuuaaucaauaaguuucccuucccagacauuccuuccugcaaaagcuauuuaaucucugguccacccugagaaggugauaugcauccauuuuccaugacaaacaaccaauaaacaguuuggaaccaaggacugucacuuucaucaagaacuacugugggggcauggagaaggccuucugacuaccaagcagacaaccaccaccaagcuaaggacaaucgccaaugagcuaagcccaaguucccauuacccaguccugagcucacuguccucaucuggcagucccccaacuccauucccaacuccacaugacccaguggugccuggauguccaggaguugggagcccaggucccggccucaucacuggccuguggacuccugauacuuccuuccagacuccucugagcaguuuuccagcugcgaggcgacuggaugcccaggagcuugggaaccccagcuucagccucccacauccuaggcuguacuuucccacccccagagcagugucucagccuuucuccagcaccaaugguggcagcaacagcauaaucgcagucuagugcgcccuguaauucgccuccccagcaguagggcaaaacauggaccuaauccucuaaacugggagugggcuaguuaucuagggagugaguuccagauaaaaaagaucaauucaucucucuuccucuccuucuugucucuucuuccuuuaucuuccucuucuccacguccauaucagccaugggaugccuuucucuguguuauaaugcaucaguuaggcuuuaaccuaaguagccucugaucuuagacuugccagucuccagaacccuuagcuaaaaauuauacacuauucaguuuaugguauucuguuuuaucauuagaaggaagacuuuucuauucucccucucccucuuccucuuucucucauuuuuccuuaaaacacacacacacacacacacacaaaccaaaaaaaaaaaaaaaaaaaaaaccaccagggucucacuauguagcucuugcuggcuuauaacuuccucuauaaaccaggcugaccuugaacucacagaggucuacgugcaucugccucuuagguaccgggauuaaagaugugcagggccucacucagagcuauuuuccccuugauaguauagacucuccaaugauauguuucuuccugguuuuggucauuuguauuuuaccuuaauuugcucagucuggcuggaaguccacugauuuuauugcucuucugacacaaugauuugauucccuagugcggcacuuuguaugaggauguccuccauaugugcaaggguuuggaccuuggcuccuggcugguguugcuguuugggggaaguuuaagauauguagccuugcuggaagggauaugucacuaggcgcgagcucugagguuuuagaagcucccuccauucuugguacucuuuuucugcuuugugcuugcuguucaaggugugagcccucagcauucagugccugccuccaugucuaccacguguugcucuggucgacucugacccccauggaaccauaagcacaaauagcccuuccuucuguaacuugucuuccucgugguguuuuccacaacaggaaaguaacuaacauaguuggcauucucauuuuuuuuguuuguuuucuaucuauuugauuuuuacuaugauauuuauuaugcccuugucucauccccaccccuagccccacccuuugccacuuuggguuuaauuuuccccuccucuuccucuucuuccuccuccuccuuuuccucuucuuuucuuuuuuucuaauuuguuaaguuuaaagcugaggucugaggucaaaauuuugaaaacuuucuucuuugaugauauaccuuacaauuuugauauucugcauuuuugguuucauucaguucaaaauauuucauaauuuuaguuguuuuccucuugaaaccugugguuucuauacuuuacucacugcucuuaguuauuuaacauucuuuagcaucuaaauauuugugaauuuuccuauuaucuuccuguuauuuauuucugauuauuccccccuucagagaaauacuuuauucaauugaacugaaugcuuuuaaauuuaccagaacauuuguaucuuguaauagccuuguguuuccuguuacugagaaaaaauauaaauucuauaaagauuagggcaagcuuguugacaguacugaucaagucuucuguggucuugcuaaccuuauucccuuauuccugcaugugucaucugucgggaggcagaugcugaaaucugugugguaugaacuuuucuauucuuuucuucauucuauaagauucuguuuucauguacuucaaagcucuguuuuauuuuguuguuuuuguuguuguugcuuuguucuguuuuguuuuugcuuguuuguuugguugguugauuuucugagacaagguuucucuauauagcccuggaacuuuguagaccaggcuggccucaaacucauagauaucugccugucucugccuccugagauuaaaggcuuauaccaucaccaccuagucaaaacucuguucuuaagggcaugaaaguuaggcuuauuauguuuucuucaugaguuucccccuucaucuuuaucaagugauccacuugaucauugacaacagccuuuccucugaugcuuaccuuaauauuaauguagccauucuagugucuauauuuugauuagaguuagcuuaguauauauuuucacauccuuuuuauuuuuaaccuauuuguguguuuuaaaaaucuaaaacagauuucuuuagcuguggguguaguucaagggcaaagcacuuugauaguguacacaggccuuggguuugaucuccagcacugcaaaaauaaauucaccaauuaaaagaaguuucuuguaggcagcauacaguugggccacacuuucuuacuuagcugccacuuaauuagggguguuaagacugugaugauaaauacagauagacauauauagaucacuguuguucuuuguauaggucaggcuggccuggaaccugcugucuuuccacuuuuguugccuaugaccucacauacaugucaugucuuugcuuuauuaucaauaaauauucuuuauauacuuauuuuuaguuuucuuugauaugcuuuacauuuuaaaaauuguauuuauuuauuuuauuuauuccauguacacacacacacacacacacacacacacacacacacacacacacauacacacacuccuguaccuguauggaggucaaaggauaacuuugaccucaaaagagucaguuucaucuuucuaccauguaagucaugaggaucaaacucagguuuucaggcucaccagcaaaucccuuuacccacugggccaucucuccaacucuuuuuuuaaaccucuguugacuucuuagguauaacucuucacuauauuaucuagugguuggcucuggguuuauauuauacuucuuaaacuuaacccacucuaucuucaaaugauaugauagcauuuacucauagcacauacuguauauaauauuaugcuacaucaguauacuuuauuucaacauauuauuuuauccuuuuuggcucuugcucuacuguugccauacauuuuaguucuauaggucuuauaaaucucaaauuaauuggcaauguauuuuauuuauaaauugggucuaugucauauuuaaaaguucuucugugaaagcuagaaaaaauaauggaaaugguaguacaaugacuuagccacuuaccgagguaaaggccuggacuugccuggccaauguagaaauacacaagggcagcaacacccauacuagcuaggguauagagccacuggaucacaaacaugaugagcagggaugcaagagccuacagauauggauaagaagaguaagucaccugaccuuacaguggugauaaaaacagaaggcuagaaccuuaggagacaaugauuucuuauuagcuucugggcucuguaaaauucugaauaauuaaaacucacuuauaauauaaucuuacugugguaguguacugguuggguuguuuguuuguugucaacuuguacuaggaucaucuggggauagagaacccaguuaagaaaauucccccaucugauuggccucuaggcauuuuuuaaaauuauuguugauugauguagaagggcccagcccacuguagguaguauccauuacugggcuggugucccuggguuguauaagaaagcaggcugggcaagccaugggaagcaaacuaguaagcagcaucccuccauggccuuuacaucaaccauugcaucuagguucuugccuugaguuucugcccugacuuauuuucaugguggacuauacacuguaaaaugaaauaaagccccuccuccccaaauugcauuuggucauaaugcuuaucacagccauagaaagcaaacuaaggcagcacguguuggauguuaacuugacaggaucuggaauuaccuaggagcaagccuguaggcaugucuaugaggaacuuauuuagauuaggguagucccuggguaugacugugaaaauuuauuuugauuagguuuacugagguguuaauauccagugcaaaggaaggugacaccaucacugggcuugaguccuagacugcacaaaagggaggaagccaguugagcacagauauucaucuucugcuuucagauuguagauacaacaugacuggcuacuucaagcuccugcugcaaggauucccugucaugauggauuguacccucaaacaaugagcccuaacaagacaucuaacuauuacagaaaauuaguaccaggagugggguuguugcugugaugaaccugaaacgcaugguucuuagugcuuuggaacugguuuuacagguagaauguagaaguauuuggaacuuugugauaguaaagucuuugaauacagcaaguaaagaguagugggccauucuuguaggagcuuggaagauaagaacaccaauagaaauacagacaguagagaccuagcuccugauguuucuaaaggcaucaaggacucugucagaacugggguagagggcguucaugugacguuuuagccaauacuguggcuucauuuugcccaugcccuaaggauauaagugaaguuuaauuuaaagaugauaaauuaauuuguuugguggaggaauuuuaagagaacaaagcauucaggcuaugguaugaugacuuucuaugcacgaauucagauguauggugaaaaaguacaaagacuugagcauaaagguagaaauaaauuugucaagaauaagaguuugaauaaauuuaacuacaaggccaaggcacaugcugaaaaagaggcuauagccauuaaagagaagcauuuugcuuuauaauaggacaagagaaaauaucuucucagaucaagaccuacccaucaaaggcuccauuuuuugaaaacucaaauuuauuugaaagaagauaaccuaaauuaaaauaaagacuacauugaagcagauuccccuuucucaaaagcaccugccuagagacuugauuucccaggauuagcacacaaaagcuuauacaacuaugguucaaggaggccaggcugcaucccaagcuggcagcagaaucuggcagcagcuccaugugggacugguuccauaugcaugaaagaugcaaccacugggguaggugugguuuuaguguugaaccacaguuccagagagacauugagaccuguaaguguguugcaagguuggagccccuauaaggaggccuugugaggccauagugugaaacugugaggagagaccuaagcuacaaggaagggcccaggauauuggauaugccagaaccaugagauaucugcugggaaaagcuauaagcauaguacagugggcuugagaaaaaaagauuaaguucccacuggcagaggagcuaucuggauagggcuauccaagcuuuuuugagcccauaugauuccacagcgccaagauggcagacaugaagcugcaggauuugguguuugcuuugcuggguuuugaucuugcuuuauucugaucauucuuucugaugauccuauucccuucuauuguaaugagaauacuuauucugugccauugcauauuggaagcauguacuuuguuuuaauuuuauaggaguccaggguuaagacuuugacauuggacuuuaaaugcuauugaaacugugaaagaauacagggccuuuugaggugaauuaaacacauucuacauuaugaaauggccauaaguauaagaggaccaggggugaaauugugguaauuaguaucaauugucaauuuuacaaucagaaucuagaacccugauucuggauuuuggaaugaaaaaauaacuauacacuuacucaagcaaguuuuggggggaaauauccuuuuaaaagucaccacuuaaucaaaaccaccaacaaacaaacacccugucugucuuauuuacuuuuuccuguugugauaaacuauucugacaaaagcaguuuaaggaagaaagaguuuauuucgccucacaguuagaggcucaugucauaguccauuauggugaaggagucacaacagugggaaccugaggcagccaguuacauugaacccacagucuagagcagagaguaaaaaaugauuguacagcucauuuucuccuuuauauccaguccaagaucccagccuaaggaauggugccacccacagugggcaauuuuucccacuucaguugaucaagauaaaccccacaggcaugccuaaaagccugucucucaguccauucuaggcgacaucuagacauuugaaauuaacuaucacauuauuuuagugcuccauuccucccuacaaucaacaaaucaucaugaaauuaguaacccaaaguuuaucugauaugauuacuuaaauagaaaauaauugacuaaaaugagugguucauuagauguaaaucuugucauggcagucucaccuuaauuccaauaaagcaagcaauuuaaucaugucgaugcuaauuaauacugagaucaagauuaaauuacucaccccuaacagggagacccagggguuacacaugcaagcauagaaaacacuuggucuucucuggaucucuuguuccugaagucugcauuucagaaagaaaucuaaaaaaaaaaaaaaaaaaaaaaaaacccaaaaugaguccuucacaaacuuacuaccaaucccgcucuauuuuuauaagcaaauaccuacacacgcauguccccagauuuugugaaucagucuagagcuagcuucuguuacuugcucacagaggaaaaaggacgaaggacuuauggccuuagaccagcacacagcugaaaagaacaggaagaaaggccagaguagaagugggagccucucuagucuacugcacauuugucuguaucugucauccagggggaccccaagucuuucagauggagggggucagaagaggggagcugggcaccugguguuuggguccuggugugaccacuggaacugaugguccaggcuggcuuuugucuacaacaggauaguuuuugcugccaucugacuucugguaauugaagcuagcuuagccuggucucugauacagcccagaagcugacaacaggaucugagcacuaauacauacauauuccaaccccuucaucaugggcuucagggacacuggagcuucucaggguugaauguuuuauuuagcgcugcauucucaauuuacaugauuucagaugugcucaugguauugaaccaugaaaauacauauagaugguuuaacauugugcucuacucaccaagaguaccaugcccugcgagccaaacaacugagaacaccggacucugcugugugacugugccuuauuuugacacugaacuuccauagcugguugcucaggaaaugugucaacuucaacgcuuuacuuuccaguaucaacuccuucuucagucgaaguaccuugcauguaccagcuccucucucagagcuucgucaucuaugcccugguccugucucacucacuuguuuucuccuccuucugggcugcuucugauggguaggaggugucuggaauccugcuggaauucucuucucauagaucccuuagcugcuugccuaucauccacucuucaggucauagaccauaucacugccucacaaaaguucaacccuaccacacaaaccuaauucuucauaccaguuguguuuccuucguacuauguccuuucuuucacagaauuuacuaucacaugcaucugcauucuuacauacguauuauacguuucuaugcccuugguguacaugcauccauauugaucuugaagcuuggacuuauagcuggcagucauuaugcauuucagugcaagccugcugcuuuuuacucugggcccugggcccuuuagaacuagucccucuguacaucuguacuaguggaaucuguaaucacagcacuaaagaagcuaaggcacaaggaucaugaauucuaggccagucugggcuacccaaagagacaaugucuuaaaauaaaaaaaauaaaauaaaauaaaaaacuaaacugaagcagagguauccucaaugaagcauaucagauuaaucacauugcuucacacccagacuaauaugguugaacaugacaggucccccacaagcucuuguacugggggcucacuugccugcugauggauuuucagggaaagcaauuggaucaugagagccaugauguuguagguggauuaaccauugaugguuucauaacuugauaacauuuguaggaggugagagaaccacuagaagaguaucuugguuggaagaagaaggugacucugaugggggugugccucugaggguguauguuguucccugucccuucuugccuuucucucacugcucacuauccuuaugaggugaguagccugaucuacaugcaccuaccacugugacauucugcaacaccacgggcucagaaggagcccaacaaugauagcgaaagccacuuuagugacaccacuaaaaaguaaagcaacugagccuucucuuuaacucacuguccuuggggauuuguuaacaguaacagaaagucugacacuuugcccuuuacuguuguagcuuuuaccaucuuccugguuaucuaucucuugcccuucucugaguaaggaggcaagcuucuagacuuuccugucagggaucaucaggguuagguuaauuaacauaggaagacccacccuaaaagagaaugguggcauucuuugaguuugaaugcuagaccaaauggaaccucauaaaauugcaaagcuucuguaaagcaaaggacacugucaauaggacaagaaaaaaaaaggcaaccaacauauuaggaaaagaucuuuaccaauccuacauuugauagaaggcuaaucuccaauauauaaaaagaacucaaaaaguuagacuccagagaaucaaauaacccuauuaaauaaugggguagagagcuaaaacaaagaauucucaacugaggaauaucgaauggcugagaagcaccuaaagaaauguucaacaccuuuagucaucagggaaauguaaaucaaaacaacucugagauuccaccucacaccagucagaauggcuaagaucaaaaacucaggugagagcagaugcuggcaaagauguggagaaagaggaacacuucuccauuguuggugggauugcaaacaagcugguacaaccacucuggaaaucagucucgaguuuccucagaaaauuggacacaguacuaccugaagacccagcuauaccacuccugggcauauacccagaagaugcuccaauauauaacaaggacauauguuccacuacguucguagcaaccuuauuuauaauagccagaagcugaaaagagcccagauguccuucaacagaggaauggauacagaaaauguggugcauuuauacaauggagaacugcucagcuauuaaaaacaaugacuucaugaaauucuuaggcaaauggauggaacuagaaaauaucauccugagugagguaacccaaucacaaaaagccacacaugguaugcacucacugauaaguagauauuagcccaaaagcuuggaauaccuaagauacaauuuacagaccacaugaagcucaagaugaaggaagacagaaguguguauacuucagugcuucuuuagaagggugaacaaaauacucacaagaggaaauauggagacaacguguagaacagauacugaaggaaaggccaucuagagacugccccaccugggaauccaucccauauauagucaccaaacccagacacuacugcagaugccaagacgugcuugcugacaggagccugauauagcugucuccugagaggcucugccagagccugacaaauacagaggcagaugcucacagccaaccauuggacugagcaugaggucaccaaugaaggagaucgagaaagaacugaaggagcugaagggguuuguaaccccauaggaagaacaacaauaucaaccaaccaguccccccaccccagagcuucuagggaguaaaccaccaaccaaaaagaguacacauggcuccagcugcauguauagcugaggauggccuugucaggcaucaaugggaggagaggcccuugguccugggaaggcuugaugccccaguguaggggaaugccagggcagggagucagaauaggugggaagauggggguacacccucauagaagcagggggaggggggaugggauaagggguuuccagaggggaaaccaggaaaggggauaacauuugaaauguaaauaaagaaaguauccaauaaaggaaaagaaaaaaauaaaagaaaaagaaaaugcaaaagcugagaacagucaccuaccccucucugcuuccugacucuggauggauaugacuagcugccucuucaagcuccugccacugugguggacucuacccuugaacuguaagccagaacaaacccuuucuucccuaaguuguucuucugagguauucuuuccucaucaguguguaaaguaacuaauauagacccagucuacguccuauugucugguuuuuuaaaaauucuuuaucauauuuaucacuuacagugcaguguauguuugccaaccaugcauuuccucccccucaggaaugaaagccccaccaaagcccuuccuguuccugccaagcaugcucuuccagcacugaaaaugcuccacagaaugcagacaccccauacauggggcugaacaaaugagccauucacccccccccaaagacaucuucauggucucgaaacucauuugauuucaucgugugcuuacugaguuauaauacucaaaguucugaaucuguaugugaauggugaauugcccuuuuaaaaucuccaggcauuuaagaguuugugaguaagaaauacuuaauaaaucuccuaacuguggauuuaaacaaaaucugucaagauuuaccacugguuugaauggaugaugguucaacugucuuuuuucuuuugagauagacucuagcugugaaggccaggcugucaaaauccccuugccucagcccccagagugccgagacucaggaaugagccaccaugccuggcagaauuacuguagaaggaauucuguuaugagugcuaugacuuacaaugugcaauuuuaacaugucguugcaugagucauucuuuucaaucacaggcuuaauaaaauacagcuuccuuuuuugauuuagaggaaacacuauuggccagggauguaucuuucugccucucugagauuuaucagauguuaggcucucuuucccaacacucgaucuuguauaagcucaauuacauaauuggugccuaacucuggauggugcaacuuagauuuaacuacuugucaaaggugcaggggagaauaugcauucaggagaaacugcacuucauuuugaucauuaccacucucuucauaagacagugucccagaguauccacacagccccaugaucauaaaaggaaacaacagacauuuaacaggccugcagugcuaaggcaguguucagucaguuggguguguuccauguauuuuucuaccacuucagcuugcuaugggauuaucaggacacuuuauaacaagcccaaaagaagcaucuauauuguuccuaaaggaaguaugcguagaugugcauguugggggaggauuccaaauacaugaggaggagaaggauagugcccuguggcagcaagaccaggaaggcagcucuacguuaucaagucuacaguuggaaagcaagaagugagccaaguaguguauuguucagguaaauaauagcaaaccaauaaacagcacauauuauugacuuaaaaucuaguggcaugucuacaaccuuucauguucaugaaauucauacacacacuaacauucuaagcauggggaaaucaacacaauuguauccauuuuuuaguuacaaacuuaagaacuuauauagaaauuacuuagaauuucuacuaaaccaucucugaacauucauuccuuuucucccuuucauccuccuucuuuuugugaugcuggagaucgaauccagggccuuguuaggacaagcaagcauucuauuaauaagaauacacuuccacaccccaccccuguaucuuuaucggaguauguaaagagaauccuagguugaaggguugauaucagcuuaggacaccccaaaacuaaauucucagcgcaauggagauuuauuugccccagagggacaaaaggcagggaauaagagcugaagacaggagacagaggacaagggagaaagggaagggaacaaggaagaggggaagggaaauuugucagaggagaaggacacaaggacuaugucuggauagagaagacagauguggcccauaaaauggccuuuuauaaagauaaaggggaaaacccuguauuaggaugacguuuaauuuuaauugggcaugcuaauuaggugagacgaagggggcuuuugauugcuggacuucaauacuuugauagcuggaccuugguagucagccucagguagaggaaguggccaaauaagaaaauggaccuugguggcuagcucuaggaauguaaucuaaugguuuuaagcaaagggauagggaagaggagcaaggccugccagagcuaugucugcugugcucaggcuuggcuggagucccuuuacuaaguagcauagaaaccaaagauuuauguugcacagaauuauguuuaaaauccacaagauauuccaaucacauugauauuacaguuggcuuaaucacuuuccaaauguugaacauuucuuucuaauuugucaucaauacaagcaaugucaccauaacaauggagaacacaguuuuugguuugcuguuuggguugggucguuuuccugauacacaauuccccaaacagauuuucuaaaucaggacaauuauacaauuuucuaauucugguuaaaucuucaaagguugcucuucaugaucagagaaccagagggacuuucagcuauggugagaggaagagaccaugagucuuccuccccaaaguaaguguaaaauucugugugugugugugugugugagugugugcaugcacgcgcacguguuuguuuuaaaaacaacuaccucgggacuucagaaacauaccaaauagggaaauuaacugaaaagcauuuauuuuucaaaagcugcuggaguguagggcccagaaguauaacaggaauguagucacauauucucaggaaaccaaagcaggaggauuuuaagaucaaaggcaacaugagcaauuuagugugacccugacucaaaauaaaagguaaaagcagggcuggagagauggcucagcaguuaagagcaccgacugcucuuccagagguucugaguucaauucccagcaaccacaugguagcucacaaucuguaaugggauccgaugcccucuucuggugugucugaagagggcaacagugcacucauauacauaaaagaaaggaaaaacaauucugaggcuguuguugaguggcagagugcucgccuaggauacacagggcccugaguucaaucccaaguuccaaagaaaauaaaaaaccaaacagaaaacucccagguaugaucgagauguaguguguacacauaugaaauuaucaaagaauaaauuuaaaacauuuaaaaacaaacaaaaacaauugcugggccuuccuaccaguugcaaacuugcagaggggacaaggcaacuuggaucagggagaaaagcuaacuuugcaagcuaaauauggugagcagaguagaaauaaauagggcaauccaucacuucuucacuuugcuagugggaggauguagacuuggcuaucuucuggugguggggcaggcuucaaaaggcaaaaauuaagacuaaaauauaaagccaacuaaagauaucagccacacacacugcaggggagacucaucccacaguucaacuccacaguuuuacuuagacaaacaugaacuuauaagauacauauagcauacaaaaacuuauaagaguuuaucagaaccgagaacugcuauaaaauaucauauacauugucugguuuucaacucaagauuauaagacaugcaaagaaacagaaaacuauaaccuauucuuacagaaaauaauaaucaagugaaggaaacuaggagugaacauacauguuagauuuaacacagacuucagagcacuccuucuaaacacaugcagagcaauaaggaaaguagagugucaguggcuuagggaccaugauagcaauggcuuuaaaaauaggagccaucaauagggaaguauaagccauaccagaggagagaguaagacuuccagcuaagaagauagugaugggaugaaagcuugcuagaugggcuuaccagcaaacugaaaagaauggaaaacccucaaccucaaagacagaugagcagaacuaauacaaagaaagaagucccagugaucuuugggacgaugacagggaccaaaggccuggggcagggcuucuaaggaaaaacucagcacuggagacaacacuugaaauaauggccaacauguucuuggauuugaugaagaacuuaaaccacaagguccaagaagaugggugguggcggcacuugggaggcagaggcaggaagauaugaguuugaggccagccuggucuaagagugaguuccagaauagccaaggcuauacagagagacccugucauuaaaauccacaggcaaaaaagaaaacagaaaaaaaaaagccaagaauggauuaucugauaguacuuacaguaaauuguaucugaucaucagacugguaccuuuuguuuaaacuauuaaugacuuaauaaacaugauuuguuuguuuaagacaguaucuguguaguccaggcuagucugaaacucacuauguagcccaggcuggcuucaaacuccuagaaaucuuccugcuucagccucccgcuugcuggggcuacggguaugggcuaccacacagcuguaaugacaucuaaaaggugguuuagauuguguucauuuaauuaguaccagagucuaggucgcaagaggcacccucagaaaguagcauacacuuuuauauugugcauuuuaauuuauugucuaugugcaugugugcaugcauuuauguguaccgcaagcaugcaagugccugaagacgcacuggauccccuagaagaggaguugcacgugguugugagcugccaugugggugcugggaacccaggucuucugucagagcagugagugcccuuaaucacugagccaucucucugguacuuugcauugugcuuuuaaagucagacaaaccugugcugaaaaucugacuuccuaaauguuggcauuucuguguggacugcacccaacaguuaccuggcaguagccagguaugcuccuucccacuuaccuggcuguugccagguaggcuuggcccacucuaaaaggggcugcuugcccccuucucccuccuuuacucugauacucuugccucuugcuccccucuccccauuccuuccccccucucuccacgugguuauggccggcccuacuucucuacucucucccucugccucuacuauucucuuaacucccccccuccaugcccugaauaaacucuauucuauacuauaccguuguguggcuggucccucagggggaagggaugccucggcaugggccugccaaaccacccccucccuccacaccucaccacacauccagauagggacauauucuuauauuucuuaaucuuuuuaugaucauaacacugaaguguccaccuucuccaagcuccggcuuuacauccauaaaaggcuaauaacaaguaccugucucagggcuuagggauggaaugauucauauuaaagacuuaaccccugugaagugucauaggauacucaacaggauugcuaauuuucggcccuggcaauacauacuucagaauaaaacucugccgaauggacaugaaugaauccgggcacuggguuuuuccaauguaaacuguguauucaugucucccgaccucucagaagaaucuggagucugaccuuccuguuuuuaaaagucaugugcuuuagaagguacacuuuuaucaguuguguuuggcaggguaauuguucccuucugugaugcuguauuguauaaauguuucuuuuuuuuucauuucuaguuaaucagcuccuuuuuugcuuugaugaugauagucagaaauaucucucuugcccagcugguauaaauaaagauuccauguguauguaagguauaaaauacagcccaaguuauuuuugacccaugcugucaagaauauuugcuucugauucauaccauuugacugcauuugacuuauuaaagacuacacuuguuuaacucuucuugccuauuuuacugaucagcauuucaaguuguggggcaacguuuguucaacugcucacccauuuaacuaaaccuuaccaaaugccugcugcaucccccagaugaggagggaacauugugauggauauggaggugaaaaggaccagugugugacccagagaaacaucaaggccauagcagaggaagaaaauggaugcuuauuuuccuuaagacaugcagaugaaugggccugaaccugacuguguaagcaaaccugauauagaagucugccacccugauaagagcuuaggcgccucccaagaauuaaauguuuugguugcguacuggaagaauucucuagguccucaaaaacacugaacaucuuuuaaaagccagauggauuugaaacgucagaguucuccaaauagagagaggaggaggaggaggcgaggcagucugaggggacagcgcaggguauagagaggaaagugauggauucggggcacuagcuugggcucagcugcaaugcuccaagcucaggggcucaggaguaugugguccagagcagggcugaagagcuaagcacguggcacagcuccgcacuucugagcuaagcacguggcacagcuccgcacuucugacacagggaugggagcccacagaggcuucuaagcaagagagaaagguccuucuaugagcagagcaaagaggaggauggggaaaacaggaguaggacacuagccuggagacuuggcaaaagucuaacagugagaagaggaguggcugagccaagguaaagguagcaaggagagagacacagggagcagccaaccaaagcccuggcauugcuaagacuggacagcuggauuguguccacuucauucauuaaaauucacagacuggcccagagagauggcucagccgguaagggcacuuucuaccaaccugaugaccuaauuucaauccccaggacccucgaggaccaguucuugcaggcugucuguccuuuggcaucagcaaguguaccauacacacauguaugcauucauguaaaauacauguuaaaugaauacauacaugaugaaugaauacauguaaaagagaugaauguaauagaugaauguacaaaagaauuaacuugcaaacucaccacgugucugucaugucaccacacaagacaaaaaggcauggaaaccaguguaacccagaaacagaggauagagaguagagaugaaaauaagcccgagaaguaacagugaaggcaggccuauguggagcagaaaaggugaacucugggccccacggauagugcugaugggagccagucaucccaccuggaggaccucagcagaacucagacuaggaguggcaccaugucccauaggcugaccaggaccagggggcuggugacauguuugucucuguaugaucuguaugcuaagacccucuuuccugcccagcaagcuaaggaugaacuuuuuguuugcaauccccuguccaagguauucuuccucugaaccaaccuaucuggggugucugggcuuggcacagcggaacagagagggucugugcccuacacaguaagacuugccaacuccuuuguuucacccaauuuccagaauaugagcugccaccugugucuccccucccucacauguuagaaccaaaaggaguaaaaagaggcccagccuucagcuguucacauuugggccagcaaagaggucagcuuauucucagccauucugcaguacggugccccaaacaaugagucuuguuguauucaggucuucuagauggcucuaagucuagccaucuguccauugucauccacugaucauuuguuucaggauccccacggauaccaaaauucgcaucuugcacaugaagugcaauauuucauagaacuuacauauucuuuuacaugguaaaucauguuuacauuacuuauggugccuaaaaaauguaauacuauguaacuaguuauuaaacuguaccauuagugauuaagauuuuuuuaaaaagaagaauguuugauuucacuauagaugaaaucaucauuauauauaggacuaaauaacaagacaggacaguggcaauuucacuuuuuauuuccccaaauacuuuucaucugaauuugauuaaauguucagaugcagaucccagguauaaaaggcuaaguguaugcuaguucuaacuaugaaaagauaagcagcugcuuuaauaaaagccugugcagugcaccugaaagcucuagaacaaaaagaauaaacaacaaccaaaagaaguauacagcaagaaauaaucaacuuagggcugaaaucaauaaaauagaaacagaugaacaaacaaaaaaagaauugaugagacaaaguuggcucuuugagaaaaaucaguaagacugaccaacccuuauccaaauuaacaaaacuagaaaugaaaagaguaacauagcaacagacauugaagaaaaccauagaaccguaaggauaugcuuuuaaaaacuuguauucuaccaaacuauaaacucuaaaagaaauugauaaucuucucaauacguacagcucacaaacguuaaaucaggaacacuuaagcaauuuaaauaaauauguaacccuaauuacagagaagcagucauuaaaaguaucacaacaacaacaacaaaaccaaaacagugccagauagcuuuagcagugaauucuaucagacuuuuaaggaagagugaaugcaaacgccaauacuucucaaauuaguccacaaaauagaaacagaagggaaauuacccaagucauuuuaugagcuuuacaguucccuugauaaccaaaccacauaaagacccaacaaaggaagagaauuauagaccaauuucccuuaugaacauagaugcaaaaaauuuucaauauaauacuugcauacugaacacaaaacacauaaaaacucaucugucaugauuaagaaggcuuuaugccagaaauggagagaugguucaacauagagaaaucaauaaauauaaucuaccguauaaacagauugaaagacaaaaaccauauuaucaucucaauagauacagaaaaggccuuugacaaaaugcaacaccccuucaugauaaaaguccuagagaguaagggguacauaggacauaauaaguaauaauuaccucagcauaauaaaggcaauuuccaguaagcccauagccaacaucaaauuaaauggagagaaaaucaaagcauuuccacaaaaaucaggaacaagacaagguuguccacucucuucauaccuauucaauauaugcuugaagucuuagcuagagcaauaaaacaacugaaggauaucaaggguauucaaaguggaaagaaggaagucaaguauguuuacugauaagaugauaagauagcauacacaaguaauccuaaaauauuccaucagaaacuucuacaacuaauuaacacauuuaaaaaguagcaggauacaaaauuaacacacaaaaauuaguagccuucuuauacacaaaugauaaacagagaaaaaaugaggaaaauaauacauuuucaauagccucauauagagagauagagauagagcuugggcauuucuaagcaagcaagugaaagacauguaugauaacaacuuuaagacacuggaaaaagaaacugaagaaaauaucagaagaugaaagaucucccaugcucaguucuauggcaggauuaauauaguaacaugccauucuaccaaaagcaaucuauagguucaaagccauuccauucaaaaguacaacaaaauucuucauagaaauugaaaggacaaucuucagcuuuauauaaacacacacacacaggauagcuaaaacaauccugaguaaucaaagaacugcuagagguaucacauccccaaucucaaauuguacuacagagcuauuauaauaaagaacagcacaguauuggcacagaacaaaccugcugaucaaaggaaucaaauuaaagacccuauagacaugugauuuuugacaaagccaaaaauacacugcagaaaaaagacagcaucuucaacaaauggugcuggucaaacuggaugccugcauguagaagacuacagauagauuuuuauuuaucaccuugcacaaaacucaacuccaaauggaucaaagaccucaacauaagaccuuaugcacuucugaaucugguagaagagaaagugaggaauagucuaaacucauugacacaggagaagauauuuugaaugagacaccaauaguacagguacuaagacuaacaauuaauaaauaggaccucauaaaacugaaaagcuucuauauggcaaaggacaccauuauucaaaguagugggcuaugaaauggcaaaagaucuuuaccaauuauacaucuaauagguuaauaucuaaaauauauaaagaacuaaaaaaauauauacaucaagaaaacaacccaauuaaaaauggaguauagaacuaaauagagaauucucaacguugaaaaacaaauguuugagaaacacuuaaagaaauguuuaacauucuuagucaucagagagaugcacaucaaaacuacuuugagauuccaucuuaccaguaagaaaggccgagaucaccaguaagacaaaugacaggucuugcuguagaguauguggguaaggcaaagacucauccauugcugaugggaguacaaaauugcauagccacuaucaggaagcugggaauagaucuaccucaagauccagcuauuccacucuuggacauacaccccaaagacuauucuacuacagagacacuugcucauccauguucacugcugcccuauucauaauagucagagacaggaaacaacccagauguccgucaaaaggugaaugguuaaugagaaugugauacaguugcacaaugggauauuauucagcuguuaaaagaugaacuucgcagguacauugaugaagccagaaaaaaaaaaacauacauagugaguuaagccagaccccaaaagacaaacauuguacacacucucuucuauauuagcuuuuaaaucuuugaugggcacacuacuauccauauaacagcggagguaaaguauagaguaagggacuaggcagggugcaaggaacccuaauguaggggaaauagaauacauaguuauggagagacagugagggacagagacacugggaagggagaauuaaauggagagggagucaagaaagagauaaaggaggaaauacagggagggacauuaacucuaagggcccuuugaggagucauauggaaaccuauuaagguagaaacuuuaaaaaauacauacauauacaaaagaaaucuauauauaaccaccaauuaacaagagagacaaagacccaacuagaccccucuuaccacuaagugaaaucuccagcagcaggaauggguuacacuuaguuaaguuguuggccaaaggggucccauggaaauucccaaacucaggcuauuguaaaagcuauugguuauucuacacaaauggauagcaaggcuuuacugcuaaagaccauaccuauauaacucaucgagcaugaauaaguugaguuuguggaacauguuuccaucaaguugucaauugcaaaggaaaaauuauuuuucuccaauagaaccucacuggguauacaccccagacuuaagggaagccccaugaucugcagugaauggccaacacaaaaugaacucagugguaguuucagagauauuuugucucaugaugcuuugucugggcacuuguaucuuacuuguuuuuugcuuaccuauuaugguuucaguuuuucugugauuguauguuuguggcugugugaaugugugagcguaugugcagguauguauguauguguguguauauauguguagauguauaugcauguguggcucuguguguuuguguguguacacaucuggugcuuuuucuuugcuccccccucccauuuguuugcuuuguuuucuucuagauuuuuggggaguggggcauaugucuucuagagagagggggaugaucugggaggagauaagggaggaaaaacugaucagaauauaugaaaaauaauuuaaaaauuuuuugcaauaaaagagagaaggauggaaggaggaaaagaaugaggaaagagaaggaaaauaaagaaggagagggacugagagaggaggaagagggagggagagagggaggaggaagagagaguagggagagagagggaggaggaaguauuggggggcaccaaaauggggaaagaaucuagagaaaacacagaauagaaagauuuuacagggagggaguaauaauauaugucaaggacagaagaagagaauccaccauauucauaaaaugaaaauuaaaaacgaugcuauucaaugaaagaaaguaaaugaagaucuggacaagucaaguuacaaccaaagcgcuuggagacuaaggcuguguaguaugcacagacagaugguuugcaacuuacuguagaagcuccagaugaagagcacaaggggucauuuuauaccacaccagguaaaaggucaucugugugauaaucagucacacaccuaaaugucaaccacggaaagaaagcaaggcauugugggcuuuccaggccggccgugcgacucugcugggaagcuugucuuuuguguuucuuccuuuccuuucucuucuaccuggauaggaugugguggcagggcuccagccgccagaccaugggucaaggacgauauacucauugugugggugguaaagcaaaaaggaguccgagucacucaggaccguggacuugcuguggccaccuugcuccgcccaccugcuuuggucggaagcaguuuaaaucacuacugccuugagaucuuguuauugcuaaucaagcuucauuauggcugacacagcagguaacugaaaaaaaaaucuagacuagaaauacugggaaauaauucugugaugcguuccagaaaggagaacaagaugauaagaaaacagaggaucauuuaacaaggauagacuggggguagggauggggagaggagaggagagcggagcggagcagcagggcugggcugcagaaaauuauuaaggauaucagggaauggguacgaauuuggugagcaaacauaaccagugacaacagcagcuguuggguuaggcucaggaagacuuggccaggcugucugugucuguguguguagugcccgggaagagacagcugacacuucuaauguaguuuuaagccuguucuagggguaacuaaaugcaaaagaaagcugagaagugaacuaaagaaauacacauaauauacuugaaaauacuguggaauaaagacaaaauauacacaauaucaacaugauggaugauggagacagaaggaacucuccaaagauauagaaaggucuugcuggggauugugguguaugacuguaaucccaggacuagugagucuaaguaacccauaauaaucuaaaaacagucugggcuauauaaugagacccugagaucccaaaacacaacaaacagaaaccgagaagcuagaacggucuugccuguagggaaccagagguguugggaaaucaguggugguacauaacagaggcuuguuucaaacaaggauugcagugcucuauaccugaagucaugagcaccccugcacagcccuauccuguucccaggcuaaagaacaugagaauuuccuaaauaaaaagaugaacuaagcggcugcaggaaggaaauauccuacaacuucagagaugacaaacccggaucagucauuguccuuguuagcucuauugcuaugauaaacgccagccccaaaggcaacuuggggaggaaagggcuuacucauuuuacagcuuacuguuucucccaaagggaaaucucagggcaggagcucaagacaggagccuggaggcuggaacugaagcagaggcaacggagggaugcucauaauuggcuugcucaccaugguuuguucagccuguuuucuuauagcacccaggaccagcugcccaggggaggcacugaccagagugagaugggcuuguuuauaggacaaucugccgggagcauuuucuccauugagguuucccauucacagagacuuagcuugugucaauaaaaaccuguuuguuuguuuguuuguuugugacaggguuuuucuauguagcccuggcuguccuauaacucaauguauagacgaggcuguuacucagagaucugucgccucugcuuccugagugugggauuaaagucaccugauacaaaugaacaaaaagcuaaccugcacagucaucauuccaacacuaaggauacaggcucagcaggguauauuccccaacagugaaaagugaacucacugaaggagaaugggaacuuaauggauauaauuucaguuuuaucagaaggaaaguuaggagaugauaaugguaauugcugucuaaccuaaacauaaacauauuuaauaacacuaaucugcaaacuagaaauggcucggauauauugagugcauuugaacuacaguuuuguuuuguuuugggaauucugagaauagcuggaaaggcuagagagugagguugggacucugcagucaggcuaacacucaaggacuaugcuacaacaacuuaugggaauacagcugcugcgggcacuguucugcaccuuccagcacucuucuagagaguucccugguguccucauuucuuaaauuuccaguucccaguucuaagucuaaggaggguuugucugguuuucauggccugaacucuggcugcaggagaugccauaacacugcauauaguugauauccauaguuugagugugcaaggcuuccucugccuacccucaagauucauaauauuggaaauuccccaacgcagaaaggacauuccgugauggacaggcaaaaaugucaagggacaaaaguucacuacacuaucauagccaagaaauuucuugcucccuagaugugauaagagauacaugguaaagagaucaucuguaaucugccaggcaugauggcacacauuuauccuaagcagcuaugaagcagaugcaagggacuuuugugaaucugaggccagccuggucuacaaguucuaggcuagccagggguuacacagugagacucuuuuuucucauaaaacaaaacacaaacaaaaaagcaauacagauauuauuuaaucaccgaaaggcuaacaguagaaacaacaauuuggcugaguuuuuuuuuuuuuuuuuucuguucugggagugggauuggagguagugaaggguaaagggagagaggauaguauggaaguauggggaccauuguuucugacauuuuaaaugccauuuggagucuuaaaauauauacuuaaaauuuugauaaaaauaaaauaaugcagcugggcaaugguggcucaugccuuuaaucccagcacuggagagacugaggcaggccgaucuuugugaguucaaggccagccuggacuacagagugaguuccaggacagccagagcuguuacacagaaaaaccuugucucaaaaaccaaaauaauaauaauaacaacaacaaugcuuuacauuuuaauaauaauccuaccacuaaaaguguccuacccaguuagaagugaagaagagaaaccuaguugggaggagaacacaaaaugauugguuuuagacaucucuuucuaugaccuccgccucauccgcugacccugacuacuguacagauccuaagagaugaggugauacaagcugccuagacaucaaaugcacacagucaccuggaggagauaucaagucaugcaaagaaucggcucaaacuucucuaugacuccacaggaagucuucaguuguaaacuggaagaugcugguaucuauuauacuacaugagauaaauagaugugugcgagucagucucuguugcugcaauaaacaccugagagacccaucucaaucaacuacaaucucaacaggaaguguccuccuaaaaagucuuaugugcugagggcuuagccccagccugggagagcuccugagaagugacuggaucaauucauugaugagucugugcugaauggacuuucaggaagugggaccugauugaaggaagucuguuacuaggucucugguucuauuauguucuccucucugccuccugaaugccucgagguaagccucuucccugaccccaacuaugccuuucuccugugaugcugcaacuugccacaggcucaagaacaauggcgguaccugaguauggacagaaaccuaugaagugguguguccaaauaaauuccuucccccuuaaguuguuuugccaggcacauugucagagugaugacaaauuuuaaagaaaaaagguuuauccuggccucacagucuuggagaugccuccaugauuaguugacuccacugaucugcaccugacaguaggguagcacaucauggugggaacgcaccuguaguggcuauuccuguuugucaacgugacuauauuuggaaugaacuacaauccagaauuggaaggcucaccagugacccuuaucuggaggcuuggagauccuuaucuggaucuugguuugaagaucuugagccauaguggcuauggauuccagaagauugaaucuccgaguuuaaggaacacaccuuuaaucugggcuacagcuuucaucugggauuaaaggugugguggaacacaccuuuaaucugggcuacaccuucugcuggagacaauauaaggacauuggaagaagggagucuagcucuugcucuugcuccuuugccugcuugcugcgugagacugaguaacugcuagauccuuggacuuccauucacagcugugacugaacaauuguugggaauugggcugccgacuguaagucaucaauaaauuccuuuacuaucuagagacuguccauaaguucugugacucuagagaacccugacuaaaauacagcgccauagaauaaaacuugcuuauaucacaggccagagagcaaaggagagcagagagagcaccagcagccccaaaccccuuaacgagcaugcuugcaaugaccuaaagaucucccuuuagguuccuccucuuagacguucaacuacuucccaauaguaucauucuggggccauacauuuaauauaggccauuggguaacaaucuagauccagauuauagcaagaaaaaaaucaccuaggauaugccagguccucaaagaugaugcuuccucuuucaggacuucucauguucuaugaugacucucuuugugacuuugagcuuguagauuuaagaaaagcuagacaucuuuaacuacccacccuucaucgcauggcgccugguuuaaaagaguucucuucugcugacaaacugagugggcccuuuagcaagcaagaagaggcauccuugucaaaggcuaacuuagucugauucacagugguuacucuuugguugaacuuugagcaaaaggaaaaugauauucaauuacuaccucuggcucccagcucuuauacacaggagauagaaauuucugucuaaaauuagcuaguguauauauaacagaguaaaauuagaaauaauuuaacuggcaccuaaauuucaacauuuugaaauaaauauuaaaaucaccaaaaguuaugaaaccuggguuauaauaaccagguagauggagcaacuggugggcaccccaaaguaggaggccccaaaauuauuccaaagcucuuaccuucucuguucacucuaggcugguugcguagaucaggaacaagauggucaugugauucacuccuagaagucugcugcuucugauaggacucuugcuccccacagaaggcaacagacaaccucucagaaguccucguaggaaaggacaaaggagacccaggguccaagaggaagcuaucuuguaggguuugcuuggcgccuuucuuacccuugcgcuucugauucuuuggguuguuuccuucucuugacccaagcugacgacucuccaguuccucuauuggcuggaggaacugauccauguccuuggugaacuccagcagggugcccucagagaggcuucuggcagggacaucagagccguagcugggagcccuguccuggagcaggugcucagagcagugcagaguaucugggccuugucuggggacgggcucaggagauggggcgaggccacagugagccauggagagggcgaaguaagaguaguccaccaugauguaggucagcaugaaauugauggugacaacgggcgccagaacauucaccugacccaccaggacaaaggccauggucaccaagcuggucaggcagauggcugcuaccgguguuuuauuuggcccuuucuaugagaacaacagcaacaacaacaacaaaaauacagaauuaugaaauuucacauagaaagaucccaaauuuuuacaguuaaacaauaaaaaucaauuguaacaucucaggaacuucucccccacaggauuguucacauguaaacuuggaaaaauaauagccaacucauggggucaaugugagaccugagcuaacaugagauagcauaagccaaacauggagacccaguagcuccugaacaccagaggcacggacaacaucaccauuaacaugggacucuacgguacaacuuuggaagucuuagugucucagcucccccaaauagaaagcccccauuaauaccaaaacacuggcauccuccacuuagcccaggcucacgcacacaguuacacccuccucuccuagaaacuaucacagcuacucaugugguucugaggccaaagcacggugcacgucucaguccuguguucuucuccugaggagcuucauccgguccagcugcccuuccccaggaagcuucucuaccuggcauuugccuccuccuuccucaguggcucccuuucaguccucuuagcccacucuccacaccucagagacugcaucuaaaguaauauccuugccuugucucccagacuaucccuuuucuccaccuaaacucacucacuagacuccuacccccacacauacucccacccccuaucucuccccaaccacuccauucaugacuuuaaacaucagcuuucuguccgcaccgcucagcuuugaacuucuagccuacagcucucucagcacuccucuggaaucaacuggggcuucuacgggugugucagaacccaggcugacccgagacucuccccagaacaaucuuuacaaaggagaaaaguaaggagagaggaggagagaaagggggaagagaaggauuuuagaauguuuggaaauuaguuucagagugcauucauuaaagugguauaaaagauucuaacaauaacaugacugcgaguaaagucuguagaaacucacaacuuuaaaagaaguuuccaggaggcugccaaaaaugcuagucuaggccaagaccuugaggugaacgguuaaaaugggccaaugagagucuuucuccaccaagagagggacaauccacagacuggacaaaagauguggaagacagacagugaaucccuaugcauaacuggaaaggacagacaaggcaggggagguggcucagcaacugaagguguuugccagcaaggccaacagccugagcugaauccucaggacccacguggugggaggagagaaccaacucugaaagcuguccucugaccuccacacaugguguagcuuaagacucgcgcacacacacacacacacacacacacacacacacacacacaauaaauauguaauguaauauaauaaaaguccuucucaaaaggcagcccacucaaccaaaugaguaaaagaucugaacaagcaccucaucaaagacuauuaagcauguggaaagauggccaaccucaucagcaauuagaggacacauauuuaccccauagugagaugccaucaaauacccaugagcacggcaauuauguaaaaguacagaggauuaggauggcucacccaucucuauagcagcaucaguuaguacagaugcccugaaaaagaacagggugcuacucacugugagaagccaggcacacggagcaggugagacauuccgguagugggaauguagccugggguucuucuaaguuuacauccagcacaggcaacagccauaaaacccccaaauaacaaucugcggcuacaguauggagaaggaggauucucacaaaaauacugaugaaggagauagggaggauagcagagaagcgcgcgcgcacacauacacacacacacacacacacacacacacacaugauuccauguacagacugaguauucucaguguaaaaauucuguauccaaaaugacagaauucuaaaaaucuguauuagauuuacauggaaauugaauugggaaaucccacaucaugaaacuuuguuucaugccuaaaaugucuaaaaaacgcugcauacaauuaccuucaggcuagguguauaugaaacauaaaugaauuggguguaaagauacuguaauauagaaauaggaauaucccaaaauauaaaacaaacuccaccauccgaaaagcuucuggccccagacaguaaagauaagaaccauccagucuauauuagaagguuucaaaccccggcaagcuguuuagggacgaauaugaagggagcagucgcaagcuguggucccugggacgaacuugguuaugccaugagccacaagugccuuugccuuucaaacagcuugguggaaaucaaaagaagaaggauguuuugucacacgaaauucagauuuguguccuuggcuggagguuggaugcucucuguggcaauuucugagcuucaacaccagagaaaagugcugggguggaaggcuggggggccugcaacauucaaggugugugcugcaggaucuaagaggccuaggcugcucaucauggaagccaggggcuauggagcaagagggaagggccucacuggguagggguggggcuggggguggggcuggggguggggcugggguggggguggggcucgggguggggcuggggguggggcugggggugggggcaggcuggcaggguuccguguuggaggcuccaggaugcuaccuucuaauuauucuuaaaaguauuuacauugguuuuaugaacuuuccugucguguuaacuguaccucaauaauguauuugagcuucuaguguucugccauuuaaaaaggaaauaagcaaauauaaucauauaugaagacacgucuaggggaugggagaagcucccgauguuaaaagacacacgacaacccgggagaaauaucuguaacgcagaucacaaagaguuaaucuuucuagcuaagagcuucuagaaacugaaaauaaucuuagugauagaaaaaaauuacaaacagccacaaaacaggaagagacagucaguuuuauucacaaugaaacgaacacaaauacugguguccugaaaggccauuucucccuguacacuagcaaaaccguucacacaacaaugagccacagauauguuccuuguuaacacugcccuugucacuccaggugcugugcaaaugagguuuauaaauauuuacauauacugaccaagcuaauaacauaaaccugagcaaauuugucuauccuccuaucuuggcaaacauaucaacaugauaaugaggaagaccagguguacgcuuagaacccuuuaguccuuggccggucguuuguuuguuuguuuaauuauuuauaaacaugguuucucuguguagcccuggcuguccuagaacuugcucugcagaccagccuggccucaaaagcacagagaucugccugccucugccucugagugcugggauuaaaggugugcacuaccaccuccuggccagccuuccucaucaacagaugcccaugaacaucccuuuguggaccauaaugggggaggggcacucacacucaucugugacucucacccauaccugacucuaucuagauggugaggggccuuugcagacuguggagguaggcuuggaccaccuggcuaagaaauucuguaggacaaguuuuggacacaguguaaaggcauaggugcauguaggaauguuccuauagccccaucaacauuuugcauccaacaggaugcaaauccuaucucauuggcuaaucauaauugucaauuugguuggguugagagacaccuaggagaucaguacaguuuacucuugaauguuugugagggcguuuaacagagaugaucugaccaaguaggcucuggucuaauugcuaauaucauccacuugacaugcucaauuuucuuuuuugucugagagagagagagguguaugucugugguguguguauauguguguuuguguguaugaguguguaugguguguguguguauauguaugaaugugugaauguguaugugugugugguguauguaugucugguauguaucugugguauguguauguauauguguguauaaguguguguaugagugcauauaugugaguaugugugugaauauguguguuuauguaugugacugcauguaugaguguauguguguaugagugugugaguguguauaagugguaugaauauguguauguguguguauguguguauuuaugugagugugcaucaacuacuacaacacuguuuacuggaagacacucauguaugcaucagucaauagagaacugauuaaauaaacuaugucacauaaacauaacagaaaaagaaugagaaaauccucuuuaaaguaauauagaagacggauuucuaaaccacauaugaaaauuuaaaaaugcaagguauaagcaauauauugagagaauuguguguugaaugaauauacggaagggaaagauucaauuugaaaaacaacuggggagccugaggagauggcucagucaguaaaguccucccacauaaucaugaggaccugaauucagauccccagaacccaagcaaucugcacauggagauuugcaucugaaacccaacauaggcugaugcaguguaggcaggaccccuggaguucauuggccaaauaaccuagcuguaucagcgagugaccuggcuucaagaaaauaaggugguguggucagagagaugacucugugguagcacuccauccucuuccggaggacccggguuugguuccuggcaccuacacagcagcucacaagcaucuguaacucuagcucuaggugaucugcugcucucugguggccuucacagacacggcaugcaaguagugcacagacauacaugcagacaccacacacacacacacacacacacacacuuuugaaaauaaaaacauacagauugggaagaacauauaaggaugcacacacccauacccacaccaacacauacaaggauacauacccaaagagcauguauguaauauacuacacacacagacacacagacacacagacacacagacacacagacacacacacacacacacacacacacacacacacuggcaaggcuauauauucaguucccaacacugcaaaagaaacaaagaaagccacacucuugugcuugcgugcacacacgcauacaaaaccaacaauaaucauaaagacuuaggaaaaacagugccuuaaagaacaaaauuaagguuaggacagguaggaagguucaacauagguguagaaauucccaguggauacaguuuguguaaguuuuaguuuugaaaucugugcucauuguaucucauaaaaaaauaaacaaugggccagagugauagcccuaccauuaagaucgauggcugcuguccuggaggacgcagguucaauucccaguacccacuuggcagcucaugacccccuuuagcauuuggggacucagaugcccucuucuggccuucaaguagugcauagacacaugcauacauacaaaacauccagacacauaaaauuauuauuaauaauaauaauaauaauaauaaauuuuuaaaugagguagaauaaaguuguaugguauaucaacauccuaaucuugaaguaucaaccacuucuccuuccggcccaugucaacuggagagaagaaacagaaggagcugguuguggucaagugugccuaugugcuuagcacacaaaugguggaggcaggaggauugcaaauuucaggccagcuucuuucuuucaagaaacaaacgagggguugcugaggcggcucaguggguaaagccacuugauguccugaguuugaucccuagaaucggcacaguggcuccuacaagcgcuguggcuaugcucuguagagcaugguacggugcagaggcaggggcuaucucagaggguccaugcugaggcaucucccuuccccugccccagguaccagucauacgaugugucuaauauaaaacagagcuuaucugggaauggagucaaggcagagaaagaaagggagagaagggagaggggggaggagagagggagaaagaggucagagagagagggaagagaggccuggccuaccuggcugcuguugcuagauaacuguugggcagagucuagaaagaaugguaacaugcuaccaggucuucuugaccauauaucuacauguucucucucucucucucucucucucucucucucucucucucucucucucucucucucucucuuucucucucuaucucccccucucuuucucucucucuccccucccucccucugccccugaccucccacucccacuccuucccucucucccaugcucucccccucuuaccccucacaaacauaaaaauacacaaaccaauaaaaaacacacaaccagagaauucuagcaaauuguggcagcucugggcuagcuagugagacccuguuugaaaaaucuaaagggggguggaaaggaaggaguuauggugauauacacccccuugggaugaggcuggagucagaagggacuaaaaauacaaacacaaaguguagcuuacaagcuacaauacagagacauuggauucccugugaguaugucuacuguucuuuaggaaagucucuuuugaccaucccagcagccgucagucaacccugcuauucaguaugaguuacaguuuggcacaugauagcucauagagagcccauagcccauaguguggggcuucuucaaacagccacugccgcugccaccaccaccauuaccacaucaacauuaccaccaucaccuccaucauuaccaccaccaccaacaucaacaucaucaucauaucaacaucaccaccaccaucacuaucagcaccaccuuuaccaccaccaccaccaccaucaccaucacuaucagcaccacaaccaccacccacggcacaguaaacccaugggaaaggcagagcugcaaggcucuauucuuuuccuaaacaagagacuuuccuuuaugcuaaacuuggaggguccuggauuuguuuuuauugaaggaagggcccugcuucauggcugcucagcuccgggaagcaggugccugugauauaugagacacugugucuaagcagcuagccuaacacacccagggaugggacugaaagguacaacuuccaccccccacucugucucuccccagagaccagagacaccagccagaagcuuaugcuucggagagacagagagaugcagacggaaaaacagagagaagagagauagccaacaaagugagccacucaccccauucgccagaaaggcgagugcagggaugacuuuguccugggcgaugcacugcaggauccggggugcgccauagaguccccccauacaggaagccagggaugagauguacaggcccaauaggaagaggaaaccaaccagagacaccuaugagaggcagauguccuauuguuaccacgggcugauccugaauguccugcaguggccccugugucuggguuacacaggacaaauuaaagagagccacugcucagugaaguuaggcuucucagcggcaggggaucggucucucggggacugaaugcugacagccuccucgaagcucuuucuaaugcuguacaaaaaaagcaccuuuaguaggucaaucuucgaauagggaaacuuaccugaucuagggguguagugacuggcuuugugugucaacuugacacagguuaucauagagaaaggagccucccuugaggaaaugacuccaagagauccagcuguaaggcauuuucuuaauuagugauuaagggugggaggcccacuaugguugguaccaucccuggguugguagucuuggguucuauaagaaagcaagcugaacaagccaggggaagcaagccaguaagaaacaucccuccauggccucugcaucagcuccugcuuccugaccugcuugagcuccaguccugacuuccuuuggugaugaacagcaacguggaaguguaagcugaauaaacccuuuccuccccaaccugcuucuuggucaugauguuugugcaggaauagaaacccugacuaagacuaaauaaagagucuagagguuaucuugaaagacccacucucaaccauaaguacuuccugguuugcuaggcaugucuccagacuaagugaugcaaagucucugagaauccuucaagagaguaacccccuaaaaucucagauaacaaucucugacaaaaggcuacuuuaaagcugaggucacagcagguucaugccagauacaauggcucugcuaaaacucuacuauaccccuguguuagggcuugcccuccccucuccccagggcagugccuacugaacaauaaggggacugucaagggcggggccuaugggaauucuuuagaccaugggugugugcuuuugaaagagauggaaggaccucaagcccuucuuucucuuuugccuuugagaagaacaguuuugugguacuacacauuuguggccauucccacccggcguuccuacaagaggcacaaaacaacaggucauagaaugaacccccuaaacccaaagcaaagugaggccuuuauuacaguuuauuuaguguggaggugugggaugagagggauuccaugacagacauguaucaaacagaaucuguagaaacugaucucucccaccauguggggcccagggaucaaacuuuccauuagacuugacuguaaaugucucguuuccuguugagccaucuuacgggccaaaacguuucucuuuauaaauuaauuaugucagacauugcgugauagugauuggaaucugacuaauagaguuauacaaugaccaacacuuaaaaaaaaagguuuuacaaacauuuucuaauuuacuacuuguuuggaaggaguguucugugccccuauacacgcaugcagguuggaagguaaccuggaacagcagcaggccucgccuuacacuuugccgcagggucucucuugcuugccucugcacugugcgcguauucuaggucagaugacuuuuaaacuucacucgcucaucuugcuacacuuguagcaaucuuggaaugccugaccugugaccaugcacugagcuucucauggaucccaggacggcacagccugagcugagccacagagcuucccagggccuaaccauuguuggguugguugguugguuuugucuucugagacaagaauguugcuauacgugcaaguuguucuuaauucacaauacuccuagcucuaccuccuagauucuggguuuaccagcaugcuguauauaccagucaaaccaugacuugagccuuccuacuccccugguacaccuacccucagaguucccauuccccagccuacuccccucagcccacuauuucaggcuaguucauauuuuauauggacuauacacuaguucuccaauugagcagccuuggauucauugaagugucucucaaaccccugcuucuggguauuauucuuggcauuucagauuuagaaggcauugagaggagccuaagaauauggauuuccagaagguucuaagguaauguugaugucaguggcuagaaaccagccuuugagaacuguuggcuggcuaugauuccagucagccucuuguacucccugugaaaaugcuccaggcccuuaccagagugacaaacucaacccugguccuaaaaccucagugacagcaacuccuauugguugauaaguuccacucuacacaacacuugcuauugcccugcuaauuagggauuaagguaaaagucuaccauuguccagauagccuucugaccuugaugcaaaaugaaggacucccuuuaguagcaagacuuccccuucucugaccuuaaccccacaggccucugccugcaggaugucacauagccuuaguuagguuauagguucugauuccuuucuccugauaagaacccauucagcuagcaccugagauugauuccugcaaugccuccccacacuaaugaggcaucugggaccuuaagucuucagccaaugaucuuugcccauccuggauauucuaacucucaucccccaaacuaaauaauccuugaaucacgucaaguaaaguugaucugccucccuacagcugguccugguguuaccauauuuacaggacuuccaacacccauccccccaccccacccccaguuguagucucugcuccauuugucuccaaucccugugggggcagggagggucacacuugcuguugggacccucuuucuacauucccuaaucugcucguuguucaccacugaacaucaagaaucacaaggcacaaggcagcagacugauggcucggcaguuaagaaugcuuaugcuccugccgaggaccugacugaccuccacaagcauccccaugcacacggugcacauaagcucaucuggguacaugcacauacacaugaauuuuaaauucuuuaaaugcaaaagacucaguacaaaccccaucuccucuaugagucaucucacuucuccucauaccagugguugcuccccggugucgugaggcacagaacaggccuaccauagucucuucuagggcugcaaagaggcaucaagaaagguucugguccuuugggcuuuuggauguuaaaugggggagggagugucucacaacccgcaagaugggaggugagguggucaaaggcuagacagaggagacgugguccacuacagcgccuuccugcccuaugggcauuaucucauuccagguggauuucaucugccucuugcuucgcugucauggguuucuuggguguguccugcucuucccuucccacuuuauuauaaggaaucauuuguuaucaauguuuccugucauucuggguuauucucuccccugcaggauguuaaucaggcucauggcuuaucucaccaucacacccugcacucccuggaguccaauggaaucaugucucagccaccaucuacagcagagccuggcuaaccagauacauuagugaagccugggcacuuuacaugaucugagcccuguguguucuacacaacuguuagaggaaccagcuccgugguuguuucuccgugcauucugagaggagccaucuguaaucuuuguguguguguguuucuucucuacauccuaugcuggcgacuuagaaaaaagaaaagaacagaugaaauuuuaucaaaagcauuuugacauuuuaacucagugacucucuuuucagccuuaggaaucaccccagagaucccgccucaauaaguucucaguggaacacuggcucugaucuuuaaaaagucuuccagaugauucaaaugggcagucagugugaagccuaagagguuaggaaagcauccuuuagugucugcagaggauggguucuggaucaccacaggugugugaaucuggaugcucaggugccugguauaaaauggccuacuaucuagauaagaucuaccuacauccucucaccucuagauuacuauacauaauaucuaaugcaaaugguuggauuuguuauggauuaauagagauaagcuagguuuauaaaaaugaaauuuagggugaaguauugagacagggucuuacuauuguagcccuggcuguccuggauacucuguagaccaggcuggucucaaacucaaaagagaucagccugccucugccucccuaguacugagauuaaagacgugcuccaccacacccagcuacagagugcauuuuuuuaugauuuuuuuaaacuaaggguugaauguguagaaugcaugcaugcaagcgugcacaugcgugcacaugugugugugugugugugugacaugcacacacacauacaccuuccucucugucucucugucuccccauccccucuuuguguguguaacuuuuucuuuucacuuaaagcaugaucauucaugggaauacaucccccaagugcuggcugaaccccaagaacuugaucagugucuggcuccaucgucuccaugacacuagugacuucaucuugggcuuccuuccacagauacacccugggacuccuccagaacccgugggcugggggcagagccagaauugcccaagcauaauagcuaguuuacauuugguggagaaacuguguuuagaauggucugcucacuuaauacucuucauauaaaacuauuauucagucuauuuuuauaacuuaacugaaauguuguccauuuccucuuucccagcugaauccuagcucuuccucuauagcucuuccaccuaugcauuuaggcagcauuuacuaagguuacggucuguccuggaacagcaugggcuuggcaggcaacauagaugcaggaguagaccgugcaccuucauucccagcucccacagaaucaggucauuuucacguuaauguuuuaaagaaaacuuaaacauauugguguuuaaguuggaaccuaacauggaaaugagaguuuauuuugcacaaauguguguuggugauucuuaaaaaauuaaagacaacauccauaucaucacaaaaagcuaucuuucuaaaauguuauguggauguaaacaacccuaacuguucuacucauggaaguaauuaauuacacauauuauacauggcucucugcucucggucuuacucaggcugugcacugcauucagccacagagggaccccccuaccucaguauguucccuucucuuggaagacuggcuuuggcaucauuuagaagggacucauuugaccucaucuaguuccugugacucuggaugauacugugggggacauccuggugacccuacaaguucagauaaacuaagaaggcaacaccuguacacacauauccagcuuccucccaccucacacuuccagacauguauuuccaauguucgcauuacucugcuguuugaccucugcccccagccaaauucugccuucacuuggcagcuggugcccacaaaggaguaaauaaagcacgcuucgucucugaggggcagugcugccagggccugagcagaggauggcucagccaguaagaggggcagugcugccucgggccagagcagaggauggcucagcuggucugaggggcagugcugccuagggccagagcaaaggauggcucagccgguggcaggugcuguggugggcacugagcagaugccuacagccacucaccagccaugagagcucugcccaucccagggauggcacgcaauggaaugcaguagugucaugggcuuucauaguccccuccccuuggauucucguugucacgagcauccugaaggauuagggcuagcucuggugggauuucuaccuguaacagagaugcuuuggggucuucucgauacuucauuugcucuuauccggugaacuggaauuucuuaggauucuuggugcucuuggccuguuauaaacacccacuuccuggagugugugcgguuuacuuuguaagauuuuuuuuuuccugauaauacuguucuuuaguauucucuaucacagagaauagugggauugacaacuuuccuacugaauuaaacauggagggaugaaagguaugacagagugucucuaaaauagaugucuccucguauaaggauguccccaugaugucccccaugagugugaaaggguugaauucuaauaacccccugccaugggucacucugugauuucacaaccaccacauggaguaaugugcuugaaggaagagugagggaaaaguucuuccauugugggagaaguggguuggaaagacagagaauuagaaauagaucagaggaagcugcagggaacccagacagagaggaucagcugcccgggcccacaugggaaaggacugagaaacccaggagccauccaaggggacuguucacuggcaggcacuggcagggccaugcaaaggagcagcacagagagcauguuuaaagccagcugcucucugugucugacggugacuguggggaacacggacagauguagcccagcuuagaacccagaccugagccgagugguuuaauaaaacuacaugagagugauggacuauccauaaagauaccucgagaagcggacaucccugcguucuggugcaagcucacacagcccaacugucugaauauagugccuaccacugcagccacuucagacccagagggagacacgggggugggggggaggagucugggaaaggaucauggguaauccuuugggggaaggaugauggagcgcuccgcuccuggaguuuuccucgcugguccauccccgggcacccugcaucugcugagaaccagaacagucgucuugcuuuucucaguggccuucacugccugauccagggaaaggucucuguguagccucuaaagucuacacuccauuucucacccuagcaugugcaucagagccaagccuggguagugcaugcugccgacuggacuuccuaccugucucacuguucuggaccaguggugcucccaagaagguccucccugucagcagguuuauuacugauugaggaccuuccacccacagaggcuguggaggcugcagcaggcaccucugagaugguucugaccuaugcuggggucagcuuccuuggugacaaggccucccccaugugcacccugagccuucccuccagagcagaggaugggaagaugagccacacccagcggggaaucugccucccucuauccagaccagagucuagugaagagagcacuggggagggagcuagcugcgagagaggaagcagucucagaggcaggcagagcuacacacacacacacacacacacacacacacacacacacacacccuuagcugcagacaagcaggugucccuggaggagccacuccuucuccauucaguggcuuacugagguuuucaguuucucaugugcagccacacuugccacuccacugagaagggaucuguggaggucagauuucagauggaacuguguguguguguguucauguucaugcauguaugcauguguaugugugucugugcauguguauguguguguaugaaagugggugugaggaugugugugucagugugugcgugcgugcaugcacacaugcaugcaagugcacacacuugcaugcgugcaugcgugcacacaugcaugcaagugcacacacuugcacauaggaggggagagagaaagagaaagagagaagagagggggaaacuuccuugaaagcaaaccuugcaacccaguguccaagauuuggggcccuucccauccugccuguggucuacggucaugaccucuggaaacaagugucaccuguacuggaaucuacucacuauaaagagagaccugaguggauguggagagcagccucaagcgcaucuuuagaaaguaguuccgucuccucugucaggauuucccaucacuggccuccugugcucagcucuaccccagagagcagugcaggaauucacaacgcuggccuaauuggccaccauucucuaaaaauuaugggaguuucagagucugcuuuuauucugugaacucggggcaccauaggaguuuuaggggauuuuuuuuucuucagaaaaucuaauucuuuugagguuaagagccaaauauguguccuuggugucacaugaccuccauucuguaaagaagcaguggaacucaaggaauucauuaaucugaccugguuuguaguccagaaacaaagauguuguagccaaaccaaccaagaguugcugagauucucaggagagacuuccuccugucuuucuccaugccagcccugcccugggggagcgugugugccgagagaacacauucccacuuucuccuuccagcuugugggcugggagauguaauuuagguccucaggcuucgaagaaagaaccuuaguccauugagcccucuuccuugcuuuuugagacagugucucucacugagaccugggcucacuaaguaggcugguugaccagaaagccccagagagccacucccagcaucuuacaugaaucuugugggggaccacuggggucuucaugcuuguacagcaagcauuuuaacaucugacuaccuacccugucauuugucuugauuuuugacauggaaagaugacccuguuaucuagucuccugaauucaugucccucuuuggaugcuggaaucugaacgccauuaugaggauccacagagagauguugcacauucuccauaugccagcacccaaaaccuccaacuugguccugggcugaaggcaauacagauucucagacagagcugcaagaggaggcuguuggguguuggguguucauggaacaaguaagcccuuugggcagcacaggaugcacccaccuuuucagcuaucaggaagucagagcggagggccucucggguacagacggcaccaagcaggaaggcaaagaugauguagagaaaccaccugcaaaauccaagagaaagagcugccauauuguccagccccaaucccaccaagccucaguuuucuaugggaaccugagucaugaaagaaggccagccauggagccauggagaagccugggaaggugcauuuuguacucuuucuacucuauaguguauuucuuggccaaaagaaaccaagguagcagugguuuuaaucuuauauuaagaaaggguauugaaguggggaaaugggaagcccagcuucccggacuuggccaggguugaccugcuguccugcaguccaucuaucuuccuccaguagaagaauuacccagucauguguuggaccucuccggucucuagaccacaggcaacaguguacuuaagugcuuuuguuaacuuggcacaagcuaggaucaccugaaaagaaggaaccucaacugagaaaaugucucuguaagauuggccugugacccguaggugaguauagccggcauuuucuugauuaaggauugauagcggaggguacagcccacugugggugguaccaucccuaggcagauggucuguaagaaagcaagcugagcaagccaguaagcagcauuccuucaucuaucaucucugcuuuccgcuccugccuccagucugacuuuccgccaugaugaauguauacugagauuaacuguuuccuccccaagguccagcaacagaaagcaaaugaagacacagaggggagaauuaacaggugaagcuguagaguggcucugccaucaagcuguucuggguggcugacuaagucacaugacccugagaucugcccauucccggcugggccaugacacacaaggcuccucugacuuccagcucuguguaaagcaggacaggugcucauguggaaccuccucucucccccucucucaugcucagcucuuccugaucguuuuaugcucuucacaauguccuugccucuuuuauacacacggccuggugcccugugccuggcuggcagcaagggacuugugucaguaagcauucacaggcagauauuuuaacauuuucaagugcugucauuaaaauagcacaggcacugccagcuccucguggcaggguucuuucugccuaugaccucacugcauuuccgcaccuauucagugaaggcagagaggugcccuccugccuacuacacaggggaaauaacagaagacucuagaaggaaaaaaaacaaaaaacaaaaaacccagacucaaggucuuguuagucaggugacagcagcgugauaggaacuaaaaccccagaaaccagcaacugagggagggggagccccaucucugagcuucugcuacuugcaucauguagcaucucccuccauucauucgguacacauaugacauguagacauccccauccucucucucucucucucucucucucucucucucucucucucucucucucucccucucucuccccucccucccucccucucuccuuucauagaagcucagaaggcugacaaauggaaugccgaugcuagucuaugagauuacccaaugcuucauccccauguucccaccaugacccugggaacucugaauuaaaaaaaaaaaaaauccccaaguucaaaagaagguggagaagaggcagggugguuggggguggggcaaggaaggauuauuuugcauucaugaucccccuccucccacagcauucucaggcaggacugugaaagggcagcaucagaacccaccagacgugaauuuuccagcccaccgaguguaaaaaggaggauuggaauacgaaauagguuggucacagccagggcauucucagaacaaaaggggcagcccccucuucugccuggguuuucucucccauucuccagcucagaccaaucuaagaggggaacuuacgagacgccaacagcugcuagggagccuaaggggacacugucagcagggucucucaggucuccucccauguugaagccagccaugacuccugaaagacacccagacaagagaugaagugaggcaggguacucugucaaucaaagagcucuccccaggguggucccuucuucuccuccaggcucuuuccuagaagcugucauuugaaggacugcaggcuggccgccugucuaucucccuaggcaacuggggaggcaucuacagggaugugaaagggaccuuuguggauugugcgcugaggaggaaaccccucccugcuacaaaagcaucuuaucacuccaugaaaguguuaaggaugagggaggugugaucagagccacacaaagguccugauggggcauucugagcucugccugcuugcuuagcugggacagugcccaaguggcucagcgggaaucaaagggccugcagaguucuucagcaacuaauucacagaggguucaagcacuucugggguuagguaucauccagcagccaggaccaggugccauguucagagcuacaaaugacaaaaaucugaggugaacacucuggcaaaucuuuuccguauuaccucaagucccaagaaccccaguggaagcauuggaaagguaaaggcacuuggaucucugugagucugaagccagccuagucuacacggcaaguuccaggacagccaaagagucagagugaaaggaagccugccucaagaaacuacccauccccuacccucccaaaagauaaugaaaauuaauucauccauccuggugagggaccaauagcauggcugaggagaagggagaugcuuucucucuagacacacucaauagaacaaaguguucugaaguagaguaagagucuagcccauaaguaugcucaaucaacucggugugauggagaacguggccaugaaacucugacacagcagggacacaugguuucauguggagcaucauagugguuugaauaaaaaugacccucacaggccuccauaggcccauagagagugccacuauuaaaagguauggccuucuuaaaaguaggcauggccuuguugaaggaagugugccacugugagggugggcuuugaggucucagaaguucaagcccaggcucaguggcucauaguucucuuucugcugccuguggaucaagaugaagaacucucaucuccuccagcaccaugucuaccugcauccugccaugcuuucugccaugaugauaauggacugaaccucugaacuguaaagcagccccaaugaaauguuuuucuuuauaagaguugccuuggucauggugucuguucacagcaguaacuaagacagaagugucccugaaggagauuuuaguggacucagggaugucauggguuugauaccacuacuauugacuuacauucagccuacagggcuggguaagagcuucaugcgaauuuuauuuuuguuuaacccuuaaaacaaccacauccgaaaaguggaaugacuuucucauucuauagaaaaguuccuaaagaaguugguugaagcagccuaaaggcucacauccaguaaacugcagagccaggcuuuacccaggggaugccgagucgaggggaaguuugaagccagaaagucacaggguucuacuucaaaagaacccugaaugccgggccaagacuuggaucugcauacauuuucguccuagugauucugccaaggguacugugcuggacagucuauacugccauccuggcacaaccugaagucaccugguaagagccaccucgacugaagaauugucucaaucagauuggccugaggacacgucugugaggaaugaucuugauuggugacugaugugaaagggcccagcccacugugggcggcaccaucccuauacccagugggccuagcuuaugacaaagcuaacaagcaagccaguaagcagcauuccuccauggucucugauuuaguuucucccuccagguuccugucuugaguuccuucagugauggacuguuacugggaaauauaagucaaauggacuggauaguuuuaugucagcuugacaugagcucuagugauccaagaggaaggaaccucaaguaagaaaaugccuccauaagaucaaguuguaggcaaggucauggugcauuuuccuaauuagugauugaugagguaggguccagcccauugugggcgggggcacccuaaugagcaagccauagggagcaagccaguaagcaguacuccuucauggccucugcaucagcuccugccucagcuuccuguccuguuugaguuccuguccugacuuccuuugaugaugaacagugaugugcaaguguaagccaacuagacccuuuccuccucagcuugcuuuuuggccaugguguccaucacagcaaagacaccaaaugaaccagcccuauccuacucugauuuucuuuuggucaaaagguuuuaucacagcaacagaaaagcaaacuagaacagguaugaauaaagacauaaccaacgauguuuauaaguacuuguuuggaauagcaaaaauuacaaaccauuucaugucugaaacuaguagaugaugguauauaugccugucaguaagaggaugguggugucugucaguaagagaggaugguggugugccugucaguuaguaccaagccucagagacagugugggcugugcugugacacaaaaagguagcugaagccauuguuuaaagagacucagcagaaacagaacauauggcauauugcccuugcuagcugaggugggaaggggaaaggagaagaagagggauagagacacagaaagaggguggggaaggaccucaguccaucaaguacuugccacacauagaguaggaccugaguuugagcccccagcacccagacaaacagggaacgguagcauacaccuauaaucccagcccugggguccgugccuagccagucuagcugaguugacaagcuccagguucaaggaaaccuggucucagaaagaaaacaagauggugaacgacagaggagaagacacaucuggccuucacauacaugaccccccacacacacacuaacacacaugacuacauacucaagaggagcuagggaaggcgacaaauguuauauuauuucugcaggacugaagaacagauuuuuuuuucuucaguuuuuguuguuuauaaucccccagcauuuugcagugaucacuuuuuuuuuuuauuuguuuguuucuuucugacagagcucaccuugaacucuauguaacaaagggugacgucaaacuacugaucuccugaauguaccuuccaagugcagugauuacgggcuuguaccacugcacucacuguaugcuggaccgauguuccaacccgggcccccgugauucuaggccaacgcugucaacuuuagagcuacauguaaauucaaaacaauuuuccaauaugggaaaaauaaaguggaaaacagccuggcaggcauauuuucuuucgacucauuccuucuuuucuuaaaggaaugauuaaaagggugguggugggguuaauacacgucuauaugcagagagaaugcaucuacuccaagacuaaaacgucucccguuugggacacagagauuacggaaaacaucagggccagaaagggcagcauugggaggcuccuaaggagucuccucaguguguggccugaggcagcccggaugcuucaccucagaggaagcccuguccacggaucaggugggcacgcagauguguccacuuacccucccauccagcaggaaaacacuacuggagggccuggagccuagaacccacacaacgaccagaacauaccagaugggugcugagaaccacaaccaauaaacaaacaaacaaacaaaaccacacaaauaagugugaagcaaccccgauagaagaaacccagaccauggcugagagaaucuuggaaaauaaauuacuaauaaguugcuucuaagaggaaugaauacucuuccagcagaauaaaaugcugaggaaaaaauccaacaggaaaaaauaauuggaauaaaaaugugacccuuaaaguaaaaaaugccauagaacugggcuagugagaugguucuguggguaaaggcauuugccgccaagugugaaucccaagacccacguagugggacacacaauaaacaaacaaauaaauggaaugauaaguuuaaaugcuauggaucugaaaaauaaaauugaguguguuccuaaucauguaggguaaaaauauaaaaggguaggaaaguuugggaaaucagagagaaaacuguagcagccagagaccagagagauaacagaaauagagaaaauagaagauaaaagaaaguuccagggaacagaaguuuccccaaacugacaaagacuuuugucuuucuuuauuccuacuauguuccaucacacagaaugggugggguccacaccuaaguacaucucugugccauuucaagagaaacccaagugcugccaaggauuaaacacuggacaccaacaggagaacaaacggcagaccaccaucaggucuccucaaccacacugaaugcuaaagacgcuaauucugaaauuuguagggacaauuguuuuuaaaggagaaucuuagccagcuuaccaguugaaugaaaguaaaguuaggcuagcaagagcucggaaacuucgacuguccauacuguuucggagaaagccuugaaagaugcacaaccacaaaacgaaaaugucggucgcaaaggaaaaaggcggugguggugacucaggcugaaaugaauaaguugauaacagagaggggagcagagacagaaacauaaggucagaggcccuggguaggaauggaagaagcaauauggaugauaguggacacacaaugacauuaagggguguguuggaugcuugauucacugcaagaaagagaaagguuauugaaaaugcaggaaaaggugaauaaaagagcuaaggucuaaauauaggagcuaagaugugacaugaucuuaaccaaugggaggugagagagaccauguuuggcaugaggcaauacaaaauuccagccauuaauucguucuucagcaagcaacccacauagagucacaggcaccuacacguccccuggucuuuuuuaaccuuuaaaacuggagacagagagaauacuauaacugcaugcagaacauggguauucuauacuuuagugacacaaaagucaggcuauagcuacaugacacucaagagggaggcaagaaggcucagugggugagggagcuugcugcacagccaugaugacccgagucugaucuccaaaacccccagagaggugggagaagagaauugauuccauggaguugucuccuaaccucccacgcacucuguggacagguucccccacacacacguuaguaagagauaaaauaaagcuuauaaauaaaauaaaagaggaauagagaaaaaccauuguaaugcagaaaacaaaaacccucagucucacucagagucaguggcaauaauaccccaagcuccaacgagagcacugaggaaacuugaaauauaauucaagaaugcauuuuggguuagccauuaaggcagauaagggaaaagcuaaggugagaagaggaauacuaauauagcagcugaaauacauuuuaacuagcuucauauucuaucuugucaucagaaaauuauauuucuaaaugguuacuagacaagaacauagugugagcuggagagauggcucagagguuaagagcacugacugcucuuccagaggaccuggguucaguucccagagcccacguugguggcucacagccuucgguaacaccaguccuaaacgcccucgucuggccuccacggguacugcauguaaaacaaggcaacuuugcaucuaaaauaagaaaagaccaacuaggccaucugcuacauaugcagcuggagccaugagucccauguauacucuuagguuggugguuuagucccugggagcucuggagggucuaguaaugugauucugaauacuaaaugaggcacauuuaccuugucuggacauuuuuuaguuucuaugacaaugaagcuauuacaacuuauaugacuaagaaaaaaaaagucuauaaaaaagccuguauggucuuguuccucucuugcccucuugcuucucucuugcucuugcucuccccuucucauucccuugcccaccccccucucuccacaugcucauggccagccucucucuucucuucucuucucuucucuucucuucucuucucuucucuccucuccucuccucuccucuccucuccccuccccuccccuccucuucucucuuucucucucucucucugccuuuaucugccucuauuauacucuuagcuccccuccccaugcccugaauaaaaucuauucuaaacuaagaaaaaaauaaaaaaaaacaaaaacccugcacauucaacaaucaaagauaacgacuguuucuuacccauuuuucugagauugcucagauuucucuacuuguguauuaagcuguuucauagacuuugaauuaaauauuuuggucuugaaauugaugacuugcuuuggaguugaaaauaaggcacacuaguuccaacaauaagcuacauauauuauuuauauuuuugcugguaugccaagggaucauggguuuuauucacugaaagcuuaauuauucaugagauuuggcccacuuaccaaggauaaucaguuauugccuuaaaaccucaauauauaaaaggguuauacagauucccuuaagaugaggauaguaauuaaaguauaccuuauaaguauuucaaauguauaugugugugugugugugugugugugugcauauacaaaaauaaacaagaaacaauccagagagucucagcuuccuaaacaacagaaggaaugaagagauguaaacuaagcucaauaaaauaacagggauuuaaguauuuaaaaguucucaaggaaaucaauaaauaauuaauaaaacuuuaucaaaaauggggaaguagauagaaggucuuguagguaacauaaauccauauuuccuagcaugaaguuggugccuaaugucucagauugauuaauuaaaguuauagcuacaaugacauguuuugugaaacacaggcuccaaaaauaccaaacaugaauaggcaucuuguucauuaacuagaucuagggaacuuuugauugugucaaaagcauucacuuuguuucuauuuccaggguagcuggagacauuacagaaaaugcugugacuagaccaaggcuggguaugcccagacccagagcauuacggcccaggugucuucaaauaucaccuuuucuuuuuuuaaauuccagaacuaaucacaugccccauacaugccuguaaugccagaacucaggaggcugauguagaaguaugaguucaagaccauccugggcuacauagcaagacugugucucaaaagaaggaaacccuuguuuagucaaaacaagacuuccaguucaucuuacuggguucaccagagucuguaauaugcauauacugacucugagaagggaaauacauauaugcuauuuccuaaaauuuacuugacauuaaacacacuuuuuaaaaguaccuuggucauuaucagaguccaugaaaaauguuuuggagaaagcuaggcauuaguuugcuauuaccauugucuuuagacuuuuuauggcagguuuccuaaaaauguauuaaaugguucuuuacaaucaaaaauucuuacagcuggaaaacaucucagagagcaucuaguuaacuuuuguuuuccaaagaauaaggaaacugagacgaggcugcuggcgagagugacuugguucaugucuuccagcuaacuacuagcccugaucuucaaagaccaagaguuuggucuaccccacaucacacagucaaccccucucuaauacccauggcuuccuuagauuguccucuccaaaacagaagacucacaugacuaaccgggguuccauccccucacaaggguguaucauucuaauuggcagcacacacuggacucuccacagcacaucagcccccaggaaucacugccaauucgcaucuggaucagccucuccuugugggcuuuuuaaauuuuuacuuucuauuuuuuauuaugaguauauguguguaccugugucgagguauacacacaugaguacaguguccucagaagccagaagauguuagaucccuuggagcuggaguuacaggcaaucgugagugaccccaagauaucccaggugcugggaauugaacuugguuucucugcaagagcagaacaagcuuucaacuguauauccaucucuccaacccuccuuguggguuuuacacugucacuguaaaaagcaggugguugcucuaucgaaacugcauuuucuccuguaccagggugacaguugguauguugcaaccacauaccuauugaguucaguccucuauccaaguccuaaugaucuucugggauaucuuggucgaugucaacuuggcugugauagacaaguugaugguguuggccaccagcuuuacuacgcuaaggcuguagcguagcauccgaaccauacagagucagcaugacugcuacccacuagucuacagugauggcaccagaugaagagagagaacacagaugaccaggaaaggaauuuauuccuuacacaucucaacaagaaucccauguguaaaauaaaaacugcaccagacccaggaccagcuuccuucucuccgcacccagaguucaccagagcacaagcacaccgaagccuucacagcugccgcuuagcacagacuucccaacccaacucccuuuucuggucuugaaaaugaagaucaaugaagaggugggggaagcaagccuaggcuuuugcucugugcuuuccugguuccugugaguucacuaaaggcaaccuuauuauuucuuuaucaaagaacacccaggucuccuccaggcgacuuccaacugcacccuauaggugccaacuuucuguuucuugagccacacugcccauuuucuuccuuucccugguuuccuacauuuaaucuucuauuaaaagaauauauacacccaaagugccuaaaucuuaucguuuucuuguccacacaucaaauagcaccuuacaggacuguggcaaaagcagagaaagauuuauaaggcgcuuaguacucagcaccuagccgcagcuacuauaucaagguccacccacaaaaauggacugaagcaggaggaucaagaguuugaagccaacacauuucagaccagcuugggcuacauaccugaaguuuccaaagacuugggcugucucucccucccuucuuccucauuuccaaaccauguuccugccccacauuggcuuacaaacuggucagcuaaguuguucuuguagaaucuuuaucccuuuucuccucggagacagaaccaguccuccaucuccuuagcuguacagaugcugcuggaaaagacagccucagaccaggccuugcaaaugccaaggcucaagcaaggguggcagggauagccccagacaccaugcagucucuccuccagagaaacaguaggguuuacugcuuaccaucugggugaucgacaguagaacccaaguaaagauuuagccuaaacuuuaaagcagaugcagauauguaagauuuugaauaugaaaugagagcagggguuuuagcaggaguugcagcaaaugagggaccuuggagccaaggccucacugaauuccuccaaagguuccugugucggaaacuggagugaaagauuccugcuagcugaccacaguggugaccaucagucauccaagcauuuggaggacagaggcaggaagaucaacuguauagcaaguuccaggggggugggacuccggccagcaugagcacagcgaccauggcgacuaugugaccaugcaaccauggcucuggcaggcuguggccuucucccccauccccuuugccuugcuaaaaaccauuagauuacauuccuaaaggagccaccaagguccauucccuuauuugugcauuuccucuuccugaagcugacuaccaagguccagcuaucaaaguauuuaagucaagcaaccaaaauccccuuuggcucaucuaauuaacaugccgauuaaaauuaaacaugugacauuuccccguuuaucuuuauaaacugccacuugccuauggaccaugucugucuccccucuauccagagacagucuuguccccacagaauaaauacucugauccucuccccuguuccaucccucuucucccuuguccucuauuuccugucuuugucucuuauucccuucccucugucucucuggggcaaauaaaucuuugugcugagaacuuggucuuggaguuccugagcugauaucgaucucuuacaucaggcuaaccugggcuuccugggagagagagguuauguuaagggcauuugaagauggaacauuuaagagguaauuaggauaagaugaagucauaagaaugagaccacauggugacuuuagugucuuuauaagaaaagagggcuagguacguguggccagugguaaaguaagacuuacuuaacauguacaaagcccucggcucuacuaucuguaucauaaaacaauaacaacuauagcaaaguccaacugccagcccagggguaugcgccuguaauuccaacacccggaagauagaggcaggauuauaacaagaggggaggaguggagaaaucugaguuagcaugguuugcuauguuucaccaugugacacccuccagccuguucucacacaucacaaggccuuucccagaugcugugcagauguuggacacuauguccuugaacuuuccagacucuagaaucaugagucaaauaaacuucuacucagucucaggcauugugugauagagauaggaaauggacuaagauaacagaccuguuucucacagaaccagggaggguuuaaaagagaggcgguaucauccacagcucugugcggugugucauaugguaagcuauggaaauaacaauuauagauauaauguaaaaucacaaauucuauaaaaucuuaaccaaguguguacaaucauagagcuuccucucuucuccuuuuccugcccacaaguccgucagaaugaagugcgaucugccccauccuuuuuugguccucucuaguuuuuaaaccuagggucccuucucucauccagcaggggcuugcuuguucucauucauggagauggagaaauaguguggggcuggauggucggucgggucggcagggaggggagucagugagacauuaaccacagagcaauccgggcugagguccugcagacagcuucccaggaugcauagguguaaauaagaagucaugaucaagagucaagggcaccacagagacagaccuugacaaagaagauggccaaggccauucugguaaaagcuguugguuucccaccaaguucuuuacgcuggguguggucagccacagcuccgagugcugacuguggccaaagagccucuuguccuuuccaguaagagucugggauuugaggacaaggguuaugugaccucauacaacugguauuuuucucagcaagcucuuugaacugugguccuggaggggcuggcucccuaaggguguguuugggaaaacccuguagagagggauguuuugcugguacagcaaagcaaaugaagagucuaggccaaccccuauccucaccccugcagccccuaccacagggugugguagagccuagcuuggugaggaccagaggucagguuccauaaauacagugggggcaccacaccuacaguucaacugcuccucagaagucacugcccccugggauaaaguaucuagguaauauauaggaugcggcucuagaggcggggacaaggcaacaaugcuuauucuucaaagcuccccuuuccagccaggaagaggauagugcaggagggcgccccagccaugacucaugcacagauaaucccuagcaaaccuaucaccauggaaacugccaaucaugcaugcuuuucaucacuuaaccgaacaucugccaggggaaaacaagugguuugaaucauguggccugccucuguguuuauccauccccccccccccccccccaguaaacagagucaggggaggcuccacuccaaagcaaugggagguccuccucugcuuccgaauugucuguaugaugucagucagguccuucccaauauuuucugagccccuccuuccccaguugggaaaaaacaaaaaacaaaaaaccaaaaaaacaaaaaaacaaaaaacaaacaaaaaaaaacaaacaaaaccccucacaucaaagguucucacgcugcugugagaagcaggaggccugccuggucucuaagauggagaagcccauguagcugacucucuauucaguauuauaauuuuaacuccuagacgguuacaaaaugacauuuucuuaaagcacagaaaauaaaucgguguuugugugagcauauguacauguuggggguagauauuuguucgggggugggggugagcacguaccauggggugugggugagcauguacccugcaaguguagguaagcauguaccaugguacacguggcaggcagacagaggacaaccuuggaaugucagcccucaccuuucugccuugucugagacaaggucucugcauaaaacaggcuagcugccuugaaccuucaggagauucuuucaucuccacucccaccuccucguggccucgcugggacuguagaugcuuacccucccgugucugacuuuuauguguuucagugaucagaacccacgacaucaggcaugcuugagacaagcccuuuccucagugagccaucuccuuggccucagagaauacaucucaaccgauauucuuagguagcugucucagaugaagacagagacccucccuggagcagaauuugcggugugguuauccagaaggaguuguggauuaaaagacaguaaauuggagggacucaaggguguaaauguagcucagugguagaauucuugucuagcuuguagcaggccauggguuccaguguuaccaaucacacaugcaugcaaagaacaugaacaagaaaagaaaggggaggaaaggaaggaaagggagggggaggcagagagaaagggaaagggaaaggaaagggacaugggagggccuggcucugcacagauacccaacagugugaccacuugaugugccuugguguuggguaagagccccaaaagcuggaacugaucaaagcaugguaacaccagguagugacauccagaaugauuggcauuagcuuugagucauccgggugggguagaaucugaagagccagagaucaacuucuucucauuuuauaaacaugaaagagacauuuuguucccgccaauugaaucugcagaugaggauccugcuacucagcccuagucacaggcucauuuccaagauuggggaagggguagggguugggguagggguuggcaaugaucuaacagagcagucaggugguaggcaugaagggcaguguagagaauccagugcuauauggaagguaaccuuguuaggacuuggagcguucuagaaggugggaggagucauaagaaggugggcagagucagcaggaggagcggagucaggaguuagucccuauuguuggaugccauccuugagaacaggagagcaaaagaacugccagcuggaggcaggcagaaaggguuugaauccaaagucauugcaucugaaguguccgggauguuaaacaggcgacugaagaaacuaugugcugaggagaagccugggcaagcggggcaaaugugggaguuggcagcucugugggugauuauuaaagaagggaauuggaagagauuaaggagaggacaggacugugcuagcuguguaccugagcugcaucucuagaaccaagggauaaagccugguaugccggcaugggcuuguaacuccaguacaggaaagucagaggcaagcagguucuuggagcucacuggucagacagcuuagccagguuggcaaguucuaagcugccaaaagaccaugucucaaaaaaacauggagacuggaaucaggggaaugauagcugagguugucuuccggccuccacauacgugugugugugugugugugugugugugugugugugugugagcaggagccugaggaaguugaauauguaacaggcagacagagaagauaagcaggcaggcaggugagagcugcagggagggaaggcucugguggugugugacaggcauucagaaguuagaggaagcgguggcugcuugagaggucaaacaaagcaggaagucagaaaugcucacugcucagcagugaggucaguaggaagucgccgaugaccuuggaaggauccaguucaucuggggcgaugcucugaguuccgaaaggggagugugguagagaugagcaggaagugggcaaggcagauagggagccauccaucuuaccuggggaaggaggagagcaaggggccuuuaccagagaagagugugggcuugaggcaugauggugaaauguguuuccuucaguuuggcagcuuuauucaagcguagcucagauucggugagcugcaugacgcccacacagccaccagcauacuucagaauguacuguccaucugaaguguccuccugucccuaagcggcccuuccucuauccccuucaccccucucuccaggcaucugccugcaaacuaaagcuuguuucuucucaaacguuauauaaauggagcuuaugugauuuuacuuuuuuuucccugacuuuuuguaucauuuuuggcugucuugcucagcauaauuauuuugagacccauauacacuugcugcauauaucaauaauuucuuccuuuuaugcuguucuuuuuguguggcugaaccacaauuuaucuacugaccuguugauacucaucaaacuauuuccauuuggggacuauacaaauuaagcagcuuugaauauuuuaagucuuuguuuuuauuuuuaguguguguguguguguguguguguguguguguguguguguguagugcagugccuaugaaggucagaagagggagucugauccccuggaauuggggaugcaggcaguugugagccauugugggagauggagcuggacaccaaacucucaccuuuuacaaguaccguagaugcccuuauauuuuugguuguaagccuaggcuuuaacggccgagccaucucuccagcccaaauuaagcugcuuugaauuuucacauguaagucuucacacaagugcauacuuccagauaauuagagguaggauagcuggguauuuggaauuuuuaaggaacuguucaaagcuuucuaaaguggugugaccauuucauguucccuucaguaguaugggugcuuggaauuucuccacagccguauaacacuuguauggaagucucuuucacauuagacauuccaguagcuucucuuuuucccacccucugugcaugugggggaagggugacaagaagggacauggcauguguaggaagcagaggauaggagacagcugacuccagcaacagagauacuuuucuggucugugccccggaaacagcccuguccugagcauuucucaugagccaccugucauauguuagcuucuugucuucuuggccagggacccacacgugaggcaagagcucuauagucuccuucagaaauuaugagcaaguaaaaccacuguuaaaaagaauggauuguuaagucauuuuuggccaucaccaaagucaacuucaaaccccauagcacaugaaggccaacugugaugcuaaacuucgggaagaaagaacccagaguaccuaccuguagcugcagggaagaacaccccaaacacagugaagaaugacuccccggggcuguacucuggcagaauguugcucuguagcaguucuggggaguagccaauaaagccauguucuguaaugacacaaaggagccccaacagagcagagugcccaaggggacagcgugguuuauagcaugguuucuuucuucuuaagacaaugacacacucuguagcccaggcuagccuggaacuuauugguuagucuggucuggccucaaauuuacugugauucuccugccucaaccuccugaguugcugggauaauaggcauacaucaucaugugcagacauauaauauugaacauucuuaggcaauacaugugcaagugugugugugugugugugugugagagagagagagacagagagacagagagacagagacagacagacagacagacagacagacagacuugagaaucugaccuuuaugugucugcaccuauggcuauacaggagacaacguggagaacagugguuagcucagaggagggaagacuucaucuuugcuuuauagauuucaggauggcuacagggucuuuucagugagggucuauuuuuuuauuugauugcuuuccguaaaaagaaauugauuuugcaaauaacuucccugcuugaaaaccuccaugggucccugggagcuaaaagaaaaauaacgccaaaacuccuuagguugaacaauaaaacuccccacauccugacaacagucugcagugaccccuucacccuuuguucccacccaccuacccacccccaccccuggcccccagagcacaacaaaugcccauccuagcccuucacuggggucauguucccugccguaucaccccucucucugagccaucaauacugugcucaauuuuuucuuagauucucuccccucccccgcccccuugugcagcuauucagucuaucauacgucucuagccccgguuuuauuuuuaauuuggagacaggaucacucuaaguugcucaggcuggcccugaucucauucuguagcccaggcuggucuggaacuguaaguccuguugccucaaccacucaaguggcuggcaccacaggcuggacaccaccaggccugaccuguacucauucuuuaagcucagacaugagcuuccuucaucuguccugaucaggacugagucucccucucguuguucuugcuauuuuaugcucuggcuguuuuaugggccuucagagauggcucaacaguuaagagcgauaacuccucuuccagagggccugaauuuaauuccuaguacccacaagguggugucucagcccccacauggcagcucacagcugucuguaacuccagucccuggggauccaauguccucuucugaccuccaugggcacuguaggauaugcuccacagauauccauucagacaaaacagcuauacacauuaaaugaaugaaugaauaaaugaauaaauaaauaaauaaauaaauaaaucuagccacuuuaggucucuauggaaccacauuuuuuuguuuugucuuauagucccaacuuauugauauuacaggccagaacauugaucugccaacugagcuauguccccagccucuaccacaguccuuguuuuaaaaaugcuuguuuuaauuuuauuuauguggauacaugagucuauucacauggaguucaaaugagggcaugggauccccugaagcuauagauauuaggaagcugccggauaugggugccggaagccgaacuuaaauccugugacagcaggaacucacuccuaaucacacagagccaucucuccagccccucacucauaguuguuuguuuguuuguuuguuuguuuuucuagacaggguuucucuguauagcccuggcuguccuggaacucacucuguagaccaggcuggcguggaacucagaaaucugccugccucugccuccugagugcugggauuaaaggcgugcgccaccacacccggcucaacccacccauaguucuugaggugaaacauccacucuggcacaccuccacucuaccuggcccacaauagguagaccucacaguaaaaugguagaccaaauaggacucacaguaaaaugacuccucucauagaucccauggguacaucuccuucucuggccccugcagcacucacucucaagcuacuuuauuacaagaacaucugaggucugaauucuucgaaguauuuuaaauguguugguacaucaaccuaaacaacgucucucaagugccuucaauccauuuugcuucuuugucaccuugaacagcauaugugaauguacuagcaggccuuggaacucugagacacaagugaagcauucuuggcucagagacaccccaaauauuccgcuuuggcuuucagucuuguccccuagaacuugcuagcuugcaucaccucacccccgccaccacagugccccagagcugagcuugagaacagagcccaccguagcugcaggccugguccacccccacccaccauugaccuccccuccacaaagggagcucccucggcucccaggagacugugcguuucuucggcuuccaggagucauaacuucacaggaaaaauauucuucaagagaauuaugaagcuccaagauacacagggagucuuugggaguccgguccacacuuucaaaucaucgucaauugcuuucucuuggcugaauauagacuuuguucuggcauauuaaaucccaagcaccggguuucugaauggcuuggccuccucacagcugguccuccccucuucaacaaaaagcaauaacaagcuaaguuaacuuuagcuuacccgcuggcugaccccacagacuagucuuccugaggagaaaaccagggcagccuuggagcuuggcucagccaggccaagaugacgcacagcugagccagggcugugcaccccggggcaggccagcccacagcacauaaacaccucauuccacaugguuccucuccaccgccuccaaggaggucuuagaacucgaaggguuuugggacccuggccugagagcuuugccuagccugagagauugcuuagucgggucgacuaggaagccuucucuaccucuuccccucacaucuacaggcugagaaaauugggcaaggcagagagaggccucgaggcugccucuccagggccaaugagaaaggcagcucuaacauguccauagcauaucuuuacgguggcgcagaagcauacacuaauacacagcuuaccagcaaagacacugacacacucacaagcaugcacuacacccgagcacacacauauacugacgcacagacauacacacacucacaccuauacacgaggguauuucauaagcacgcauucacaccagaccauucacaaauacacuucuaugggcacaggagcacgcgugggcacauucauacugacacacucacacugacacgcccacgagcacauucccuggcacacacaauccugcugcccugacccucugcccuggaauaagucuaauucuuagccuuucuuggagagauaaucuuaaccuugaaaagaaccuguugacgaagauaauuaaugcuuucuugcaaucauaugaauguggggaaagaucuaagucucuaacuauggagaacugagauauuuuagaugucagugaagauguuugaagucggaccuggaggcacagacguguaacccccagccacgcaggaggcgagaauuuugauugacaggaggagaauggggcugagguacagcucagagugucacucuuacccagcaugcaugaggacccguaucauagcaaaccaccacaguacuuaguagcgcagaaaacugacaagccauaaucuuaucuaauaccuagcaugcuaauuaaaaauaaauaaauaaauaaaaacuuccaauguuuuaaauauuaaaaauaaacuuauacauggaagaaauaucuaugccaggccugguaguacaugccuuugaguuugaggccagccuguacuacagagugaguuccaggauagccagggcuacacagagaaacccugucucaaaaaaaacaaaauauuaacugugguugucuauauaaauaauuauggcaauucuuauccucucugucucucccuccucccuccuugaggcagaucuaucucucccuccgucugucuguccucccuccuugggaucuagcucuuucccccucuuugcuucccucucuuucuucaucugcccuuucccucccaagauagauuugauuacguagcuuggguuggccuggaguuccugacccaccuggcuccaccuccccagugcacagguuccugacaucugccauuagacucagcaagucuucuccuucaaauuuuuccuauaaaauuccugcaguuaagaaaaaaaauugaaggcaaucuacuuauuaugaaaaagucguaucuuucaggaaaugaucccacgcgaaggccaagugucuagaggggcaucccaaaugugccaucuucuuuucuuucuccccguguauacuuguccugcuucccagaaugauuagaaucguuuacgagaaagucaugaguaagagaauaaauagcauuuaauuagggagggguaucacccacaacacagccagagggguucaguaagguucugaagugaaaucugaggcuguggccuugagucuagaauuuggggccuagggagauaaucuauaguuuuucugaccaagcucauggggacagggcauugggccugguugcuuggucccauauaggccauuuuucucucagaugaaaaggaguaucugagacuggccuuauuacacacacaaacacacacacacacacacacacauacacacacaccuccuaagccuguugacgcuugcucauucugauucccucucaggauuuguaauaaauauccugggacagcucagacugaggcuugucacucugccucccacacagagcaguccucuucagcuucagaaaccggugucucccucgggcagacuucaucugggaaaggcaggcauguccuguggagcaccacaggucagaggcaccgaguaggguugauagaggcccagcugagaggauagccaacccugcugggauuccaggucugucugcauucaagacuccccaugcacuauguuuggggcuucuguuuuugcaggucuaggguucgaggcaagugcccuagccuugagcuacacccccaaacaaagcuugcuuccugacacccaaaugguaacugcuugcugcaaaaacuggguccugucagcugccaucuccaagccuaagugccugggaugcugagagccugcagcugcugccugugaaugcgccugggcuugaccugaacaucugcuucugaauccaccgaguaaaaauacuccagggccccucugugcuguguacuuuuaaagaccaaaagcagaaugggggaggggugggagaaacaaauccucacaggcccaggcaggaagaggcagagggaugcccuugcaggccuguguguagaaagaccuaacuucuccccagauuccggucacuccccugaaguugucaguaggcuguaguucuugggggcuuaguguuaccuccucaggggggugcagacggaaggucuccucuucccgugguaaaugccuuuagcggugauguaagaaucguugaucuggguuuggguaccaguugcccaggcucacagaccuagccacgcgguggcugcugggaaacacccuguggcaucuguaguguaaguacucacccagcccgcuacacacacaaacccuggugaacugaguacgggcagcugagcccuuggugagggagucccguugugacuguggacuaacuuagaaaaugaggcuucuaaaaacguugcugguguugcugcuguggguugugggcugcgggcugcgggcggagcuucccgcaucacccgcuuucuucugagcucaggucccccacccugcaaucaguuaccggugaccagggaccagggaccagccagacaagccuuuccugggaagggacaaugagagagucugguccaaccaggaauagaaagaguggaggaagggcuuggagagaggaagggaggcagcggcgccccccagacugagggaggguggggccugagagaucacaggaagagucacuaugcaaggaaaaggaaaggagaggccgagguucugggaaaacacaggcaccaaaacagccccgaagggaggggcgcgagggacacuggcaggggaagggaaggccaccagggcucagcacgcugagauccucaaagaagaaggaaauacaguacagucacugccggaaguacuacucgagccuccagcagcguauggccgguccuaagcccccgccccaacccccucagauguggaguuggacugacauccaugagagcccagugucacacuaccugucauccucuggggacagagacucgggcacaucuaaaauagccugacagaggggugaggaaaaggaguguucaaagagugcccaucucacagcggcaacaaggggcaagaggcgcuuagcagcagggacccugucagccugggcuuuagcauuaucaucugccccacucugggauccugaucacagggaggcauggccuggggagagaucccagcuggguuccucuugccugggcauugggugugagaucuaguccaggcauaagacugccccgaagcuccugcccugccacugggaaccagcagaugacaaccagcaucaccaacgcagcuacaaccugucuagggccuugaaugguuuuaucuuccacgguuuugggucaacagugauuugugguuuuccugagugcagauaaugagagaugaaaagagggaagaagggcagggguauggucugcuugacugggccauuuuuaaaauuuguauuuuuuuuaauucucauacaauauauuuuaaucauauucuuuucucuaucuuaauucuuccccacaaccaacuuuguguucucucucucucucucucucucucucccucucgcucucucucucucucuuucucaauaaaacacaaaaacaaaauaaggaaaacaaacaaaaccacaaaaucaaaacagauaaaaauaaagaaaaaaaucaguaagacaaaaaauaccacaauaaaacaaaaaguacacacacgcaaaccaagaccacagagacuuuuauguuguccaauaauuccugggcaugaggccuaccuagaauguggcugauauuccuagugacacaccauuggagaaaacuggguuguuguuguuuuguuguuguuguuguuguuucuuucccagaaaguaaucaauuacaaacagcuccugguuaggaguggcguuugguacauucccgugugugacacugcuaccaugcucaagaaccugaggcuuccucggucauggucccuagcgaaaacauaacacuauuauucugcuaaaacaauaacaacaacauagcaauaaaaugacaccuugcuauauccacagaucagagcaucgcuccauccaaucagagaagccucuuccuacaguagaugagagccaacgacaagaagauccacaacuggacaccauccagagagugagaggcucuggaacacuguguccuaaaugggauaucuuuaucaaacgccuccguccaagguuaggaguucuaugaagaagaggaugugggcagauuguaagagccagagguggugaugacuccagagaaacaucauuuuuucagaccccacaggaugcacacguaaacuuacagagaccgagccacuuuaaccacgaaggacacuagugugcaggacagaagcagaauauuuagaagacgcaagagucaaacgaagagaaaccccagauacugccaaggccauauaugauggauucccccugcccaggacaauuagagguguccaguaagaguguuuugagcuggaugugguggggcuugccggggaccucaaacugaggcaggugcuugaagaguucgaggcuggcuucagaguaagagguggccucaaagaaaauccuaaaaaggauagaccauauccaguguguacagcuaaugggccugcagagaagaaagaggagauaggacagguuugaaagaggccccagggaacucugggcagugagcugggagcagcccucaaccugcacucuagccucaucccugguaacuuuggucguucgaggagggguuguggaggagugaaugaggucuccaagucugagacuccacccagagagaaaacaugaagagagggcuggacauucagcaggggccagaagggaaacgugaaauggggcugggccugcaggguccacccagauuacccaaggaaagcagccuggagccuccucugucccuggggaaggccuccacccugagcgggacaggcugccaggaagcaguaacacccccaccaacccccccccacacacacacacacauacacacacacacauacacacauucucgcauccaaggggaugaagggccagaggaggagggguagaugcucugcucugaugggggagugacuaaguguccagcaacugaacccuugccaccucuacacucugaaagagcagccugguuccucugagcugagcauucuuccuuguggaagggaagcugaacguuuccuauugcaagauggcuucuaacagccaaauugugccuucuaugaccaauggccucuguuuuuaaaaguacuugggggcuggagagauggcucaguacugacugcucuuccagagguucugaguucaauucccagcaaccacauguuggcucaccaccaugcguaaugagaucugacucccucuucuggggugucugaagacagcuacaguauauuuauguauaauaauaaauaacccuuugggccagagugagcaggguugauuggagccagcagagguccuaaaaauacaauuucccaacaaccacaugaaggcucacaaccaucuguacagcuacacugcauucguauacauaaaauaaauaaauaaaucuuuaaaaaaaaaaugccagaaaugaggacaaagccugacuugggcucuaagaagaaagcgucaccuuaaggagaggaaagcaguagcuacuggggcagccaagcuugugccagaucccauguggagugcugucccagcuggacauuuaagcugucaacagccuggcacauuuucucagugagguaggaaucccagagagaggggcccagggcagauucuaacacugugcuggcuucacaacuaucccaaggaugcagggagaccuggcagggagccaggagcuccaggggcaacuagggcccugcuuuggggacuagagaggucccacccacuguggccccagauucccccacccaccccccacccccagaggccuggccuguguaacucucagccugaaggauucccugagaaaggaaaagcuggccucuuaucuccugggguaaaggaaugugcucuccugccaggacaaggggcugcuggacaggaagucuccacccuagcuguggguuccucccagucaccacuugcuccuucuggcugucccugccucuggcauccacuucccaugcuuaaacuucugaccugaccuccccaacagaauucuaagccauuuuaccccucaccccaccccaagccuccuccaauuagcuacccacucucagcuccaugccacuggggaauucugacccagaaguccauccccugccccacuucuauguggcuaugcucccuaggcagauggcugaggaugccaaguggccuuguagugcacaggaccaucucagagauacacuccugcugugcagcaggcugacacacugaaacacacagcuccugccucgcaagucuccaagccaaucccaaccaggaaacaaaucagaaagccucccuagaaucccauggcauggagcuggguaugcacaucagugguaaagcguguguucaacaugaacaaggcccuggguucaauucccagcaacacagaaaacagacaacagugacagagugaaucucauggaugacagcgcagcaucacagaaccugagaacgguccagggacucuacccugacacccauuuuauagauggagaugcugaggcccaggaaaagugaguccuauaucacaagauuggcagcuggucagguaagggcaggacccagggaaucuaagccuccacucaacaagcccuauguguccucacaggccccguagcagcaaucauauguauuguuauuguggggcuauuugacuauuuuuccauuauguaccagauagcuauuuuucugguauggcuauacugucucaccacaugauacaugcaaaaacauaaaauauucuuaagaguaacauuugggaucaagccaaguguucacaaccggagaaggcauaaacaaaauguaguguacuuggggaauggaauaucauucagccaugaaaagggaugaagugguggcuagaaagcaagcguagcugguaaccuacuugccuggcaaacaaggggaccugaguucaacacuccagaauccagauuuuaauaggcagagagccaaagaauuuacucagagggcaggaaaacuuauccuacagucaugagaacaaaauuccuccggcaucccugucacaaguuggguuucccugcagauagaugccuagaaccucagcaaugagggugaggagacaggaggguuauagaggcuugcuggcuuccagccuagcugagaaaauauaaguucuggugccagcagaggccaagagagggcaucagaucuccugcaucuggaacuacaguugcuccugagugcugggaaccaaacccagguccaacacagagcggccagugcuucuaaccaccgagucauccgucagccccacuaaucacauaugcuuaaaagugggguguggggacacacgcuuauaauccugccacuggggaaacagagaugagcaaacagaucccuggggcuccuuggccagucuuaccuacuuggugaguuccaggccagugagaaacccugucucgaaagcaccguggacaacaccugaggaacagcagcuaagauuguccucuggccucugcauacacggacucaugcauggauggacacagacagacagacacacacacacucacucacaccauacacaaagggaugaaacacuggacauacuacaacuuagguggucuuuaaaaacaucacuccaagugaaaggacaaguguccuaagaguccauuccuguguaacauccagccugacaaacucagagccagacacggcagaacaguuccucagggcccggggacucguuuucuauuugaggugagggaaccuucaggagccgaugguggugacugcuguauauagugaugacuguggcuaaccccacugaaucgcuuaccuaaauaugguuuaaacaucaacucacaccuuagagauauuuuaucacaauaaaaaagaaaaccaaaagaacccauuucuuugcacaugcccccucagagaucacagcccacagccuugauuuagacccagcucccgccugcuuuacacauauagaaauagggaauaaaagcacuucuugguugaggccagugggaaaucagcuaugaagcaauaaccucccagacauggcuauucccagaacagggcuggcuagagcccaggagggaaagaucagugcuaggcuugcuguuaucuaucuguccagugcagauacggacagagcccuguguguucuugaguuuagguggaagccugggcucccuuugcugacaccgggggggggugggggggggcuuggugugucagcaguggagaggcaggcaaggaggcuaucagaagcagagguuugggugucucagugucagguguucuaaggagucaggcaaggaggcuaucagaagcagagguuugggugucucagugucagguguucuaaggagucauacuuggcccacauguucccacuuccaagacucuucuggucaccaggacuugaggacugggaacaacauuuaacagugguccccacaagccagaacuagccuugggguaauaugcuaucaaccuagguggcccugugacaguggcagcaugcuggcucuacugcucuaaucuguucccauguccccucagaggcuggcagagcucacugcuccaggcacccauagccuucaaggcucaugcagagugaggugcugucugggguaucuccuaacaggagacaccucagggucccucuuccuucugcaucaauuccucggcucagacuggaugucaucaucgggaugugguaccuggaagcuuuguuaaugggguagaaaguguuguaaugacagccaccgacacaaagaaacagaggaguaaggucucauccagauggcuuggauuaaaguguccccgugccugccucacagugcagagccuagucccaggagcagcagggccugagcacuguucaaagaaugcucguggguccgcuccuuccucaucccugaccaagcacacaagaauuuucauuuucacacgggcccuagauccugagaccugagaaacacugucuuagcacacaacccaguggcuuccaggggcuucuccuuuuaggauaagcagugauggcuacaauaacucucuguggagcaccugcuucaugccaggguccacaccgggucucacauugacaguaucuuacuucauucuuugacaguccagcagggcagccauuaccacuuguuuucagauaugagggaaaagagguugguaggaucugaguagcauguugcagccaagcugggauuugcuaugaggggccuaacucuaaaagcagggcucaggacaguaauugugcuguaaccuuuagcaccaggccagcaacgacagccucuugccaagccccuguagggccuaaaacuucaccuguguucccccagggagguguuccagaggcuuccuaggccuggccugcugcugcugcuaagccggaagcagccucaguaucuucucagaacuuguccacaaagaggagcgugcauggacgccugcagaguacauggggguccaggacuaacauggauugggagucggaacagugagcaggccugaggacugcuucauuaugaguucagaaaucucagcacuggaccccagagugaggacacagggaagaaagcaggggugcaccaggucaauccccacauuacuguauaaauugcaaauuuaugacgacaacccuaggaggaagcccggcucagccagcuccacccgccauccuccacaggcgccuggaucuccagucaaccuuagacagcggcgcucugccucagcgacucgcugugacugcccacucuccgaugugcaggauacaggcaugccuggcagccccacccuccgucgugaugccuccacacgcauagucaguguucccaaagugcuuuagccucuaagugucgugauuugcucucccaccgccacagcggagcacuccgcagacuacucaaugccacggggccaccgaccucggccccuauagcgagaggcacacaaggcuggcugagcgggagcguggagggucgcaggcagaacaugcucgcccauuccucggagcuccauccuugcucaguaauguuaaagaaccucccaagccagugauuucauacaccaggcauucguccccagaacucuggccagggaggccggccagggaggccgccugcccacagaguuggaucccacacaagggcagaaacugggcaacacugacucucacuugcuccguaccauugaucgggcuccacggccucuucagcaugugguuccauucucuacccuuuagugcgaacggcagcaagaugaaaacaaucccguggacccaucucaguuguagggugggguuuggggccagggagcuaacauuccggccagucacucuaucagaaccaaacucaggaugagagaaaggagugagacugaguaauccuccuagcacuccuggcugccauucugcccauagaaaacggaacaggagccagacccauaaagcaggacuuccaggcaccuaaagcccuuuccacuucagagacauacuaaaaguccaacacacucuuaaaaauaagaaucucccacauacaaugguaucccauagguggaacaaacuugccucugguugaaguuaucaagaaagauaggacaugggaggaacugagggcaaagaaaaagaacagaaaaagggagaaauaaaggaagacacagagagucaggagggagccaggagagagggaggugacuccgagggcugugguaauuuggcuuugcuguaaaaaucuccacccagacccucgucuuaucgcuuuccacuguuuaaucuucuaaaaaauuccuauguucugauccacaaucuuucucccuuuagggccaaggaugccucugggaaucuggcggcaguccugaacucccucccagaaaaguacacuuauccacuucucgaaauuucaggagcucuuggacucgaaugcuaggagcuaggaucaccacugucauugggaaacucauaagagccccaauaaaaguguuaaaaugaaacuaaaucagauuaaacuaagggugggagaggugaugugguggugcacgcuggaaugucagcgcuugcgaggcugggguagggggaucucuacaaguucaaagcuggucuggucuacagagcaaaucucagaauaguaaggucauaucucuguucccuaccuucugaaaggggggaugggauguggcuuuagggagaacacuggcugcacuugagaguauuuggggcccaagcacuucucccuagggaagaccuuaccaggcaaacuagaagcaagacccagggccacucaugugcacggauuguuauuaugcaguaaaaggccugccuuugacacaggcagcacuacccaccuguucagacucggaauucucucuuuacagguucguggaauuguuaaauaacaauaguuccaaaaucgaacugugcuuaagaaucaccaguauguuuguguaaaaugcagauuucaacucaaauuuugagucuauuccagugagucuucgggugauuggaugcaggcauucugcagacccaacggagacgcacuguccuugcagaaauucagaauaaaccuugggaggcugggccaguuagcggauuccugcugccccuaauggggcaggacuaggcaugugugccaugguacauaagacuagcuuuggcuccugcaucuagaagguuccuugcagggaaaaagguggagugccacagggacuuuuaaggcgacacuucucagaucugguuguacacaaaggacaacgauauaggcgugaaaauggcauaaggaaccugcuacuuuguaugcucauaggaaauuuaaaaaacaacaacaacaacaacaacaaagauucaccaggaauacuucucauaauccaaauuucuaggucaaaggcucuuagggaaucuacacagacacauacagacaugaacaugcacauacagacaaacacauacacacacacauaugcgugcacacacacauuugacuauugauucugacacugaggcagguuucaggacuugcagagcuugguggcucacacccagaaacccagcacuuggaaggcugaguuauagcuucaaauucgaggccagccuagacuguauaacaaguagaagaccagccuaggcuacaaaguaagaccuaguaccaaaaaagcaggaugugggggugggaagagccuuguauuguuaugauauccauaugcccaauggcauuugaucaagauaccagguuuauucuaaggaugccuugagaaauucaaaauguucuuggaauucaacgaaacucagcggacauugcuagagugucuuaucugucugcugacugugaggguugaaagccugggucucccacuaggacacguucugccccuaagcuauacuucugcacugucuucuuucuuuucucugaagagacugaggacugagacucugagggucacugagacugugaggccucuuaucucacugucccuuccuuguccuaagcaagugcccugccucugaacuacaugcccggccagguaugaguaucguuaacauucugauucacugaaaugugaaugaauguuuuacaaugaacacacuuuguauugauagguuuuuuuccaccagaaaaauuuugaacguaguaaaacugacagcggucuagacuugaggaaauaaagucuaucgcauccauugaucucugagugcuccgggaggcagggacucucaauuucuguuucccagacacggaagcugcugugcagacaggugauuuccccaaggucacagagugaggaaauggcagagcugggacaaagucugggucccauggcuuccucccugaugcagugugggcagauuugcucguagacugugggacgucugcucugugacgucacuuccacucugcaucucugcagcuucccucugguuucaagaaggaacugggggaugggggauacaugguggguuuuucuggaugcuggugguuuugguuauaacuaguaucuccucauuacuuuaggaacugggucacacuccucauacaacagcuaacuggacuuacagugcucacuccaacaucuacugauguagaauaaaucugcuauuuacuuuggguagucuuaauuccuugcagccagaucaccuuggaaaaucuagguuucuagcagguuuaagaugagccaguaggggccuaacaggagaaacaggugugguauugcacaucuggaaucccagcccucacggggcuuggagccaggcugggcuauaaagccagauuaugucucuuuuuuuguuuuguuuuguuuuguuugcuugcuuuuaguuucucuuucuggcguuuuauugguuuuguuugauuguuuguucaaagcacggucuugcuauauauagcccagguuagccuugaauaaaggauaauuccccugccucagcagggacuaaagcugugagccacccaccauaccuagcuccuugcuucacuuuuuucuuaaagaaagaaauuaacugaagaauuucucauugaaaucauaaagcuaaauaaugaaggcuggcuagccaaagggaacgaggacucugcuuggcuucaccucccuagcacgggguucauaagcagguacccccacagccagcuuuuuguuuguuuguuuguuuucgagacaggguuucucuguguagcccuggcuguccuggaacucacuuuguagaucaggcuggccucgaacucagaaauccgccugccucugccucccugcugggauaaaaggcgugugccaccacgcccggcuuuuaaaguccccaagucuggggcuugaacaaauauccucaagcuugcaaggaaagcucuuuggagccaucccccagcccugaaaaggcauuugcaauacaauauuccauuaguuauuuuauaguucugucaguaauagcacaggaagaaggugcuccucagcuaggaacuaggugaauuuguugcuuaagcagaacagggaccaggcuagggugauagcucagcguagagugcuuagugggagguccuaaacucaugccuaguucucaaaggaaaaaaagaaaucugacuccacagcuuauccucaaaaucugaaauucaagaccugcccuuagcaagcauuggaaggagggagaagcaggaggaucaagaguuuuggagccaguugggcaugguggcacaugccuuuaacuccagaacucaugaggcagaaauagcggaucucagcgaguuugacaccagucuauagugaguuucaggucagcaggggcuauggaaacaaaccaaacaaacaaaaaacaaagcaaaacaaacacaaaaaaacuaaaaacauacaaauaaaaaaaaaacaaaaacaaggaaagaacagaaaauuggggccagccugggcuacauaauaagaucccguuuucuuuuucuuuuuucuuuucuuucuuauaaaagacaacauuuaauugggggugguuuacaaguucagagguucaauccauuaccaucaaggugggagcauggcagcuuucaggcagacaugauacaggaggagcugagagcucuacaucuugaucugaaggcugcuagugaaagacugauucccagccaucuaggguaagggucuuaagcuuaugcccacagugacacaccuacuccaacaaggccaccucuccuaauagggccacucccugcacuaagcauauacaaaccaucacauuccacucccuggcucucauagacuuguucaaacauaugagccuauggggaccauagcauaaugcaaaauacauuuauuuaguccaacuuccagaguccccauagucucaauaauguuuccaauguuaaaaguccaaaguucuagucucuucugagauccauccaaucacuuaacuguaauccccaaagcaagacaagaaaccaacugggcaaacuuuaaacucugcaucucuaugucugaugucaggcagucucagaucuccaacuccuuuuucaucuuuauugacugcaacaaacuucuuucuccugggcugcuuccacucccuguuaguagcuuuccucagcagauaaccuacggcucugacaucuccaacaucuuggagucuccaaggcaacuucaguguuacagcuuuuuguuucaaugucugggauccacacaugaucucuggucuccuccaaagggcuggcaucacuucuccagcucugcccucuguagcacucuaagcucagguugauccauuccacugccgcugcuguuccuggugaucaucccaugguacuggacaucuccaauacacuugggucuuccacugcaacuaggcuucaccaauagccucucauaggcucucuucauggugccaagucucaaauccuuugcucaguccuggguugucaacugcaacugaggcugcaccuucaccaauggccuuccauggccucucacagugcuaagccucaacuguucuccaugaccucuucaugccuucaaaaccaguaccaccugggugacucuuacacauuaccaaguacagcuacagcaugagguccaacauguaggucuaggcugccucuagaacacagcuucuuugugcucucagaaaacacuucccagaagauuucgccaaagugaugcuggucucuuccugaucacugcuaauuucuuagcuccaacugaccagcaucaauugucccagucguccuuuucuccucuugauauaaaggcagagccaaaugaccaaagcugcugaguucugcugcucauucuauuacacaauuaccagcuuucuguuuuccaacuccuucacugccuaagcuuggcuguccuggaucuagcucuguagauugacuuugaacucaagagaucugcaugucuucugggauuaaagguguguaccaccaugaauggaucuaaauuuagcuggauaggaucuugccccagugucccacucuuuuaaucugccaucuccuagaacacaggauuuagcuccauuucacuuccuggugccccuuuaauacuugaaccauguauuuuauauuuuuccuuucucagcuugcuaugcuuguucaaaaugcucuuccugagacuuaaccagagaacaaagucucugcugaguuuuucugagacuuccuuuaccaaugcaaucaucauaagucucuuuaccuuagccucagguaaacucuucagacaauggcauaaaguagccacauucuguugcaggaaacacggaaaagggcaccauccccacuagcgccagcuacucucuggcccccggcaaccucgcugccucuguggcuagccccaugcagcgacugcccucgagguuuuauugcugcagauucugcucacauucccaaccccaguaaaaucgaaacucuggaggcucguaauuuauaaaucagauuuauauuaguaaacucucggcccacaaaacacccgcacaaugaacucaaaacucaauugauauaaacacaauguacacaccuagauggggcagacguacccuaauuauuauuuaauaaacuagcuaagaaauccccaauaguuauggcucccaggacugugugguucucuccuauagauuccaucuuaucucuuccucuucuucccuuccaagaucccguuuucaacaguugcucccacagccauuccuuauaagcagaaagaugcaauaauuacuguuucaaauuuuucuuuaaagcugggcugcuuggaaugucugacaaugguucugugagauucugaugugucagaugaugcagacgucugacagauuugaaaacauuaaccaucaggcaacagugcacucacauaugcauacuauccacaccaaauauuuaagugauagaauuugucagagacaagggaaauuucccuucucaucucuagacucuggaggagacugccauuugggcugaagaucugggagacagacauuauuuucucaugcaaagccuggccacauacaagaauaaugcaggcucccaggccaggcagaguccccagcugucuauuugugcugcuggucuagccugugacugugcugcagcccagagacuagggagccugcaggauguaugaugggagaaguugccuauguguaggcccagcaccuuggaaagcuugucaaugaauuccucuaagcgugagcaggcauggcggagcuggcuagaauuugcugggaaagagaaacacucuaguucacuuucugacucuguucugcugcuuuccgucucuacaguguccaagcggggcaggccacgugugcuugugacuagacaggucucugguugggaauugcaugugugccuacccacaagcaagucacauuggaaaacccaaauauucauagcacgaucuuggaaccuuuuaaaaguuauuauuuuggaucauaaacuaacaagagaaacaucauuuaaggucuccagguaaaaauaaacuuugucgcgggugcuugcagguauauaugccccugauggugauaaugggcacacugggaaauagagcuggguguagagacacacaccuugaauuccaguacucgggaggggugcagaggcaggcagaucucugaguuccaggccagccuggucuacagagcaaguucuaggacagcugggguguugggagacccugucuggagaaaccaaccaaccaaccaaccaaccaaccaaccaaccaaccugggaaauaggauggggagggaagagauggggaaacuaaauagguauuuagaacuaagagaaagaucucacccucccccccauacgcacacucgcucucgcgcgcacacacacacacacacacacacacacacacaaaugauuucuaaaccucuccuggccuguucccaugcagccccacagucccagcugugacuuguccaaccugccucaggaugguuccugaguuuuauuccaccccagccugcccaugcaagguuucuaaagagcaacucccaauuuaaccacuucccuacauaaaaggaaaccuacugaccuucugcuuagcuuuuaugauuuauuuuuguucccuuuuuugcccccuagccagaaagacccagaaauucccagagacuccacagggugccucugcuguguuacagacugacugagaccacuauauacugccgguugucuuuaaucuugaacguaacacgcacuaagaugaacucaauuauguuuccaagaggcggcggcuaugauggaagagccuuucuaccucauauuuuaaauggagcaugugagguggcucagggguaaaggcauuagccacuaagccugcugacccuaaucccuggaacauacaggguggaaggagagaaccaacuccccacgggguugaccucugaccuccacauguguacugugguacacacccacccacacaagccaccuacauaaauaaauauaaaaccaauuuaaauaaaauaagugugcaccguucagaauauaaaauuguaguuuauguucaauauuuaaugaauacaaacaugaaauuaaaaacaaaacagaacaugugggccuaacgagacuaauucucuuuauuucuccaaguagcaagguuuuugguugauuuuuuuuccauuucuucugcauaugaggggaauauguguugcuuugagaaacaaaaaacaaaaaaacaaaaaacuuuguuucuuuuuuuuuucaaguugccuaguuaguuuugccuggacuggcugacccuugaccugucuguucugucccacaugaucaaggagaucuuugaugcucuccgugcuuggaaugucucuugaggacaaaggccaugagaauuuguuucugcuucaacaucucccuaugcccuauugcucacuccccuggacacagucucccaacagaguggggcacgcggagccuggucccaagggagcccacuggauaagagaguucccaugaggcccuguccugauggaucccacuuugggaggaaagggagaaaguccuuagcugaggcacuaaaggacagcagguaucagccguggcugugagccaagaggcagacgcuaacccuuuaugauucauguugguucuucugcagcagccuaccgagaaaaaacacucucuuauguuuucuacacuguuauccugaauggcaucuagaggccucugaaaccauuuauuuacagaguuuuauuaagauuucuacaaauggcccccagaaaucagggcauaucccaagugguggugaccauccugaauaugagacuuuggaguuugccagagaacauagcgcgcucucugaaaagaagaguuuuauuaucgccccaucacacaacacaacacacaacacacacacacacacacacacacacacacagaggggagaggggagagagggagagagggagagagggagagagggagagagggagagagggagagggggagagagggagagagggagagagggagagggggagagagggagagagggagagagggagagagggagagggggagagagggagagagggagagagggagagggggagagagggagagagggagagagggagagggggagagagggagagggggagaaggagagagggagagagggagagggggagaaggagagagggagagggggagagagggggagagggagaggggggagaaggagagagggagagagggagagagagagagagagagagagagagagagagagagagagagagagagagagagagagagagagagagagaauacucucucuauggucuaugauacaaacuacaaacguucuagaacccugggaagccacagggccuacuuagcugcccugucuagucaagggaagccacuaucaggagacugugacucuucaugagcuggcgacacccucacuuccuucgagaccucugucacuccucauccuacaccagagccuaagcaccacauaucuaacuucccgcucuucgggaauuuuccaugcacuuucucacuccuggcucuucaccuacacgguucccuugcucuagggucacucucugaagaucacugucagguggcacacuuucucuuagauccacgucauagccucagcucaaggucauugcgcaacgcucccggaacauggagacucuccuuuaugguccuuacccaggaugugacgcgguucaguuaagagagacagggccuuauccuuuguguaucuuaaauguugagcauuucauuugcacauagugaaacucaggcaaaaguguuuuggucaacggagccaguggaagagaaagaaacagaggcaggcuucagaggacacugaagacagagauaaaugggaccaaggaaggacaagaagaaauaaaggaaccaggaaggaaugucaguuauagacaagccugaaaaaugcaucaugacaaauauuuucagggagaaaaauaagugcauuuuccuauuuaagucuaaauucucauuuccuuugcuuuguagggaauagcugggauauuugagaaagggucucaagggauagccugggcuaauccuaacucugaucuuucacagaaucccuaggugcugggacuacagacacuacugccacaccugguccuaccaaggacaccacuucucugccuguuuucagucccagcuugcccugacuguaacugggaauauagcacaaugauugcgggaugcucccuggacaacaugagcuucucgcuugauaccauuuccaggcacugggaccgugaagucacuguucuucccagagcaacgccugacacuuguuuuuccauagccuacacauacuccacgguguguuugaccugggcucucacacucaccuuggaaguuguucacaaagccaauucacaccuucugaaugcugugacugaggaccaacccagaaagccaccucucuaaggacagugaggguucucgacuguuuauuuuggcacugucaaaaaucccacaccagcagccaauucuucuacagugcuaucccccaaugacuuugaagaagguucugaaagcuuuauuuauaguguuauuuggguuuccacagaugcugacccccaaaugugggcauagcccacaugauggugacugucccaaacgcaagacuuuggggaucacuaaaaagagagcacacuuuucagaaagccgaaccaauaugcauccccgcccauggaaaaaugauacuuuaugaaggcaaguaaaugaaaagaaguauuuuuaaaauauggucagugggggcuggugagauggcucagcagguaagaacacugacuguucuuccaaagguccuugaguucaaaucccagcaaccacaugguggcucacaaccacccguaaugagaucugacacccucuucuggugccugaagacagcuacaguguacuuauguauaauaauaaauaaaucuuuaaaaaaaaaaaaaagcagacaugugagagcuggugcuaacugaagggccagccagccaccggugacgcugaggcccaacacaauccacccaccacaccauggaggaccuugcaucugacgcacuucgacagacucugauggaugucugagagauaacaggucauaggcaaaaagaccuggagaaaaugcugcuguuaucaggcaauugguacaacccaacagaaccacaaauuuggaggcugcucucugagggaaggccuauuuacuauauaaaguagaacucacccaggccccagguguuguggguaagagcuuacuuagguuauuugaguguccucuguucucucaaaugguaaaguguuuauggaucacugccucaacuuucccaucuacaaaaugggaauaaucacgagacacgcuuaguggauaauaauuaaguaaacagguacaaguaaaacaauaaauaaauaaacaaauaaauaaauaaagcaagccuaugugguaguugauaaaagauggcuguugucaugcucacacuucagauauguaaugaucacacaagagccauuuuuucugaaaguuuuuuucauccaaagggccuggcugugcucagucugccugcagaaugugucagacccuuuccuauacugucuagcuagcuuuccuauacugucuagcuagcugaaggguuuggaugaagccagagucaucugugacaacgugucuaugucuuucacaaccaggacuaaggcacgggucccuaacagccauaggcugagcuuggugguaggcuggggaccaguccugcugccuuccucacaagccagcaucacaaggggucuugagaagaggagagaggaacacacagacaugagccaucgcucccccaaaacacacaagauggacacaagacgaggaugugggagaagcgucccaauggcaaccgugugacccagcaagugucccccagcucuucacucaaggcucagaugcugggggucuaugguggugugcccuuagacccaaagcccaguggcucuccaccuuccuaacgcugcaccccuuuaauauaguuccucauguuguggugacccccaaccauaaaauuauuuuuguugcuacuucauaacuguaauuuugcuacuguuaugaaucauaauauaaauauuugugcuuucuaacgguuuuaggugacccccugugaaagaggucuuucaacccccaccuucacccaaggggucaugacccacagguugagaaccacugccauagaacuccgcagaggaaaagaggucagccagggggugcugaguuacucagaacacagcgccucguccaagucuaacucuggggcuagugcuggcuggcuuguguuucccaucuccuugccuaggcaggaccuguaacaauguuaucacuuuuuaaaaccuaugcccaaacuccguuccuauuccagacaauuggcagguacccaguuaauagauuauuucuccagacagcugaaugcauuggccauuggucaaaagugagaucacugcgauccuaugugcuauaacuggaggagugugaugagaaacaacuggcuagcggcauuugacauucccuucccacaauccuucaucugccuugccuggugucugguucugagcaaaggagggucuguuuaagucagaccaguuuuguucuuuggccccucggguugaugcuggacugccuauucauaacauacauccacagauccccagccagacuccagcugaucuaugggagugucuggccaacaucccugcuccguugacuuccucucagcauccccagaucccucgccuuccuuucagaccuacacaguuggaaagaauaaggcaggagacucccuguccccguugucuagauucugguuugauuuacuuacauacggauauggguauuaugacacaugggaaagggggagaaggaacggaagaagggagggaggagggggagauaguauuguuauccaaggcugugacaguacacagauacaguacugaccugggauagguaggauauacaguccgauuucccagugacccaucccccccucuccacucuuucaucaaauaugcagcgccuccuuaagcgccaccacuccuuacauacaagaaaauccaggaggaagacauucaaagccacggcuucucucagcuguaacccuucuuccuuccuucugcccaagaaggucugacugaacuuguaaccggucuccacccagggccgggcccucugugaaggcauugugaaaucccuugccagcugagccugugcagacagaauaccugagagccacugccaaaacaggaagguuggcgccucucuggggggagccuggggaggaucagccacccaggucugcagacaaggggccaaggguggccgggaccuuuccccagggcucuccacauucugauuccuucauuugcccaauuaacagagucucaaacccugccugaggccuuagcccggugcugggugacacagacgugacaguaucuaucccuaucccccagagcauucacguuguugugacaagccaccuaagggacaauuccagcaacugggacucuucugaagccucagucccacuaugacaucccagccgugugccucagaucacugucaaagcaaaugaggguucugaagagagggaccagguaagggcauccaggcaggcccaacuucaucucucccugagcauccaugagcuuccagauucugucccagugucuauaacaagaacuugucacacuagcccuccguggugaauggcaucugcugagauccaauauaaaugaaugaccacacuccucaagucuaaaucauccgcaaugccugcuuccaagucacccaaaugcugcucauuaccuuuguccacaggggucacaggggucacaucuucggcuaaacacacuaacauauauauuuagugguaaaaggguaccaagaggauuuaggacagcaauaggaaugaaugaucugggcuaggccaaaaacucccauacacugguucauuucaaggauccaaucaugaagauagaaggaaagagagaagggaaggaaaccagaaagggaggcaagucaaguauggggagagauaaaagagaaacagaagauaggauaaugaugaugaugaugaugauaauaauaauaauaauaauaauaauaauaauaaaaacaucuuggugguacaccuuuaaucccagcacucagaggcagaagcagaggcagguagaucucugaguacaaaguuagccugaucuacauaguguuaauccagacccagcuagaguuacacaaugagaugcugucucaaaaauaaaggcuauucaccaugccccuucuaccgcggccucagaucccgcaggcuugcuacccugacccagcugugcuccuugcccacucucagcuggcaucuuugucagggaacuaugcuaaggaauggcagaaaugcucacccacgcugaggugggacugcccucgggcucaaugcagaggaccaguguggagccaccugcuguaucaccccgccuuccaggaagaaggcagcugcuggagaacccaggggugagaggcaggcuacguggggagugaccucgguggccugacaauaaaccugccggacuuuggaccugaaucuagcacuuguuggcugagcuuguccgagaucucaguuccuaguggcacugggagagcaugucuuugucaccacccugccugguguuguucacaggcuucuauuucaucucuuguuuaccccucuaggggcuuggcucugaccaucugacccccacaagagaaggcuggcugagaacucaggcucucagacccucuugaucugaaagaauggaagcaguauagagacccuaccucuaccugauggcacauggcgccucugaggucauacuagccaagccacuuacuacacaaucuaggaaaauuggaccagcucuuuggagucuccacucccuugucuauaaagugggcauuguuaccucacggcccccacuagguguuucaagggugacuaggauaauacauauagagugucccucuccccgguuccucaaauacguacauauguacacacacacacagcaaagaucugugaguucaagccuuggcugagcaccagucaagugagagguuuggaacaaagaugggcgcuaugcucucagcacacuccagaccaauggguuaggggacuuucuauccccagguuucugggagcagaacacugggacccauagucuuugucccacacuacaccucacugcccaucucugaagaaggccaugcggaagccuguaggagcagaggacaccgggcagggauccccaaccccaugcaguuugaaaauacagguggacagaggucuagcauugaaccagagcuuaggguguucccugcuucccucggacucugccagcacugcuaggggcaggcagggccauggggaccaaggcuggaaugaaagucaggcccucauugaaauaguucucugccuacucccagacuuugccucucucugcuggaccagcugggagcuagcugcacagcggcgcucucagaaccaacguccccucucccggcugcuguuucggcaucucucaaguaacccugcccagcccuguccagugucacuugagagugugugcaugacaguccuuggugaacaaaaacauaaacaccagcucuggagaagcaauccacacacaggaguggguguuuccuccuaggacuguggaagggagaagggcugagugagcugcccuggggcgagguauccugcccagaggucccgagagaacacagacugcaacuccacacagaggccacggagggcacugcaaggccggcccuccaggcaggccuugccccacagccuggaaaccacuuggagacaaagccugcagcguugguguccaccacaaggggcaggagcugguugggaagguaaugccacagugguaaccuggccccuguucccguuccaggacugaagcagggugcuaaaaauggggugcaagacaggggucucacaguaagggcauggaggccucccuuauggcggcuacagacuagccgaccgcuccugcagggacaaaaaaggccaugcagucuggcuaccuuuccucgugggcucucuccaugcaaauauguacugccugucucuguaagccagugcugagcaauucugaaagauccaagccuuguccuucuuagccaccaugugggcugacuucacacuccagaggagcagccagaauguucguguucacccugcuccacaggacagagcucacguauauacuauaaaccuaggcaaaaguccaugccuuagggcauaggccuuacacaggaaccuaagucugauaacucagauuuuugccucucugcuagaccagcaaggggcugaccgcagaagccuggguuccuagaaauuacuccucucuccagacugcugcuucugcgucucugaggugggaagcaacccugcccagcaucugucacagugugguuuugcuaaguggacauauugucaggcuucuuucuaaauagugacacauauagaccagugcucccuguaaucuuggucagagacgcauaacuggucaaagagacugaacugaugacugagugaguccucgguucuaaaugggacagcuaugugaccuccaucccacccucaaggcugagacaccaucucagaugaggcagaaagaauugaaggccccagguguggggaggagcacuguggguggggaggagcacugugaguguggaggagcacuguggguggggaggagcacugugaguguggaggagcacuguggguggggaggagcacugugaguguggaggagcacugugaguguagaggaguacuguggguggggaggagcacugugggcacuguccucuggacaugccacgaucaauacacucgggaacccacagcagcuauggccaccggcagaagaccaggccaacacagucaggagucaccacucaacagaaaguaacaacuggcuucagugggcugccaaagcaauacagaagccagagcggaugugagggugggaggaagaugugucggggaugucucaggguuguuagaaggggucuuggggguggauaugaccaagauauauuacucacacauaagaacuugucagugaagaaaagacaauucuacuuuuaagagauaauuagauuaauccuaacuuuuaaaaguagaaaaauggagauaaugaaugaagggccagaggguguuugacuuuaauuugagaugguguguagaccaugggaacuggcaauauggaagcuggguuggagaacucuagggaggcagaugaagcagggcaacggugaugaugaagaaaucccagaguacucacugacagcagagaacugagcuucgugcuccccugaucaccaacaguagagaacugagcucugugcuccccugaucacugacagcagggaacugaguuccacgcuccccugaccauaugaggacuaggaagaccaagaagagagcaaaggacuuauuucacagaaucaaggaaaaauggcuauuucaaauagguacaugaccaaugugcaaaaugggucauagauaaaaccaggcgugacaagauaugucuuuaagaccagcagcugggugguggagacaggaggaucagaaguuccagaggauccuuggcuauagagugaguucuaguucugccuggacagugagacccugcaaaaaccaaaacccaaaacgaacaaauuagcaaacaggaaucagaguugagcaaagguccuguggcgaccaagagcucaauggaagcucaggaagagccgucucagcugagagcagaagcaggcaagaucgcuggagccuuuccuagcucccaugcugugacucugcccuucaucggccaaauacaagaccccagccucacggagcagcuucugccugcuggauucugccugcuggagaccagccuaucccaggucccgcugacugacucagacaccacgcggagcagugcgccauggucaugugggcuugucacagaagcuuggcaaaugccugcccggauaaccaagggauuauguuuggcgguucacaguuucauuuuaaaaauguagaaacuagcauuaaaauguaccucguguuacuucaucuucuaaaauacauuuucucucuauuugccugacuuucauggcauuaugaucguuuuggcaugagacucgucuuauauacaugaaauaugagugccccccccaaggcauuuuaggggcuuugagacaaauguuugagagugucaugucuacacagucaugcuguucaucuuuguacagucccacacugugucuuagggggaggugugugcuagggaaagacaagacgggaaagaaagagggacccuugcugccagccuacauggcaaauaaccugguggccagggacagagguggugaggaaagucaggacaaagagaauaugacacagagagacauccugagacagagggauauagcacacaaacgucacacacacacacacacacacacacacacacacacacaguuuaaaauuuuuuaaaaauuaaaugacaaacauucaaaccuacuauccaacucuuguaguuaucaauuauuccuggggaucauuggcaaaugauccccagaucccugggaugcccaaaccugcaaaucccacuaaauccugcucuuucccacacacaccuaugaugaaguuuaauuuauaagguaggcccuggaaaagacuaacaacagcgaaacugaauaauugggaaacuuaugaacuguuugucaauuaauuugaucaguuaauucuccaguuuuccauuuaauauuuuuuggugguaaccuaaacugcaaaaauuaaaauuguuuuuaaagaaggguugcuacaagcugggcagugguggcgcacgccuuuaaucccagcacuugggaggcaguggcaggcugauuucugaguuugaggccacccuggucuacagagugaguuccaggacagccaggacuacacagagaaacccugucucgaaaaacaaacaaacaaacaaaggaagcuggguggcugugggguacauaccuguaacuccagcucucaggauuugaggcaggaggaucauaagcucaaggcuagccugauaaaaguuugaguuaaacacuacaaaauaggaaaaaaaugugggugggaggaagacacuauaaaagaaauagcaauaacccccaaauugaagguaacaagcugauagauuuuuguuguuguuguuguuguuguuguuauuguuguuguuguuguuguuguuguuguuuuaggggcuggagagccgacucagugguuaagaguacuggcugcucucccagaggaccuaaguucaguuuucagaacccacauggugacucacaacuaucuguaaccccagcucugggggaaucugucgcccuuuccgguauucuaugggcacccacguacauguucacagauacacgcauaugcauaauuuacaauuuccuuaaucagaacagcacaaauaccugagacuguggggugcgaggcagagaagcaaaauguugucacaauucuauuccaaaguauuuucaacuuaggauuugugauccaaugucaaucacugcugaaggggaccuacauuuucugggacuuacaggauaggguccaggaccuagacaaagagguagaguccagcauaccagcugggacccagcagagaucaccucuccaggaaaagcaaggcugaagagacaggcuccaugaggggagcccugggacagcaccagcagcaucuggaagcucugcagagcauuuucuacguggaacuggccacagaaaauaaagcaaaucaaaggugaugcuguguuggggugagugguacccccaaagguauguuuucacccuagaucuaagaaccuacaaaugugaucucgcgugggaaaaggggcuuuacagacagaccuaaggaucuccacaggaggucagccuggauuaucaggcuggcucuauuuguagagaugagguuauuuuguuaaaauacugacuacacaguaaaaagacaacagggccaugugagagagagagaggcggagacuagagugaccaggcacaccuaagggacaacugugcucccgggagcuggaggaggguuaggaaaaagucucuucuagggauuuauugggacagugaccccaagacacuuuugauucagacgucuggucuucagaacuacaugaggauaaacuucuguuaucucugugguuauagcaguugguuaaggaaggcugaggaccuagcacuugcaguauauuuaauuucaggaaacuauacaaagaaauagaguauauaguuuagaucaaaauggauuuuuuauggauguauuacuccuuuauauauauuuuuaaaggacagaugacaucaggggaaagccucaauaucuguagcaaguguccagcaugaaugaaaaacuaagcugaccgugcucugugucuggcucacugcuaagguagaagaccuuuaggaaccgucagggaaugagagaagcgacucagaaagacaagggaagauuauagacacuccaagggaagagaaauagccgaagcaauaaaaaaacaugaacaaaugacccucaaugguuuacagaaaaaaaaagaaaaacaaacagaaagaaaaggaauacacacuuuauaacauggcagaaauguaaaagauuaugccuaccuaacauucuccaagagauagagaaucucccacuagugugaguucagagcaaucuaaucggaaggcagugugacagaacccagcagaacuuaaagugcacuugaccuuccuccucugaauucccuuugugacucucuccugaagaaacagacccccuuacacgcacaucucagcaagcuguucacaucagccacgucuguaaagguccagaacuggggaaaucuggagcacaguaacagggcuuucaacuccgaguguuucuaaucaguaacaggggccgugaugcauguccauucauaugcacauguaacagcaguuaaugaaagaagaggccacgcauucuacagagaggaaggcuuuggagggagaagagggaaaggggaccccuccuugaugaugauaucauaaucucaaaaaacccgagugacagaaggguguccccgaggugcuucagagcagagcggggaccauagcuaggucagggagaauuuaccugcaucucuacaaagagcagucauguguguguguucaucaugagcacgaaugcacaugugccccaccuucuccugggccacaggagugagagaaugaagcaagggaggggcagguguacucuucuucucaggugucaggggcguucauaagacaacagagauuucuuucccugcuugauuuucucccgacccuccacuccuuccuuccuuuucggagagggcuguagcccuacagcccaggcugaccuugaacucaugccgauccccggucucagcuuccugagacuauaggcauguuuuacaccuuuagaauacagauaaaggggagccauaguauauguuagaucuaaauuuuguugucuuuuuaaauuuuuuuucaaauguuaauuuuuguguguggguguuucaacuguauguauaucugaauguaugucauagugugccugaugcccauagaggccagaagacaugagaguagccaauacuucagccccauguauguauguauguauguauguauguauguauguauguuuguauguauuuuuuaaguaaugcuagucuggagagaugguucaguggcuaugagcacugacugcucuuccauagaggauccagguucggugcccacacggcaguuccgaaccgucuuuaacuccaguuccagggaaucugacucauucccucuuuaggcuuccucagguaccaggcaugcacacaguacauauacauauaugcaggcaacacacacacgaauagauggauggauggauggaugaauaaauaaauauuaaaaaauauaguaaccccagccaacuaaaggaaauguagaacugaaguaauaaagcuacacacaacucaacagacaaucacuguuagccgccaggcauaguuccuuccaguccucuuucaagugucuuuuucccccucgaagagcugaaguuaugccccuguuaaauccauuguaaaaguuuauggucuggcuucagauugggguuuuuaacuacagagaaaacagucugcuugauaaaaaccaaugauguccguugcuaugggaauucuggaaaauaaauuucagcucaaacuacacccugcuaauguaucgaccagaaagaaggagaagcauuuggacucacuuacaagagcagccaagaaagucuccaauggagaaggaaaacacaugagucuagugaaguuugagguggccaacaacacugcccugucagucaacugcggucucuuagcaacugugucaguggaguggggcgggcaucugggagucggggccuggguagauuguuucucccuucauagacaguucagcagccaaaggccugucugucucccucagugugagagucaugacugcaggauggugcgaggccaggaaaaagcacacuuucccuccagcagagaugccccagagagcacacugcagcacuucaggugagccagguccuuggcacuaggaugaguccugaggaccccuucuguaucggagucagcccaucuggaugucaguggggaacaucagagcaugggccauuucuggcauuggaacuaugauauuugaagaaauagcagcaugugucaacucaacucugaccagccuacagccaacagcauuuaaaaggcaagacuggggaugcugcagagauggcucaguaguuaagagcacuugcuguucuuccagaggaccuggguucgauuccccacacccaugucaagcaguucacaaccgucuguaacuccagagccaaggaaucugauaccagcaggcaccuguacaucugugacauauacacaaacaggugcacauauauucucauaaauaaaauuaaaauuuaaagcauauuaaaaaauaaaauuauaauggugugcauagcuuguuuguuuguuuauaaaggcaagacuaggaaggacacagugcagaggugaccccagacagagaaagcagaaagcagacaagcaugcuguaugaaacaggccucuuccuacuccaggaagagcuuggcuacagcaugguaucugguuucaaaccccaacccugccaugcauuugcacaaacauagcuccuuucucugucuguaaaauggguaucaguguucccaucucaaaaggucuggcaggagcuauguaagauaaacuguggcaaauacucagcacagagcccagcuuggcaggaacuugggcacagugacuaucacccccaccagcaucaugggucucucccugggcugaagauuauucuaaacacacguguugguccggucccccucucuuuaaagacuagucucuauuaaacacagaguuccuggagugcacaguauuggguguuuucuacagcauccuggugacagcuauguaugcugaggacaaacaacacaaaucagaaaguggcaaagguacagaccuccaugucacuuagagacacgggauguuggguucacgcugcaaggcuuccaugaaguucaggaaacccugcguuagauuagaccagugguucucaaccuacccaaugcugugaccauuugauauaucuccucaugcugcagugacccccaaccauaaaaucauuuuuguugcuacuucuuaauuguaauuuugcuacuuuuauaaauuauaauguaaauaucuguguuuucugauggucuuaggugaccccugggaaagggucauucaaccccaagaagacacaacccacagguugagaaucacuggaauagccagugauggguucacugaaugguugcaacaccucugaacauagugaugcacaccuuuggucccagugcuugagagacagaggcagguggcucucuuugaguuugaggucagcuugaucuacauacuaaguucugggacagcuagagccacauagugaaugaaacccugucucaauacaguagaauagaauagaauagaauagaauagaauagaauagaauagaauagaauagaguagaguagaguagaguagaguagaguagaguagaguagaguagaguagaguagaggagaauagaggagaagagaagagaagagaagagaagagaagagaagagaagagaagagaagagaagagaagagaagaguagaguagaauagaauagaauagaauagaauagaauagaauagaauagaauagaauagaauagaauagaauagaaaaggauauaccaauuacuuuaucccaaaggauaaaaaccuguaccugggcacuugaucauuuucuaugcuuagauaaggaucacacauuuuuauuuugaaauauaauuuaguauaucgagcaauagauaaucgaacauuucaguagccaucucugugaaaugacaacugucaacauuugucauaguuugcucuguuuuacaagauaaggucucaguauuguguucacaaucuuccugccucagccucacaaauauuuacaggcaggugccaccauguccagaaacauacauugacaucaaguucuuaaaauaaccuggaagguaacaucgaagucuguuuuccucucugucccugcauuucuuucuugcucagggucccagucagugcuauggaguuggucucuguucaccugcuuguacuuuugauuggccgaaguuguguuauuuacauuuauuuuaauagaaaaaaacugaaacagaaucaugggaaauacaugaaguaaaagugugugucuguaugugucugugugaguguaugugucucuguauguauuuuuguguuugugugugaauguggggguugucuguggggggacauuuguguguucaggggugcuugugugaauggaggaucuucuggucccagggagcugcacacaagcugauggacuugcucacaugauuaggaccagcccacccuagucagagguacagccugcaggagagggagguugcccugaaaucacaccuauccauagcuacaaagcacuacacuccaggggcuuaccuggguccaggugggugaaagagcccaccacaaaguccagggucgagacagccagcaggagcagcagcagcagcuggaggcggauaauccacuugacaccugccagguugaugcccagcaaagccagaagcacagcaacugaaauuccacgcacugcccagauguccccaagucccagcagaucugagauggacuccgcaaagccggugauguacauagcaccugcaacacacugccgggcaauccccgguggggagagccagcaacagagaggcaucagcagcagacccgccugcucacggacacacacacacacacacacacacacacacacacgcgcgcgcacgcaccagcacugugggaggagugagcaggugauaccuccacugucugggaggaagcaucaggucuaaccugcucuuccacagggggaccugacuaaggccccauuucacauccacaucuugaacaagagaggaaugagcccuggguugagagcugucagugguaaacagggcauaaugauuaugggauguugggucaggauuuggccuucucugccugcacuauucaagaacuaaauguuuacaagaaaccagugcacacagggcucuguccucagagccaccgaagcacacucccacaaacauuuaaacgccaauacuuuuaacgagagugcauguauagacguaugugggaaugaguguguguauaugugaguguggguguaugcgaguguguaugugugugugaguauguguaugugugaaugagugugugagugcauguauauguguaaauaaguguauguaugugaguguguagguaaguguguuuguguauaugugugugaaugaguauaaaugugugaguguauguguuuguguauauaugugugugaaugagugucuguggaugugugugugaauggauguauguguguauaugacuaugcauaaaugacuguggauaugugaguaugugugugagugagugugaguauauauauauauauauauauauaugugaguguguguuaaugacuauggauaugugaguauguguauguguguguugaguguguauauguauguaagaguguguguaugugugugugaaugagugugugaguguguguaugugugugaguguguguauaugugugaguguguguuaaugacugugguauguauguguauguguguguugagugugugugugugaguguguauauaugugugcauguguguauauaugugaguguguguuaaugauuauggguaugugaguauauguguguuaagugugugugugugagugugugugugaguauguguguaugaaugagugugugaguguguguguguguaugucuaccucuuucuugaaacagggucucucaguggccuagaaugcuaggcugacuaacuuauaguagccccauggauccucucacuuuggccucucuagcauacaccaccaucccuuguuggcacugggucuggggaucaaacucauguccccagccuugcagagcaaacacuuuauugaguaaacugucuucccagcuuguaaaucuggugauuugguuugguuuguaucauuugcuuuugguucuuuaagacagggacuaacacuguagcccagacugauccagaucucacuauauaucccaaauuagcuucaaacucacaguaauccuccugccucagccuucugauugcuggaauuauauacaugaaccacaauucuuggcaguauuuuuuuaauuaguuagcugccaacacuuauguuauccgauggcacacaccucuaauccccguacucagggggcagaagcaggaggcuaacugaaagccaaggccagccuagucuacauaggccacccagcgauauauagcaugagccugucucaagcacauacuuaauauaaaauuuagaacuaaaauaagaaagagugagaggcacaccuuuucaaugugaugugugacaaaggugaccacaggcuacccagguggcaucagagccucauucaucauucucuacuggucgaauuggcaguaaauaucccacacugacuaaaguuacaugcuaacuuagaccgauuucuuccagcuauauagcagauacagaaauaacuccugccugguaagcagacagcccaaaggauuagaauucccaguccuaugagacaguagcuagucugauaucuaacccagcuaaccugucuuucccuuggcucauuaaagugcccaacugugagugucccucuggccucacucagcgcucuggaacaccuuaauggcuacacucauucauacacugugugcuugcuacgugauuaucuuauaauugccuagggucauaauuuugcauuuuuagaaauauuugaaaggcaggcccaaacaaauagugaagagugaugugaacugggucuggugguucacacuguaaugccagcacuuaggagguagaggcaaauugaucucugugaguucaaggucaacauggccuacagagccacacagugagacucuguuuuuaaaaagaaauuuuuuuuaaagugucauguggggccaacaagauggcucaucagguaaagacacuugccaccaaaccuaaugaccaaagcacuuaucaccaagccugaugaccaaggcccuugucauggagccuaaugaccugagugugaguuccaggacucacagguuugaaggagagagucaaguccugcaaguuguucuuugguuuccacaugcacacccacacacauacaugcauacacacaugagcacccacacauauacauguauacacacaugagcauccucacauauacaugcauacacauaugcacacccacacauguacaugcauauauacauacauacccacacacauacgugcauacacacauguauacccacaauauacauaugcacauaugcacauacaauacaugcauacauauaugcacacccucacugauaguaaaugcauacacacacccacacacauauacaugcauacacacacuccacacauucaugcauacacaaaugcacaauaaacaaaccuaauagaauucuaauggcaggagcaaaacuuugcacaaucaucaucgucugucaccuuuccucagcuuggccaccucccugagccccaggcucugcuggucagugcaggccugcccuugccauuauugcagggacaaauacagcucaaguuuauucaaguucuuccuuuuccaugaacucguucuuacccacccccucccagucucucaguaagcguuccacuuacccaaagugcuauaugauuaucgggguccagauucuauuauuguuucaugguuauaaauuugucuccugcagcaagaauacaaauacccuuuaaaaacaaaauauuugggguagaaagccagcucaguggauagagcacaaggaggcccaagugagaaggcuaauaauguucagaacccaagggaaaaagcuggccgggugucaaugcuaguggucaaugcuaauccuagcacuccauuaggaggcacacagagugguggcgcacgccuuuaaucccagcacuugggaggcagaggcaggcaaauuucugaauucgaggccagccuggucuacaaagugaguuccaggacagccagggcuacacagagaaacccugucugauaaaaaaccaaaaacccaaccccccccccccaaaaaaaggaggcacacagagggagcuccaggaauuccuagccagaauuagugaauucagcaagaagcucccagccucaaaaaauaaagaguaauggaaggaaaaaccagugucaagcucaggccuuugcauacaugcaugcacacacgcaccuauacacaggggaacacguaaucacacaggcacacgaaucacaaauacaagcuaaaaaacuuaauguuuguguccugucuucaauaucuuccauuugcaacgcaugaugcacauaugccgacuuucaaagucaaugucugucuguggccuacauuacuacuguaucgucucucucacucuaacucagauaaagcuggcugagcagcccugacaaaaggacacauuugugggacgcccaacuugccagcaaguaagaugccacaacaggauccuucugcacacguuuauugggagagcuugauugcagaggcgaagagaccccaagcccagaacuggugcugcuuauauaggccuaggagaggcgugucucacacccggauugguugugcuuggguuaugcuuaccaccucauuugcaugccuacaucugauugguuaacuugucucucaucugauugguuaauuuugguuaauucucaaaaccucaucuuggcaaaagaacuuuacugccuagguaugugugauggccagugguggccagcgccacucugcaacggcacauguggcuucccacacacauuaucaaccucuugcugcuuaguaaggaaggaggaagucugagucccugugaacacagagaagcauagggacucccaccccacccccaagccaggguucuguagaggaacagaagcaguggaugugugcgcaauuacaaaguggaugucauggguuggcuugcacagucagaggcuagauaguccugugauggucauuuacaagcuggaaaaccagacaaaggcauggcagcuaagucuaagcugaugaggaacaaagaugcagcaccaaucuaaagccaaaggucuggcagcucccaagaggucacuggagugggucugcauugaaaggcugccaaagcugcuguucaugggcggugguguagcacucaugcaccugcugaggaagacuucaucauccccucggacuuccucugaaaucugauccuuggccuaccagacuguggcacccacauccacagcucuuggucccucucauguucccccucauagacacagcaagaagugggcuuuacuuccucuguauccaaccaacuugauagguaagguuaacuaucaaguuagagaugagggcacuugucuaaaagcccagcacuaagaagguagagacaguagggucaugaauucaaggguagcuuggaugacuugacaacauucagauagacuagacgauacagugagguccugagugcagagagggaagagcucacacaccaucagagauuauggcauugccuuuacauuucuaacagguagacacacccaucuccauggaaccagaaugccuggguacauuagggguguaccaucaaaaguaccuugcacccuguugccaagugagcccaucucacuugaaaaguacaaccuguacaugagcccccauaggcaagaaguauauucccuuccagcuacauccggcuugggacagcugacacggggcgggucugagccccaggccuuccuggagcaagccagcuguccuaaggcugagaaguugcucuuccuuggaaagcauuacugaguuucuguaaacauucccagagcucauuaggguugcaaaguguuuucauuaccuucugacauuuauaacaaggggcuuuuucucuuuuuuuaaccguucucaacauggaaaccucugacacucccugccacauaaggugggguggccaccauuauagagggaagaggcuguuuucccaggacagaacauccagcccaggguguuuguuuugaaugaaucugcucaggagaccugguuggaagcuggguguuccuccccuccacacccucugucaggcucaaauccuaaucucggcuauaauaggcagccagugugaauuuugcucacucccacauccaagugaggagcccaaagaggccccucagaugggcacggauggguggaacagggacauaggaggguuucuagcuggccuuggccauagucuggucccauagaguaagugacuaggcaggccucagaacugaggcagugagguuuguauaaaggcguguguguguauauguaugguguguauaggacauagcaagguuuuuuuuuuuaaaguuuuuguuguuucauguggaacuuuuuaucaauuuuauuaauuuuaauuuuagaggauggguacuuugcuugugugcaugucuaugcaccacuugggcaacuggugcccaugcaggccaaaagaguggggagucagauccccugaccacccugugggugcuaggaaucaaaucuaggucuuuugggaaagcagucgguguucuuucuuaacugcugagccuacauggcaagauuuuaaaguccugauucuaaucagacauuagagguuuuaggccuguaauucuagcacuugagaggcugaggcaggaggcucaccaugaguucaaggucagcauaagcuacagagaaaaaaagacacaaaguugaguggguaaggaacaggggugaaucugggaagaguuggggugugaucaaaacacacuggaugaaauucccaaagaacuaauaauaguaguuuuaaaauauagaggcuguagauagcucagugguuaauaguauguauugcacauuacagaggacuccaacaauguauuaacuccaguuccaggaauccaacgcccucuacuggccuccaugggccccgcucucaugugcucaaucccucaccaaaaucaucacauggacaugauuaaacauaaaacaauacccaggcauuggcccacaccuuuaauuccaggacucaggagguggagacagacacaucucuguaaguucaagaccagcauggucuacacagugaguucuaagccaaccagggcuacauagugagacucugucuccaaaaaacauuggguguuugauaugugacaugaacugagaaagaagacuauggagguggaaggccacaggaaggggacagggagguggagcagggagguggaggaguggaagagcugauaaaaacaaaucucauggggaaaagcacacagggcuggagggauggcucuacagcuaagagcacuggcuguucuuccagaggaccugcauucaacucccaccauccacaugccaacucaagccugacuguaacuccaguuccagggcuucugacaucugaaaaaggcacacaugcaggagaaacaccagcgaacauaaaauaaaaauaaauuauauauuuaaaaaaagaagaaacccuaauaauauuucucuauaaagauuaaauaaaaguuguggauaaaccuaucuugauugaccaagaagagaggugaauucaaaugauuugaaguaaggaaugaaagaagugcuacuacugccagacuuaaagaaauaaagaggagaacaggggacaguuaauauauccguacuucagagagucaggauaaaguggauaauuauggagagggacacagccuaccaacauuacacaaaacaggaaaucaggacacuccugugcagggagagaauaugcuaauaaucagaaaauguaaacaagugcaaccaagaaacccaggaccagaugguggcacugauguguucuacuuagcauuuauagaguuaaugcuaacuguuuauacacucuuccaaagacuagaagagaggggaacccccacccccacccccaccaaguaaguccucauagcaguguuaaugccacaccaaaaccagacagaggcaucucauggaagcugcaggccagcaucccugggaaguguaugccaauauccucucagcaaaguuggagcagauggaacccagaaaccaauguaagaaccacaggguaaggccccugacaagagacuccacccaaaggagcuaagacagccaaggacccaucagcaccgacuacagggacugccgacagaggcccaggcccugaaacuucucagccauggccaccugugcugggcaaaccuugugaagaugcuuccugcuagccaguccagcuaacaauagcugagagaccccgcauccucuccucacuuagggugcucagccccugucuucauuugucugcccagagaguauagaaagugagguuguccacaugaccagccugcagccacuguggcuacaggaaggagcagaaagcaucuuccuccccacaacccauaggauggcgaagcaggcuggugaugacuguaagccaucugaaaauggcagucacggggcagcguauguaucaaacuauuuuggaucuuguaaauuuugcauugauuaaacguuuuuccucaugugaaaaucuagcuucaaaaaggcuucaaaaucugaaagucagugggguuuguuguuuguuugcuguuuuuccuguuuuguuuugguuuuuuugagacaggguuucucuguguagcccuggcuguccuggaacucacucuguagaccaggcuggccuugaacucagaaaucugccugcuucugccucccgagugcugggauuaaagauaucccacugcccggcugcucuuuugucuguugugugagagcuuugguuuccuuugguuggguuugguuugguugggcuagguugaguuggguugaguugguuguguuguguugggcuggauuggguuugguuggguuagguugggcugagcugagcugggcugguuuguuuuguuugggcugggcugggcugggcugggcuggguuggguuugguagggguuuucucuuguuuuuuguuugauaugguuuucuuuuuuagagacagggucuuacuauuuugccuggcugaccuaauagucacaacccuccugcuuuaaccucccagaugcuaggauuauaagcauaggucaccacguccagcuucaaaauaugaaaauuguaagcaaugcucaaugugaucaaugcucaaaagguuuuggauuuuuggagcauuauggauuuugaguuuuuaaauuaucauacuuccaaaucuuucuccaauaaaaacaacugccuugccagguggugguggcacacaccuuuaguccuagcacuugggaggcaagaggcaggcagaucucugagcucaaggccagccugguccacaaagugaguuuaaggacagcaagggcuauagacaaacccugucucgaaaaaauaacacaaaaccaaaaagcaacugucuuuuccaagcaaguaaugaagugccucccaugcaccuguccuacucacagcaugcacacccucacauaugcacacacacccauacucgcacacacacccauacucacacacucacacauacucucacauaugcacacacucuuacacacacacacacacacacacacacacacacacacguucagauacucaugcacacccucacacaugcauacacacucacccauccucaaacucacacacacacacacacacacucacacauucaccacacacucaugcccucagcucugugcuguuaaagaguacgauguguuuaugcugauccugugucucugcugccugccuacaauagaacguaacaaaggcccacccaccccccuuuuuuucuuuuuuaauuguuuuucaaccacccacuacccuuuguuucuccauaaaacccucuuugguccaagccauaguuauaaaagcuacuuccuaccauucccauguugucuucgcagcaucaaaucucauccccaugucucagcuaaaugaacucuaguugagccuuggaaguuccccucgccugcugguuuucuaucuggcuuuguccacugcagugugggcuccucauuggauugcagcucagucuaaguauccacacgggggaccuguggccugcuuaaggccaccaaagccauuggaccugccagagccucacugccacaggagagaccucuggcagaggcgcgauguccacccacagugcaaagcugccugccaugcacaccucuccaagaaaagcuguuagacccuggcccuggucacccuaggaagucaagaggcagagaugggaggagacagaagcucuggaguucaggauugguggugcaagcuccagcucagagcccagugugguccucugucaagcggagcccuuguuuucacccaugugccgucuucccccauuccucccccagacaaaugaggaagugaagagagacacuggcaaaugaacagguaagaugucucaccuguccaaauacauagagcagccccacagugccucccaucugcccaccaagcaccgaggagaucauggaguagacaccgccacugcugaucccgccaugcucugcgacaccaaugcccgacagcacggugaugagggccacgaggacgacgaaggacaccaggagcaagcccaggagcacaccuguguuucccugcagcagaaaggggaggaguaucagaguuaggaaaaccaucucucuuagagcuguucgagauggaagcccugggcaccuccauccacuaggugauccacagggcagaggggcacuaugaggggcgaugagaaaagaagcggacaguaccgggagagcugaggcccacccaagguuucagguggaaagcccgcccuucaaacucuuacaacuucauaccacaugucgauaaagugaaggcggcucaagagagucaccagcaggaccaagagaugagcuggcuccacacuuaagagcacuuuuugcucuugcagaugaucaggguacaguucucagcgaccacguaaccaucucuaauuccaguuccaggggauuugaugcccuuuccugaccucucaggcaccagucauacaaaugguacccauuuauguaggcaaacacuccuauacacaaaaguaaaauuaaaaaagagagaaucggggcuggugagauggcucagcagguaagaguaccgacugcucuuccgaagguccugaguucaaaucccagcaaccacaugguggcuuacaaccauccguaacaagaucugacgcccucuucuggagugucugaagacagcuacaguguaaucacauauaauaaauaaauaaaucuugagagagagagagagagagagagagagauuaagagagugagucaccagaagcuugcaaacccaccauacagguaaccuuggccuagcaugaaaggauauguugauauguucucucucauucucucucucucucucuuucucucucucucucucucucucucucucucucucucucucucucucucguccucuuaccuacaccagucuagguguagauagccuagaaagccuuuucuacuuauucuauggauugccaggcuaacuccaaaguggccuugaaaacgacucugucuucaggauuuguuucucugguggcuggcacuggcacccuuccucugagcucuacaguacucgaagccuagugcuuaucuaucuccauacuuccuaagugucuauuugccaaggucagccccaaucuccagcuaaguaucuauuuacagagucucuucccaggucagcccugaucccugcgugugagcucuaagaggggacucguuuucgacuccccuucaugcucacugggcuuacaccccauuggacuuaguccucacuaaauacuuucuggccaaauaaguacaccuuccuggaaguguaugccaacguguacacacaucucagugugaaaagagaaaggaggguguacggcugguugugugucaucuugacacagcuggaguuaucacaaagaaaggagccucccuugaggaaaugccuccauaagauccagcuggaaggcauuuucucaauuagugaucaagggugggagggcccagcccauuauggguggugccauccuugggcuggaaguccugguucuauaagagagcaagcugagcaagccaguaaguaacaucccuccauggucucugcaucagcuccugcuuccugaccugcuugaguuccaguccugacuuccuuuggagaugaacagccauguggaagugugagcuaaauaaacccuuuccucugcaacuugcuucuuggucaugauguuugugcaggaauagaaacccugacuaaaacgaagggggaaaggacacaguauaagccacccacaacacucgcucccugcaagcuuuguaagagugagggcaacggagaaaggacacaguauaagccacccacaacacucgcucccugcaagcuuuguaagagugagggcaacggagaaaggacacaguauaagccacccacaacacucgcucccugcaagcuuuguaagagugagggcaauggagauuccuaaagggaggauccccagagaugugcuaaguguugcagagagagcgaugagagggcagaggcagcuuaaacggaacuggagggugcccugcaagugaugggugcucgagcugcuuugcuggucugggaugggagcaagaucgcaagaagaugguguucucccggcucccagucccagcguuuuacuauguuguucuuacuaaucucugugaguucuuauagacacccaugaggauguuugcauuauuauacuuuuauuagcuguagaucucaaauggaccaauucuggcuuuucucuucccugcaaacuccccuuuccguuauaacacugcuacauaguaggcuuaaaagaaagacccucucuccccuguccccucugaggccacugggagagucagcccagagacccagagagacacacuguucaacugauauuggagugaccuguaagugagaccuggccagcuagaagugcucaggcaguacccauaggcccuccaaggacuccgucuccccagguuuuuauuucagaguacuacagguaucuuuguuaacccuggugagcuccuuggggggauaaaacagaacaggaaugaaacguaggccugaggauguagcucacccauacaucacuugucuaguacaaagcccggguucaaguccaaaaugcaaaaccaacaaagaaagaaaacaaaacaaaauccauagggggagcagggcugcagcaaggcaaagcaaggcauaccaaacaaaugagacggugcagcgguagccacugccagccucacaaaucugugccaaaaaagaggggccucugcacauccgaccuaguauggggacuggagcgaggguagggucccuuaggggacaucugucugcaaagggcucugcaugccaacugugugaucagugugagcagacaggaagccucuccucagccaugccuuccacuccuucacagcucugggcugucuccucaucuauaaaacagagaugauaugugccucacagcugucaggaaauacuaaauuuuagagaauuaaacacauucacugcacuuugaacgccaccugucacguagugcuuacuuguuaugugcuauuuugcgauaaauguuacacuauuauuauuacuuauuauuacacagcucauaaagaccgcgcccuccgaauccgcucaaagccucgccggguucauaaggacagcugugaguucccuuuggagagagaaugccaacagccacguggccacgcagggauacauacgugcaaagcccagcuacugccagauggcaaaggacgcugcugaaguccuggguguggugacgugcuagaugguaguggugagaacaagagggcugcgagaauaaccagagugcccauguggcucccucuacucacccgugacaaagcccuaguccccaggaugcuggcgucuccaggacucacccccuugagcaugacaucugagcauucuaacuacggacuuugcuaauauuacacuuucaaugaaauccuacagaauacauucuucuuuaguuuguacuugaaagcugucugcaugugaauauaaauaucugguuccaagagcagccuugggucuucagaggggaacuguuccuuuaacagcuuauaaacuaugacuccaagcuguuuuagaguuaauauuuucuacucaagagauguuuagauugauuucaauuucauacaacucccuggguguuuugucucauuucuggcauuucauguuuguccuuuucucuccaugaucaaauauucaggugauuccaauggcaaagguaaaaggcagagguuauuuuagggcaaaaggacagacaagcucaagauggcccuugacaccugcguggucucuggcucugugaagugacucacuuuguuuuuuaaaguagguaaaaacauuuuaugucaguccaaguuaucacauuaguugggauuuacauagcaguuuuugauuagacaugcacagagcuucuguuucgacuguguuuuaucaucuacugagccucuuugaauguaccacagaagugcugagacaucauuucagagacuaggacauugaagaacugauggcugccaaggagaggugcucucucuuauucuauccguggucuagacaucauuucagagacuaggacauugaagaacugauggcugccgaggagaggugcucucucuuauucuauccguggucuuagugaaagucugcagccucagaaggagacaaucccccggggaaccacgagguguggccaaggccugccaagugcuacuugggugaucagcggauccucccaugugccuggaggccugaccgacagcugcagcuucaagggaccuugagcacacaggccucagggccacagagcacacaugcaacuucuguaagcuguuagaguuggggcagucugucacacaacaauaaacagcgaauacaacucauaccuucauucuggggagggaacuaauuuuagauaacccuuucuugguuuuguuggugguggugcuugcuugcuugcuugcuugcuugcuugcuuacuugcuuugguuuuucaagacagaguuuuucugugaaguccaggcuguccuggaacucacucuguagaccaggcuggccuugaaaucagagauccaccugccucuaccucccaagugcugggaucaaaggugugugcugccaccacuggcuagauagcccgccauuucuuaaaaaucaaauaaaauuuuguuguuguuguuguuguuuuuucgagacaagaauuaacauagagcuauaucuucuucccuucuacucuuccuuaaccagcccugcaugcagcaaagccccgagagccaggacugacauugauaaccagaauaaaacaacaacaagaucaaagccugaggcuucccaagggggacauucugcauccagacugcaacagaaaugccugcuagugucuccauuucacucaagucuuaccuggcgaugcaugaugcauccgaugugugugcuucccacagcauuggcuauucaaggacaauauucccccugaauggcucucuuccuucaccuagccaacccaacccagccuucaagccucuugcaaacaccucaugcacgcagcuuucccaaacaccuugcaacauccacugcagggcuccacuccuggggaccauaaggcuccugagaucucucagugugagacuggcaccagcagagggacaaaggcugguguuuuacaaucccuuuggcagcauuagcgucugcacacaguaggcgugcgcuaguguuuaauucuuaacuggguggucuucccauucugcucagcuuguucggucuauugaaguucacugugugagaaggcacagaggagagguuuggaagcccugcucuaggauauuuuugcccaaggaggaaaggagggacccuuuguucccugugcuaaagaugaaugaacgaacuauccaucaggaucuaguacaagagagucugcccugggcaaugaaucccgggaggcaggaguuuguaucuccaaccaugcagcccuacaaacaaggccaagaacagugugugagagagcaacuauguauacggggagcugguacuucagagggccacagagugcggugacauacuaggaaguccagaagggucacaaacuagaguaaaaguccccaucugucugauccuugaccuaacucuagucccacccaugaugaccacugacccccauauagucagauccaucccaaggcucacacugggaaccucugaagcccaggcuccccgauuucccauucuaaaagcagugccagcucugcccuguacuuccugcuuugugucagagucugugcuuggggaaucuguucccuaaacuguaguauccaagaagcuucacccugucacaggcccaccagaagcuccagggucaccagcucacucaccaccagccagccgguccucaagaaaaggacaacgccaaaaauguugaucaugcaggaugugaacacaccaucccaggucccaaacagcaccggcucccacaugaacagcuggaucuuccaccagggcuggggcugggccaggaugcccugcaaagaacaucaugaagucagaugugcagccaacaggaggagggaagaggagcaggaaaagagaagagacugaacuuagaaaucaaaacagcaaacgaacaaacagaaaaacaaggauaaaaccuuccaccuugggacugggaagaugguucagcuggucagaguauuugcuacgcagucaugaggacuugaggucaaauccccagcgcucagggaaagcugugugugguugccaugcugaaaccccagccucguggggcugagacagggagaugccgggaacucauugacuagguagcagagccaggacaguuucagcucagagagacucugucuccagugugugcucuccccacuacgcacacacacaccuagaggugaggaaugacucuauaaagggaucccuauuuucucuuaguagcagggguugcugcaucuauaugugaccaggagagagguaguuagaagcaauagcagguuuugccuugguagacuggggccccagcagcucagacaguaucacuggcucccagcaaugcacacucccuucagucuuccagaugagggcagcgccuagcauucgcuccuucugaugaugacuggacacuuuucacuucauuggccuuucccauaccucugucacaagauucuucuguuuaaaagacccaagucauuuguuucucugccugaacccugccugccauggugacucuacgccuccuuucuuuccaagagccuagggucugcaagcaugccucugcugcuuaucucagaaucgacugguucaguggggguuucugauaguuuuucuaauuuaaaaauaauaauaguaucucugaaccccgugcuagcuaguuucuaugucaauuugacacgagaucgagucauuuuggaagagagaaccuccacugagaaaauucaccuaccagauuagccuauaggauauaggcaagccugugggguguuuucuugagugaugaucgauguggaggguccaaaccccuguaggcaggcagcccaggugcuauaagaaagcaggcugagcaggcccuuaggagcaaauaagggaguuacaugccucuucugccucaguuccugcccugacuucccucugugacaaccuguggguggugugaauagaaaagcgccccccuccccccaccccauagacccauguguuugaaugcuuggcccauagggaguaacacaguuaggagauguggaagaagugugucacugugggguggguuuggaggucaccuaugcucaagcucugcccagugugacacccaguuguucccuucugcugcccaaagaucaauauguagaacucucaacuccuucuccagcaucaugucugccuggaugcugccaugcuucccaccauggugauaaugaacuggaccuucgaaccuguaagcuggccccagccucaacuuuguaagaguugcuguggucauggugucucuucagagcaguaaaacccuaacuaagacauacuguaacguggagcugugagaugaaauaaacuguuaacaccucccccaauucuucagucaugguguuuuaucacagcgacagaaaccuaagacaagcccucaaauggaaaccuauuacuaaaaugaccaaaagcuugugcgauacuagaauaacauaacaaagucgguagccgcucauacugggacuugcuuuugcaugggcugaguaauuaaucuaaguuugggcaucaguaaagucccugguacccuaaaaccaugcggcaacaauuaaggacccucagcagaacaggagagaggaaggugcagucccgugcagugucugcagcaggcgagcacacguggccagagcaggcucuagaagcugcauuugaucaacuguguugagucuucacugggaaccagaaggugagagcgccuggcacuucugccuucaccugagucugacuuucuuacugaggggucacuuguucccccuugcagguguguuaaucacucaaggagugucuaacccguguucuuccaaggaugaaggcacagaaguaacuaauuguccuaaaucucuaaccaccuugaauucaagcaacaguagcucuucacagggcuucagaugaaggggauaacccauggugcugaggauacacccuggagugugagugauuaucuuagagccagacugcucugaggauuuucuuucucuguuuaaaccuaaaagucagaucauuguuuccaaagauggccuuggagucauuagacccugagauccuugucucccaaguguauccgacugacuaaauaacuucugcuucucaccguugucucuuuaaccggagcagguagccaagacucgaauugcuggagccugaaauuuugccccuccccccaacucuagguuuauaaaugcaaagauaagugcauuauuuauaaaugcaaagagaaggcagaaaaaagaagcaagaagcaggagaaaaaucuaagaccuguacagggccuguuucugugaugacugaaaagucacaccagugaccucaggcgaagcuagacaacagugcuuaaaacaaaagagcccaaagguuguuccuucucccuagcccacacuaauagaccaugaaagggccuucaagugaguccugcucacuagaggcagugaaggacaggggagagauggagggaggaaggacaggggaggggagggagaggaagggacggaaaaggaauggagggaggaagcacaggacaggggagggauggagggaggacgggcaggaagggauggaguuuggauauugggaggucagggaggaggaacuagcuggaguguuucauagcaccaggagugacuacugucugcaaagauuuguuacacaugcucagagagaggagcuuaaagguuuccagcacaaagaauaacuuguguuugacauggaugugcuaaccaccucuauaugaucauccaucguguaucuaaauaguaucgcauugcaccucauacauauguacauguuuuauguuaaagauuuuuaaauuuggggccagcaguuaacagcugcacaaaccugauggccuggguuugaugccuggauccacaacguaaggagaaacuuguuuccuguaaguugucuuuugaccuucauguguaccauggcaugugccucccccuucucucugucugucucucugucucuguccaucugucuuucucacacacacacacacaaauauaauaaaacuuaauuuugaaagcuauaggagagaagggaagggaaaaggaagagggggagaaaggagugagaaagguaaggaggagggagggagagaugggagcgugggagggaagggaggaggagaaggucucaagaaauaacuagggagucaauuagacuggcgaugcagaaggcccugugagacucuggucagcccugacugcugguucuccgcucugcugacgucuguuuagucauuacugauucuuccgucuuucacaaaccacaaacgcaggagggccucaaagccagugacugacggagcucagagcaaggacucugccacccgagacuguccuugaccuacauuacccagggucaggugaccccaagauuguugacuaggaucccagucucucaaaaugcaggacacagcccaacuuccugucucugcuugugugagccuccugucagggccugucaugggucuguuauuauuauuauuauuauaauuauuauuauuauuagagucaguaauagcaguagcccucagcagugggaagaguuaauagcucugcuucauuccucacagcccugggagacagugccuuaggagacaggccggauggugcugccuaaagcuaagaaaaugccuggcugcccuaagucuuccagcuggggcaccaaugggugcccagacugugggauguguacuuuaccauauaccauacuugcuuaaaggcaauguguucucuccuucccuaaauuuagauccuaaugcucugggucucacuguguccaucuggucuacccugugaaugcgugugugacugugauucaagucugaaggcugugggaagccuccugaccucccacucuagcauaucagccugaagagugcuuuaugucuauuguaggucacuuuuuacccugagaaaggaaacagaacaucuauaaaaugucugggugaccgagccaggacuguguguuucaggauguuggugugaggaaccuuccaggguauugcugggguucuguuuguuuguuuuuaagcaaagugaucaaagacuaucacuaaaguuuauucaccaaagaguggguaggaacuaccuggauuugaccaccauugcaauuccaguguucuuagggagaaagaccucuuaaaaccuagugaaagcaaagauagacagacaaacagcaaaagagacagaugauagaauagagacccuuagcauaaaaugacuguaaguaccacaaaucccccaggugacuuuucagacucugugggagugauacacugucucccaggcaccccacagaagcaccagcaucugcaccuaguccagccucacacacacacacacacacacacacacacacagugccauuguucaggagggugugguccagaccccucaaccagcacagcagcugccugcuuggguauuauaaggggcacagcagccaucugcaacagaagcagacccacagcagggggguggaggggagcgcaaugucagcucucaacucccuagugauuccuccccgugucuggagggggacagaaaaggaugagaaaggaggcuaggaugagaaguguccauguuaaaccaguuccgggcuguuuucaaagugucagggggugcucugaucucagcuguugguaacugccuuuagaacauaguuguccucagcuuaggaccgucaaguccagaaauagaauuucacucagugguucacacagacgugcaggcugaggaaggggaaguggccgaggaugggguccucgugcaggguacacugggaagcagagaugccggcugagcggaaggaacccagugaggagcaaguucugcccuuccaguuugucuuucuguugcuguccaugacuaaaagcagcuuggggaagaaagggugugucucagcuuauagcuuacaauccaucauccggcaggaacugaagcaaaggucacagagggacauuguuuucuggcuuguuuucucuggcuuauucaacuaccuuucauuuauagcccagacccaacugccuagagaugaacagcacacacagugagcugggcccucccacgccaauuaggaauuaagaaaaugcugccuuacagacacaggccugugugauuugggugauuuuucacuugaagaccccucuucccaggcgacucuguucuguacccaaugcugagauaaccaugguuuucaguugagagaacaguucuucucugugaaacagacugucccaccauaagcauggaaguacucuccuuccugcaucagugagcugaguaagacaacaacucugccagaggcagccacaagaaugcaggcccaagacccuuuugcuccuacagcuaccgagaggccaaaucuuuuaaguucagacuccauuuuagagaaccugacuuuuaaguuugaacucaaguaaacuaacuggcugguagcuagcacgaguuuccaaguugcuccccaacaaaacccaagccuaacuccagucucuaggcuaauugccaacaagaccaccaucuccagguuauuaccccaacagaucugcacccccaggccuaacaaccaccaaugcagaggggagcagaaguugaguuuauguuaugacucccagcaccagccaauuauguuaaaggccacagcagcuuuccaauuagacacuuacacacuuacacacccccccuugcugcuuacuauaaagccuugccccaauaaaaaaagcuacccccacccccaccaaaaccauccugugcuagagggccugagcuagauccaauaaaauaaagacccugcugugaguugcaacagaucagcuccugucuguuuuggcgggaucgcuaacacuucuuggcacuacacuaccugauaagccuuaacaaucacaccugaaccgugagcuaaccccuugucucuucugacaacuggagaaaaagauaaaggucagagguggauugaagcagggcacaccucuuaacaucuccccagagcccuccuacagacacagaguggaucucuacccguuacaucuugugcacaagaaccugccggacuuuuucuuugcagguucccguguuuuccaagagcugacuauuuaauuggccaucagagaauaugccuaagcugcugcugacccaugaugcaguggacugcuuggaggacuuaauucuuuuacccuggagcugaaugcaucauggcuagaucacagcugugacagacagcugggcaccagggugaugcgaccaaggauuuaggggucagaacucaccugggguaccuacaggaaguacacgguuacaccaggggacugugcaaaguucaacucucugaggugaccauugagaaagcuuugcagaagugacguucaacauggguggccuagacaugggguuucugcaaccccacugaugguaaaaaugcaaccuaacccgcaggagaggaccaagaacccgaccggaacaaagucugaucuuucuggaucaggacaaaaauacuugacaaaaacaacuugagggaagagggauuuauguuggcucaugguuucagugggcucagcucaaguuugcugggccccugugcuuguacagagcgucguaguagcugguaugcaugguggaaggaaguugcccacaucauggcugaccagggaaacaggaaauacaggaaagaucaguguaggagauacaguccugcacauccccagugaacuacuuucucacaggcuccacccccuaccuuucacaaccucucaguauugccguuauacuaugggucuauaaaaguguuuuuauaucuuauauuugauuaguuaagaauacucacggucauuucaggaaacgucuucauagacaagcccagaggcagacuuuacuaaccuagacauuucucaaugcagucaaauuaagcaucuuagggcuaauaagaugguucacuagauaaggacacauggugaccuacgaccugauugcucugaccuccccauuguauauacacacacauacacacauucacacauauauucucucucucuccccccucccucccucccucccuccuucccuccuucccuaaacaaacaagcaucucagguuccaauuaagaaaaaagaagagaaaaauuaauucugugaagaacuggaaccuggaacuagaacuaaagguuugaauuuauugauuuuuagugugugugugugugugugugugugugcgugcguguuuggacaacagguaaguacacguguauaugcuuacaaacucaucuuccuucucucucucuaaaaagcaaagacaucccaguagcaaagaccaugccuaggauucaggucuucacuucuagauaccauucuucaggaacuaagguucuucaaaggaaaaaaaaaaaagguaaagaaaguaaggaaaugcuuaaaaaagaaauaaugggagcuggggugaagagagaggagggaaugucagaggacacaggagcuagauugagccaugugugacaugguaucauuaucaaauaugaaaaauacuaauaauuaaauagaagaacagcagaaaaaugaaaauuuggaucuagggcucuguaagugucuuaguuuguauuuguauuccugcacaaacaucaugaccaagaagcaaguuggggaggaaaggguuuauucagcuuacacuuuccacauugcuguuggucaccaaaggaugucaggacuggaacucaagcagaucaggaagcaggagcugauacagaggcuaugaagggaugcuacuugcuggcuugcuuccccuggcuugcucagccugcucucuuauagaaaccaggacuaccaucccagggaaggcaccacccacaaggaggccuccacccuugcucacuaauugagaaaaugccuuacaacuggaucucauggaggcauuuccucaagggaggcuccuuacucuaugaucacuccagcuuguuucaaauugacacaaaaccagccaguacaauugaccccuugucaacuugacacacaaacacaucacuauuaagccucaacccuuacuuucuuauucaucccaaagaucuaaauaauuuuaaaagucccacaguuuuuuguuuuguuuuguuuuuuuuucaaauucuuacauauuaaaauuucaaucccugaaaauauacaaucucuuguuaaucuggauaaagcagaccuguagcagcagaucucuguacgagcaugguuucccugcauucuaacuaucacacauuuguucauuuucauguuacauugcaguuacuuaaaacucuccccuguucuaaauuaauucccaaaguuggaguguagucuuuccccuuaagcuaugcauuaauuaaggcuuucuuuaccacuuacauuguuucacucuccaccucuugcucugcagucaccuugcccuuccccccaccauuugaguaaagaagaugguccauuaauaguggcauguaccgaugucuguguguguagcuucagaguuagauugacaucaccuggcacagauuuaguccugucguuuguuuacacauuggggaaaaauucaguuuaaugaacguuccauguaacugcaugcaguuuucaccaggcuggagauguagaucuuuucuguguaaugacacuucuaguuucuguaaccuagagauccgacuguugcuuucgcaugaugauguuuucucaugacuggaguuugcuuuguuuuaugguaucuguacuccuugcauuuuucaagagcuauuuuguaaacagaugauguauuucuccauugaaaacacaauugaaaaacagcacaaaaauauccaaucucuuaaaauucaaagucuuuuuacaauucaaagucucuuaacugugggcuccacuaaaauacuuucuuacuucaagaggaaaaaauaucagggcaaaguuacaauuaaaagcagaaucauuggacucuaaugguccaaugucuggaauccacucaggaacuucugggcuccuccaaggucuugggucacuucuccagccaugcccuuuguagcacagaccuugucuucuaggcuccagaugccuguacuccacugcugcugcuauucuugguugucaucucauguacuagcaucuccaaaacacugcugucuccugcuguaacuauccucucauaggcucucuucguggugccaauccucaaguccuuugagugacccauucaguccuggaacaucuauugcaacugaggcuguaccgacaccaauggccuucccuggccucucacggagccgagccuuagcugcucugcaugaccccuucaugccuucaaaaccaguaccaccugggugacccuuacacauuaccaaguccagccacagcacaagguacaaccuuagcuaucccuggaacagagccucuuuaugcucucagaaaacacuucccagaagaugucaccucagugaugcuggucucuucuugaucaccaaguuccuugacuggcuucaaguuucugccuugaacuccuguccuagcuuccccugaugaugaacugcacccuguaagcucuuuccaucccaaguucauuuuggucaugguguuuuacauagcaauagaaaacuaaaccaggacacuaggcagggacccuaguucagauccaggcaaccaccuaaaagccaggcaugguagcaugcauccguaacucuagcacuuacagggagaccccaagcuuugcugcccaucgagucuaacugaacuggugagcuccagguucagugagagauuaucucaaaaaauaagaugaagaacaaaaauuagaaacaccugacacugaccucuggccucugugcacauacacacacacacacacaagcacacacaauuuacugaagaccacaaagagucaagaauauuugcuugggcuggagagauggcucagcaguuaagaggacuggcugcuccucugaagguccugaguucgaaucccagcaacuauaugguggcucacagccauccauaaugaaauccgaugcccagagagcuacaguguacuuagauauaaacauaaauaaauaaauaagcauuugcuuauauguaccaauauuuaccauaucaagaacuugagaagccaagcaugguggcucacgccuuuaaucccagcacuugggaggcagaggcaggcaaauuucugaguucaaggucagucuggucuacauccugaguuccaggacagccagggcuacacagagaaacccugucuugaaaaaccaacaacaacaacaacaaaaaaagaacuuaagauguuuaaguauuuauuuauuuuaacguaaccacaaacuuguuucuuaguaagacaaauggcuuuagugaaagaauuauuccgcaacacaaauuauuuucuguugugaaaagaaagacuucauuuuacaaaucuuaauaucuagccugagagcaaaucugacacacacacacacacacacacacacacauauauauauauauauauauacaccuuggauucuaccugcuguaaaaugaugucauuuuugaauuacaagagaagaaacaacagccaaaccugccacuguuaaugucagaaaaggaaagaguaacuuguuacaucugacccauguguggaaaaccuggaucacugagccgaccgacaggagaagccccagagaaaggagacaaaggaucuaagaaacugagacagcuguguacacacagagugaaggaaaacaaaggaaauuaagacuugaggcagcgaaggcaccaggcuggcccuguuuuccucuaggugagcccguggcaccgcuuggcuuuucaguugagcacaugcgcacaaccgcaccacauaaacacuguucaccauuuaaaacguucagagccaaacuauguugaagaagaaagugcuccuuacaguuacaggacuguuguacuccucaacggcguccaccagcuggcaggaaagcagggcggcgggcaggcaggcaggugugccaaggucuuauuuuuuugguaucaggaagcaacaaguaagcugaugguaaauuaauaacccagaaaccaagauaucaguauuuuauuuacagugauaaugauaaccagcagaggaaauagaaaccagaaaguauccggggugucuggcaccugggacgggcaggggaauacaaggagauuuugucuggguggccuggugcauacuucagggcgucuuccugcacacgugaaguguuucaaugacaaaaacacuccuuuuauuuaaagaaaaauuacuacauauuaaaaacauuuuaaaauaaaauaacuaauaaaacugaaaauaacauuuuaaacgaaugagggcuuuuuggugugauuuugcuaagcugaugugagaaauccauuuaucauauucaguggauggagucacaaagcaauguccuccuuucgaaucgcauuuuaaaugcauugcacgagguccuuuguaaagugacugccugcucccaugauuucggcgccuuuaaaaugaauuguaauuugcuauuguuuucuauuauuuauuaaccaauaaccacauaaaaugaaaauaucucacaugagccaagacauuguuuucuuuuaguuaagaaguugguaaauaggggaauucguguuagagcaaggacagaauucuuuccgguuuacggaaggugcuaggccuccguggcucuuggucauucaguaagcacccagcagcuguauagugauguuccacagaaaugagaggguuuaaauuccacuauccccccacccuucuccccccccccuuuguggagaugaaaagcacuccccaaaauaaagaaaauacguauaagacuugcuaugauugggaugcccaacccccaccccauguuccacguucaaacuuuugguucccacauccuggaaugacauggacccuuaaguagugagugcuacccggagguaacauuagggaggagcacacccucuacuggaggguauuuccaggacagauuaacugagggaggaggacccucccccaguguaggaagcaccuuccccugucagccugggugaagaggucugaggaagacacagggcauguuugcuuuccugccacugcuucuugcugcgagucuaccuauccuguuguuacucccagcaugcuuagcugucaucagaacaauguggacugaagaucaaugacucuccagaaagccuuaggucagcgguucacuagggguugaaacccuuuuggggaugcauaucagauaucccgcauaucagauauuuacauuaugauucauaacuagcaaaauuacaguuaugaaguagcaauggaauuauuuuaugguugggggucagcacgacaugaggaacuguauugaaggguugcagcauuagaaagguugagaaccgcugcucuaggcuuuuacccccagagacauguagcagcuaccagguucucagacucucaugcuggacuauccagccugcaccauguaagccaguucuauaaaugcucaccugcaguguauccagucaagauguuacuccaaagaagcuugccuacccacacacacuugucucucccucugccgcccucucuucccccuuucucgcccuccucugacccuucuugcucucucuacuuuacaugauccccaccaccaccaccauaauccaugccuuuagcaggacuaagcugauaugggcuuugaaucuauuaaauaaacccgcucccuuuauaaguuacuuggcucagcuauuuccuuguagcaacaugccgcugacuaacacgggaucuuucucccgagagcugguaacacuaagucacugucccucagaagugcauuguaggcuguuuguauaaaacaauccuauaccaccaucacuaccacagugcaccgucugaauaaggcauuaaagcucgagaugaaaaaauuucuuaaaauugauuuguaaauagauuuaauauacuugacugacaaauuauugaugagcaaaugaagauacucccaggagcuggaguuucacauccuaugaguugcuaguggauacaggaaccaaacgccucuguaagagcaacauaagcucuuaccucuuccaucuucucagcuccccauccccacuucucccccuccccugcauugucuaggguaccauuucuugccugggcuguuccuacccuccuaacaucuuucuccuuuguugugacguaguucuuucuauagcacugaccugugcauuugacaucuuggccgagagccuugaaggagauucucuuagucacuuuccaguuuaaacuuucuaucuuggccuucggaucuacugagauaugaccaaucuacaguuccaguuguaccugggucuuuccacuugcccuguaaugugaccguuucugucuucuuuccuugggguggggaguggggcagaagcauucucaagucuugauagcaugcuuggaguaugggcgauguucagccaugcugguuguaugucugggauuggauaaacagccauuugccucaggucuugaaguguugguagaaauagagugugugguaaauucgggaaacacaucccagacagauggaaaaaucacaguagccaccagguagugagcacugucuuguucuaaacacuuaacauucguuaucuuuacauucugggauacaguuacuucggggcgacugacaaggacuggaguucuuugagugcagaaauuuccucuuuucugguauaugccuucugcuccaaauuuaugcaaaaugcauaauccauccagaugguaaaucaagggccucuucgggagccagaggggaacagacaguaaaucaaggaucuccaugggagacaaagagcagugagguagcuauuauuuuuaagcuguagugacuagucugcagugaacaucugugaaccuuuuugucaccuuuaccccagcugugguggcaagaaauucugugaagagcuuuggcacauguauaacaugggauuaaguaggcagaguccaguaggaagacaggcuauggaauguuguauaaaacccuucggccuuggccugucucuugagcaccauggggaggaagcagccugugguugugaguuauagagaaauggaugacuaaauucucagguuggcuuuaggcauuuuaguuucaaaugggaguuagguguguguguguguguguguguguguguguguguguguaugugugugugugucuguguaucuaaaaugaacuccccaacaagggguuguagaucuaaguguuacagucugguggucaagguuacacguacagacugggcuuaagugcugacucugcacuuugugaguuugagugagucucuucaccuauccucuauuuucucaccuaugaaauggcuuuaaugacuaagcuuacucuagaggaguaagaaaaauuaaggagacaauucuugaaaaugcuaugauaauacaggacuugguucauaguaagcauucaguaaacauuuaguccacauuuaguccacagggcggccguauacaugaucagaaggaccagcuggcaaaugcacacgugauuuagcacagcaaggucaggcaaaagaaggacaaaggcaggaaugucacaugcagaaugacacccgggaggaagugcuucccagugucugagucauguucuccuccucuuaguucuuuuuuuuuuuccguuuaugaaaagauauaucuugugaggaaaauuacaaaaugaagcuaaaagucacauagccucuccuuaggaagucagaccaugcucuagguaccacccggugggcaccucacuuagagcacaaaauucgugccucagcauccuuaacaucuagacaucuugcaaacgcugaucuaucauauagugacaaagacagcaauuuucuucucugcuucuggucauggaugaaauguagcagagggcaauguaaauguuugaaguaauacaagccauccauucauaagcaggcaaagaccaaauccuacuggcugucuuagagagcaaaagcuuagaugggacuaugucuuucauaagccaaccuaccaauucucagucuagagcugcggccacuaacuccuaacaccaaccuaaaucaucccagggucaguuacuaggaaacuagagaccaacacuuaauccagaguccagaaaaauucuucagaguggcacaccccaaacuguucacucuacccugccuucacguuccugcaauaauccccagcaaaagccuuggucuuagacuccuuccacuccuggcuuuggucaccugacuaaccaggugcauccccuauggucuggcacagaauuuuugaggacucagaaaugaaagcaaagguuuuuuuguuucguuuuauucuguuuuuaauuuuguuuuuaaugacacagacuagcaccaauguguuaacauauaauacuguuacuuggagacuagaucaucccccaacugcauuacaaagucauuaacugacuucagccuaguucugccacuccuugucauauguuuauggagcauuuaccgccugcuggucagcaggcagcacgccuucacuggcaucugugcacacaugaaaaggguuaacauguggcuuggaugccccuaccaccuccggacuuucagcucuagaccuuguucuugaaauauauauucuuucuccugcugaagggcuuacuccccucucuugcagugcaggaacaccucccugccucucacuacaaagcauaaaggaaacccagggggcaaugaaacaccaaggugacugaacacggauggcagagaccccauaagcaccaaggugugggcuuucauuuaagggauuaauccuucaauucuauaucaaccaucgaccacaaauggaauauuuuacacuacacacuacacacacacacacacacacacacacacacacacacacuaauaaccaacaagaaggacuuaauaaaaacaaaaccagcagacaucagggaguccagaaacccccugauuuccguagauuagcuuuucuagaaauaaacuuaccuucugacuuugaucugauuuguuauuaaagggaguucauaucauuugagucucagccuccacucguggcauucuucccaugaugggguggagggcagagagcggaguacauuacagcuaaugccaaaggagacuuucugcacgguuaacugcuguccgagguauucccucaacgccuaaguaaaccugagauaacugcuuugaaaauacugcacugccacagacccccccucugcuggcaccugucugucugauggccucugccagcuccaccaccaccccuguaaccagacuuaccugcugggcugccucguggaagaguucuugcggagaccucugggccauucuccaggaagugagguucugauacuuuuaucuagauagggagaccacucuggaaagcaaacaucacucugucaggccaggcccucccucccucccuugcugcuucuugccuguccagcuuccucugcacugagaaaggucgugggugaaguagaaaccuuguuggccccaucuggggacuccuccccacugcucucuucagaaccucauuuaugguucagagcccgccugaucauuucccguuguccuggggucacaggaacuccuauaguucacucccuacucccugaacuccugaauauuggggaauggucuaggcugacugcucagcugccuagcccuuaaagacauaguccuacacucuuuuccccagugccuugggaacccuuuguucagagcaaggacauuuggggucuugcuggaacccgugucugguggugagugcaggcagaguguacuggaggcagagccagagggcuggcggcugucuugagaggccccuggacccuggccagaauagggcagguaagaaaaagaugucagaaaaguacaguucuggcccaccagaggaguugaucuggcuuuccugaggccagggaccuugccccaugacauuugaaagaaaaaagagagggagggagaagggcugaggcaacuggccgugcuccccauccugcaggagacucguggggagaggaauagggcaagauuccuuugggacacaucacccuaaaaagaucugagggcugcgggaugaggcucugggcaccagagucagguccuugcgaccccagccacucuuccccuccacagagcagugcccgcacccucaccugcuccuacucaggcuccggaggccacgcccgccccacccgguccugccacguggccgcaagcgcuccuggccaccugcccugcaucucgggcgaccccgccccagcguccggacucgagcaucuggacuagagacccaggcccugagcacccccuguccgaagggcg

SEQ ID NO: 8222 - RNA, 1076 nt, Mus musculus
cucugucuuagaggauuuuuauuuuauggaaagaaacccugagagauuagggaaguggcuguuaacagugacuggaucagauaaagaagcgcucagcuauaaacaaaacaaacaaaauaaaaaaugaacgaagccuacagaucccuccgggggaaaucaggcuucgaucuagcuuucagguuugaaaacccaccuccccaaccaggaagcaucuagaacacucaaugaagcccgcggcccgggccggaaaggggggcggaagaggcgggacuucugggugacgucacgggccccaagccccucggcuuccagagcgaacugagcgcgcgagaauggaggucgccagccaagcccugggccccuuggucaccgagcuguaugacgugcaggcuuucaaguucgggagcuucguccugaagagcgggcucuccuccccagucuacaucgaccugcggggcaucgugucacgcccgcgucuucucagucagguaccagccccgagggacgggauggcuccggguggcgggaaaagagagcaggagauggcggggguggccgaaauuggggacaagggagagccacagaccaggcaggcaagcccucccgacugcuggucuggagaguguggaggagcuuggggaccgggagccuucagcuucuuugagaccuuguuucuggaccgaucgguguagacacguguuuugcgagaguccggguguccuguugggcucuggccggcggagaaguccuugagugaguucuguguaccuaacccccagaaagugacaauuagggaggaaaggaaaaggcgggaggguggagaaauuaguagcggaucaaacgacucgauuuaauagugcauggccaguagcaagaagugaaagccauaugguggauaccagaaaggcagaauuuuuugguuggcaaggguaaagugugcacuuagagguuucuagccuguuguuucucaaaccucgugucgguugucugugagucaccgccaagucggccuugaggcagugcuuucuagaauaacaagccuccagccgaacugcaugcagauggcauuuagaaua

SEQ ID NO: 8223 - RNA, 34641 nt, Mus musculus
cugggcguggcaagcuggagcacgcggagucuguugcgcacgcccagggcuccagguuccgacccgaaggaaaaccuuuuagcgccaaggaggcuaugagucccggcgguccgcggccuucuucccggaagcggaagcucagggggcgggacaagggagguccggacaucucggcgguuaauucuuuuuuucucaaguauucguuucccuacgccugggcucuucugaggcugagagaaauggucagguccggaucucgaccgggccaggugagggcugcggaccugaugaguccacugugggguggcgagaggcgagggggauuuaggaaggugcuagaaaaaaaauaguaacugcggcgcgcccgaaguggugaggacgucccuagaugaaugcuuuauucagggcggccgugccagucuuccagagcgcaguuuggugucagaccccggguucgaagcccagccuuuaucaccagugcagugaccuccuucccgcucugugcuuugcaguuguuuccaauauuacguaguuauccagcaauugugccucuacaaagccaguaauuugcccgacuuggucauuuguccgacugccuaauaacaucucuaucagagaaguucuuaggaucuuagcuugaguuaauccucuccccggauucagcuucucggugcuucucuuaacugaucuucugucucuguuguuggagucucccaguaaguggcuguacccgcccuccguucucaaacgcgugacucuugauguucucuaguaacugcuccaaguacgacagggaaacccauuuucaagauacacauuuggcuuggaacagagccauuuuggauccuuugcaguucccgccccauccaaucagguccaauagagcuaaacuaguuuuagcccugcugugcccugggcguucugaccuuucgugcucccacgucuuuucaaauuauggugggccuguuaauucuauuuuccuucuagcccucaugucaagaaccgucucuagaauauuuuuccaacaccaucacaucuccgcuaguugggcgugcuucaggccaccuuccgcaucuugcaaucuuccacaaaucacuucauguuggaccuggugcuagucuacuacuagaauauuucaucucugucuuggagauuuagaaagcacuuggcauauaguagacuugggguuuuacuuuguuucccaccauuuaacaacauaccuauaauguugucuuucuugcuaauguauauuuugcacuccccccucccccccaaaaaaaaaacccugucuugagacuuccuuuuuugaaugguugcauguugucaauaugucuagggaaauaugcuguagucaucaaagaaauggaaguuaaaauauuuucuaucacaaaauaaguauuggugaugguguugagaaauugguacucuuguauaguccuggugagaauauaacuaguauagcuuccucagaaaauaagccgagcacgacagugcacaaguguagcccuaguauuugggaacccgaggcaggaggaucaugagcucaaggccaacuugaauaacagugagauccagucucaaaaaaacccaaaccacuuaaaguagagcuaaggugacccagccagcuucauuacugguacuuauucaaaagagcugaaaucaagauuuuaaagagcuguuugcgauuccuugcauuguugcauucgucgcaacagcuaagacauagaaacaaccuaaauaucucugagugaguggguaaagaaauuacggucacauacaucuaauggaauauuacucagccuuaagggaggucugccguaugcaguagcagugugugugaugugugagacugacuuaguggacucagcuguuccuagaggacagcugcugcuugcuuucccauacgugugucugagguagcccaauucagaagcagagccguggcuauagagagcaugggguugcuacucaauagguauaaguuuuaaguguacgaaaucuaggagucagugagauauauuguaccuguagguaauacuuuauuuuguuaagauagaggagauguuaaauauuuuugugacauucucuauuuaaaaaaaaaagaucuaacaaagcucuggaauuugguuaaaaauguuaaaguauccaacuagaaggagcucccuuccugauugacucugaaacaauuugagcaucauauucuuuuaaaaaagauuuauuuauuuuuaugugcauugguauucugccugcauuucugugcaagggugccagaucgucuggaacugggguuguagacagcugugagcuuagcuucugugugggugcugggauugaacucagguccucuggaagagcagccagugcucuagcugcugagucaucucuccagcccaagcauucaauuuuuuuaaaacaaaaauuuaauaaacauuauuauuaaggaacucauuaagagaaaacaucacaaaugaaaaucacucagauacaaagaacugggucuguagaacucagugaacuuuuguccagguagaguagccauucugaagcuguggugcuccacccuggaugucguacugucacuauugaguguguacuaauguacuucuccauuacaauuagaacaauuaccuuucuauccucuuuugucucucauguucaucaccugcacucacuccuuccucauccccuaauguuuauucuuuugauccucuuuguauaguguauccaccugucuauuuguuuacauaugagcaucacuauuaguaaugagucauagucuuuugacuagaauaggaaucaguguguuuacacuaaucaaucaauaaggaagaaagaaagguccuguucuacuaguugaaagucagcuaauaaaugcagaaggaacuguguagcuacauaaauaugucacaguuugaugaaacauucacuuaaauacgaaccaucaauggauguucagacuacugagagagcguuugaggauagccacauaaugucaggguaucuuauaaaauacuugauuagaaagauaaaguaguauguuuguuuguuuuggagacaggguuucucuguguagcaguccuggaacuugcacuguagaccaggcugacagggaaucagagauuugccugccucuggcuuuccagggcugggacuaaaagugcgcaccaccacugccuggcaaacauaguaaucucaaugaugaaaauccaugcagacaccauuguauaucaccaguaacaggacaaacgaauaucacuugccuacuuguauugagaaugacauaucucuugcuguauuccugcuagaaauaccuaaccugggucagaucaugaggaaacagccgauccaaauauucagagaaccauuaugcagaauaauuagccuuuacuuuucaaguaugucaaagcuauggaauacgacagcccaagaaacuauucagauuaaaggaggaccaugaaccucaacaguuaagugcaccaugugacucuggauugggcauggucuuuguucuuuuucuauaaaggacaaaauugggauuagugcagugugaaucaugucuaucuagauuacagcuuaaugcuaaaguuuucaguuuuuauagcuauacuugggaauuuuguucuuaagaaacauguaggaauauugugaucucuaccuauuuugaaaugauaagacaaaaaaaauguugcucuaucuauuuugagauuauauaugucaagcaagaccuuuuuguuuuaguaugauacuguaaauccuuuguaaaccuguuuguaaagguuucuuuccuauaacauuauuuggggcaaaaauacauaguguuugugugugugcauauccaaauagagaagaguaaauaacaucaggacauuugguaaucacuguauaagacucuugcuaugagauacguaaccaugugaagacuugaaugaggccgccaacacugagggcaccuaggaguggacugaggggaggacuaggagcuuugaugucuuaacauuuucuuuugaguggagauuauauuuaucagauacaguuacuaagauauaaagcacauaugauauaaagcuuuccaauugccccgcucuggaaggcucucuuaucagcuucugcagcuacccguuuuuccugccugaagacaacguucuuguguagcuucuacaacacugggugcauguaaagaugaccuugucuacauaaaagucuuuuuuuuuuuuuuuuuuuuuuugguuuuucgagacaggguuucucuguauagcccuggcuguccuggaacucacucuguagaccaggcuggccucgaacucagaaguccgccugccucugccucccaagugcugggauuaaaggcgugcgccaccacgcccagcgucacaugacuuuuaaaaugcaaacuuaaaauuguuauuggaguuuaaaaagagugagaaacugagauguagauaagaguguucagugucuaguccugcccagccgucuaagaaguuagaagaugaccagaguuaugaggagaguugauuguaaccccugcaugugugcguguggaggucaggggucacuggucuuccucugacacccuucacuucauugucugagacaggcucucucacugaaccuggagcucuccacugcuuuuggcuagacuggcugccguaauccccagcacgaggcucuucacccuccacuccauugcugggguuauagacgggcccucaagccuggcuuuuaugaggaugcugggggucugaacucauuuccucgugcuuuagcugcagucaguguacccgcugagcugacucccugcuuuguguaugcuggacaagcauucucccucugaacugaacugucuucccaacaucucuguagucagauaauuggaaaguagaaaguuguugccagggcaggaagaaggagggaugaaaauuuacugugucacuuuggauguaugaaaaaacacaugaguucuauugcagggaugcagaaugccaaucauuggaacaguaauuacauaucuuguguaauaugucacaggugauaucuucaggaaggcaaccuggagcuaaguuaccaaauggaaagaaagggugaguacuuuuuucuaagcucccaaauucaggaacucugaacuuagauuaagauuaaggcaaauuuuaaggucuuagggcuugaccauauuuugccuaccucaggaaaauaaguggggcugccucaacaaguaguugggugcuaugcagauuauaaaucauuagugauuaagucaaagucaccaauaacacaacagugucacauuaaggaaagaaauguucuuggaguuguguuuaaccaagaaugaguccagucuuaacucucuacucaugcucccugugucuuccuuccggccucucggucuguuuuaugagucugaaucugucugccugaaggcugcccugugaaaucugugugugucuauuccccucucucucugucucucucucucucucucucucucucucucugugugugugugugugugugugugugugugugugugugugugucuguauguguaaauacagagggcuucgcgcugucuuuauugagcagcacuagaagcauccauggggaaggaaugggacccuuuacaggaaucuuuaagaguuuuacaagggauuaugucacuccagcugaccuagacagcaaacacugcuuaucagcaaauauccauaaugguggcuuucaaccuuuacaugauagauuuuaggagucugcuuucaagucuguguuugccaucuuuagcaaaugaugcccgugcauuacucugggucagggacauggcagaauaacuugagguugcagcugugcauuagcugaggcuguaaaaugcgauuaccugggcaaucuaaggcagguggguuuggucguuacagucuucucuugaggcagguuaagcaacaguuugggauagcagaacugggagcgcaguuuuagucuuacgugaccuuaagguguauuauucccuacggcugugaggaccagcaaaaguucagucccuuagaauguaagauguucucagaauaugccaucacuaccuaggucauuccgaccuagucagugcuuggugcuuggugcucuucauaaucuccagugucuuauccacgucacgugcggauagauaagcuuucuuuuccgucuuugcuggaaaggaaaugauguuuacauauuuugaaaaaaaauacuugcaaauauuuugaaagauaucaacuuuguuuucuaggacccacguaagaaaaauagcacauuuuaauguagacuccgccuguccuguucaaucugauucagaaagucagguaaggucaaagugacuggacgcaauacgcuauuuuaauuggaccucagguaaagcuaagaaauggacgacaguggcaaagugaagugugguuugcaccaaggaaguaaauaggcugucgucgcuuuaagacagguuucuacaaugauaaagugcguagaaagagauguauuugaggaggcaugguggacuuuucucucuaagcggcuuucuuccuacagacggacacucuccagggacuugacgguugugcuucuuugcugcgggacauuuugaaaaaugaagauucagguuuucuuuuuuaaaguucuuugcugaucaucuuuuaucaaugagguagcucuuuuucauguuuacagaccuuuccuuuuauuauuaacaggcucagaaaugguauauucggaaaacagaugcaauucuaaaccuuuagaaggcagaaagaacagaucuaaaaagaaagggccugaaaaacauguuccuucagugguccgaaaggaaauauguaaguauuuuuccuauauuuacuaaaagcuaauuguguguguguguguguguguguguguguguguguguauacauuucaggagucaagucaaugccaggugucuuucacuguuuguugagacaucuuuuuacugaaccugaacugaagcucaccaguucugcuagagugguuggccaggacgcuagggucugucugucccugcuucuccagcucugggaauacagacauggaccacugugcugaacuuuuuacaugcauaucggggauuucaaucauaauuauuuuuaaagauuuauuuauauguguauacuguagcugucuucagacacaccagaagagggcaucagaucccauuacagaugguugugagccaccaugcgguugcugggaauugaacucaagaccucuggaagagcagccaaugcucuuaacugcugaaccaucucuccagccccaaaucauaacuauuuuaaaauuaacuuguguguauauauucuaguuaaagaauaaacuuguugaacuauaguuaggauauaggacaaaaaaccugccaaugguugacacugauuguauccaaauguuguaugcuuucaugguuaaccuugcugaaaauuaaguguagugauucaggaaauauuuuaaaacaaguuuugagaauauuaucuuuuaaaggcauauagcauuaaacaguucaaaaugaaguugaaaagucuacacuaugaauuucacuguuaaauuaacauggaauuguacacauuuaugggguacagugugauguuuccacccauguacagugcauagcaaucaaacuagauuacaaugggaauucagaguggaaucagcuaguccuacucuucagaugggccaguacuuaaggcuuaaugucagucaguacuuaaggguaugcauacauuuuacacaagggguaaaguuuaaaaaacaaaacaucuaagacaaucccccuggguauuaagagaucaagaugcaaacagccuagaaaauagagauggaaagacuggccauugucauuccauaugaucacuuguuaagagagugaaggcuagaaaaccagcucccuucauuucuccaucuuggagacuguacuggcuggcuuugugucuacuugacacagcuggaguuaucacagagaaaggagcuucaguugaggaaaugccuccacgagauccagcuguaaggcauuuucucaauuagugaucaaggggaaaggccccuuguggguggugccaucucugggcugguagucuugguucuauaagagagcaggcugagcaagccaggagaggcaagccaguaaagaccaucccuccauggcucugcaucagcuccugcucccugaccugcuugaguuccaguccugacuuccuuuggugaugaacagcaacguggaaguuuaagcugaauaaacccuuuccuccccaacuugcuucuuggucaugauguuugugcaggaauagaaacccugacuaagacagagaccaaucacuuucuauucugcuugccugcacugcccacgugugccuugaaaugugacagugcaccuagugugugauaauguaagucccuuuuuccagccccuccuccugggaugacaacucugagacuaauuauuuauuaauuaaugccuaggccacaagcuuuggcucauuccccugacuagcucguaacuuauuuaacccauucuaacuauucuaugucuuccucaugguuaguuaccucuccucagcuucaugcacccaaguccagggcgaauuuccuuuuaauucuauccugaguucaucuaccugcugguuaguuagcucuccuccagucccaccugcuucuuccucagcaucuggcucucaaauuucccaugccucucuauuuuccagaauccucugucuuccugccagugucccgccuccuauuuccugccucagcucauuggccauaggcuuuuuuauugacagguggugcuuauaagcgaucacuacauugguaggcugaauguguguauauuuuuguauguaugucuucacauuagugcuguguacccaugugcuacacauguuugucuuuccuuaucacguccugccuuuauucuuacugaaccugaagcuuauagauuugacuaggcaggcuggccacuaaacuccauggauccaucugucccugccuccccuuugcugggguuaaggaccauacugccugucagucccugccagcuccuggggauggaaacucugguucuugugcuugagccagcagguacuucacugacugggcuauuuuucuaaucccuaggcugaaauuuuaauuaauuuaguaaauuugaaaacugauauccaauuauaaaacuccuaagacuauuggaauacuucugguguguaaaucuacucuuucagcuauaaauuauacacagucuaaauagagauggaguguuucucauaaagauuuagcaucuguuuugagguaugcuauaaauagaugcugggcguuacacacugcaaugucagugcuuuuguuauauuuccuucuuuauuuuugugguguuggagaucaaacugaggccuucaguguuguaggcaagaacuauacuacugagcugcagccucggcucuggcuacauguaacuaaaacauggaaaguaagucgucccuuuaauuuuuugguaugacuacuuaaaauuuuaaauuaaauauauugcuuauauuauguuccuguuggacaguaucagucuuaacuaggguccauuccauauagccaguuguguuuuuagaaaugguguuuaguuuuacuuuauaauuaaagcuuuguuagaaccuacuguucauaggucguauguggcugcuuucguacuacgguggcauugaguaguugugacagagacaaguuagcucauaagccuggaauguuuauucucucuggccuuuuaagaaagaagcguguuuggaguuuuuuaguuucugugagauggcgacaucugcuggcagaggcaggacuguguagcucagcuuaauaagacuacagaaggaaguccagugagcuaguggauugagaacaugugccggugaacauggacucagagcuccucagauuagacaauucuuaaggaaccagaagucuaaaaaagagaggacuaggauucaaaaggagaggacaagauugugcuuugcugugcugugcuguguugugcugugugcugugcugugcuguguugugcugggcugugcuguguugugcuguguugugcugugugcugugugcugugcuuggcugugcugugcugugcugugcuguguugugcugugugcugugcugggcugugcugugcugugggcugugaucucccguggaccaucuuagacuccugaguuaaaauagcuuuagaggauauuuuucuauuuccuuuauuguaaaauuauuuuaauaaaaacugauacuuuauaggaaguuauuagcuaguuuuguagcucgucugauagagaugaucuguuauugcuauggguuuucgucaucucagagggaucacguuuagaaauauauuucuagauagcaagauuuaugaaaaugaaguauuuacuuaucugcucaguuugcagcuauuggaugauauaacauugcugaguguuuacucugugcuacauacuguucugaggcguugccaagugcuacuuacaguucagcgaucuuuagaaguuggugauuuuauuugcauuuuacucugucuuuguguuuaauagcaaugagguuaugcaaaguaaaaagacacucauaguauuaccgauugacuuuagcucuguaaccaguguugggggauggacugaaagagugacaggaaauugaaggaguggguuaggguaccucugugugaggaagugauuggcagcaccgagcaaacucgcuuuuuccacucugaaaacuaaaggaagcagcagccuauccuggagcuguucauauagugaagcagcauuagggagguggauagaccgauggcuagccuaccccucauauaaaggaaaaaauggccucuccaguccugugugcaugugcgcauagcagaggcugacaucaggugucuuccuccuaacaccucaucuuuuuuuugguuuacuuauguauuuauuuuggugacacaguuucaugaaagucaggcugucuucaaacaggauaugaagcugagaauguccuugacuuguuguuguugcucuuguuuuguuuuucuuuuuuauuuuauuuuuaacauauauaagaaauaaauguaaaaaaccaaauacguggacaaaaaauacaagaaucauaugaucaucucaaugggagcacaaaaaaacaaaaagucuuugauaaaauucaacaugcauucuuaauaaaagcucuagaacaaguaggacuguaggaaacauauuccaauaaaaguuauaaaugacaaacacauagccaauaucauccuaaaugaaugaaaccauuaauaagcgccauuaaaaucgggaaugggagaggagugcccacugucucuacugcuuaucaauaacaugauugaagcauuagcuggagcaauaaggcaagagaagggauacaaauggaaaaauauuaagucaaauuauuuucaauugaagauuauauuaucuuauauccaauauuccaaaaauuugacuagaaaaauuguagaaauuauuaauaaucucagcaaaguguuaugauacauaauugacuuacaaaauuuaccagucuuaauacauaaaaguaacaagccugcugggagagaggucauggaugugcuccucuucccaguuucucaaaauauuuagaauauacaaaaccaaagaggaaaaaauaaaaaaacaaaaaccucuacuaugaaaacuuuaaaugugugaagaaagagauuaagaaacauucuagaauuugaagacaucccaagcuuauagcuugguagaauuaacauugugaaaaaaagaccuaccuacuaaaacaauuuacugauuuaaugaaaucacaaucaacuuccuuauuucauucuucacauaaauagaaagaaaauccucaauuugauauggaucaacaaaagacccagaauagccaauuaguccuagauaagugcuuguuucuauguaugcauucugcuuguuuuaagugcuaagugcaucugucuaugaccccaacuuuuauacaucuguuucuauugagucgauuuuguucgauauuagaauguucaugccucaucuuauuauucauuuauuuggcaguccuggagcuugaacccagggcuucaugcaugcagcacaaauagucugcacuacuuccaucuaucuuguuuguugagacuaaucuuuucacagagccuaguuugcucuuccagcugggcugaccucaggggagccucucuugcuccccuggucuggguuuacagaugcccaugacuaugccuggcuuuuuaaguggguguuugaguaacaaacaccccacuaagcuaucauccccagcccugccagguuucuagaguguaguccuaagagucacauucaccuuucaguagcgugucccaaaaaaugaaaccuugagcucuguauacguucaguaaugcccaucaggauuuaaagauucauuuucaagaugacguguaaacaucaaauuccccacacugucagacagcucaguggguuugcuuaauuagugaagggacucugcaauccaccaggcgauuguucuucuccccucuguagacuugucuaguuuucuuggauguugucccagaaggucccacuugguuugggagauuucccauggacuucaguaggauagugccugugagccaugugugccugagaguuggauuagaacaaauagcauauucuuuuuaucuuuauagaaaauuaccuuugucuccuugugagucuuacauuacauggcccuccaugcuuaggcauugccugagccuggcuuugcuagcaguacauacacucuucauaagaaaacugguuuuaaagacucacugcugugauagucugcugcauagcacccaguaggcaguuuggacuucuucccaggaacgacaggggcagggccugcaaaggcugcgccugccuucugcagugcuugaaucuauuggguaacuguugucagaauaggagcaguauucuuugaaucaccaauuuuccaguacaagaaaagggaagggaagguuaggcaaauccucaagguuauacagcuacuaagugagcauucuaguauaugcccuuuagcagucguaagugcucaugggauugugucauuuguauuuguuuuuuguaggugcuaacccaagcuauuuucuaaguucauuuugugaccuguuaacuuaugaucuaccauagccucucguuucugcuaaugcuguuuagcaaacauuuggggaggagaaucuucuuagggaaauagaaucuagauuuuuuuuuuuauacccauuauaaaacagugcuauaucaaaaccuuuuucauucuuuagcuuauuaauaccagguuuauacuuugcauauacacuagugaggccuuuaauaaugaagauaagacacacucuugucuagguucugcuugauauccaugggaggccugcccuuuuuugaagagaaacaggagauggugguggagguagggggaagagcugggagggggggagggaggccuaggguuuccaaaacuuacuuuaauaaggguucuuaaacacuucaaccucaacuucuggcucaccuacuggagguaggagaaaagaaagguuaguaggaaaugggggauguggaucuguuuagaaauacuucuuuggggcaauuauaaucuucauuguuaggauaucaguaguguaguccaaaacaccaaccaugaaucaguagcaguggcuugauccauaagaaacugugaggcucugcugaauggcucgagucuacagaagcagcaagaagcacccaggauaccacaagaaguccuguggcaugugucuauauuggccuagauugaugaaagauuugaguugaauguaauagagaguuggaaaaguagauagaugguggucagaucuggggaaauguuuaacgcuagauuaagauugguuuuuucuuuuugauuguccacuguucucacuguuugaccuuuuuuuuaacuauaaaaacauagaaacuuacaaaguguuuuuucuuuuguuuucuacugagaagcaaggacaaggaaccagguggaaguugugaccuuuagugauaaugcaguacagguguuauaacugaaagggagauuuuccagguggcauuuacuggagauuuuaauagguacacaugaauuuugacuggggaaaccuaauuacuuacuuucaaaagaacuugggaugauuuucuucugggaguuacuauaaagauauuagaguaaaaguuauugaagacucauauuuaaacacucacuuccuuucuccacauuaguaucaucagaaaauaggaaauggauaucuaaugaagcuucuacugggagugacacagcacagcguuggucacuacaagaucauuauagaauguacucaccgauaauauaccaagcccucugugagcaugugcagacucaaaugucacugaugaauagcuuggcuuuaaaaaauggccccaauggaauacaugcugugugccauaccaugucuaauucagguuaguuccuaccauagcuucaaauguugaaugugaacuaugauuaaauuacuuuguaauuauauaagcacuguaaggugugaauaaugcauacuuucuuuuuaacuccguaggcucucaggcaacaccacauucugguuuuggcuguucuccuuccgcuucugucuggccaccucagcagccauccugcccccuaaugguccacucuguggguauauauaguuuguuacuaaagaaguggcuugcuuagagaaacugucaucuuagcaauguacucaauuuauugaucaaauauaguaggauauaaaaccaauuucauaauuuuuuuggauuaaaaacguuuaacucuuaagaacaguagugagagagaaagagaagaaaucaugagaaaagggaaagcaagccuucugagcacuaagcacagccagugcccugguccugguaaaguguguuuucacucgguuaacgcugcgucuuuaaaacgagagcuuuguuucacaguuaugugcugccuuuucacuuaauacaguaguaugacuguuuucuugaaauaugccuuuuauauaguuaagcuguauuuuguggguguuuucucuuaagauaaaugucucugagcuaaguuguauaguaaaaucacuagucucugauuugacauugaacuaacagcguuauuucucuaaaauucauauacacuuaauauaugcacaaacauuuuuauuucugugguccuaaaaauugaacccagcaccucacacucaagacagucacaggaccacugggcuccauuccugcugaauauauuuuuaucaaagcucuguguguguuuucuaaauaaaauaccuauuuuuuuuuauuuguguggggauuugccugcauguaugucugugcaccacauacaugacaacauugaauccccaggaacuggaguugugagcagccaugugggugcugggaacugaacccagguccucugcuagaguaacaagucuuaacagaugagccaucacuccagccucugaacuugcuucuuaaacuguuucucaaaaugaaaauguuugagucuaaauguggacuaauuuuugaugcuuugaaagcauguguggcauuuguaaacaaucuauuuucaucguggcuaauguucccacacugcagagggaucuacuuaagcucugaaaaucuagccuuuguugugcagugaggaaguccagcuugcuggaaagcugaaaauauccaaaauugguaaugguagggaauuauguucuacuacuaauucacuuguguuuuuuuaguccuacaaugucugcucacacguugaaggcuugcuguuuucuugcuuuaggaaguucagacugaugcugauaaccaguuugaaucacaaagucaagcgaccucugugaaguacggugauguucccagggauccguuuaguguccauccuggaguugcauguggccuuccccacgcugacaguccagcuguugcaaagagucggcagcuggaucuuacgaguuguauucugccccaacagagagcucccaaggaagcagaguuacuaaagugcuuccaaacacacacgucucuguuuccagcucacgggaaggacgcucucucggacagucaggcauaccaaagucccucucaguuacagccagccuucuuggccacuaaugaagaaaaaugugccaaagaacaauuugaagaggccacaaaugaaggaaagcauuuaagcacacaugugcaagaugcaaaaauagccaagaaugugcagcaggcagaaaauguaagccagacugcugaaaaaaucagacuugccaagugcuuguugggagagcucaaggcccugauggaagguagaugagcacuuccuguuuuucuguacucuauaaugcuugguagcaguguuguguuuucuagaugucauucagaugacggugauggagcaggaguuucugguguuucucacagaacuuuaucuugacccaauaaggaaaagaucucuguuuguugucuugcauuuuagggcuuuuguuuguuucuugagacaggguuucauguagucuaggagagcuuccagcuugcucugcagcugcugcugguguugggucccuagucuuccucccuagaugacuuuuuuguuuaacaaggauguaaauugacuucucugauuuaauaacuagcuguuacaauguuaaacagaccccacuuuauguaacagcccaagcugcucacuagcuucucuguucauguuuagugcuuuuuucuuaaaucaaaggaaaaaggucuuugagccaaguuguuguuuugguauguguguguguguguguguguguguguguguuuuaaaguaguggcauuugcuuggaaugaauuauaaauaugucaucuuagaaagcauaguaauugauuguggaacuaacagaauagcugccauuuauaggcugauacauacacagacuacuaaaauccuuguaaauacaguauaguuaagucauagguuaaguauuaaaauugcagguuuuuaaaaaaagaugauuuauuauuauuauuauuauuauuauuacauguaaguacacuguagcugucuucagacacaccagaagagggcgucagaucucauuaugggugguugugagccaccaugugguugcugggauuugaacucaggaccuucagaagagcaagucagugcucuuaaccacugagccaucucuccagcccaaaauugcagcuuuaacaucuucaaauuagacaguuuuuguuuauuuguuuuuuguuuauuuuauuuuuuugagauagggacucacuauauagcucuggcuagcccggaacuugcuuuguagaucaggcuggacuugaacucaagaaagcaauuuaccucccucucccaaguacugggauuaaaggcaugugccaccauaccuggcucuuucuuuucuuuugccaaaaucuuuaaucauggcagcagcagugacagcaguggcacugguguccccuguccugagugcucacuugcucagcacugcacuguacucucgagugaccucucaugagucucagagcacugcuguaaucaccuacauuucagguaaggauaauaguaucucauucuaaucucagcaacccaaggagauagauaccuuuuucuuuaguucuauuuaacuaugaagaagcuuaggcuaaaagaaugaagucauugaaauaauuggccaaagaaugaaaaaaaaaaucucaauuagaaaggaggaaggacuaauguaaaaaacuauugugcaggauggugagugaugauaguaaguagcaauauagcuuuccuauugcugagagguuagguuuccagccuucucaccacagaaaauuaauacaugaggcaaugugucuccauuccuucauuuuagcuauugugcugugcauacauaauucaaacauguuagacacaauaagucaugcaaucuuuaugugguuugacuauggucaaagcucuaaaaccuguuugagccagcucuccacuucagaaccaugagcagaacugcucuauagagagaggaccacgcaguugcuggacacaguuguucauugugcaugcacuuucuaccagaauucaaauacugugcaagcgaauacaccuguauauauauacuuaauuaucucacaugcucugaugcgacagaggggacaaaaaaaggauggaauacgaacuugcuccuugcauguguugacuacuuccagucauagcugcucuccacaguuaguaacaaaaggcagaggucggcugggucacauuaguuguacuuuauaaaguuaaauaauaaagucauaucuuagaaaauccacauucaguauuuugccaacugaaucaccuaaaaugaacuauauuuuuaguuuuucaagacauauuuuuuuuucuggguagcucuggcaaccuggaacucaucuuuagaucagacuggucucaaacucagagaucccccugccucugcccuccuccaccuccgccuccuaucucuacucuccacccccuccccgaggagugcugggauuaaaggugugugccaucaccaaguagugaugaacuauauuuuuaaaugcaggaucaaaguauuauuguuguuuauagaguaacaguuauaggaaacuuguacagcaaucauuaagucuaccuuagagcuuugauaagugccaaccaggaguuauguggagaucuguuuccuguuucauuuaacuggaaaaaaaaaucacuaacuauaauagcuuugugauuuaagauuaagcuuucuuuacucaguuuaccaauuccuuagaauaguucugaguagguaaauacagaaaggcaagauaaagaaaaguguauguauaauaaucaugaguaaugaaguugaaaucuauaaugaguacauauuaucuauaaagacuuuuaguaauacaugccauuaaucuugucaauuuaaaauacugauuuuacucaguugccuuuuauagaggacuccgaaguucagagguuggugacagaaguagaggcgugcguaucuggacuuucagcagugagcggccacccaaauguggaaguugaaauagcccuggcccugcagccccugagaagugagaacgcucagcugcggaggugagguugcucuggguguuuugucuauaggugaaggugcuucacagcuggagcccagaugccaaggggacagauuucagucuccaguacauaugccuucccguucucgaguuccgaagguuucacauucaucaacuuuccaucacuucugcccacuaggauguauguucucccaccuguuuuaugucuguggucaccuguuaucauguacaccggcagaugggccugccucaggugguuacuguguuaaucuaaguuguuuuacaacaacaaacaucugauucuuaggaaaaguguguucuuccuuccuccaagacccaugaagccucuuuuucugaaugucucaggauguuuuccagggagugugaauguaaucaucucaugucuuggaccagaagucauuuugugaucuaaaaccuaaaacaagucacacgcucccuccugauacagucgccuggaacauggcacccgggaagagacccugcugugagagcugagugcaggcagcccugccgacuuagacguacuuagacauaggacaacacuuacuucaauuccuacauuucuuuuuagucauauuaacuuacuggaguucuagucuuaacuuguuuaagaaagcucaaaaccagugagguaauccugagacguaaggagauuccccaucuauuaacaguauuguuugaacggugaguguuucuguggugaccacugaaauguaucauccgggaucugccgauguacuucauguggaguucauuuucagaugcuucucagcucugugcuguacugugcccugacaguguucucucgagcacagaugggacuugcagggacgcacacaguuuuuaagagacuugaaaacagcaaaaaaggauuccuggcuggagaguagcuuaaaugcaugggucuguagcccacaaagaaacaucuagugagacuuaccugcuuagcaucaagagaucucauuuguggguagaguugugggccuaacuucuaauaauacugucaucaguucuaaucugaggcguuccugugacaguauuaauuuuccaaaaacuaaaaugaagaguaagucacacaaagugaacagcagcuuucccucacguuugcugcaugccugcaguacuguucuuccugugugccaucacuuaaauccucccaggagcguugcaaguaucuugccaucucauauggggaggaggaaaccaaggcccagaaagcuuagcugguuugcucagaguuguguauucaggaauugagggagucaaggcuuaacuccaaggugauuugauuguagagccccaaaucuuagcugcaggcuucuacaguaacuccaugaggaagcagagacuuaaggaucacucuucggguguauuuucagccugguauuuaaaggaauaauaaucaaauaguugguuuguuacauauacuagaaccuagucugagacuauuaucaucuuaacauggucaccauggaaaugccagugggucucauuucuguuccucggaauguuuuagaauugcuguaggaguuccuuuauaagccacucgugaaaaggaggcuugcucuuuaauuugucaccaguuguuuuuaauuuuucuaagggcguugacuuaauugauauccacuucuuuggaauugacaguagagcuuuuuagcugucuguccuuagggagaaaagauuguauaacagccuauugccacuguuauuuacuugaucuuuuaaaguaauaaaaauuacagaaaaaugaagaauuuguuagauauguuucuuuggauagaaugggacuuccuguagcaaugugggaauuuugcgcuauuuuuuaaucucuauuuggaaagaaucacucauaaguuucacuauaaauaagaaacagauuggguggucuuauuuacaagugauuuucuuuuuugcuuuuuguagacauuuguaaacuacauguuuuaacuagacagcugauccuuucccuccccgcccgcccuucccccacacaacuugaagcuuauugccaucuuguggcaaaaagaaaaacugcuaggugcauggcuucuaauguacuuugggcauuuugaaauguccauaacuuuugugauacuuggaacacaguugucucuauuuagucugcuuguucccaacccacaagauaucuguaaucuguaaugccuuguugaauuuaacuauagaagccccuaguauguccccaaauacccuggauggugguucagaauagaguauuaccucguaauacuaauuacuaaugagcaaucugagcuguggauggugguugucuguccaggaaaggagcaggaugaaaauggccugaggaagcucaggugcugagggucuuacuauggugagggucuuaucacaccacaugagaaaaaguguguagacguuuucacuuuaaauagauguagacuaguguacaugugcuuccccuucauacaguuacaugguaguaagcuaauuaaagaauauuugccuaaauaucagcugucuuuaucuuuuguuaaaaucaaauguauuuaaacggaaugcauuuaaaauaguauguguaauauccauuucugagagauuguuuuugcuauuaauuucuaguauuuauuauaaaacagcaaaaauguaaaagcagggaauaaggaaagaaaucuacugguacaguuaggcuugaaaaguugugggaagcguuucagcgugcuccucugcuaagacccaggagcuagcaaaagagaugaaggaagcagcaggcacagagcugagaguccuugggggggggggagugggcuucuggggaacgcauguuaauaaggacacgcccaaguaaauugguguacucuguuacaguaaguuucucuccaugccacauuuuaagguugggggaagugggggggggugccuugcacaggcacauucauguggaggcaacacaaagauguuguuaaaugccuuccucuauagcuuuucaucuuauuuccugagggcaggaccucaggcugaagcagagauugcuguuugucuaggcuggcuggcuagugagcacccaggguucugucuccaccuccaggugcuggguuaaggucauccauagcuauacccaacuuuuuuugcauggugaggguucaaaaucagguccgaaugcuuacccagcaagcucugucacccagaggagcaucuccccagccccucuacucuguguuuauuuuuuuaaagggcaagugugaaaguaucacacuuagaggacaggguggggaugggaggcuuguaauaagugauagaagguucaaguugacuaaugguucaaaagaggugaaucugaacagcagcauacagaaaguuuguaaaagaaucauuuucucauauaagguaguugcugucucucuggaagacaccagaagaggcauuguguuauguaaucugggccaucacucugugcugccucuuccagaucugcguguuuuguuacugaggaaacccuuuagaaaaucagaguuucaucuucagcucauucuuuuucacuuuaugugugucuuggugauuuuuuuccaguaauaaacccaaggauaaaaauaauaaacccaaggccuugcacaugcccuaucacugagcuauccuccaaguccuuuuuugugcucuuccuaugucaauauauauggauaucuuauucaucuuaauauguguacauuuaguauuucaucacauggaugaaucauaacuuguauggcaucuaaguuguuuucaguuucuucucaaauguauaucguguguguguauuguuucaugugcuuuugcauauguauaguuauuucugaguaagcuuguccaggagauggaaagauggcucaguaguuaagccauccuugcagaagaccccgguuugguacccagcacccauaugacagugcauaaccaucgguaacuccagcucuaggggucugacauccuccuuuguccucacuggcaccaggcacacauguggugcacagacaugcaggcaaaacacccauacacauaaaauaaaaauuaauuuaaaaacuagcuugucaaggaugauacauauuuuagagcuuggauauuacuaagcugucauccacaugguuacagcagacucccacugacugcgaaaaugccccucaugaagagcuauugccuuauauuuuuuauauuuguauguguguguguguguguguuauauguaagugugucugaguacauguggaagcuaauggucaauguugugccacuauacccagcuuucauguaagcacuaggauuccagacucaggcccucuauuuucuguggcaaaccaucccccaaucccaagcuaagcauuuucuaaaagcuuauaaaucacuuagcuuucuuacaggaauugcuuguuauauuuuuuuccaggccuucaauucuaaaacaagcuauaaaauugugauguguuuaaacuuuauauucuuuacuugaugguuguuagauuuuaaguccuucuuagggauuucuuuuguacuuaaaagauuauuuauauuuccucauaaaacuuguguuguugaauuuauguuuuguugguauauuuuguguucuuaacucuuuaaucuauccagaauuaauacuugugaauggcguauggcaaguuauuaucauuuuagauucaauuacuaaaucaaauacauuuguauagaaaguuuccaauucuggaaagauaggaaaugccaguaccuaguuacauauucuuguuugugaagugggugcacacugugaagacaggguugauguuaacauucccaugaggccauuaccuucuccaucuaacaaugaaauuacuagaaacacagauuuaugucucccaacuuugucaaugaaucacaaacaugaaauaacauagauagauagauagauagauagauagauagauagauagauagauaguaguuggcacccacaggcauucugguugacagaaauggcaauuauuuuaaagguaaacuacaguaguaagguuauuguauaaguauacauacacacacauuauuuugaaagaggagaugugaagauuaaaaaaaaaaaggaaaacaaaggaaacguauacauggugguacuugaguguugucccaguacuuaagaggcuaagguaggagaauccaaaguuccagccacugugagcugccauacugaguuccaggccagucuuggaaauagugggccacaguuuuauugugucuggaacaauucugcaccuaucuauccugagccugguagugcagaccuguagucccagcuacucaacagagaccaaggcaggaagauuaccaacucaaagcuaguccuuuggucccaguacucaggaggccaggucaagugggucucugugaguucuaggcuagccuagucuacagagcaaauucuggaacagccagagaucuacaaagaaaccauuuuccaaacaaacaaacagaucuguggauauagaagguguuuguuaugagguggaagggugcuaggcucaaaaugugccccuguuaacaguugggguuuguaguuucauuuauuuagauuuuguguuugguuuuggguuugagaugaacuggugacuauaguguuuaucuuuuuuauaucaaaauaucugauguauacuguaaagugggcuuaggauucuuacccaucuuuaugacuuucuuuaggcaacugagaauuuugaaucaacgccuccgagaacaagagaaaaccgaaaagggaccugguaaccuugaauguaggugacgaaacuugaaggguugaaauugaagucuuuauuacucuggaaauguuggugcggacuuguucuuuaucuaaguggaguuucucccuguaucagcuuuuuaaaauucggaguuacuguauuauaauuuaaaacaguuguuggguauguuuguaaucucaguauuuaugaaguaggaggauugccacaaguuugaggccagccugggcaacauaacgaguaccacuccagccagaacugucuguaguaagccccuaucucgagaaaccaaguuaagaagugugcagauaucuuaaauagucgggacguauucugcuuguuaucucuacuauauuuaagauccucugaaagauauuucagccuuucccacaaugaacaacgaugaaauggaaaucuguaccaggaucuuugugagcaugcgucgagguuugcaggauggauuucuaguagaaguacugagccagagugcauauauagugauuuuggcagauauugucgaaugacccuuguuuuuuucuggauuuuguuuuguuuuaagugggagucuuacuguguugcucaggcuacucuuggacuuggaggcucaauugaucuccccuccuugcucaccucagucgcugcagcuacaggugaauaucacaucaucuuuauggaccacagagcuuuguagagaaaaacaggagucaaagaacagaugaggucucuuuucaauauucucaguggauuuucucgagucuaauguaaaugugauguuauaaagaagugggaagaaaauucgagcaaccaacgagcaaacacuuuacaaagugcuuaacuucacccgaguagucugcgauaguucuuucugguucugcucucaguaaaugguguggguaagacgaaggccagaggggaggcccuuuaugagugcuucucuaagcguauucuuuguacucauuuaccuuagugcacuuuuuauuacuguuuacaauaauuuguuuacuaacagcuccuugagggaccuuggggucugucuuagucaggguuucuauuccugcacaaacaucaugacuuauaagcaaguuggggaggaaaggguuuauucggcuuacacuuccauacugcuguucaucaccaaaggaagucaggacuggaacucaagcaggucaggaagcaggaacugaugcagaggccauggagggauguucuuuacugacuugcuuccccuggcuugcuaagccugcuuucuuauagaacccaagacugccagcccagagauggucccacccacaaggagccuuuccccccuugaucacuaauugagaaaaugccuuacaguuguaucucauggaggcauuuccucaacugaagcucuuucucugugauaacuccagcugugucaaguugacacaaaaccagccaguacagggucuauguuguucacugcagcauauccagauucuaauaguaauucauacacaguaagcagucacuuaagacugcgaaagccaaucaaaauggugcccugugccuuuauguuauuuuauuuacucuuuaagaauuucaugcauauacacagugccuuuucaucauauccaccucucaugcugcauucugacucuucagcaggcaccaggcacagccccugcccuccccuagcccagccucuguccucccccagcaggcaucuuagcacagucccugcccagcuucaugaccucugucuuuuaaacccacugaguucaguuguguuauucccaagugcauggcuguccccuggaguaugggcaaccuaccauugacaucuccccaccccccaaccaaaugacucaucccucaugauccuucaacuguaaauagcuccuccauuggggguagggucuccaugucccucaacucuucagagcagaguuuugacugguuugaucuuguaugaucaccauagcuaccaugaguuuaugaguggcaugaccaggcuguguccagaagacagcacucgggcacuccuccccaucauccagccuggggaggacugugauggagaugucccauuuauggcccagcauucccagucagcugcucccaguacucagggcaggcagcagucucugcaucagaugccucccacuguaaaaacagccuucucugcccaagaccaagaacaccacagaucuguaaguacaaacaugaauauuuagaggagaguuagacaguauaaccauuuagcaaaacaacagugagguccccuggagccugugaccucuccagucauaagguuuacaguaugaauucccuccugugcagcaggccucagauccagucggaaaguuuggcacuauuuaaugggcacaucuugccuagcagguuaguauuguagcaugcugggucuucuagauacaaggauuugugucuccuccccuacgccgcuaauaugcagucugcauagcuucuuccagcacuaugaaaccuagguaggaagguuccuggucagcucuagauugguuucucuacauuucgcaaccaacgugucuuuagcaggaggcucuuaccauccuuuuaugguagacaaccaaaagcaauggcaggagccucuuguugggggcuuugagggccucccugaccaauaacuuacaggaagguauuucauguucugcacugagauuuucauuuaauaaccaaugucuucugggaguagcuuugucuaccugugcaggcuaccucuggucaaaguccucuuuuaagaaauauauauuuuaaaauuuguugacauaggauuggguuuccauguuuuuacuuucacucuuaguuuugaguaacccacucugacacucaccucuuucacauaacccugucccugcuuaacccuguaaccgccaauauucuuucccucuucuuuauaccacacaauucuacuaucccucccucuguuccuauuccauuuaccucuucgugggcacuuccuccucccugagcuccacagacccaccaaguugaacauaaaaucuauaauuugaaucuaggauccacaugugaaacagaagcaugcagcacuugccucuuguggggccuggacauaucuuguguauuuuuaccacaauuucauuaugcaucaguugguggacaagagugucucuguaggagaguaauggaauccuuuggguauccucagauguaggucagagggugauucuguuuuucccuuuuggagagaucuauacugauuuccauagugggggauacuucaacacugaguaaauguuucugguucucuaaauccuaggcuagcaguugcugucauuguuuccuugaugauaguccuucugacuggaguaauguagaaucucagacuaguuggauuugcauuucccugcuggcuaaugauguugagcacuuugaaaaccauuucuuagccauuuguguuucuucuuuugaaaacucuguuuaaguccauaaccuguuuuuuauuggauuguuuauuuucuuaguguuuauuuucuugaacucuuuguauauuuuggauauuaauccuuuguuagagauauagcugacaaagauuuucuuccauacuguugucuggcuuuucacuugauugacaguuuccuuggcuguauagaagcuuuuuaauuucaugaguaccuauuugucagucauuggcuucuggccuccuuugcuuucugaugcugucauaaaacaccaugacauaaaccaacuugaggaagaaaaggauugaacuggcuuauacuuccaugucacaguuugucauugagggagagucaaggcagaaacucaagguaggagccuggaggcaggaacugauacaggaaggagugcucuuauauggauugcucaccuugcuuuuuuuuuuuauguaacccaggaccacuuugcccggggauggcaccucccacaguggacugggccuucccacaucaaucauaagucaagaaaaugcccauaggccaaucugauagaaguaauuccuuaauugagguguuuuuuguuuuguuuuuaauccuagaugacucugguuugugacagguuuacaaaaacaaaaaacaaaaaacaaacaaaaagacccaagccagccuuauuuauuuccugaaugacuauggccccauucagaaaguccuucccuauuccaguaucuugauguauauaccuuauuuuuuccacuagcaguuucaguguuucaggcuuuauguugaguucuuugaaucauuuggaagugaguuuuugcagggugagagauaaggaucuaguuuuauccuucuacuuguagacgguuuuaccagcgccaucuguuggaggugaucuuuuccaguguguaaugcuggccggugucuauuguggaauggcuugguaucugggucuucucuucuauuccauugaucucugcgucucuuuguuugguuaucuggaaucuuuuguacguccauaugaauuuuaaaauacauaguuuuuacuauugauauaaaaaaugucauuggaaguguuuaauaaauugugugugugugugugugugugugugugugugugugugugugugugugugugguuugccugcauggaugcaucauauacaugccugguacccaaagaggccagaagaaggcauuggauucccagggacuggaggcagaggcugaagcagagacuauggaaaaaugcucuugcacuugagcuaccauguagauacugguuuggucuuaaagguuaagcuaucucuccaaccccuaaaaucucauuuaaguuguuauuuuguguguuguguuuguguauguauguagacaugcccuugccaugauauacaguugaaggcagaggacagcuugugaaaaucauuuccuuuauuucaccauguaagucuaaggauucaauucaagucaucaggugugguagggugugccuuugucugcugggccaucuugccugcccacagugaauauggauugcauuaagucuguaaauagccuuugguaggauggccauguuuacaacguugauccuaucaccucuuaagcaugggaggucuuuccauuucuagugucuuccuuaauuuccuaauuguauaguuuaaagguuuagcuauagagagcuuucacagccuuggcuaggguuauucuguuuuguuuuauuugggauuuugggguuuuguagcuauugugaaugggaucguucccuugguuucuuucucaguguauuuguuauuggguguaagaagucuccuggucauuuuguauguuaaucuuguauucagccacuuccugacuguguuuucaauucagaguuuucugguggaguguauaggaucuguuauauuagaaacauauuaucugcaaauagagguccuuugacgucuuacuuuccuauuuguagucccuguauuugcuucucuugucuaagaccuucaguauuguauuaaaucaaacuggagagaauggauacccuuuucuugguccuuguuugaguggaaauucuuugaacuuuccccuauuugauauguuggcuauagguuugucauauauggccuauauuaugcuaaggucgggagcuaagccaagagugaccccaggcaaaggaaccagcauguuuuacauuuacacacaacaugggauaguaugauucuuuguguuuaaauauauauuuuguguaaaucauugucuacauuacauuaguauuuuccagaaaaguaaccaaaaugauagugauugauugguuggagagcgagcguggagaaagggaggcaucacugagaaguuuuuggcgucuuuggaaauuuuuuggaguuuaagauauuuacauuacacauauauuacucauuuguuuuauaagguaaaaacaauuuaugacuaaaacaucaacugggaaagaaaggcauuacuucugcugcuuacuuuuuuaaauauauauaguauuucuauugcauugugcauguuaccacuuagggaaucagugaacucaggguauuuucuuuuucuaaaagacgcauuuuuagguguuuuuuaaaaauugggaaacaacuauuugauguguuuuaucuuacaguguuuucccuucagucgcugaauaugucgcugcagaaucagcugcaagagucgcugaagagccaggaguuacuacagaguaaaaaugaagagcucuuaaaagugauagaaaaccagaaagaggaaaacaaaaaauucaccacuuuauuuaaagacaaagagcagacucugcuucauaauaaacagcaguuugacauugagaugaccagggugaagauggguguguaucugucucuagccacagucguuugguuuugagcaauaaggaagcuaagcagguuuuguuguguuugcuuuagaguuggaggaagccuuggccaaugagaagaacuugcgguuuaagcuagagacugcagaaaaggaaagucagauacugggaauaacacugcgccagcgagaugcugagguugcacgacuuagagaauuaaccagguagccuuacuucccuuggguaagcccgaccuuuaacagaugauccguaaacuucaggccuucuugcuuccuccuuuuucccucuuguuuugucuuuuuuuuucuuuuaauuucuaauccuuuguucuauuucacuuuaaaaauccaagaccuguuuaaaggcuguuuacuccaugagguuguagacuguggguagcuaaugacucugaugaagaacuggacaguguguagugaaguagguaagcucccugacuccgauaccagagaccugaguggacucucagcucugcugcagauuaucugaguauuuugugcacauuacuuaaccccuauaagccccaaguuguaaagcugggacaggaauagaguugucugggggaccacagaauaauuaauuuaugaugugcuuugaugugguccauccucaucucaugccaugugauguuggguaggucacuucauuucaucagaaaagugacagauucggccauagccccccagaaugucuucauucuuuacucagucucuucccauauaaauaaaccuaucuuacuuuuuauacuuuuauagaaaucuuacauucaguuuucuuuugagacauuuguuaaucacuggauuuuugucuacuuauaaauauuaacgagaaguuaauguuuuuaauguuuuauaaaacaguagaucugacuaugccuuaauaaccccagaugcuaaucauuccagauccauuuuaauuauaaagaugucuauuauauauaaaucaugugcuauauacaauauguuuaguuuuauaaauauacuugacaauaauaaguggauauagaaauucugcuuugcuuuaguaauaccgccuacuaguaugacuuuuuuuuaaacucagagguuuaguuugcaacauugcuuaagaauaaaauaucucuauacuguaagaaaaaaauuaugagccuuuacuuuuacauaugauaguagauuugauauaaagcaagaucuuuugucauuuguuaucuuguuuuucuuugccaaagccuuccaacacuaauguucacacucgccuucuguccuuccuuuaaaggauagaggcauauagaaacgcguuaaaggauugaguaaaacaaucaguaauuacucacuucuucuuggcagaacuuuacagagcagcauggccaagcugcucucugaucucaguauggacacugcgcgcugcaggauggggaauagccucaccaaaucacuucucaaugucuaugaucaacaacuucaacaggacccagccccugcucagacuuccauaaugagcuaccucaauaaauuagaaacaaaucacagcuuuauacauucaaagcugcuuaacaaugaggcagccauagagccagacagacucugugaaagugugcugcccccacaaaggccuccccauagugaugcggggacagcagaugggggcucugcaucuggaacugucucugcugcuucaguggaggauuccgauauggacugugaaacccucacuguaauagaagauggguguaacguggacaguacaguuuauauccccuuugcaagaaacacuucuaaaaagcacucgccacuuuguaagagacuauccccccagccaaagcugaguguugcugcagcacagcuagucaguggcagugcacagaccucuaaaggagaaaguaagccacgugcaccugcaguuuguuccucacgaaaugaagcagaagaugcacccggagaucuuuccagcacguaugacacagaggacgugcagcuccucaggaaaaucaaagaagcaauugguaagaucccugcugcugcugagcacgcaaaggaacaggccacacaucauggcccaucagcucaucccagccccggcguuccagugaagggcaguauuguuccugacagcagcuuucucaauucugacuugaugucagacuggagcaucuccucuuucucaacguucacgucucaugaugaacaggacuucagaaacggccuggcagcacuggaugccaauauugcucgacuucagaaguccuuaaagaccggccuucuggagaaaugagucugggagagacugacggagugcuuuucuuaaagaguagaacuuguucauaguguauuuuggguuccccuagagagaacacuuuuuauuauuaauuauguaugaaauaauaaauggaguaaauuuacuguuagaauauuuuaacaccugaagguuauaaaaaaauucuuuuaaaaaccaacaguugcugagagaagaaaguuguagaugagcaaguacuguggugcguuauuugacagcuugaguuucacagagaguuccucacugugcgacugcugggucacuggugcagguaccgaggauuucuggcuggcuggaaggagaauaggaaaggagucaguacuguuuaaaguuuccucucugcuuuggaauauuuguguguuucaugauagugugcuuguguaugggaauacucuguguuacaagcuagggcugucgauggccugcauuaacauuucagagagaaaagaugcugguguaccuaccucauacaaagcauugauuuguccagggaaauaccgaugauugguuaauauaugguccuuaaaucuugggcauuuuauuuauauuugucuugaaugcauguuuuaagaccuuuaaaaauaaagucagacugauaagauaaugcuaaauaaccaaguuuuaccuuaguaauuuuggguuuugauuuuuuguuuuuguuuuuuaguaagaauuauuggguuuuccuuaaugucuuuggaaaugauggaguuuugcaaaucucagcacuggggguaacucugccuuucugacccaauuuucccccaucauuuagcugagaacguuguucuauaauuaacauggacuauguugcccucucugcuuccuaauacuagcccuuuguccugucuugccauauagcccaagaugacuucagacauuagaucuuccucccucaggcuccugagugcaagccccagcaguucucauucaccugcugucacagcuuucuguugaacaccaaguccugcccugucaguaacucuugguacauguuaccugccugguguaguugaauuugguucuuggacagccucuggcauucgaguagucugcugguuccaaauuuucuccugcuucuacaaccucuggaggacccugcuagacuacuuaauauuucuuagacuuuauggggaggggucuuuuuuguuuguucuacgucuaaauguauuaaaaugaauuguaaacuauuuuaaagauuuauucauuaacauuuuaaauauacuuccuuccaguauucauacguga

SEQ ID NO: 8224 - RNA, 3478 nt, Mus musculus
cagaaucaacuuaaagaagaaggacaguccccacagggguuuaagugccaaccgaaagugacgugggagguggaaagggcuguggucaggaagaugaagaccacggguaacauacgcaggcuguggauggggugaagagagacuggcagggguuugaggaaagguaauuuggcuuaguagucagggggacauagggcacucagggagaugggcagaagcuuguccccaaggaguucaggacagagcuggugaccaggaagcugggacucugccaccacuccugccuuuguaugguaaagcccagcgcgcagcacuuacucucuguuccuagcacagggggaagagagcucuugggucuccgggauuucaucuccggggccuugguguucucacuggucugagcaucuggaacaaaaaaaaggaacacaaacaucagugaguggcuaucugaggagcugaguaggggaggcccucagucagaacccuaccuugacccuagcuggcccacccaccccuacguuccacccagaggcccucugugcccgccaaguggcgccugcagugggcccuuccuccaggggaguaccaaagaaggagagccugcuggauggaccugauaaaucagguggcuagaacagucgcuggcaggauggauggccaggccagggagcuagugacugcucccaacugcagccccagacacugccaggacuaaggccacuuagcagggccuaggcucucaauucccuuugcccacacugggcuuugauucucuccuuuaaauguucuacauuccaaaggcucucugcaaagguaaaggccucacacagagggaggagaagacugggcccucuggaccucuggacucauggacugaacgguguuuauggccuuagauuucuaaggcuugccuuugcacugggucaggccuagccaauugagggcuucagagucagccacuggcauagucucucugagacggaggcugggacucagucaggggcuuuugggguaccuccucaaggcaggccuaugaauuccugcaguggccacugcuugaugcuggcagcaaguuccuucuuccauguuacaguagagcucagaaaaugcuggggguggguacaauacuagggggguggucucuuguggauaaaggagaauggcacugcaggcuggguggaacugaacagaaaaccccugaguaccaaugagacuggacuuucaacugggggagggucucuuguggacaaaggagaauggcacugcaggcuggguggaacugaacagaaaaccccugaguaccaaugagacuggacuuucaaacguugugggaaaaccacucaggacuuagauaagaagcugcuggcugaaugacaaucaccgggcaguguuuuuacuacucuuugggggagaggauggaaggcaccucccccuaagccccuuccuguccucauccuucauuuccgcucuggaggaggaaguucagagggaggaggggauuuuccagccagggcucuggccacauuccuguggcuuggcugaggaagggcuaacagacuguccuugcuuccaggaugggcagccucagcuggucuuggcuagacugggcucccugugaggagugguacugcacccaucaauggcagggguuggagacaugcacuuuacccgcuucccugguuacacuuauucuagaugacaucugugcucuguccacagggccccuucuacuuaagucuuauuuuugaagcuugucaccagcuaggcuuccuccaggauaucccuguacucuuuaugagcuggguaauccauggacagagacugcugugggcacagcuggcucagcuggguggcagcugaggaauauuaaggucaauucccuguugaagaugacccaaagccacacacacacacacacacacacagauacacgcacacacacacacacagauacacacacacacacagauacacagacacacacacacagauacacacacacagacacacagacacacacacagacacacacacgcagauacacacacacacagacacacacacacacacagacacacacacagacacacacacacacacagacacacacacagagacacacacagagacauacacacacacacagauacacacacacacagacacacacacagauacacacacacacagauacacacacacacacacacacauacacacacagaggaaugauucuguuugggcuuaaugaggacuuuccagcaguauaugaagauggggugagggguaaaggaagggaggcagaagugauccuuuuaagcaccacuugauaaccuugauacccugucccccaugguguggcuaugcccuacucccuccauaagagcaaaggugccccagagcuugaguucaggguuccugccauguggcgcugauaaggucucaagcugcuguucacccugggcaccagguuccaugugcacacauggaacagaaggacccccaggacuuuaaagaaagaugcacucagaaaugucugucuucgauuguucuccccuucucaggaaaagggugaaugauaaagugaguauguaguauugaauuccugauucagcacucuuuucugucccuccggguaagcuccggagcagagaggaguuugugagagaaggaucaaaguuccuuuucugacagauaagccgaggcacaagcaagccaaggggagaggcccaguucucuggcuucugaaagagggcaauggggaggggggagguucagccugggaugccauuccuugugggucccauuggaugcuauuuuggugcggguuggaaccaagaaacaggaaaguucucauucuuugucacgagcacccuugagaacuugggcaagucguuuacacugucucugcuuccguagcuguagaaagccaacucuuuucuagcucccugcagcccaaagcccagcgaaggcaaggcauggguggcauucuguagagaucaaaagcaccgcuuacauaguaaaugaacucauucuuuuuguuaaccauggucccucaccuucuccuaaggcacuuuagcauccucugaccuuggaaagcccugcuaccagcugagguucaccggaggugugaccacucagccugcugugcacacagagcuggauuugagaagcuccacacacugcaacuuaucuucccaucaggcccugaagaaagggcucaaguuucccuuccaaaccaggccuuucccaaacccagaggcccaggauugggggaggggcagcacccccuaaacugucaguacugugggggcugugcacgcagcacggggcccagccagggagagugaacugguaggccacugugagaaccacagggaagaaggagccgggaggaccacacgcuuaaucaaaaccagcuuugugcuuacacgcugcccaggggauaaaaauaauaguaauaaaaguuuaagagcag

SEQ ID NO: 8225 - RNA, 23417 nt, Mus musculus
agaauucuugagcuuuguguauaauuuuauaugccaggggcuacaguuuuggguuuuuuuuuuuccucaucuaaaaauaccucuacaaaauuuaggaacaagucaguuguaauacauuacauauuuaaagauacacauaagcaaaacugguggcggauaugcacacacacaauccuaaaauauauaauacacauguauuuaugugcuuuuacuccauauguuuuuaacaccgauauuuauagagacauggcuagacauaagggcagccaaugggauccaucuguagagacagacaagcagauuaccuguuuaagaaucaaacuaagguuuucucucucuuagcaauauugccuaccagguccucugacacuuuauacagccauuacccgcuguauggaguuaauauuugcauacuauaaacuaaucuauuuuagguuugcaaaugaacucuuuucacaaauucauaucauacaacuaucacaaccuaauuuuagaauuugugcaacucuuaaaaaagaucccuuguaccuguuaagcuuggauguguuuaauuucaaaacauuucacuuucaucaagaagaugucuagccuugguuguacaguuagaaccuggaccauauuucugcagugcucuacgucaucugacaacguggcauuguaagagucauggacaauucauugugcacaccuguaaucucagcacucaaaaaggcugaggcaggggggcuugaaaguuggaaacuaaccugggcuucaugccaagaccccgucucaaacaaaaacagacuuagaauauucuauuugagguuucugaaacgagucuuagcaacauauguccauaaauauggagaugcacccuaggagccaaccucgugcuuuaaucaacagggguacccugagagccucuugauugaguucauaaggauauuggaugacggguucugugcugugugucucuccccgugcugcaggauacccagacccugagguggucugguucaaggaugaccaaucaaucagggagucccgccacuuccagauagacuacgacgaagacggcaacugcucgcucaucaucagcgacgucuguggggaugaugacgccaaguacaccugcaaggcugucaacagccucggagaagccaccugcacugcggagcucaucguggagaccauggaggaaggggaaggggaggaggggggagaggaggaggaggaggaggaggagugaagccaagccaaacagaagcaguuccuaagucauuuuaaaaaggacuaauuccuuaaagcucaaaaaaaaaaaaaaaaaaaucaaaaaaaccaaagcuagaaaaggcaccuggugugguagaugaucuaguuaggcuauuuggaggcugauucgucagcgacggcggcugaugccugggagauauacugaugggcauuacuuugaauuagauagcaccuuaaacacuagugcagcuagauuccauuugggagagaucaccagcaacucgucuaauugauuugauuuuagagagaaaauagcuaaaagaaauacucacuuagaaaaggucaaacauuucccaguuuaacgcacccugaaaaauaaaguugucaucagccccuuccgccccgccccccgccccccccuccccaagccuccugcuguagcucaacccagauccccuggagauagaauguccagcccccucccacccaauccagagaacccgccuugucccauccugcggugucucauucuggaagcgguugagccaagcugacucaggagacacauugccuuccaacucugcacuuucaagcucugcguuucucuccccgcuccaacugcuggguuuccuggcucuaauccuugccugaguuacagcaaggaggacauuuaucauguuucuuccauccugaaaccaaguuccccggcuuguggaugacucuggcugccuugggggggugagagguacaggaaggggggugucuccucuccucuaaaauccuuaggaaacuaaacuuacuccucugugcaggagucuggcagcuccagacauuugcaugagaauucaugaaggagaaaaaaaaauccuugcuaaugagcuuuucccccccuucaaccaggauuccuauuugugcugugagccaacgucagccugcacgugcgguagagucuugcacccagacuuaaaagcccaguuugcugaagugcuggcuuuauugggcacuaugaaacugaugucagcaacuguaggacuggggugcuuuggaaucuccuucuaggcagucugaguuuaauccaucuucauuggcaacacucuucaaagagcuuguccugccuucuggggucccccuugaucuuucuuccugaaugugcaucacgcuuuguagcccccccacccccaaccuugaccugcucaguacacucagacuugcaucuuuagcaguuugguuguuuuuuuguuuuuuuuuuuaaacuuucuuucacuucauuggcacuuaauuguuuuuccuuauaagacuuuuuggaggucaucaacaaagaccauaaacugauauccuagugugcuuccucugugugugcgugugcgugugugugugugugucuaacauuccaaauacuuuuuuucuuuuccacuguuuguaaagggcaacaaauuaauauuucaaagguuguuuuaauaguuccuuacaacccgaccuuaaacuacuucugugcagucccacacagugccgacauuagagagaugacauugcuuugucuucucagccgccauccuuccugagcuguuugcugcugcauugccacuucuuccccuguuucgcuucucuuaagcaguuucaauaucuuucauuauagucacaauauugccacgguuuauuauaauaaggggguuuuaauuugauuuagagcauucaaaguguuuuucaucacuuuguguuuauacuauaauccuugaguguauguuguguguaugugugcaugggugguuaugcguguguucauaggguaaugccuucuugggacuguguuacuguucucucaguuuauuaugccauccaaaugguggacgagaacgcuaugacuguaguuagcucacaauuuuuaaauaaaggauaccacagugcaugguguuuguucaaucuuuguagacgucucucuuuuuuuucauuacuaauuguaaagucuauggaucccucuugguaauuacagccaaauuuugugcugcauaauuaugaagaauuggcuucuggagcugaggagacgucucagcugguaaagugcuugcagcacaagcacaagggacugaauuuggaucuucagcaucgaugucaaagauaggcucagcagugucacccggcauugugaaggcagagaugggaagauugcugguuagccagccuaaguaaucagcaagcuccagguucaauaagaaacuaucuuuuaagauagauagauagauagauagauagauagauagauagagccaggcagugguggcgcacgccuuuaaucccaacacuugggaggcagaggcaggcagauuucuuuuuuucuuuucuuuuuuuuuuuuuuuuuuuuuuuuuuuuuuuuuugagacaggauuucucuguguagcuguggcuguccuggaacucacuuuguagaccaggcuggccucaaauucagaauuaaacuaaauuuuccucuuucguuggccauaacuaaagaagggguucacaaaugcagucaucuugcucagucacaucgcugucuguuaagcacacaucaugagcuccaguuaggaguuaaguugcuauggggcaguggcuuuuaaccuuccuaaugcuauaaaccuuuaauacagucgcucaugugcugacccccaacauaaaaucccaacccauggagccgggcggugguggugcacgccuuuaaucccagcacuugggaggcagaggcaggcagauuucugaguucaaggccagccuggucuacagagugaguuccaggacagccagagcuacacagagaaacucugucucgaaaaccaaaaaauaaaaaauaaaaaauccagacccauggguugagaaacacugggcuagggcuucucuauagucuugauucugggguguguuagcaaaaggauagucucaaauuaaguucaucaaacauuuauuaucaaauagucacugucagccagauacgguacaugaguuugagggcagucaucccggccagcccugucucauaaacucuagaaaguaucuugcauguucacuaaaggcaaauccuuuaaaggauuuagccucucagucagucaaguggaacaauuuuccucauggacuagucccauguucuauuccuaaaaggugcugaaaaggucagcuuaggaacuuugggaggucaugaaacacuugggaagggagaggcuaauuagcauuuuucagacaacagggcaaaaccgaccugcauguggggacacauuccacaggauagacaguugcccaccuucagacaagggaaguccuugucaccucauucccuaaagaccaaucaguuuaaaggguucacuguuccaccaaucauauugugccuaguugcugaugcuauauucugccccuggaaaccauauaaaaacucaccaaacgacugcugggggucuccgccucuccuucaggucuccucagugcacuggaauaauaaauuccucuugcuuuuugcauagaucccgguuccacgugguuuacucuggggguccccaguaagcuaaggcucccuggagcuuuacagugcuacuugcuauaauugguagcuuguaccccaguuucacuaucuaguaaauugacauaauaacuccucauucuuagauugauaucaagaguaacggaguucaggcauagucagucccugggucugugaaagccccuaccuggcacacagguacugaguuuaugccagaaacucucuccacccccagggaacugauuguauaccuguggaaacaaaaugaauauuugaaaaaguuauuagcuacaaaaaaacagaaagauuauauauauucugcuccaaggaaggcucuuuugaccuuacaauucuuaaagacgaaucauugacauuaccuguugugcuggcugguuuuaugucaguaugacacaagcuagagucaucagagaggagggagccucuguugagggaaauuccauacaauccuacuguaggcaagccuagagaacauuuuccuaaucagcgauugaccucagaacagcccagcccauugugagcagugcaccgcugggcgggugguucccaguucuaagagaaagcagacuaagcuagccagugagcagcacuccuccauggcuucugauccugucucaagguucuugcccugcugggauuccugcccucgcugcuuucaaugguaaacuauuacauggaacuguaagcuaaauaaaacuuuccuuccccaaauugcuuuugguuaugauguuucaccaaagcaauaguaacccuaacuaagauaccugugcagcuguauuaaaaacauaaccaacggggguaauguugcuacagcuacccuauuaaagaaaaaguuuaacuuccagucucaaagcaccgcuucucaucacugagggaugagagcucagcugaccuucuuaggcuuccuuccaaucaguaguuuucucagcuugacuuuagucauauuuaaccuuuauccccccaaauucccuguuuuaguugcuuauuuacaaaaguaaauccacauucauuugcuucugucugcauuuuaaccacagagcaaauagguugcuaugcagagggaaaggcuaaauacauaccauuguugucuagaaagcucaaaacagagacuucuauuuuggggggcacuggaagaugaaaagugucagaaauaggaagucaccagaguaaggagaaagccagacaugagcugcuaaauauaagcaauuauucuauauucucagaaccuccauagagcagaucauaaauggacacaauuuuuuuaaagcuauaaucccuugggaugaaaucuaucagaaguuuggaaggugagaguaacuuucagcagagaaaaaagcugugcuaacaaaaaaaaaaaagcaaguucaucaaacauuugcacccauucucaacucucccaagccaggaaaguauuugucacaaaggacugagaggcugguguggacauaagagggaaauuccagggaauggaagaucaaauggaagacuucaaagccaaauccaaaauuccauugagaagaucaaagcagagaaagggguuucugagaguuaggccagccaugcuggagagccuagguagacaacucaaacgcuccaguagcauccauguggaagacagagaagaccuuugcccuggggagaugacaguugcuuggugauggcauuuaaaaaaaaaaaagaucuaauuuuuauuuauaugaguacacuguagcugucuucagacacaccagaagaguauauugaaccccauuacagaugguugugagccaccauguggcuucugggaauugaacucaagaucucugcaagagcagucagugcucuuaaccgcugagccaucucuccagcccuggugauggcauuuuuaagacagggugacuuccguaacuugguuguuccagggcccgcaucauuagguguccaugacaacagaugacuguccuacucauuuuuuuuuguuuuguuuuguuuuucaagacaggguuucucuguguagcccuggcuguccuggaacucacucuguagaccaggcuggccuugaacucagaaaucugccugccucugccucccaagagcugggauuaaaggcaugggccaccaucccuggcucuguccuacucauuuaccuagagcagaggcugucgaccuccaacuacccuaacuugcugucuuaaccacaaucuucauuaucccuggaaagugaguggacgaacacacaucuguucucggugaguuccaugcacaccaagagucaauagguuugucauagacugcuuaaugcccuuuauacaggacauuguaguuacauaauuuaauuauuacauaaagccacaacaacugcaguguggaggagagcggcuguuucuaugggagcuaaaccaagaguacuacucgugccuagcacaggaacauccuggccagggcacaaagggcaugaacccacaggagcggagaagaaggcaguggugguuguuuaauaagaauaagagguuauugguuuggacuaaguuccugcacugguccccacaggccaagcuggagucauucacccuaacaucuuagucaacuauacuuuaacaaaucuauuuaacugagaaaucgaacugaggauauagccccagggcagaacacuuaccuaccuggcaagguuugaguucaaacaccagcagaguuaauuaauugacuaauuacaauggaccugcaggaagcugguauuaaacaauccauuauuuuuuauagcuuauucuuccucuuccugauuuuuuuuaaaguaacuucuugcuuuuguucuuaacuuucuucagccuuuuuacacccauaagcucagucaccucugcccagcauugcucaacucuggaccuaaagguaaagccaguggagaugcauauauaauguuguauauguauuaauucauguauaugugucuguacacguguguggagaccagaggcugauaucaugugucuccuccaaauugcucuucaccuuguuuuucaggcagaagggggucacagaaucuagaguucucugauuggccagacuuguuggccagcaagcuccugaccuauaacugcacauuaccacaucuugcuuuuuauguggguggugggaauccaaacucagguucucuugccuauagaacaagcauuuucugaccuagccaucuccccagcucccuaaguuguaguguucaauugcuaagaaaauuguagaauaggcaagcuggaaauuaauauaaaauuucuacucuguuguugucuauagagggggaaaaaaccacuucagaaagcaaagugauugcaaacacagaauuacaacaacagugaaacuggguaccucuaucucuugcuaacagggcacacagcuguaccuucccuaacuguggcagaaaagaagauguagaagggcuguggacuggcagacaagaggcuugcugaagaaacaaagggaacauagagaaaucaugggagcugggggaaagguggcauacugaaccuugaacucuagcccccucccacuaggugccugccaagacucugacugccgggcaggacuuggauacaaaaugagaacacugggcccuugguuuuuguuuguuuuguuuuagaaucucaagaaggagggcagaggagauagcucagucaagaaaaugcuugcuuuacaagccugagaaguuaaguucaauuccaguacccacaucuaaagaacccaggagaauugucaucagcucagcuguggcccugugugcaaccaucccaugucgacaagcaagacgagcccacuacugcacaggagcaagacuacugcuuguuucacacugcaauguuuuugcuuugcaaacagauuuucgcucuuaagaaaaaaagcauaauaguugaauuggguaaaaacuuguaauauuuuucuaucauuuccccucaguacauaacuauuaaaccaguauauuuuuuuuauuggagucugauaguauguucuaaaaggacuaaaagaagguaaucccuucucuuaucuuuagcuagaagcauggacaaaagcuauauuuaaaauguguccuuucucuccuguaacacacccuacuuguguguguaugcgggggaguugggagacuuuucugugcugcaacuaaacauccuuuuuaaaaacaacuuaagggcuggagagauggcucagcaguuaagagcacuggcugcucuuccagagguccugaguacaaaucccagcaaccacaugguggcucacaaccaucuauaaugggaucugaugcccucuucuggugugucugaagacagcuacaguguacucauauaaauccuuuuuaaaaaaugaguuaagggaggaguuucuugguuuaugguuacagagagauacagucuaucaggacugggaagacauggcagcaggcagagaaggcauggaaguaggacugaaggcuggccauaccaugucuacacucaggaagcagagaguaaacaguaaguggaguugggguauaaaaccucaaggccaacuuccaguaacucacuuccuccagcaaggcucuaccuccucaagaucccauaacuuucccaaacagcugggaacugaguguucaaacacuugagucaaugggaaauauuucauaguuaaaucaacacacugugcaggugacaucugucuaaccuauguagcacccuguguagaugggacuugagaaccaacacaaggcacugcuuaguuucuguuuugucuacaauaguuuguuguuguuccugacucuucuucuaccucugcccauaccauaaucugacaaaauauuguuuucauguuaggaaauaugccaguuggucuuggugugccuuagacuauuuucuguugcuauaacagaauagcucauuuggguaauuuguauaaaauaaaggaguuuauuugguuuaugguucugaacaccuucuuggaggaaggggaaggacaaguagucacaauguggaaaaaaacugggauuucuuugaaacccccugcucuuugaaagugaacccaguucugcuggaaagucaauaaccucucuuaaagacccacuaccaacaccgcuacugggacaaucaaauagcuacgugaguuucaguggagaggggguagaggggggaguaaaucagauucaaaugugacaaaggacuaacucacuggagguguaggguaaaauuuggagucagcccugucaccauucccccuucucucuaaggucucagagaagcuagaucuguaacuaaaugagaaucuaaauguuagcuaucuucaugguugaccaggcagcccaaaacaggucauuguagccccucuccugcugaucagauagaagggaugcugagauccguacaaaccuagcucccuggauggaagauagcugccuaucccguagcacagaauugcucucccucccuagccucagucacaggcaaagaaaacuagacaggaacaggaaaggugcucugcagagcagagagggcagcccagcuccauuucacuucgguggcugcacaaucucaucuucggugaaaugcaagguucauugagucucacaggucuuaaguaacuauaugacucaguucccuuucccacggauaggcaggagccagauaugcuuaauuuggauauucccuaugaugcucauuuuguaucagggccagguuaccacacuccuaguuggagcaugugccaauaggagccuccaguguaaccgaacagccccuuucacagcuccuucaucuguagcauuugaacaugaguucuucuagccagcugauaauacuuaagaccuugacauuggaguaacacagagaaccaaacgacaguauagauucuuuccacggauggcagagaaagcaguaauguccagugguggcugggccaaugacagaaauuuggauacuauccacacucuuccuguguauugauuuggucucuauuucuggcugcuucauuucccaugguuccuguccacgucugaacauucuucagcuuuuccauccauuuuaugagcuagccaguguccuaucaauaaaguccuuucucucuaacuaagcagaguaagccuccauuguuuagaaaucuaacuagcacauuacaucuuucaugcagaaacuugcccuuguggaggcaaagaugacaaauagaguucccugccuugucuucugucuuaccaccucugcgugguaugcagucgggagaaugauggucaugugauuccuccgaagcacaggguggauuggagaaggcuacauauggugugauuucaaguacaucacacucgagagaaacuagcauagcugugguuuaucugucuucuucaaagcucagauugaaagggaauugucacuguacagugcuaagacuugagacugggaacuggagauaguucuucagccaggcaguggugaugcauaccuuuaaucccagcacucaggaggcagaggcaggcagaucucuuugaguucaagagcagccuagucuacagagcaaguucccagacagccagggcuguaccgugaaacccugucucaaacaaaacaaaaccaaacaaagcaaagacuguguacuccuuuugcagaagagugaaguucaguccccagcaccuccauaugcuggcaccuucauauugccuauuucaagcucuagugaaccugacgacucuggcauccacagaacuugcacucuccugcccacuccccauacacuaauauauauuuuuuuaaagaggcaaggccagaaaccauguggauguacaugauccacuccugcacugauuauaaagggcaggugugccaggcucgccagcccgagucgaacagucucugaugggggagugaggauuaaugauaagaaaggcagaaaaagaugcaaagucaagauuuagaauugagagggcugcaggucaauacgacgucaguuuauuuuucuuagccuuuuuauacuucaccguacugugggaagcaaagccacaagcuaacagaaaaaaaauugauaaaauauacauaagacaucuguucucauccagacgccuccccaugccguccaccaaggucgguagaaccuucggcucccucgccuugagccucaggugcaccuccucuuauagguucaugccucagcaggacagggcaggaaaucugcagguagacccugaccugccuagacucugccuggcaggcagacuuucuuuuauuuucuucucugcuucagagaaacaggcaaacggcucccaacaggcaagggaacuacuuuugcgauggcauugauggcugcagacacacaauucaaaaaagagggacaugaaaggcuuugguaauaaccccuuuccccaccaugcccccacaaaaguaacagcaguacagauuggagugaggccggcacgagccauggaaugcuagcauucuuagaggcugcaacagguaagaaaugaauucucuccuggaaccuccaggaggaacuauccucacugacacuuuaguucuguuccauauuaguaauuuuauacuuuugaccuccagaacuuuaagggaacaagucaugcuguuugacccacuaaauguguaauaaucugucacaaaggcaauagaaaguaguauguguuguacauuuuccuuuuggaaaugaaauacuuccaaccuauaacuauuuauaaaacuauggcuuuuugguaucaugccuuaguucaaauuuaaauucucuagccugguacuccaaacuccacaauuuacuuguuggcuauuuaggacauuuaagagcagagauaggcuucucugcuauggacuccuuuuguaaacuuucuaaacuuugugaacuuuguaaacuuuguaaacucucaaggcaggaaaguggccagugcugccucaccaccaccaccuggggcgcuccaguagccaggccuccccuagacuuuucuaacugucauagggcauuuccagacuugguaacugucacaaaggucaucuccagcaccuuaauacaacucucuccaaauuaugcuaauuauaggugaaacguaugaacaggaaauuccacccauccuugaucucccucaaacucaggacuugaagucccgcccaucgucacccuggaaaucucccuagaggagcccagcccccaaaaaacccuauauaaaggcugugucugcucaguucccugcuaucuacucacaggaacagaggcagccauuccuggauuuauccuuucacauccugaauccuccccauaaauaaguuuuuugagauuugcuuuguggugugacuccuucaucagaagaaaccaagaagaaaugaagaagggaagagguggcgcggggcugaggcuccugagcgucucaguuaagcuggggaauacccuuuccugggagcuguaacacuucugcugaggaggcuuccucucagagcuguguggcuccugggcuucugagucccagaacaccuucccauaugaguggaaagaccagcauuucaccucacccugguuagcuuucuguagacacaccacugucccuuagcucuucucacugccuuuauaacacuccuucacccucuauaucucuguguucaauaccuugucuguaagcuuuucaugacuuagcuuccuucacugacccauccagcagguccaguuauucgagggucucgaggggaccuucuccuaagaaccaaauggggggagagaaggacggacaccaaguucgagaaacgacacguaaacagucugagaagaagcaucaaagugucacuguauucagcaaggcucaaggcuuaaaugcacaagcaaaaggggaagcacuucucagcaggaggaauggggcaguggaaaugcacaagcaaagggggaaguacuucucagcaggaggaauggggcaacggaaauuuuucuuuuuuucuuuuggcaacuacacggggaagcaagaacuuggugguaucaggguacaucuugaggucaggacaucuggcgcugacuuagggcuggaacauucugugguuguucucggaacggugcgucaguggcccgcuuuugacccccuuuucuucuugguggggggggggggagaggcccaauucggagaucaagacaauagaguugucuuaauaguucccaacagugauaacuaauuuguaguccucaaaauacuuacaacaauuucccaagugugcuuguauuuaguaguucuuucacuuagggcuacacaugaggcuuccagauguaauuaucucccuguggaaucucucuaucuuauguuggcccaaucuuccuugcuaucucccauuccucuuuuugaagaaggaacauuuuacuccauaaauuuuauacugaaaauauguaacuuuuaaaucucauuuuauaaggauuacagucaagaguuugcuuugagucucagaagagacuuuggaauuuugaaguuaagacuuugggaaagucuggcuguccuggaacucacucuguagaccaggauggucuugaacucacaaagaucugccuuccucugucuccagagugcuagaauuaaaggcaugggccaccacugcccaggaacuuuuggaaauugcagaugggccugguguuguuuauauuuugauguuaauuuggcacuccugggagagagguaguggacaaggagugagucauguacccaggugacuucuugugaaccaaucaccuaaucaauaaaggagccaaucacugggcgaguaggugggacuuccggguuggauggaggaagaggaggaggagagaguuaggggcuucuuggaauggggauaauaacaagauauagcugcaagaguuucccuguaucauggcagaucugucaggauuugccacuggaggaaucagauuuaauagggcuugcaagauaagguuuuaguuguugugccugagauugaguuaccauuguuucugaguuaaauuugugugguguuuuucuucucccagcgauucaacuggguuccagggagaaagguacagcggcaaagcguggguucgccugauguucaccacaaaggccaugggggcuuugaagcauggggcuggcaugguaacgacccagcagugggaaccuagugagcuggguggagagauuuuggaguucugagucauagucuccacaaaauaauaacaggucagccauugccugccagugcauggucagccagccccauggggcagaaaguugccagugccuggugguagugugggaacuugccuggucuuuuuaaauauuuuccgcaacaggugccgaaccaacgagugaacaagaauccccuagaaauguaagauuauuagccugagaguuagaguuuuauuuauuuauuuuuuaagauucauuuauuuauuauauguaaguacacuguagcuguccucagacacuccagaaaagggcaucagauuucguuacagaugguugugagccaccaugugguugcugggauuugaacuuggcaagaacagucagcacucuuaaccacugagccaucucaccagcccuauuuuauuuuauuaagugagcacugagucaaguguacucaagcacugggaguugaaacaaagaaagcagcucugagguccccugcuguggggaguugcaggcugcucagagucaggagagagaaaaagaaugaaguugccuacuuuuuagggcagaggaauugaacuuugaauuuaaaauuggaauuauuugcuuuuaggauagauuuaugagcuguccaaaucacgugaggaauuucaccugcgguucagaacuaggauagggaaaauuagucacugacuccagaguagagaggcggugauaauaauugccugcuaugcacagguauuaaauaauauugucugugacuccagguacagagaccaacagauagauauuauacagauauuaauaaaauaugucuguggcuccaggcagagagucaaacagauaaauggcauaacaagguggccgcucuaggcagagccaaacaguaagaugguaugaagauugcuuuauauaccucacaggauacucaaauucugucuaacaugggcuccacgggaaucuugggguuuuuuauccugcuuggcaaaauagacaaggccuaaaaauaggcacauacaguaauguaguuuacuuaauuuguuuuggauuguuuuaacuuucaaaaugggugugauuuugaguuuugugguuucauuauucaucuggaagagagggcaggauacaaacuuuccugguugccuacugaaggauaugcuauuuugggagaaagguuuugucuuugcguguuuagaaaaggugauuagggucuuuacaccuuccagaguuauauggaucagauaugaugaagggagacccccaaaggacuagauuccagagaaucaaacaaaaaguauauuuugaugauacuaaauuuuuuuuuugagauuuguauauuacagaauauacagccuuggugaaucuccucgccagacaagcugaaccauuugaacuccugauguucuggacuuucagccggauccagucaagacacagacaucagagacuauucaauccuauuuucccuauccuucucuuuuuaagaaaaaauaacuuuuuaaaacuuauucccuuuauaccccacucacugccucccucaugcucaccccuucccacaaucuuuccuucauccccucuccccuucuccucugaguagauuccuaccugccccuguccccuaucacuucaaggcucucucgagcuagguacuucuucucccacuagggacagacaaggcaguccagcuaauagaacauaucccauguacaggcaacaacuuuuggguuagccccuguucuaauuguucaggauccacaugaagaccaagcugugccuagguucagccuguguauauucuuugguuggugauucagacucugagagcuucaaggguucaggccaguugauuguauuggucuuccuguggaguuccuaaccccuucgggccugcaauccuuccuccuauucucccauaaguaucuccaagcuccaucuacuguuuggcuguggguaucuauaucugucugagucagcugcugggugaagccucucagaagauaacaugcuccugucugcaagcauaacagaguaucauuaauaguguuagggauuggugcuugcucaugugaugggucucaaguugggccgguuauugguugaccauucccuuaggcucugcucuaucuccugugccugcacuucuuguagacagaauaaauuuuggguugaaaauguuguggguggguuggugucucuauaacuccacuggauuccuuucucacuacaggagguggccuuuucagguuccauacccccaguguagugagucacagcuaaggucacccccauugauucuugggcgccucccuuauccuaggucucuggcuugucuuggagaugccccccaacuuuuagaacucauaaaguuggauuaaauauauguuuugauuacuuguuccugcccuaggcuuaauaauuugggggguuguagagccuacaggaggugugguggagaaacugugcccuccuccuagccuugagccgcugauuuagaccuugucugcuacagucagcuagccuaccuagggugaagucuucugaccuagguaaaguuuauuguccugccaucugcagcuuccugcaagaagccacuaccugcugagcagcugagcuuguuuuccugacaggauccugacuaaguuacgaaaucauagugggggauggguuuuccacccuuuuaaaaaucagacccuagaauuaaaguugagccuugaucagauaacuuugucuuggcucguuauuucucucaccauccuucccauccauccccagcuuuccuucccauccauccccagcuuuccuuucaggaacccaggaaccuguggccacugguggcuacaagaaacuaaagaagauuucuaggagugggucuuugaagguuaugaccuugccuuuaguuccagucacacacugcuuccuggcucccuguaagaugagaaguuuucacuguauacucccacuaucaugaauccugccauacagucuccaccauuguggacgaaagcuuucugaaacuggaagccaaaguaaaucuuccucauagagguuuauuguuuugacacagcaacauaaagauaacuaauacaaccaugucugcuugcuuuuuucuuuucuauuaauagugguuaucacaacaccuaggacugcauugcuuuuaguacuccaagcaaaaggacaaacacuaucuaagcaucuauaagucaguuucauaauaggacccugauuaggucugcugucaucagaguuuguaagccuuuaaggaaucacuuugauuaguaaaaccaagaucaaaccagacuauaucaucuugacagguugguguguuguguugggcaacaaaagagaaacacagaagcaacugacaugagcuuccaccaagaaaaugcaccacugcuuuugucuucuaagacuuguaagugugaaaugacugguaugcaugaugagacauguguagacaccauggcugggagauaauucauuccagaaagucauggaaacuucccuugauaauguuacugaagaguucagaucagaaugaagacaggaagagaagucaucuugguaaaaaggaggcuuucccaccagaagaaccaagauaaacaugcuccggcuaggcugagcaggguguuaagugagacuuuagaaggcacuuaacaacaacugcuuuugcucuagccccucacauggggccacaagguaacuaaaagcaugauaaaacccuagcaagucaccuucauuucuaucugucuccuuugcuuugggucaguuaccugcuucguuuugcucauaggcacaauauucaaagaaugucucccuaaaacauguuguggggcagggcaguaguggcacacaccuuuaauccuagcacuugggaggcagaggcaggcagauuucugagauggaggccagaacuacacagugaguucuaggacagccagggguaaacagagaaacccugcucaaaaaaccaacaaaacaaaacaaaaacaaaaauacaugguguggugguuugaauaaaaaugccucccauaggcucauauauuuuaaugcuuagcaaccagcgaguggcacuuuguggccuugugggaggaaguguguugcugggggaugggcuuuguaguuucaugaaaaguccagagugucucugucucugucucucucucucucucuuacacacacacacacacacacacacacacacacacacacacggucuggcaaccaggauguagaacugggcuacuacuccaaugccauguaagcaaguccccaguuaguguuuucuuuccuuagaguugccuccggucauugugucuguucacaauauaagagugacaaaggcacaugguaauaauacuuaaccuaucucauaacucuuuaaagcuaaagacacaagaaugguaacugagcuauuuuacugucagcuuuuuacagugucauguuccagaaacucucaagggccagaaagucuccagucauuguccuguacucaccuuggauccaggacagcaaagccuucauacagaucauccaucuuuggccaagacugcuuaaccaugaguacuucuugccccauguuccaauucuucuccuguuuauauaauaaggcuugugucaguacucugaaaauuaacuuggagucauuacaccuauuaaucuguauuucccaauguaaucacauugauuaaaucucucuucuaugcuuuucauaauuacuuaucucuuuacaucauaaauuguguguguacuggaauggguguuugugcauggcauguuggcacuuggacccagggcuuacuuauuaccuaaagcuccgguaguaaaacugaagaggcagguagaaaacaaacuauucaaacuggguggugugccacacaccuuuaaucccagcacugggaggcagaggcagguagcucucugaguuugagaccagccuggucuacagauugaauuccaggacaaucagagcuacauaguaagacccugucuuaaaaaacaaaacaaaacaaaaaaacaaaacaaaacaaaacaaaacaaaacgaacccagacuguuauugcaggucacauuuaaugguguacauuguaucuuuuuuuuuuuuuaauuuauucuucucucacaucccaccagcagucucccuaccuccucuccucccaaucacccacccccaaaccuucccucucucccagauccacuccuccucuauuuccuuucagaaaagggcaagccuccuugguuugauaucaaccaaacauagcauaucaaguugcaauaagacuagguauauccccucauaucaaggcuggaugaggcaacccaggaggaggaaaaggguccagaaacuggcaaaagugucagagacagccuuugcucccacuguuaugagacucacaagaacucuaagcauauaacauacaagcagaggaccuaggucaggcccuacaggcuccuugauuguugguucagucucuuugagacccuaggagcccugauuaauuuauucuguggauuuuguuaugguggucuugacccuucuggcuccugcaaucuuuuccucccccucuuccacaggauucccugggcugugucuaauguuugacggugugucucucuaucagcuccuaucagaugcuggauggaguuucuuuguugacaauuuugguaggcucuggcccacaaguauaguaaagucucaguaagaauugucucauugaucuuuguuuuuuuuucugguuguguuugguucuauccuaggugucugucugggcuauccagcucugguuccuggccuucagggagugucagguccauugggcucccucuccucucauggcucuuaagcuagaccagucauugauuggccacucccacaaauucugagccaccuuuaccccagcacacuuucagaaaggagaaauuguagguugaagguuuuguggcuagguuggugacccaaucccuuuucuggaagucuugccugguuacaucagauggcugauacaggcuccauauuccccaucacuaugauucuugggaguuuccauugcauggaguuucuaccuugcuccugaaaugccucccaauuccaguagucucucccaggacucucuuccucuacucaccccucaucugacccauccuguuuccauccccacuuguuccuagucaacccacaaaaucuauucuaucuccccuccccagugauauuuauguguaauuaaaaagaucaccuguacuuugcagagcugauggguauaaauaacuacaaaaauauauucugaguuuuaaguugauuuccaacuuuaugccuuugugacucuuacuuuccuauuguauuauacugaaaagagagucaguuaaaugaaugagaguuuuaaagugaaugauuguuuugaaaaauaguucacuccuuuaugagaggugcgggggugguuugcauuuuuggauuuuaguuuuugggguuuuuuuuuuggcuugguuuuuauuuuauuuaagauuuauuuauuguaggaguguuucaccugcauguauguauauguaccaugugugugcuuggugauuuuugaggucagaugauggaguaagggauguugaaaacuaaaccuguaccuuccuccuucacauguucuuuuaaaagucaggggaaaaggcagcaggaugucuuuacagucuuugagagcagguaaggaugagaauucagcaauuucucugcuccuaccucucaguuucugggggugcaucaugacuuucaauccuagcauccugaagcucucaaaucucuagccugcaggucuuccugaaccucagagucuaaaucuaauugucucuuccacauuuccacuuacauuucuaaaaaggauuucaagcuaaacauaaaaguccugacuucugccuucaaacuuacuucuucuucuucuuuuuuuuauuuuuugguuuuugguuuggggagacaggguuucucuguguagcccuggcuguccuggaacucacucuguagaccaggcuggccucgaacucagaaauccgccugccucugccucccaagugcugggauuaaaggccugagccaccaccguccagcucaaacuuacuucuuuuuacagcuuguucucccaagcaaucugaaugcuccuuuuaccuuccuuuaaaaccaaauguucuacccaacacauuucacuaacucuaaaauauucugagaauucaauguuccucacuucaacuauuaucacacuggcuuaaaucacuaucauugugaccuggaucauuguaauaauuuucugauaccacuuuucaccagcuaauucauaucgauucauuccuggauccuucuguguaaucucuugaagacugacgacguuuguuucuuucauuuauuuugaaauauguauauuuuccaauacaaccuuguauaugcuccacaaguacuucuuggaaucaauacauauuuuauuacauuacauaaaugccaguauauuuaugaacacugauaguaagguacuuuuuaugaagaaaguacuaaaaaaagaaaugaguggggucagcagauuaaaggagcuuucagaaguuauuucugaucuaacucaguagaaguauuucccucccaccuagcccauaaccuguagguauaaacaacucuuuacugccuuacaagguccaccacuaaccacugauugaccuuaauccucuuuaauaaaaagcaggccuacaaauggagaaaaacuggcuaaccuuuagagacuguugggaguguccaagagagcagguuuaaaaaaaaaaaaauccaaagacagggaagaaauuguugaaggcuauuuccccgaguuggcuacaauuagaagagaaagauaauauguuacaaaaaugcugguuccuucugcucucugaacaggacacacagcuuaacugacgucaaucacccucuagcuacuugggcaacuguguacagggguaaagauaccugguaccugguagaggcuaaaguuaccgaggaccaggacauaucauuuggauccagcaggaagagauggucauaagauagcaaaugaccagagacaaauuauccguaagaacaggccugacaagugaggcccagguucacauuaaccugaucaaaccuggcgcuggaugcccacacggauugugcgccggaaguugggaggaaauuaccccuauccaagauggcggcuacggagacgagcgccuggagcgucuuugcccucauccaagauggcggcccccgugggcgcugucccggcuccgccccgugccgcggccccgccucucccucgucccuuccuccgcccccucguagagcccaguugggucugaggugcaggcgcgaggggagcgggguugcgggcgcuugacauggcggcagcggcggcgacugcagcgaccaaggggaaugggggcggcaguggccgagucggggcuggcgacagcagcggcgcgcggaagaagaagggccccgggccuguggccacggcguaccuggucaucuacaauguggugaugacggcggggugaggcuggagcucccuccccggggaggcggggagcgagcucugugaccggcggggucggacccgcagcccggggcggccgc

SEQ ID NO: 8226 - RNA, 52790 nt, Mus musculus
cacguuggacgcgggcauccccgcuggaaggccacucccggccccacaaugcacugcguggcacgucacuccgagccgcgggucccggagcgacagguauggcccggccccucuuuucagcuuccucugggucucccggagcucuggccggcugcucgcgccgcucucucggaguuccaccucggcuugaccgguaguuguccgagccggagcuugguggcgguggccucagagcuuaggaggacgggcgugcaggguccgagucccugcgaccuagggcugcgagccucgcgggcggcgguugcuguuuagcaggccuguccuaggaugggcggcuggaguaggggcugcugacggggagggacggccgucccgggcugccagcgagccguaguguugacucccuggcucccgaugucagcagcacaccgacucacucgggcugguagguggcccgagagagcuugagguggcauuccuacuuucuuuugggcgggguagcuuguacccugugauuugugaagucugaaugggcguugcaguuggacaucuuacucguuggcucugggaaaucccgugaggcccuguuuuaaaggugcuuugcgacucucuguggcagaaaagagaccugagaaauuggcuccacaaguggggagucuccugcugcuuagcuuccgggaucaccaucaccugggggcagguggaacucuucagaacccgccccuccugugcuuaacccugggcagagccugggugucccgccaggcuacacgugauagaaucccagcggauuaguacaaccaccauuuuuuuaaaaaacggaaucacauuccauguuacugguacccacucguuugccaguaccgugagaagucgguuucuuaaacaauacuuagaacuucuaguguguaaaggaagacuugagagcugaaccugacacccguaaccaaaaguuacuaaaggaucggccguuuccacuuaagaagaucacaucaguuuaguacuugauuuuuagagacuggguaaaguuuaaguauauuuuaguuugguguaugaaaagacacuagcaaagagauacuugccaccuuccucuccauguaguaacgaagccuggguauguuuagaggcagugucuuauagaguuauuagaguuaguaacaacuuauuacuuacuagggguugaacaaaugacuuaagcuuuuggaaccuguguuucuuccaaagcaaagugaaacaaauacccaaccuuaccgguucccggaagguucaaaugagguguaugaaguggaucuuaaauucaauuaaaaaaaaaagauagguaacuccuauaauauucugucauauuguaccucugggcacuguaggcaggucauuauuagagcuugcaggguucguaguugggugaaauggauggcugccuuucuccagucacuugcauagcaacuuguagcacuaugaacacugaccaguaggggugaagcauaugugugccacagcauagguaugcaggucaaaggauaaccuaagguauugguucuugccuucccaccuuguuugagacagggucucuuguucacugcaauauaccaggugaucuguccucagagcuucugggaacucuuugugucuccaauucccaucuaccuguaggagcccuggauuauagauaucuccucauauaaccacgucucaauuuuucuuguguucuggaaagccaaacucccgucaucagauggcuugcccuacaaguguuaccauucagccaucuucccagcuugcaaaugcuguuuuuacaagcuuguuugguagugggagagauggcucagugguuaagagcuuuaguuacucuugcagaagacucuaguacccccauagcugcucacaacuaucugcaacucuaguuccaacauaucaaguucuuccucucuguucuccaagagcaccgggcaugcacauggugcgcguacauacauguggacagacacucauacacauaaaauaaguuacauauuuuuaaaaaauguguuaauuggaagguucuuggaauauauuguguuguuaucuuaauacucugauuauuacuaauugugaaaguuguauaaaugcuuaccaguuuuggccuugauuuuuauuuaauucagauuucucauuuuauuuuaggucuucuguggguugaaaugucuaugauuuugucugccucagucauucgugugagggauggacuaccgcugucugcauccacugauuaugagcagagcacaggaaugcaggagugcagaaaguacuuuaagaugcuguccaggaaacuugcucaauuuccugauagauguacacugaaaacggggcgcuauaacauuaaguaagaccucaguuugguucgcuagagucaguugccuguagguugccauuuucaugaaauguaaaugguugcaagaaaaccucauguuugagugacucugagaaacuugaagucaacauucauguucugaacuuaccuuaaauaguagucaugauguuauuaaccuuuugucuuugcagagucucuggauuggauucuggcuuuagaagacuuuauauaaguuuuucagauagugcuuccuguaaauugcucgauaacuauuuaguagaguuuucacaugcacaagauuguagcaagcaaauuguaauggaaaauguuaaguacaguuuuauccuacaguuuuauccuuuaagacugggcaauaggauagagugugacuuuacccugugcugacugcauccuucaggaagaaugauauuugacccgaaccuuuaaaaaugaaaaagaagacaguuguaugaaggacccuguggauggggaguaaggcuggagaaacucuuggauccaucuuaaaggguaggaggaaagccaguggugccgaagcaccuggggucagucagguggcagaacuugaggucaagaagguaggaaugggacaggcuauuuaggguccucuacgcugugaugaguguguacaccccuuuauuaaucuugugcaauaggaagcugcaggggaguuuuaggcuggagaauuguauggucuggucuugacucagcuuggauggaccaagccacuuugaagagcgacugagcaggagcagagugaccgcuagggggcgcuguagagacgacaggugcagcuugaguggguaguagaguauuuggaguuaagcugcauuucaggccugucaccuguaaagggcccugagaggcuuuagggugcgaaggaaaaagaaaagaaucauguagauuuuuggccuuagaaacugcaugccuaaugggacuacaaugagcaagacuagaaagguuuaaguugcauuucacugguaagguuucuguuuggguguguuaaaucugagauguccaaggggcauggucagcuggauguaugagccugaggcuuagcaaagaagacaauugugggguuuagauuuagaaaucaguuuaugauuuguuaaaauggaaacuguuaaaacuguggaaacaaaugagaccacuuuggacagcauccauaugaaacaauuagaacaguuaacccaggguccaugaugcuaauuaugaacauagaaggaaagcagauaguaacaaaguggguuuuaucagcaacauagccuuauuauuaagaucagacacuauauuuugaagaauuaaaaguugccuaaggcaggacuaggcaucacagcuaagaguaaggcagggaggcaggagaagcagugugagagccacauggcagguugacuuggugcugguggaugaagauuugcagguagcuaugagacaagugugaugacuaguguggcuccagguucugcugccugaaaguucaggcggagggauguuacuguacacagcaggcugcaggucaccgcugcagguuugaagaaagccauuugauuaaaaaucaagcaguguaaggagugguguguccuuacucccaggacucaggaagcagaggugggcggaucuauaagucccagcuagaacuaccuagaaacaaagaacaagguacaaaaccaaagcaaacccaagacuauagaacagagaguaaaacagaaaguuuaucaaccugcuacuccagugugaaguaaacaaauagauguacaaaugagaaagaaaaugccgaacagaaaaauggcucaaaggacgaaauggucaagccugugagguggaauacuagagaugaagaaaaggagcgagcacagaaugauaguguccucagaaaugagcaguccuuggagaaggauggcuuagcuggcugaggaggagggacagugaaaucccaugugauuuuuuuuuuuuuaaaugggagauggggucucacaguauaguccucgauaguauugaacucauuagguaggccagccuggucugccugacucggccuaucuuuugcuuuuuuuguuuguuuuguuuauuuguuuguuuguuuuuugagacaggguuucucuguuguagcccuggcuguccuggaacucacuuuguagaccaggcuggccucgaaaucagaaguccgucugcuucugccucccaagugcugggauuaaaggcgucgccaccacgccuagccccugacucguccuuucuaugcuaggauuaaaggcaugugcuacugugcccagucuucaugugaucuuuacagucuaguggaaggaugauggggauucuggaaccauuuacauagauacaguucaaauuuugagggcagaaaugcucacugaauuuagagaaggccaggauagagccucagagaauguccacaauuauuuagaucacauaacucuaaaauaaugggauauuacacuuaccuggaguuuuggaagcuuaucuagaaaaucacauuggugguagcgguuggauugaaucuaaaggcuaucucagccugccucuacuuaggugaagacaagaccuugaagcguugaagcauuguaagugguggcauuguaauguccucugucauucucagcucugucuguuguaagguagugcuauagacaugccguaguuacuggggacugccugaagucuacgguaauauugguaacuaccuggaauuaaaacacaaaucuuucaauuuuuguuuugcuguaucuucuuaaaaguaauagaaauguaccaaauuuuuacuaugucccaauccuauuuaauuaugaauuuuagacuuuauaucauuucuucuaauccugucuuauucuauacaaaggauuugaugcaauuuucaaauacaauaauacaagaggguaaaugaagaaaucagaugaaaggaguagauugaggggauuaaaaaacagagguaacacuuucuggagauguagcccguguguguguguguguguguguguguguguuagagcaggccugcagguacugccugagcucccuugugucagaggcaagguugaaggucagucaggagacucaguuucccuguaauacaggacaggggcagcauugugcuaacccuccuccgguagcaguagcgagccugugugacuuuucuuagacuccuugguauaagcaaauggcaugauaggacauuuauuuuuuagauugguugguucauugauuaguugaauuuuggcuuaaaauugcuuuuauauuuacuucauauagguguguucauauacauggcauacacacucuugcacaccauggcacauaccacacaacuguugggaauugacucucuccuuccaccacauggguuucagagauccaauucaggucgucaggcuuggaggcaagugccuuugccugcugagccauuuugcuaguacacaguuuuuguguuuuucagacagugucuuacuauguuccuuuaucuggcuuugaauuugugaugauucuccugccucugccuccccuccugagugcuagaauuguaggcuugccccacugugccuggcaauacaauguuuuaugacagagguuacaaguggaauaagucugauccaagaaugcauacauuacauaacuuuuauaaccaggcauuaaaaaaaaaaucucugcauguuuuuuguagucaaguauuuaaaaggguuggagagaacuuucuuaguuguaguuccagacaagaaccugauuuuauguauuuuucucucauuaauaaaagguccuguugguugcuuucuaaucuuuugggauguggcaacagacuuagucuaauauaaauuggcaauuuauuuguguuacuugacuuuaguuuuuuuccaugaccuuuuuucucccugcucuaaggcaaauaaaacucaagggcucugcaguggcaacaucguggcacacagccacuaggcugcccuucuuuguccuggccaugcuaaggaucucucuuucaaagcccagauuuuuaccugcuugcucacugucuucauguagaacuugcucaacuacucuuuuucaccacuuauuaagauucuuuaaauauuaaaauucucuaauuugcucucaguaauuggguuguaacucauugaggaaauugacccaccacugccuaaucuauuuuaaauauauauuuauuuuuuaauuaaauguguaugugcaggaguguaggggcuguuuacauguggauuugugcacaugugagcacagguccccuugaaguccuugagaguugguguuucaggcaguaaugagccaccucugcguuaauacgugcuccuaaccauagagccucuccagcccagccuaaccuauuuuaagucuucaucuuuuaguauaaugguuuucaaaucuguauagaaauugagugucaaaguaacaaguuauaauuguaggcuaagucacuuaguacuucacgcugaagucuaguugaccugacaagagaaagacuagaggcuucaaggggaaauguaagaauaguaauguuuaaaauggagacagcucuuuucauuuucucccucuguguauggggaagaugaugguuuuuuucugacugcaaugacccacgggucuuuuuguggguaaagcauguuccucaguguguggcuggccuugcccgugucagagcagcagcuaagugugagagagagcugccccucuuggcuuucuguugcugugauaaacagcuaagugugagagagaggcgcccuguuggcuuucuguggcuuugauaagcaucacgaucagaaacaaccuggggaggaaagcgguugucuuacuuacacuugcugaucaccauccacugcuggggagauucuggguggaagcuccagcaggagcagggucagagccagaagcgguggcacaggcuuuaauccagcacuggggaggcagaggcaagcugacagcugauacuaacuguggcagguauuuuaggaauuuacagguucccagccauggaagugagccuguuuucuucaaaaggguuuuuuagcuuuggaaaaccuucuugcuuggucuuguuguuuggucagagugugcaguguugagugugagacgauuuaguugugugauuuugcauuccacagugauauuacauaauuuuaaaggaacuaguauuucauaaauuaacgaauauacuuuccucaugcuguaauaaauaucuaaugauaaccuuauuacuuugaaaauggcuaaagcaaucaugaaaauuaaauuguguccucugaguccuuaaaacucugugguuggcuuuggaauuuaaaaaaaaaucagauuguguauuugagaucucuuuuaauuuugagacauugaucuugugaaaagacaaauguccuuugaggaccaggccuaccccacugugaauuuuaauggaacaaugugauuacuuaguucuuucucugggaguucauuugaagugagugaaggcugugggccuccuagguuuucuccugcuugaagaugcaguuucuuuguauuuaucccuaaacuacuuucggugggaaaugcuguugaaagccuccugucuguuaguuucagucacuagcaggucuuuccugucacucuuugcugauaguuucuuucuacaggaguuguagcuugaacaauagcauaauuauucaccaccuacaauuagcagguacuuuaccuaacaucuuuaaauuuuguauggcucugaaugccgaguaaguggaguacuucccuauugugggcaaaggcaagcucaaaauucacauuagguuaaacaaaaaagcaaaauguaucaugaaagcuugcuugucaaaugcucgguaggcagucuuucuucuguacaaucucuuggcuuuuguagauuuucuguucuucacagaucgggagacauuuaccagcagcugcaagccuuaguggagcuguguaccugcccucccuugaugucaggagcaggacuuugacaggacuacucauuguggauaggaaagagggacacucacagguagccugggcacacuccaguacauguggcauaaacaaggcuguauauaauacaugguggguuagaggccuucccccuagggaagagaagaaaggaugcugguagauacccauaaccaguacugucacuuuacugauggaaagaaagucccaucaagucauaaagccaaggaacaguagagcagaaccccagccuugccuuuugccuucaugguccacauuaucucccaggagauuuauguccuuccccuuuugugaccacguguguucccaaucucccuaauucuuuuaacuuuuuauggagagagaaauugaccagguuaaaaaaaaagugaggucccuuuuuucuuuauuguugaagaaugaagugucugugugaagccuaaauuugaugggacagcaaccaagcuacuugggagggaucgcugcccuccuacuucccugcuugccuuauugccagccucacaucaccucucggccugauucuggcaaacguguggcugugagcagcgugucuguugaguagacgcaggagcaccucggaagcacaucacucuucuuuuacaguuccugugggaagaucguagucacagcucugauugagaaugugaucaguuuucucuccuuacaccucucaaagacuccuuucucuuucuaaguugacuuugccugguaugcugcauaugaauaaacauuuuuuauauuuaaugagacuaaaaguaaaggcuaaaauaggucuuuuacucauggacugauuuaauucaugauuuggugcucucauuagugaguaguugaaagcccgcugugugagaggaggguaggugaagagguaggaagucuugcugcagcgcuguacgcugcugacccucaguggcuucucccccacuuucccacugagggggcagccuugaguuguuaguuuauuuuguauuggauacaucuauaggacaauagguccuauacuaaacauaaccagcagugaacaaaaggugugccugcuuuuauauugucaaauuauuauaauauuuaaaagauuauauacuuuauuuuaguaaaauuuuugugaaaguuuuuauuucagagguacuauuuuuuuuuuaauacuuggcaacuuuaacacagaguuuaugcuacuagagagauuuacugcacccaggaaagcauuuaaugggggaauauagcuauaaagaauaagacuuuuuaugugugaugguauaauugaagaaugaaaauaauauauguaauauuauuaucaugucauuuaaaauugcuauauauuuugucauuuagcuuggaaugcuguguguguguguaugugugugugagagagagagagagagaaggaaagagagggagagagagaguauguguguuguauuaaauaauuguuucaaguauuaaguaauuguuucaaguaaaucuugggcaauuguauuucaggcucauggaagucgaggaccuugucuuugacauuaaaccucacauagugacaugcuuggccacugguguucugugaucugcugagaaggaacgucauugccuuuacuguauauuuauauagugcaaaaagcugucaguacuuaauugguuauauguaaaguuugauacauuguaucuuaaauuauaugucagaaaaguuuuauguccaaaaucacucauuuaggagucauuuauggugauauaugcuagaauuagcuuuuuagcagcgugauuagaagagcauagcccugguucagaaagcuguguaucuuucagccucacuuacucuggauacacuugauccucaaaggacuaaguuccuaaugucugaccuggggagaagaccaaaggaaguuugguuaaguuucuuggccagaagaaaggugaggcuagaaaugccaacuauugaaacuaaagcccagaaacagaggaauuaaaacuuauaaaaaagaaaauuggagggagcuggagagaugguuuaaugguuaagaguacccacacgguggcucacacccacccauaacuccaguuccagugaucugaugccuucugaccucugugcuaaccagacacacaacacaaugcacacaugcacaugcaggcaaaauacucacauauguuaaauuuuucuuuuuaaaucgacagggucugguggcauaugcuuguuauuacaggaucaguaggcuaaggccagaagguuuugaguacguggccaaccugggcuacaaagaguucaagguucuguuuaaaaaacgaugugauggugcaugccuuuucaucucagcauaggguggguggggucagugggaagaagcaguagcagguggaucucugaguuugaggcuagcuuguucuacauaguaaguucuaggcugagaggguuagagggaagaaggaggggagagaagagagagagagagagagaggggauggaggaagggagaaaaggagagcaagagaaggaaaauguaaauucacaaguauccucauugggggcugagagauggcgcucacuacacaacugugaggaccagaguuuggaugcuagcaccugcauuauaagcccugcauccccaaauaccuguaacuccaggucugaggaaaaugacucccuuuucuggugucuuugugcauaggcaugcacaccugaacacauguguacauagacucguacagacacagacacacacaaauaaaucuuuaaaaaauuauacucaguggacugaggguguagcugaaacucuagguuugauccuuaguaccgcauaaaccagguauucagggagguggaagcaggaagaacagagguucaaagucauccucagcuguguaaaaguuuaaagaaccugggauaugggagagccuguguuuuacaaaaaucaaaaaacaaaaaucagaaaaugaaaaacauuaugcuuaaguuagagaaaagagagcauauccauugacagugcgcacacacacacacacacacacacacacacacacacacuaacagugaugaagggagcagcaucaugacugcagauuuauauggucaucuguggguacucacugcaguaccacaccuucaaugcuaccauugauggccucugagaauaucccugguucuggauauguugaagguaaauuguccugaaaugguacagugacuggcagaguagauguuuuccucagggacucacugagacugccuugugcagauacugcuaggcuguaaacaagugaauggugccuauguggcucuucuuuaucuguuaauuuguugaguacuuauuauguacgagacccaacauuucaggagcugagaauacaguggugagcaaucccgagaccaucccugcuguccuagaguacagcuaucagugagagagacauugcagaaugcaaauauguaaauguacgcuuacagcuugagcuaguugauggguaauuacagcugcuaugcagugaccauaaggguggguucacuuuagaucagugguucucaaccuucacaaugcugugacccuucaauacaguuccucauguugggucaccucgugggugaucccaaccauaaaauuacuuguuugauacuuuauaauuguaauuuuacuaguguuuugaauugcaguguaaauaucugauaugcaggauauaugauaugcaacccccaaagggguugagacccauaggucgagaaccacuguuuuagaucaaugcauucugcaaaggccuuuaagaauaggugggugaggagacuuuagccacuucagauuuggaguacagggggaguggagaagauaguguucuggaaucuucuugggaugggauugacugagcugggaguagguuggcaucuuuaaagcucugaaacaggccucuguggcuggaaugcaaagagggaggaagagaguugcagaagaugaagugacaaauuagaaagguuuccuagcaagaggguguguggguguguuuuaaaguccuuaagucucauugcucuucauguaagugggaaaaaucaaaacaaaccaaacaaaacccucacacugaucugugacugaaaucaaaugaaaaaauugauaaaaugaaaguugauguguuuuagaaagauuauagacucuggagugaaauguuuuuuccagucuugguucgucaugcugggguucaaaugcagggcuuugcauaugcuagacaaguacguuuccagcugagcuacaucugcagccacaccaucucugcuuguuaaucauguggccuuggguuaguuacuugacuucucugaggcucuucauuugcagaauggaucuacucuucuuccuccucccuccucucuccucccuccucccuccuuaaagcauaguguuuguauauagaccaugaaccaagugagacuggugggugcagacagcaugcuuguagugaugguaagaaucucugucuggcccuacaauaacugaaaaggcaauucuucuucuuauuauaaauguagauuaacagagcuggcauggacuguuaggaagcugguuuucauuucagagaaagaauuauaagccuaaauuuacuaugaaagucauauaugucgaaugcuuuauagccaguucagagaguaucauacaaguagaugauguccugaaagugccagcauauaaucuuuaaaacaaaaauaggguuuucuguauuucucaccaaauuuuccaguuaaauuuagcacaaacaagauuugccauauacuaugugguaggugucuguggcuuguugaacuauucaugaagagagaaguauagcaaaacugacauaauacaaaaacugugguccaaaaauuuuagucacauuauuagaugauaaugaaauaacuugugucucacuaguggggaguucugaauggauggaagccaauuacucauuguguccaaguucuucaaacuguuguggaguuuauccaaaugcuaaugacaaggcaaagaauuuugacaaugacaaaguauuuucagauaagaaaucacuugagaaaaauacauuuuagacuguucuuuguggcaccugauuguaauccuagcaauuuggaaucugagacggaaggaucagaauucggaggccacccugagcuaauaaauucaagaccagcucaagacuaguuugguuucuguagcuagcaauccugauucagugccccaccccccacgccaucccaccccaccaaaaagacaaaaacaacaaaauacugaccuuugauuaaaauacuguuuuagaaaaauuccauaugcuauauagaguuuuuuuuuuuuaauuaaugauucuugagaaggcauacaguugccuuggugaacacccccacacacacauacacacauauguguguguguguguaaaugaauguagguguguguguguagaaaacaaauguuuuauaaaacaaauauuucaguuucuucuucuuguucuuguucuuccuccucccccauucuucacaaaaauuuucuaacauuaauuuuauauccuacuaauaaguugcagccuuagaaauuuuacaaaaaugacuauguaucaaguggaauuguagaauuuagaaaggaguuucagguuccuguaauaaguugagucuagucuuacuacagugugaacuacacuauaaaaaauacaaagagaguuaggagcauggcuugcccaaggggagggagauggagcaccuaccuauggacagaggaggcaaugagagaucaguacauaguccauuuucccucuccuuugaaaauugaaucaugagaacauacuuacuccaaaaguuaaaugaaaagaaggucugggugccggagagauggcuuaacaguuaagagugcuuuuugccauacaaccaugauuacugguguuugaauucuagcacccacaugacaagcccggugcucuacacaugccuguaauccuaguuccaagaagaguggagacaagaggguugcugaggcuugcugacuuccagugacugucucaaaggaauaaguggaaagugauagagggggacuuugacaccuucuggccucugagcaugcacagggaugugcaccaacacacacacacacacacacacacacacacacauacacacacacacgagagagagagaaagagaaguggggggagagagacacugagaccacauuauuagaaaaaagugcacugguauggaucaaugcagauugcugugauuaguaguauauagcacacaagugagagccacagccuggaugcuguguugauuuccugucccuggucuauaccauccuaugugaucuguacaauaaaaggauacuuaggugacucauuaaacggugaauuuguguuuccaccugcuuggauguuuauguauguguguguuuuuccccuugcuuucugcuccauaaugagaucuagaugcauacacauccauaacuuuggauaguguuauauguugguuccuuuaaaguugcuggaauauauaauaaauguuaauaucuccauugauacuguagcagcaguuuauacuguauagaaucagucuugugaaacaaggaauuaccuugauuuaauuugaaauuuuaaaaccaauguuuucuacacuguaguuucauuagcucucugggagugagcuacaugauguugugcagugagaauuauccaaauguucucgccuucucuuuccuggaugagcuucagaaggaguucauuacuacuuauaacaugaugaagacaaauacugcugucagaccauacuguuucauugaauuugguaagggccuggcuuuguuuguuuguuuuauucuuuguacuuuucuuauuacccugucucuggucaaauuuacaucuaauauugggaguaagggagaaacuucugcaaccuugauuuugauagaauaauuggcaaaagaucuauaguucuuaauuuagaugucuauuaggacaaaaauguguuugcauugugaaggagauugugauuauuaguccaaagaaugacucccagaggacacauucucaaugaaaaauuuacuccauuuuguguuuaugugcuaaucuuuuauagucuauuuaauguagaacagggguugccaaaugcuugcuagaaaagauccuagaguauauauuucagauuuuaaaggccuuccagucucugccacaacuacucagcucugauauugcagcuuggaagccgccacaggcaauacauaaaugagugagcauaguuauugucuaauaaaacuuuauuuacaaaagcagcaguuuagauuuggccuaugggcaguaguuugcucaaccagaaaaguuuggucaaaguuaugaauuucuuuauauagaaagaagggaaaucguaaaaguaaaauucugcuuagaagauauuuaggaaaucucuuuuauucuuuuaaauauacucuucagaacauacuaucuaaugguguaaaaaaauaagaaaacaguuauaaaaacacauugcuuguaguguaauuuguauguaauuacagcugauaacagauugaauauuuugucagauaaggauauaaaaauuaaggcaaugguugacaacucuuuucuuuuugguuuuuguauuuccuugaagucuauacuuaggucaguaggcucuauuucuaguacguuaaugcuagacuuuacuguugagagugcuaaacagaaguaauauuggaagucccaggauaaacuaaauaguuuugaauaucaaauuuaacuuuaugaaauguauguccauaaguaucacacuuuaagaugacuuaauuaacaaaugacugcaaggaaacuuauuuuuauuuuacauagauaacuucauucagaggaccaagcagcgauauaauaaucccaggucucuuucaacaaaaauaaaucugucugacaugcagauggaaaucaagcugaggcccccuuaucaaaucccaaugugugaacugggaucagcaaauggagucacaucugcauuuucuguugacuguaaaggugcugguaagauuucuucuggugaguucuggaucucaauuauuuuauuaaaauuuuaaaagauaaaacaaaggaacacuugaaaaugaauugcuuuacucuaguguuuuaaaucaacuacaugagagaauauggaaguucaaagcaacccauuuucccaguuguuauaaaguaggcuacugaagacgugacuucuggaagguacuuucaaaugacaaucucagaagauuucuuuguaaacauuuuucggaauguaggccugagaaguacuuuccauccuaucaauagggcuauguuuagucuacauguuuuucuuaaguacaacuguaaagguuguggugcuuaucuacgcagucuccccucccagagaguacacggggcuugacaguugggacaggaugaaacuuuuccuuagaauggaaaccucacuguuucaugaaguacaguaugcuguuauuggacuacuucuuagaauuuuccuguggcuuaaggugaugucugccuccauauaaugccugcuggugugucuuagguucugucgucuccguagccgaaacagcaguuauguccuuucugugcuucuaggcugauuuguucaucuucaguuucuuaagacuuuuuugucauuuugacaucuuccccuguggugguuugaauaugcuuggccuagggaguggcacuauuaggagguaugaccuuguuggaggaagucugucacuuuggggauggacuuugagacccuuuuccgaccuuccuggaagucagucuucuuccuagugaccuucagaugaagauguagaacucuuaacuccucuggcaccaugccuuccugcauguugccaugcuguagccuugaugauaguggacuggaccuuugaaccuguaagccagccccaauuaaauguuaucuuuuauaagaguuaccuuggucauggugucucuucauagcaauggaaaccuuaagacagaaguugguacagggacuggaauauugccaugauaggcccugccaugcuuuuguuuagagaaaugugcauuuggggguuuggggaaguaguggggcuuaauggaccauccuaguaggaauauagaagacauuggugcugaggauaauucgaacuguguagaccuggcucaagauguuucaauggaggaaaauuuuaguauguggccuagagagacuguuacugugauauuuuggugaagaauguggcugcuuuuuacuguugucugaagagucuaccugaggcuaagguaaagagauuuccaaucaauugcuuugacaaaggaaguuucgaaacacucugguauaaauucuguuuugugguuacugaaguucacucuuugaaaagcauuuugaugaaaaugagcaaauugaaaaaggaaaaauauaaacuguauaguucaaagaauaaaggggcaccaggaaguaggauggagcugaauccuguguucaaggagucuaauaaacagauuaaaggaguggugacuuggggcaagauuuuacccagcuaagcuuacuguuuaugcuuuugcaccugaacaaggaacaguuauaucuagauguuauuauuaccugguuauuguuuccauuuggacuuuuaaucuggaacgaacugcaauccagaaaugaagugcacaauaguagugaucuagaucuggagacuagaagaucuggcucucgaggaauagugaccaugaaaaagcuuuagcccaggcauggugguacaggucuuuaauccuagcacucaggagacagagccuugcagauuucugaguucaaggucaaucuacagaggaaguuccaggacagccaaacuuaggcagugaaggaguuggaaaacagaaagcuggugauaauauaauagaaaaagggggccauguuucaguuccagcaagcagcagaacuggacagcuucaaccauguggcucuggcuuuagagucaagaauagaagggacuacugggacaauugaugcugguuagcuggagcuaagaaauuaguggugauuaagaagagaccagcauuacugagguaagaucuucugggaaguguuuucugauagcacaaagaagcuguguuccagagauagcuaagguuguaccuugugcuucaucuggacuugguaauauauaagaaucauccaggugguacugguuuugacagcaugaaggggucaacgagagcagcugaggcuuggcacugugagaagccauggaaggccauuggugaaggugcagccucaguugaaauugaagccuagacugaaggggucaugcaaagaaauugaggcuucauaccaugaagggagccuauuggugaagccacaacagaagacuccagugaauugagaugucaguaucauggaaugaugaucacuaagaacagcagcaacaguggaguggagucaagccagagccuagagugcuacagagggcagagcuggagaaaugacccaaucuccuuugaugagcccagaagauaauguguggaucccagacauuggaaaaagaaacugugaaagugccuuggauacccaagauguuagagaugccagagccuuggaauaccugcuaaggaaaacugcuaauagggagugggaccaaccaaagaaaaagaauuguguuaguacuaaggaacugccaaacugauuuccagagugguuguaccagcuugccaucccaccagcaauggaggaguguuccuccuccucuacauccucgccagcaucugcugucaccugaguuuuugaucuuagccauucugacuggugugaggugggauccuaggguuguuuugauuuguauuucccugaugauuaaggauguugaacauuuuuuagaugcuucucagccauucgguauuucucaguugagaauucuuuguuuagcucuguaccccauuuuuuuuuauuacguauuuuccucaaugacauuuccaaugcuaucccaaaagucccccauacccucccccccccccacuucccuaccuacccauucccauuuuuuuggcccuggcguuccccuguacuggggcauauaaaguuuguguguccgaugggccucucuuuccagugauggccgacuaggccaucuuuugauacauauguagcuagagucaagagcuccgggguacugguuaguucauaauguuguugcaccuacaggguugcagaucucuuuagcuccuuggauacuuucucuagcuccuccauugggggcccugugauccauccaauagcugacugugagcauccacuuauguguuugcuaggccccugccuagucucacaagagacagcuauaucuggguccuuucagcaaaaucuugcuaguguaugcaguggugucagcguuuggaagcuaauuaugggguggaucccuagauaaggcagucucuagaugguccauccuuuugucgcagcuccaaacuuugucucuguaacuccuuccauggguguuuuguucccaauucuaagaaggggcacaguguccacacuuuggucuucauucuucuagaguuucaugcauuuggcaaauuauaucuuauaucuuggguauacuaaguuuugggcuaguauccacuuaucagugaguacauauugugugaguuccuuugugauuggguuaccucgcucaggaugauguccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucauaccgguugggacaucaucuggauauaugcccagaagagguauugcuggauccuccgguaguacuauguccaauuuucuaaggaaccgccagacugauuuccagaguguuauuugguuuucuagagucuaacuucuugaguucuuuguauauauuagauauuagcucccuaucagauuuaggauugguaaagaucuuuucccaaucuguugguugccuuuuugucccauugacaguguccuuugccuuacagaagcuuugcaauuuuaugaggucccauuugucgauucuugauuuuacagcacaagccauugguguucuguucaggaaaauuuccugugugcccauaucuguugggaacaaaauaaggggugggggggggggccuggaggagggcccagggagaagugggauaggaaaaagaugcccacacccugccagaguuucccuauucucuggucagucaggcgugggagggcugcuaucuacucuauccacucaucccugggugggcauuccuccaucccacucuucaggggguggucaagggacagcccugccuggaaacccccccaccuccccggagccacuuugcuaaagccaccaggguugugggagagagggaagagggaagaaguucccaacacugacuagagugcgcagcagaacuugaaggagcagaacacaaacucuaugguuuuagagcuuuauuauagaaaugcaggggaaagagagaaggagaaaggaggaaaagagagagagaagagaggaaagaagaagacaaagagaaagggaagaggagagagaagaaagaggugagaggacaaaggaauaagagagugagguacgggcuaagcaccccuuuuuauggucuucacuguugcuagguaacuggggaggagucuagccugaaggucagaagcuugggccauugcuuauaugacuacugaccaugcuucucuugugggggcugugggaggugguaccuuaggcaggggccggaguuccaggagcaugagggaacgccuaccgugucauguaggugaaauaugaccaucggggguucagaccucagcucgacuggaaaccagccugcaauuccccauacaucuucgaggcucuuuccaacaguaauaccacuccugggcauauacccagaagauguuccaacuuguaauaaggacacaugcuccacuauguucauagcagucuuauuuauaauagccagaagcuggaaagaacccagaugucccucaacagaggaauggauacagaaaaugugguacauuuacacaguggagugcuacacagcuauuaaaaacaaugaauuuaugaaauucuuaggcaaauggaggauaucaucuuaagugagguaacccagucacaaaagaacacacaugauaugcacucacugauaaguagauauuaacccagaagcucagaauacccaagauacaauuugcaaaacacauaaaacucaagaaggaggaagaccaaagugugguuacuucgauccuucuuagaaaggggaacaaaacacccauggaaggaguuacagagacaaaguguggaguagagacugaaggaaugaccauccagagacugccucaccuggaaauccaucccauaaacaaccaccaaacccagacacuauggcagaggccaacaagagcuuguugacaggacccugauaaagcucucuccugagaggcucugccagugcuugacaaauacagaaguggauguucacagccauccauuggaugaagcacaggguccccaaugaaggaacuagagaaaguacccaaggugcugaagggguuuucagccccauaggaggaacaacaguaugaaccaaccaguacccccagagcucccagggacuaaaccaccaaucaaagaaaacacauggugggacucauggcucuagcugcauagguagcagaggauggucuaguuggucaucaaugggaggagagguccuugguccugugaagcucugugucccaguguagggaaaugccagggccaggaagcaggaaugggugaguuggugagcagggaguugggggagauaggggauuuuuggaggggaaacuaggaaaggggauaucauuugaaauguaaauaaaauaucuaauaaaauaaaauaaaauaaauucuaaaaaaaaaaagaaaaacaauugugcaguuaauauaaaugaaagaaguuggagaucuaaagagagcuuugacaucagacauggagaugcugaguuuggagugugccuggcugcuuuuuggucuuuggaucaguauuuucucacuaugauguuuuggaaugguaauguguaucaugagauguuggagguaugugauuugcuuuuuuuuuuaaauuuugauuucauaacagaucauagcuaaaugauuggauaaguaucagaagagacuuugaacuuuuaacauuguugaggcuguuauagacuaugagacuauugaaguuguauuauacuauggcuagguauggccuccauagacuuuugaguuugaacaagccuguggaggccagggaguaaaaugugguuugaauaugcuugacccaggaauggcacuguuagaagguguagccuuagugaagaaagcugucacuuggggguaggcguugagacacuucuccuaguugccuagaagucagucuucuuccuaacgacuuucagaugaagauguagaacucucaacuccucuggcaccaugccugccuggaugcugucaugcuccugccuugacaauaauggacugaaccucugaaccuguaagccagccccaauugcauguuguccuuauaaagaguugccuugguugugguguaucgucauagcagugguaacccuaagauauucccuuucucauauacguauaagggaugaauauuuaaguaacuuguaagaagaaagcauugaauauacuauuuuauuuucuuggaacaaaacuagucagaagggggauagagagaggccaacauuuaguagcacuggcugcacuucagaaagccugggcuugauccccaauaaccacacgauggcucacaaccaucugucacucuagcuuccagaggaucugauccuugggcaccagacagacaugcagacaaaacacguguacacauaacuuucauuuaaauuaaaauauauuuguuuaguauauauucaaagggcucaagcagacuuaauuuaaaagccagccccacagcccgcaauacagagucuacauagacucugaggagaggacagaucgucugagacggucaggugcuuugacugcauuguucauacauuguucaaauuuguuuucuggcaaauuacauuguuuguuguuaaacaaaucucucaguucuaugauaaauucuccauggccaugaugugugaugcuuuuuauaugcuaucagguccaauuugcuaaaguuuugcugauaauuuauagugucuuacugaaggaauugauuucuagcuuuccuuuuuuauaauggccauguuuguuuuugcuaucugugcacagcugacgugagaaaguacacuagaggguuuucccgccucuucuacauuuuuggaaaauguuuuguagggcauagcaauaaauccucaaauauuuuugucuggggaaguuuuaaauucguucuuuccuagggccagugcugcucagcuuuucucuuucuucuuagugagccuuugcagguuuuuuguuuguuuguuuuuuaaaauggaaucuguucauuuuuuccagguuuuggauuuuugguguaccauacauauuucuuuacaccuuuauuuuccauaaaauuaacaauuaugucuuucucauuacugguauuaguaauuuuuuucuuuugcucuuuucuccuaauauauaaaaucugaucacuuuuauugauuucuuuaggaauuuuacuuuuauugauguuuuauuuucuauuuuauuaacaaguucugcuuauugcuucccauuuucugcuuaccuuggguuucugugcuuucauuuucugagauuuggagcaguuugagaucuucuuuucuaauaugagcacuugcuguuccauaucucagucucaguagcaguuuagcuauauccuauagauuuuaucauacugcauuguccuuucagucugcuuauuauauaguuuuauuuaggcauucucaagugucuauugauuuuuaauucuauuguguucagaggauaaauuguauuugacuugaguauuuuaaaauuuaucuagacuugauauuuuccccagaaaauagccugucuuagucauucuuuucugcuuauuuuaauuuccugcuguugguuucuggcacuuuaaaacuccacuaagagucacuuagaucauggugccugagauuggugaaaucuguugugucucuucugauuugcugucugcuucagucauucucugagagacggguauugcaauuucugcacuucugauuuuauaucuuucucauuuuagggugaugaauuuugauauuauguauuuuuuucagauuuaauucuuugcuguauguguaugaguguuuugccugcaugaaugucugugcaccacauguauguuugcugucuacagagaggaguguuggauugccuagaaccggagucauguaugguugugagccuccauccucugcaagagcaacaaauucccuuaaccacugagcccucuccccagccuuuaaagcgugugauuuguucucuugauguguugguucuuucaucauuuuaggguucuuugugccuagggaugcauuaagcuuugaaaucguuauaauauagauacuauauuaaaauuaauauuaguaguggaccuguugucuuucucuuuguguccuuaugguugaaugguguuuuaaugcccuuuuaugggaauccuaaaggucuagugaggagcaucauguaugugaagggcaucagaaccucuaacuucuuguuuguauuuggugcugucugcacccagcaggauaucagucaccauggugcagccaucacuuucuacagugacuagugacauguugauuuguucauugcucuuuguuuugacuuauuuuuccuaccuaaggcaacacuuucacauauuugauaaauuugagaagcacaucaggaaaugcuauacugucagucuucuuuuucccaauaacccucuugucuaccuggaugagaguugggcuuauaaaagucacagugaagaaauaccuuuaaaccagucuaauagauuaacaagccggccugguggacuauuuuaagucaucauuuaaccagaaguaguucuguguuuuuguguaucugcauggucuuagagacuucauuuuaaugaucauauuaacuuacgagcucaggucuuaucuuaggcuaugucagagcacacugacugaauauuacugcuuguggcugcagcauauauauauauaucuauguauguauguauguauguauauauauguauguauguauauauguguauguauauauauuuauuuauuuauuuuuaaauaacugcucugcagugguuccucguguuuuuaguaauaugugucauuguugaccuuuagaggucaacuguucauacguguagaacuugcucgcuuuuaggaugauaaaugucuuuuccccuuuuuccuuagugucagugcaggugagggugggugguuuagcaaugugcaacuagcaugcuacauauaguugugggugggaggguuguuagauuuugucauguuaaauacuaucccuuagcucuuaggccuaguuagugcccaaaaucuuuauuuuuuaaguaaauauagaaaacaugacucaguugagucuuuuuuucuuuuccuuccuuccuuccuuuuauuucuuuccuuuccuucuuuguuuucugauaguacagaucuggauggaauucguagaggcauauugcuugcugucagaguaacuaaguuaagucuccauuauuauuuucucucucucucuuuuuuuuuguuuuuguuuuuuugguguuuguuuguuuguuuuguuuuccgagacaugguuucucuguauagcccuggcuguccuggaacucacucuguagaccaggcugaccucgaacucagaaauccgccugccucugccuccugagugcugggauuaaagacaugugccaccacgcccagcccauuauuauuuucucacagcaagcuaguugaggaaacauacugccaaugugccuccccagcaccagaacccccacaguaagcccaccugcgaugcuggcuacucugcugcuucugggauugcuguagcaucucagagcuugucagaacauugaguggcugaggaaguuucucccgaacuuuaagacaaauguggguuuuuugcuugcuuguuaguuuuuuuugcuagccccuuccuucccccuauuuuggacuuuugccuuuaaaacauuaaaugcuaccagugcuggccacaggcaugacaggcugaagaggcaguguaaaaagcuccagaccuagcagcuucugauguguugcugugguccacagagaaggcuggggcagcagcaagucucuuuggacuuuaaaauuguuccuaugcaccuauuuuauuuuuguuuaaucaaauagacuaguuccccccccccauggaaugagaaaauaaagugguguuuuauaguugucauuuuauuuguuugaaaauaucuuucuuucucucucucucucucucucucucucucucucucucucuuucuuucuuucuuucuuucuuucauuuaugugucucuuagucuauguucacaugugugugugauacuuacagaguccagaagaggaugucagguuccuaggaccugggauuacaggcaguuagugagcugcuguguguggaugcugggagcugcaaguggacccugggaggagccuuugucucuagcugccaucaucuuucagauuaauauucuguuauuugcuggcuuauuauccauaucucuuucauuuguuuucaugauuauuuuugccuuuauaguauauaacuauuauuucacuguggggugaaguuaacuucuaccaugaauaacaagcuaagaaccagcuuucaaaguggagacuguuccuugccaaaagaccaugucacugcuucauauccagggucuuaucuuaauauuuugucuguguuucagagcaucaucccugccuuccaguguuauuuugcacaacacagaacccaugagugucauguaguguacucuauauccucuguuucucugggcccucaacugcugucauucaguaaacugugauuuaguaaaugugcagaaauguaguaauggcuuugaaauguuaaaaaaaaaguauacuaaucaguagugacucuuuuauuaguggugucuguugccuggugcauaaacuugguucuuacuaccaacauauucuacacguuugaccaccagcaaaugccugacgugaugcucuccuauaacuguagucauuuuuuauugucuagcuugcaugugucuuaaggcaucuacccaaucugcuucucaaguacuaucaccaugagauuaauaaugcauacaaaauaagguucuaugggguguuaaaauauuagaucccuguaagccaagggccaggaaacuuuuucuauagagggcuagaugcuacauauuuuagauuucuaaaggcuauauaggcucugauguaucucugcuggcauaaacacaguuuagucguagauacuauaaaaaaggcuaagugcucugaauuggcuuaugggucauaguucgaucagccccugauguaaacuaagcuaaugacagcaugguucauguacugcuagguagaagcagaauauuucugauuucuuccauuuauaaggacaaagaaaaaagcuuaccaaauuauugucuaguagauaucuaagauaaugagcugaugagugcuagugagagaucauauccagaagagcacuugcgggauugggcuguaacuuaguccauaacuuacuccacuccugagcuugagccccgcgucagacccagcaccagauaaaccacagguggagguggggguggucagaauuugagugucauccucagcuacaacgugaaaagcacuugcaagugaaccuuacaaaagcaguguaucaugcuucaagacaaccaugguggagaugcaagcaggaauguuaaaugaaaaacauguuguuguuugaauuuaauucuauuacuuuuuaaaaauacauauggguguuuuaugugcauguauguuuguguuucucauguaugccuggugugugaagaggccagaagagaguguuggagcuucuggaacuguagguacagaucaugugagcugccauguggguacauggugggaauuaaaccuuaguccucugcaagagcagccaguucuuaaccccugauccgugucgccugcccagaaaucacuguuuaauugggaucgucaccauggguuuuaagccucagaugguaacacuagucauagcaguuaccucaggcauuagucuuagugguguuuggauggagaagcuccaugaccuccaggccuccauuggccugcucuccucugagaauucugaugcuguggguccagcaguagcccuagcuuaggauaucugcccuuuaauauauacucaggauuuaggguaauagucuuacuuugaggugggcuugcaacuugaccuaccaaaagguagacuguuagaaauucuauggacuacugacuucuagaaguucucucugaacuuagacuccauuggcaugcugagucaguacacaccagacacuagaggcaagugagaagaagccgggauuguuuuaauaaagaaugacuuaaaacuagagcuuacuuuaaaauuaaccuuaaaauuauuuuaauucagacugucuacauaauauuuucuauauuccucaagauaaaauacaguuggauuuuuuguuuguuuguuuuaugggggagagagaaccucuaaaauaugguuuucaaguuuuccccuuacuuugguacaguauuuuaaaaucacuuuaaaaacaguucuugauuuuucuuuaaaaaccuuugauccuuucuuccuauagucuggcaugaauauuguuaucuugccauaauuauuuauugagauaugaccaugauggagugaguugauggagugaauggaucuuguuaaauguaguaguaaguccugccuuuucuuugucuuuuuaaauguuuuauuauggaaauuuucagauaaaaauguauaaauauugggaucagaggauuaguugcaugcuuaaaucuuuaggaauugaugguuuuuugaaguacuuauaccauccuacaguuccacacguaauuguucuagcuuagaaaggagcugacacaaaagcacccuucagaaugagcuuuaguacagagccucacagccauggucagccucacugcaacccugaaguggggucggggagggcaggcugauuguccuuuaaauccugagaggaguuuccuuaggagagaugacugcuguggagaccaugaccaggguccugaagggagaaagacacucuucuguuccaagaacaacucucugacucuuaaagguuuuuaggagauggggguaagcuucagaccacaugaucuagcugggccugggcuaaguggcaaguguuauuagaggcaggcacuagauaggaccuuaaacuuacgucuggaagggaaggacugcgaggcuaaaacauagcuugcuuucuuguucuuugucguugggggcugcaugaccugguuucuaggagagaggcagcucaagggccuuugagcuagcagcagaccaccacuccacaccguaucauuauuuaauauuacugaccuuuuaaaauuuauauucugauucuauuuuuucuuuuccuuuuucuuuuccuuuuguuuuuuugagacaggguuucucuguguaccuuggcuguccuggaacucacuuuguagaccaggcuggccucgaacucagaaauccgccugccucugccucccaagugcuggaauuaaaggcgugugccaccacugccuggcuaguuuuucuuuuuaaaaagucauaaaauuccuccaguuucugacaucucuguaaucuucaucuguuuugaaaguuuuguagacaacuuguuaguuggccaaaucuuuucugugaauuguuaugcuaaauauucuggaggccuuuuauaaagauagcaaacacuuucaagaugggaauaaggauuauuaucuaauaagagaauuacaaggcugacgaggaaucguagagaguggaugccugcagugcuagcagucaggagccugaaucagagaaugagaaguuugaggccagcuugaaccacauggugaauuccugucucaaagaaaggcugggggucaggggaggaaaaggaaagaaaguaucauaugcuguauguagggagugccuauguccauguaaagggagcuguccugaaguguccuuaucuuacgagccuguuccuccaggaguugggcuuccucagugaccgcaccuugugcacucugucugauguggggcagaggugcugugguuuagugcacugucuuuuuggacuagugauggcugcccugguuucccuuuuucuuuuauauuucagccucccugacuugucucacuauacuuaugucgggucuuccuuuuccuguacacgugugugaagagaaugacgcugucaaccuuguuguguguaaaccuucugcgugccugcuggaacugcacacacaccugggugcuuccucagcauuaccagggacuucacuucuuucuuaggucugcaacaaaggccuuucuuugucaucuuuuuucuuuucauuuuuuuauuagauauuuucuuuauuuacauuucaauugauauccccuuuccugguuuccccuccaaaaauccccuaucucccccaacucccugcucaccaacucacccauuccugcuuccuggcccuggcauuucccuacacuggggcacagagcuucacaggaccaaggaccucuccucccauugaugaccaacuaggccauccucugcuaccuaugcagcuagagccaugagucccaccauguguuuucuuugauuggugguuuagucccugggagcucuggggguacugguugguucauacuguuguuccuccuauggggcugaaaaccccuucagcaccuuggguacuuucucuaguuccuucauuggggacccugugcuucauccaauggauggcugugagcauccacuucuguauuugucaggcacuggccgagccucaggaaagagcuauaucagggucccaucaacaagcucuuguuggccucugccauagugucuggguuuggugguuguuuaugggauggauccccaggugagacaguuucuggauggucauuccuucagucucugcucugaacuuugucucuguaacucaucccauggguguuuuguuuccccuucuaagaagauuugaaguauccacacuuuggucuucuuucuucuugaguuucauguguuuugcaaauuguaucuugggguacuucacuucuuaaagucugaacuucaucuccccuucccuccuaaaacugccuuagagcaucaaugaacaucucuuggacaauagauuggauacuguguaauuuuuauaugcagauguuucuuggccugucuguagguaccauuauucacauauuccuucugaagcccucccuccccaccccccuucuaguugucuuagguuaucugcauauaucuuauucucucacaucugucuuccccaauuuauggcaguagcaaaaugaaaaaacugcucaggagaugcugcuaccuggcuugaugauacuccugcauggcccucguucguuagagaguagguauacucucuaccuacuggugccugccauggugccaaacggaagugggcugcaaacuuugcuugcuguacagcguaucuagacucugucucacugaaguaacaaauagcacacagaauaauacuuuaucaugugguuaaauaucuuguuugcucaucaaacugggaaauugccuucugugguccauuugcagaaugaaguuuguuugaaaacucuucuuagaaaacaagccacagaucccaggaaaggggugaggauaaagcagggaaagcaacacauuagaacuuguugcccacaguaaauuggccccgcaccaaccuaccuuugugcacggugcuugccuuaucuucauuaaaagagacuuagcacuugcuuuuaccuuuuaaaaauaucuucggucauuuugaaaugaucaauucauaagcgguauacuuuuauuauaagauacauguucuaaggccaaaaaacaaguuuuaggaaauuaauaauuuauauuagcuaguucauuucuuguuuuugguuuuuuucaagacaggguuucucuguguagcccuggcuguccugaaacucacuguguagaccaggcuggccucaaacucagaaauccaccugccucugccuuccaagugcugggauuaaaggcgugcgccaccacugccgggcagcuuguucauuucuuaaguacauuaccaucaacacaugaaagugguagcgaucuuguuuugaacauaccuuacuugaccggguaaagcuagaauuuucacuguuuggguuuugguauuuuuguuguuguuuuuguuguuguuuucguuuuuggugagguuccucguuucauauggaagugggauuugauaguuauucaguuguuaguugguuuuauuccuaaaucccauuugcuuuuucugagggaggcucaaggacagagaugcuguacaacaggacuaguuguaacuuucucaacugcugaaacgcuaugggaucaggacuguagagcggcauuugguuuucauagcagagucuaaagggaauguauugaaagaccagacaugggcacagaagaaauuaugaaauguuauucuagauuaguaguuucugcugaaccugaagaaccuuccaugagauguggguuuugggguuuuuauuaacucuuuggggaaucuuuucugcugugauggcugaauauaauuugcaaagaccugagcuuuuccuucguuaacuuucugccucauuaacuucauuguugggcuuuuacacuucagugguuuaaauaaaguaauaaaaaugugguucuguuguucucucuuugccagugucccuuuugaagccuacugauuauguauuuaguuguguuuucauuuaggcacaauuauaaagccuaauaacuauaaaaugaucaugaagggaagugauuguaugacagaauauuuuacucuguugaagccugaaaauuaaggaaugccuuuguaaagaugaaaugaucaauauuagcugguguguuuuugguuugggcuuguuuuaguaacuuuucuucaaaugaccaaagaggaccagucuuugcagcuguaagacugcauccuauugacucguuuggggugaugacuaaaugugggcuuucacauauagccagcaguguucauagccuuuagucccagauaaggggcuuuugcuaaaagcaagcuauggauauccuuaaaaguguuuucuaaacauuuucagaaaacauaggaguuuuguauuuacucuccaaaguccucuuuugcaaauacuuguaccacauugcaaauuguacacauauuugggcaguaguuuuguuuuguuuuguuuuguuuuguuuuguuuuguuuuguuuucuaagugauuuacugacggaugccaguacucuauagcauucuuguaccucaaauagaaguuagaggugucuacuaaaauguacaaaagcaauguuaguuccauuugacuuuuagaaugggacuuuuuaugucaccaaacauuuuugcauuuuagaacaauauuuaagcuugauauuguggcacaauuuuaaucuacugcagagaggcauuggaucccugaggaagccauccuggucuacagaucaaguuccagggcagccagugcuacacagagaaccuuugccuacacacauuguuuaauuacuguuuaccuucuaagauacauuguuuaaaguuauuuacauuugacucauuuaaguugaacaaugauuuucuguccacauaagcucagcuaacaagagauacugcuauucauuucuaaccauuccuuuucuuuuucagcccaucagcgacuagaaccagcaacucugucagggauuguggcguuuauccuuagucuuuuauguggagcucugaauuuaauucgaggcuuucaugccauagaaagccuccugcagguacugugcuauuuuugcaguuucuggugacugggucuauucacucgacuuguuacagaagugauuugaauuagauuaggucuuaguguaaucuaagugcaaguuccaagucuguucuuacaccagaccuucucuacuuucuucaaaaucaaaagccugaccucagaggcaagccuugugggcaugccuguaaucuugguccuuggaaggcugaagcaggaggcauacagauguaaggccaguugaaaccacauagugaguuccaguccagcuuggguuauacagggagacccugucucaaaaaaacaaacacaaacacaaucccccuccccccagaauauuucugguuggcacguuccuuuauuacccauucuuucggaggcauuggcgacaggcacugugguagcaugaagcuuuguuagcauggaccuugaauucucacagcucaaaguugaguuagguaggcaaaggagucucgguguaauacuaaguucuuagagccgggagggaagagucccugugauucagaagagcugaggagagaggcugagcuggugugaaggaacacgagggcagagaaaggugggagcaggaagguauggacacgucaguaagcucugcugcugcgccuuuugaccuuuuacaaccugaguuggugauuggauaagggauggauccccagguagggcagucucuggaugguccucccuucagucucuacuccauacuuuguaacuccuuccaugggugucuuguucccccuucuaagaaggaucaaaguauccacgcuuuggucuuccuucuugaguuucaugugguuugugaauuguaucuuggcuauucugaacuucugggcuaauauccacuuaucagugagugugugucauguguguucuuuugugauuggguuaccucacucaggaugauauccuccagauccauccauuugucuaauaauuucauaaauucauuguuuuuuuuuuuuuauuguguuugcugacgggagccugauauagcucucuccugagaggcucugccagugccugacuaauacagaaguggaugcucacacucauccauuggucugagcauagauaggguucccaaugaaggagcuagagaaaggacguaaggagcuaaagggguuugcagccccauaggaggaacaacaguaugaaccaaucaguaccccccagagcucccagggacuaaacuaccaaucaaagaguacacauggugggacucauggcucuagcugcauauguagcagaggauggucuaguuggacaucggugggaggagaggaccuucgucuugugaaggcucuaugcucuguguaggggaaugccagggccaggaagugggaguggguggguuggugaauagggggagggggaaggggauagaggaagagguuuucggagggaaaaccaggaaagggggauaacauuugaaauguaaauaaagaaaauauccaauuaaaaaaaccaaaaaucugaguugccuauuuaugggcaggguccuugguuucuucagauucuucauuguccaagggaguuucuuccagggccuuuagcuaccagacuauaucuacuauauauaaccuauucucuuccugugcuuucugaaucuccuuucuuaaaaguccagcacauuuacauuucagaucucacaguugucuuuuucuuuauuuccauucacuuucuaccaagaguucuugacacuauccauuauaaaucaaaucucucucucucucuuucucucuuucucucucucucucucucucucucucucucucucucucucucucucucucucucuguguguguguguguguguguguguguguacuauuuauaaaaaccugcucggcaugcuauguucauggugccauucuacagguccucuauuuucagccaccuaaaaccaacagaaagcagaugacaguguuggucccgacaucaugggaaugcauggggcuucuuuuugucaauuucucuucuaaacaguuccucacaggcaaagccccuaccccucucagucaguggauguuggcugucaucccucuaccuucuugucucacccccugcacugcaaaguuggauuuauuccaguuuucagccagcuagacauccugccaacaagaagaaauggacaauuuugaaacugcagagugaaaaagcuaauaaaauagucuuuaaaacauuuuauugauguaauaggaaaaaaaaaaaaaaaggugggauagguauaaaaaaguuaacuuucuagauaaaguagcccugggcagagaaaaagcuuuacucucacaaagccuuguuuacauccugacugaagaggugccucagaucuuagcaccuguaaguuaaaaaugccuauaaggugcuuccuggcucagccuguuaaggauuuccuuuggacacucagcuaucauguccuugccugaucuggcauugauucuuuuccuuccucuucugguucauaacugaagaacuaaaggaagcuuuuguguacuacagccuuucaugcuuuugaaauguugcaacugacuucagcuuuccuucauugcuaauuguucuguguuuucccucugauugguaauacacuugucugauuguugugagaugguuuuaaguuucagaagcacaaucagauccaacuauuugcuacuuaaauguaauugacucuuuguucugacauuucucagcuuguuuauauuuuuaaaagacaacuuuaugaccuaucuuucuuggacacagaugcagagaucuuuagcaauauuaaaccaaaucuagaaaugcguaaaaauaauuauacaagaaccaagugugcaaugcugauuuaauauuugaaaucaauuacugcuaucacuucaacaaucuaaaguagaaauaauagucauaugaucacaucaguagaucuagaaaggaauuugacaaaauccagaaaaaucuucaugauaaaaacaaaauauucagacuauaucaacaaaaggaaaauaaaaaacagaaacaguuugaagcaaaccaggaguagagggaaauuucuucaccuuaauaaggaaaacccauuucaaaucucaagcaacuaacaucuuuacuaacaagaaacuagacaaccuuuccucuaagacagaaacaaaguaaagaugccuccacuuaacucugcugggugaguccuguguacuggaaauccuaacugauguaauaaaguaagaaaaggaaaaaaauauauggaaggaagaaauaaauuugcagauggcacgauucgcuauauaaugacucccaagacccagccagaagcuccugaagcuaucgugguugcauaacggaguaggagauuggacuguacagacaauauuuaaauuccagcaacaacugaauguaaaaguucuaaaaaaggagguacuuacaaguaaaucuaaaacauauacaggacccauaugaaguagauuagaaacucugaccaaagaaaucagagaugaaauaaacagaaaacgauuucacauuucuaaaggaaaacucaauauuguugaagugccaguucuuugugugcuaaugugcagguugaacauaucccagucaaaaucccagcaaguuauuuuggagauucaauaaagugauugcaaaguuuauauggaaagcaaaagacucaguacauagaaaaacaaaacaaaaacagaaguuuuuauucuguauucucacuaacaaaacucaaaauuuuauuucuaccaacagaugagugggaggucuuuccauaccaagcaacucugcagucccagcgagguguuuuacaguuuaauucaguuuuaaugcugucugcuuagaguuaggacucacacguuaagucucagucucaugggcugcccuugcuugagaucccaguccuaugggagauuguucagauaaccaucagcuggcuguaagagaggugugugcaacuccucaucuggugcagccauuuguuagcgcaguucugcacgcagacacaucugguggcugauuagaaaggccauuucaaaggacacaggagaguaaagaggugcguacauagggcgagguuagaaggguuuagacacgagucucuguucugguggagcugaguucaucuccucacaggccgaggugcucaccaacccagcaguucugcaagcuccauggucagagauuuggggaggcuucucuccucucuccuccugggagauugggauaaagacaaaaauuccagccauuuaaccauggccuuuucugguauccagcacugaucuaggaggcuaucaggaguugcuucagaacaaaagcuguccuccuuacacagaaaauuccaagagagaugggaauucugggucaaauccuucuauaacucaggaaacuaaauuccuaaaucuuaggggcucucuaucaggacuagugccaaagauggcaccuucauuuacaaggguuuaggagcccuguguuagggcagacuauuuauuacuacuucauacuuucugaugaaaacaaaaguugggcucacauugcccaucuuuaagauguacuguaaaaccacauauuuaagacaguaugauauuggcaaaagaauaaacaguacaucaccaugacagaauugaaagauaagagauaaauuuacauccauguagcgaccugaucuuuaucaaaagagcaaaagcaaaucaauggagaaugggcagucauuuuaacauggugcugcaacacaagaaagcuacaugccaaggaauaaaucuguagauacugcaaguugaguaaacaggaauuuagagugggucauagaucuaaaugugaagaacaaaacuuaaaauuuguaaauuaaaagaagcagcauaagagaacucuggugugagccuggggucuggggaugaguucuuagguacagcaccaaaaguguugugaaggaaaaauaugcuguuaggcaucacuacaucuaucaaugucuguucugugagagacucugcuaagagaaugaaaaaagccccagguuaggaaaagauacuuggaaaccuccagccgugacucucuagggcuggagagauggcuuuucaguaaagagcuuauuacuacuacucuuccagaggacccaagagauguuugucauaauguacaaauaacuaacacauaaauaggaagaaaucuuuaaggagaggagagggugauucuaaaauacaccaagaaaucugaaaacuaagaaugcagaucaaccuguuaacagugguaaaaaaaucaguaaaaaaccucaccacagaagauacugaaggugacagacaggcaugugagaagaugcuggacauugugucauuaaaaaacugcaaguuuaaaauaugaugccacuaaacacuuguuagaacaugccccaacuguugacagcugacacuucccaaugcugaugaggguauggaacaagggaacccucauuugcugcuaagugggaguguaaaacguuaacugcaacucuggaaaacagcugggcuguuucucucagagcuaaacaaagcuuuacucucucaucuggugauagugcuuuuaggugucucucaccaaauaaguagagcacuuucaacauguggguguuuauaucaacuuaguuaugauuucaagggaacagcuauggaaggugagugguaaacgguaguaauccauacaguagacgacaaccauuccgugauagaggacacggcugggagucacaaaagacagacagacaccucuaaagugcauguugcuugaugaaagcagcuagcaugaaaaacuacgucccggacacuuucugcaagaggcagaccuauagacaguaaguucuauaguuaugcugggaugggaaguccgagauucucagggccaugcaguggugcuuugugacuuagugguggugcuugccauugugcauuuguccaagccacagagccuacaacaggaagagaggaaauuaccgggugguaauaugucaauacuggcucagcauuuguggugaauguaucacaccaauuccaguuguuacuaaaaacugagccaggaguugaguaugaagacucucuacucaauuuucuauaugacuauggcuaaucuaaaaaaaaucuaucuuaguugggucuguggaauacuccuuuaauauagcacuuggaaagcagaggcagguggauuucucugaguuccaggccagucaaggcuacauagugaaaccaugucucaacacacacucucucucucucucucucucucucucucucucucucacacacacacacacacacacacacacacacacacacacaaaagcguaguuaagaagccaagaguaaaacaaagacuuuuucuuuggugaucaguccaaggaaaacuggaagggagacauguuucuuaccccgagcuuugauauuuugauguucuccagugaggugcaacccuacuuggcagcaguuaaaaguucaaccuguugaacuuagccuguucuuagaagcaugauuagguaggcuuccucugccugugggggucugcauaggccaugugaggacauuaaugccccaguuagaauggagcgugguuuaggaaucugaucuguguuuuaaggucuauauauaaauucugugccaguuugagaaugccagugaaaugcaggucgggccuauggaccuuguguguacuagccccugucaacuuacugcccuuccuccauacgcaaauagcaagaauggucugguugaauaacagcauguucuaaucugcauaaacaagcucugcaagguugggaagguaauacacaugguggacuggcagauggggaacgaauggagaggcagcaaggcuucacuaagugccucuuccuagaugguucuuacuuugaaccauguaaaauugcucaccaaaacaacuguugggcuaggaguagaacuuuaaugcuagaacaguagccuaacaguacgagaucgcucgguucaauccucagcaaugaaaaacaguuucucuaggguaaacagaagcaaaaaaaauaacaucuuuuguuaauccaguuuaauagguagauucuucaaguaccaaaaauucagauacagguaaaucuuuuguguaacaaugacaugauguuggucacuuuuucuuuccuucagaguuauucuuguucacaguuuauacgggaugaaaagucauuuuuuugucuucacuaaagccuuuagacuuggucuagucucuucugguuucucagugcauuuuguguuaggaauaaucccuuuaaaucacaaguuaaauaguucuuccugaagcuuucucugaagaauuuuguacaaauauuaagaauuauauaaguggaguuauucaguucuugcuagugaaagagcugaaaaaucaacagcuuccauaguucuauaaaacuugauuuauaaaguaaaggguuuauuuguugggugugauagcacaugccuuuaggaucuuugugaguccaaagcaagccugauauagugaguuccagaccauucaauacuauauagugauucccuguuguuaaaacaggaaaaauaaguaaagaauuuauugaaaauuauaacuuuaaucuaguggaugauauauuguauauuuccugauugugaauaguauaguagauagguacuaauuuaaaguuuauaguuuuauaaccuugauuuguaaauacucugaauaauaagaauuauuaucuucuaguauguuacuuuauguuuguggcauguuuaacucugcagaccuacaggagucagcauuccuguguauugccauuguuguuaaagaucccagauaagugugcugguggaauggcucugcugguaaaggcucuugcuacaggucuaauugcugaguuggauuccaggaccccuaggauggaaggagagaacugacucuugcaaguuuuccucugaccuccaucuguuugcugugacauguguaugugcaugcuuauaugugcaaccauacgcagacacaaagugugaagaaaaugaaaaaauaagacucagcauaaguuugcuuauucuagauuaguaacuguuacuaagagugauagaauuuauuaaaauauguggcaccaaaguuuuucuuuguuguauguguguauguauuucucucuuucuuucuuucuuucuuucuuucuuucuuucugucugucugucugucugucugucugucugucuauaucuauaucuaucucucuauauauauauuuauuuuuaaguugguaaaucugauuucauguucagaguaauguguaaauuggauuauuugcacuugcuuccuagcuuuguucugaguuuagagauguuaauaagguuguugugaguugacaccucaggaguguauaagcuuuuaucacacuguuuauagugcagggguucuucuaacgaucaguuuugaaaugaugauaauuagaucaaggcgaaagcagagcuacuuuucauauggaguauuagaaaaugaauccugugacaauaacagaaaugcugcccuggaagucaggagaccugugaucucuuugccaguaacuagcucguugcagauaggaugcugugggucucauauugaagugugcaggauggaggcuuagacuccacaugcccaaggacuagagagcacuaaugcccuaggguccucagacucgagaguuguuugcaguacuuacuacaaagcagaaaugaguuaagaaauaaaaaauacagcuugugaauaaagauuuaagcacagacugccucuggaaacaugcuuugagguauuguaaaaucaauuaagaaagauuucaaauggcaguguacucucagaaaaaaaaaaaaaaaaccuguuacauuauaggaccaguaauuagguccugugauauguugaaaggcuauauauucuuucacauauucugugguugauguauuuaccauguuagaaaguguuuaugacucaaccaaaauacuaaagagcagcaugcaaaaguauagguucauuucuuuggggauggagaguggagagguagagagaaaaagccagaaacacucggaaagguuaacaaucauuguuccuuuauauaagaacaacauggacuucuuuguauagugugcgugcguguguguguguguguguguguguguguguguguguguguguguguguacgcguauuuguguuuugagacaggcuuucucuauauagagcuggcuguccuggaacucacuguguagaccaggcuggccuucaacucagagaucugccugccucugucucccaagugcugagauuaaaggcgugcgccaccacugacuagcuugaacauaaacuuuuauaauugggaaaaaggacuuaaaaaaauaagcaguuuaauucaagccuuugaauuaaaaacguagaaacuguugaacugccugcuucuggggcagaacuggccugagcauccuagggggauuaauaguuucuguuccaagaucucacuagcauaagccacucugccuuguggccuguucuguacucaaucaacugcacuaaagcaauuugcuuuucuuucuauuguauaccgauccuuccacccacaugggcagagagaggcacauuugguggcacagucuuguaaugccagcacuuaggaagcugagcaaggggauugagcauuugaggccagccugggcuacaucaugagauccuguaggaaaaagaaaauuauuuuuccuaaaauaagaggucuaguguaaugucccugcauggaagaaaaacacuccuccuuccuugguuuuguguacuguucguccacacagugaaggaaguugaaugccgguacuugcuaggaacaaaggacaaguguaugguucucuauucucacaggcucuggcuauucuuccuuacuguuuucuagcucagugacauuauaaccaggccugaucuuucuuuuggggauuuagcacacucuaguggacaguagcuuuucagucaccacaguuuuauuuaucaugccaaguuacuuuauuaggcaauucauuuaugugcuuccggggaguagagcuugucagauuguauuuaaguggugagccucacgagcagggggagcuugcucacugccaggguggagugcauuuucauguggcuuuacuggaagaagagguuuucuguauugugaggaagcuagcuuuuccucggugcuucucaucaucccuggggugacaggcugcugauaggugaaguuaagacacagagaaugcaggcaguuuucuucaaugucccauuccucugccuuuuaaauuuaaauguaucuguaugcauggguguuuugucugcauguaugucucuguaccacuugugugccugccuggagaacaugaaggucaggaaggaagcacuggaucccucgcaccuggacacauugucaguccccaugugggugcuaggaauugcaccucuguccucuggagagggagucaguacuuuuagcugcugaaucagaucuccaguuacuccucgcucccugccuuaccauguguucuauauuucuauuuuuuauacaccacuuuguaaaauguuugaguguguauaaacauaaacauauccuauccugguagauuguuuuuggcuuuuuuuuuuuaaguaaguacugccaaucaaaagguaaucuugauuuguuuuuuacagagugauggugaggaucuuaauuacauuauugcauuuuuccuugggacagcagccugccuuuaccagguagguuuccucccauuuguaacaaacacuuccccauugcuauuuguuucagaugucgggucucauaauugccuguguguuuaaaauacauaaaaauggugucugaguuauuugccucuccuauaauuuggucuucuguuaucuuuguaaccuacacgucaaucuugaguuguaggcagauguucacaguggacuuaguccuaacccuuucucugugguggguuaucaggggugccacgucaugugccugcggcagaaaggcuacuucucaguugucuagugagaacgagaggauuugugcucuggaggaagccauuaauaaggagugacacagcaaaguaauauuuuaggauuuuuaaguaggcaugacuuuucaguagaggcgaauaggauggauuguaaacagaaggacuggcaguuaggaaaccaguugggagaugauucuagcaauucagauggaaaauaaagggagcgugaaguuuggcaauagcagcaaggccgugaaagaaauacugccacugagaaggaaggccagugaauguguagacgacucggggugggggugggggcagguucugugccuggccaguagggagaucagucucaggagagaugggaagaauggccauggcagugaggaauacucaggaauaacuuuguuagaccauaaggagcaaacaggguccacugacccaaccuuuauaaguggcguguuccuuuggcgucuaugggaaaaagaaagaaaagguaggacuauuuaaagcucaguguggaccuaagacuacccaaaauuuaguaggacgccgggggaaaauacuuugauagguauuugagcucuacacaaacauacauuauacauuuuaguuuuaguggcuucacuuuaaaaucuuuaaacuuucuuaauguuaucuuuagaagucuuauuaaauuugacagguuucaaaugacacuucauacagguaaugugacgccauguguuugauaguggaacacagugugcuucaguuugcacaguguucucuugaggguuucccacuuuaauccuacacccugucauauaagauuauugucucauuuauaaaaaugaggacagaaggacucaguacuguucuguggcagcauaacaggaaaagggaggagccgaggcuacuguugcagaguuagagcacagguucacuccccuauagcaugccaccucugugcccaaccaagucacuaauccugcuucuuuuucuuuuuaaauuguuuguucgugaucgagugcugcagcaccauuucuuuaucagacugcuuucuuccacggaauugcuuuugcaccucuauaugaacucaguugguguauuuugugagacuuucuggguucugaauuacguuaguuuggucuauuauccuucuaccacaaucauauggucuuuauuacccuagcuauauaccaccuuaaauucaguuuuccuaauaguuacagaaugauucacauuuucuauuucagcagaugaaauuaugguaguuuggggguuuuguggaaguggucuauuuuaucuaauuuauauguauagaguugguagucauaucucuauuccuuuggugucugcaauguuuaugauaguguuucuuuucugauguugguaauuuauauugucacaguugguccugucaguuucuaugucacuguuugaaccagcuguucaguccaucaggguuuuuguuuuguuuugggguuuuugggguuuuuuuuuuuguuuuuuuuugucccucuucuguuuuucuguuuucaauuuuauugauuucugcucuuguuagaaguuagaaguugaccuuucuagguuucauuucaguucugguuuugucucacauguuuuaaagcuaugugguuuuaguucaugcaaauuuaggauugcucuguugucuuggcaguuuuacucaugugucaucauuuucuuugcuuugaaguguuuuuauauuuauacuuuuccuuuuuugauuaauguacaugacauauucuuuuucaucuuuuuacuuuuaauuugccucuguuauuugaugcaauuuucugauaaugaaauugguuuuuuagucuacuuugcuaaucucuuucuuuugguugcuguauguaagccauuuacauuuaauauaauuauagauauauugggcuuucuuuuuguucuauuuucauuuuuuaauuuucuuuuuucuauguuucuauaguuuauuugagguuuuaagaauuccacuucaauauuaucuauaguauuuaaaaaccugauggauuguaaagugguuccugacuauagguaacaaacaauagauacuugucauagucugcuguuguuacuucguuuacugagauauagacacauuaucucccuagauguucuauuguccuccucuauuuauaaaacuuucauuuuccccauauauuccagaacaugucagacacuuguaauacauuuuuuucaacugugaaacauaaacuuaaaaggaaaagaccaccugucauaccuagucacaguguugcuaccguugguuuuucuuucugaauauuucaaguuuuuucuucuuuuguuuucuuuuuuggcuuagaguaaaauuuuagcuguguaauauguuucaucaaggugauaucaacagcgcucauugcaaggcaucuuuuuucuucguugccugugaaaacuugagucaucaauuaaauuuuaauacaagaaaaacuuuucguuacaguagaauuccaauuaaugaauguagaaagaaugauggagauaaaacgucacuauuaaaucaccauuaagcaaacaccacuguaauaacugaggcaggcagaggguggcauacauucccaucaagggguccaaguugacagcacugauaaaacauacugccuggcaccucuguguuguucuuggcaaaauuacauaugcuuaacucaaucuuggaacacuggacacauccaaauugaggaacacagcuccagcauaacugaugaauauuuaucaggucugucaaggucaugacugagaaguuauuacagauuggaggagacgugaccgcuaagaguagcacagaauccugggugggaaaaaggucccuaaugggacacuggacaaaaucaaagcccaucaguuagcaauccucacugugaucacguccuggugugaugacuguucugugguggcuguggaaacaguacagcucugcuauuucaaaucuacuccaaguccaaaguuuauucaaaagaaaacucaugucuuuaaaccuuuauuucacagugaaaaucacucucuuaaaauaaaugcuuuuauuuguggcauauagauagcaauaggguuuuuuuuugguuuguuuuuuuuaacagcaggcagggucuuacuguauaguucucuggcuugccuggaacuuuauaggccaugcuaaccuacagagauucuccugccuccaagugcugggauuaaaagcaucacucuggugugcauucuucaguuuuaaauauggacuaaucuucacucgugaaagaacuaauguuuggcaagaacucccuuaccucccauucugaagccuggauacaguucacagaaacuaccgcugcuuuucagagacuucacgaguguauacaaaucccuuacuucccagauaguagauuucaggcacauucuugaaaaggauccauucagucauuaaauuuuguacagcacuuauuauguacuuggcacuauucuagacucuggagaugagcaaaugcacaggagcuguaggugacaagcaaaauaagcauguuuauaacgugggaaaaugaaggauaaaggggacaguacuagggcuggugggugggggaugcuaccuuuacugucucacugaaagagcacucacugucauucuuuguccccuuuccuacuuucuaagcuauaacugcuuuaagcuaaaugaugaagauaugcuaauaucacucugucccuucaguggagacccaacaaugcaauggcuuuguuucugucacagcugaggagcaagacccaacuccugcagcuccucacuaucccccagccucagccacauucuaccccccaccccacccccgcuguuucucacaccucagacuuguuguuuucuuuaccccucagacuccaguugugggagcguccaucuuccucagcuguuggcugguguuucugugcuuuccuggguucacuggcccaggggcugagagcucagcaguguaucuauccuguucccugcuaggguagagaauuucugaagucugucuuacaagggagucaccgggcuguacuuccauucaacauaugaugaagaauguuuuucuucugaaaacgaaagacagagaagggaaaaucuguuucccuuucgagcccuggaacucccgugacugaauuucuccaauagcuuacauucucuuuuucuucucuaggaacuuccuucauuuucuucucauguuuuauucuacucuguuacauaucuagcucuuuuccuguaaccuaaccaacucugauuuuuauguuuugaacaguguuauuuacuuguguacuacaccagcuggcggaaugucaagucauuucugacuuucggcuuaaucugucugugcaacauguaucucuacgaacugcgcaaccucuggcagcuuuucuuucaugugacugugggagcguuuguuacacugcagaucuggcugaggcaagcccaaggcaaggcuccugaccaugaugucugacaucucccuucggaugauuugccuuugccuucaggggaagaaggagaggacauaaauuugcugccagugugaugaagaaaccagucaccacaccagagaagcucugcuuucuuucucugcccaucuucccguuuuguuuuacaaaucagccugugagcgugugagaccugguaagaaaacuuccacaaggauccuuccuacaguggaaugucaggccaucacagcagaaguucagaaucaccugaagaccuggcaggcagcacugaauccucaccagagaguuaagcaaagcuuaguccugggacgugcucugaggaccaggcagaaaugcugcaaccuaaguuugccuuugugaggcauuaguguagaccaaugaagaagaugcugcagcaauuggaaagcuacgaucuaagacagccacuguacuaagugucagauuauuggcacaguuguaguaucgagaguuuaugaagccuagaauggcauggaauugauuuuuuuuacuuuuucuguuucugccaccuuuuaacucuggagaucaccuggugugggagagggcugugauguacaucucuacaauaucacaaguccugacaacacagugauaacguguuuucuuucuagaccauguuuaucauuucuuuugaaaucacuaaaaauacaugauucauuugacuauuguggucuuccaaauucuuaucauuuggguacuauguauacuauuauuugcuuaguuucuaaccuuuaagaucauaaaguauuuaacaaagaaaggagccccuacuccaaguggaaaaugaguuaucaguuugccagcacacaaugaaaugcuaaguucucacaagguacugauacccaccagggcucuagacccaaguagcacauucauuguaauagugaaagguguugccuggcaccaaaaugagagcccugugggauacuccaaggauaauggaaaacugcaaaggcaauggcuuuuucaugguggcacagcacugguuaguuaugguuacacccagaaccaguucauuuguuccagagcugcugagugugagaaaugagacguccccugacaauuccguuuacuuaaugguuuggggagguaacugguauccagaagaaauaacacucuuauaaccuuggaagauuauucaagccauuuugaauucaugauagagaagcacagcuugauucuauuugcaaaaauguacaagucuacugguuuggagccaucaugaaugauuugccuuuguuuuuaaagaaaagauuccaaacaaggacugcauaggauucugguaacuuuauaucaucccucaaaacaaugggccuugguauguagucccuucaggggcuguaauuacuugauaggaggagucacugaacugccucaucucucuaacccauuguguggacacuugcaaaaguggaagauaccuggaaccuucacugccccuccaucuuagaaaaauaagguagaagguaggcaguaaguggguuuaugauguccaugguuuauuuaaaacaaacuccaagucugucuagauuucugugguaacaaagcugcuaacaaaguugucacguaccuucugagagcagccccgagcgaggcaccacauggacuguguuuggcauuguauaccuauugagccuuguaaguaaagugguucaacuuaggaaggcuuucugagcuaguggguagagcagaagagauuccucaugauaguuaaucaaccaggaaaugugggcuuucugauuaauuguggcuuuacuacaucuccguauuugauagcucucuuacugguuugauucaaaagcuaccucagcaucacuguguuguguugcaguguuuagaauuugagucuguucagcaggggcacuugaaaaaaaaaucaccauuuauuucuaaaagcuuguuuuucuguuuguguuuuaccagcuguuuuggguuaagagaguguuuauaucuuaaugaaacagcuauaaguaaucuuuucuguaucccacugccaucuuucauucuuuagaaugugcaucccuaagagggaacauaauuaccuugauguuguccaagaaucucuaggcuugucaggguccuagagagccucuucagugucuaagcuguagcacugauagcagcuuccauuugaagugcgccuuuacucccaagcauucgcucccucgggguccucgugagguguguguggcugugcuggaguaaucagauccccacuuacgugucacauagcuaaguacacgugcgcuaauugcgcaccaggcucugugaccagugugggacuaaugaaaggacucugugacaacagucuucccagcaugugucaauggauguuuaucuuaauuuaguucugaaaugcugccuguuuacucugccaagaacagacacucugucauaaucuaaaaguauuugcuuacuuuauuggucuggguuugaaauguauucauacugagucuuuucccugaaagaacaacaugccaagaaaagucacaaaagaugguguuguuaaaagcugaacagaaagggagacagaccagagcagugacauacaauggggagcuacagcugccacuguggcucggagggugugagucgguguccagaagcuagggucagaagggagcaaguuagacagggcucugucaaagaugaaacacauuccagauaaggucucuuguacugaugaauuugguaaaaauguucucacuugggguccugggaagugcuaaaaugagcagaacucuuaaauagacauuguauuugcauauugugcagauuaucuguuugucacagguuuccauuucuguguguaugcaugcauguguguuugugcauauguguguguaaggauuuuauuuuguuccuauaauuaagaauucuugcccugagcuaagaacaaguaccuauuaaagcaugaaaguccauuugagacgaaugaaucaug

SEQ ID NO: 8227 - RNA, 6252 nt, Mus musculus
gaacaggcugcgagagaguggcgaggacaccuuuacagcugaggacagaucuagaaaggugaagccuccagagauggagggaucguaagaagccuggacuguccuaccugacucaggggugagagauggggaccugggugggaccugaggccugcagcagccacagcagcagagagacgcgaugacaagaagggaaggguuguaaauagcagagaacaucucuaacuccagcaaacuucagcagagaaggaauucccugggaagcucucaggggcuccuagaauccagaaguauguuaacuaugugugcuccuuagcaaaguagcccaacauuaugaggguagacauaacauauuuguaauucacaguuucugcaaauuagcugugugguucugguuugaggguucuuuuuagggcucucgagguguuggguaguuuugaccuucugaaguuuggggcuggaggagcauuuugaagauggcauauuuacuugggauuagcacaacaccccauuaguccauugacagcggacaacggguuucauucucuuauagaugaaucuuauugcaaccccguggagcucucagggcauagcaguuggcuuucugcagaggaaacagucccaagggaauagggggauggggaagaaagagcagugucugcuagcaucuagucucucaagucacacaccagugcgucacuguauuccacaugaaaaugagucaugagucuagcucauuuugauggaaagggcgaguuaagucucacccccuugaugaugauguauauuugugugcacguucuggaaauuaaaaacaucacaggaaaguuggagauuugaagucuuuaaaaauuagacaggaaguugcauggcuaccucuccagucaaggucacaccaaaaauaaaauaaaauaaaauaaaauaaaauaaaauaaaauaaaauaaaauaaaauaaaauaccuggguaagcaggacauugaagucucugcugcccagacaugaaaucugaacgcaaacguucucuaugucaugucacccuuguucaaaggacaaagucaccaaccccagaggcugauuaguugaggaguuugugucacuaugucucagugacguuugagacuuucccaaauauaaggcaagaucuugacuaauaccaaagccuacauaguucaacuaacauacauguguguguaugcacaugcgugugcauguacacacauauacagacacagacaugcacacauguaauugcugaucucucaaacacacaugcacacacgcucgcacgcacgcauucaugcacauacacaccaagagcauucccacaccagagggcucuugucuuuuacauuuccaacugggugucuauaacaguucaaugucauugacuuuggggguuaguguggacccuauggguugaguggccacaccaugcucgucagcacagaagagagaaacacaaagugccaggagacucauaaguaucuguacaagacauaagugauucagaggccaaaggacugccuuccaucucugaaagaccccaggagcccguuucugaaggugcgaaggcuuuccugagguauuagggggagggggagggggggacaccacggacacggggcagggggcgggggcaggguguuggguuucacaacaccgcuaggaugagauuuugagucauuuaaauguaacuguaauagaagagcuacccuauagguggaagauagcuagauagcccagauucugagacauggcuuuaaauacacaccuuaaagucuuuaguaaggugaacauuauuacuacggcggaaaacagugucuucuaaggucaauucuagauuuaguuuuagcaagacugcguguuuuuuguuuuuguuuuuguuuuuuuaaugagcuagauagagccagaggccuuacagguaaagccaccagagagggaaaaagaaaaagggaaggaauacagaugcauuguggaaauagcucacaagacagaugcaaucaggaggaagccagaugcaauuacguccucaggugcucagugucaccugggggcuagacuucuaauagucccauaucccccgcucaagcgugaugacugaauaggguuugggggaacucuaggcacauaaggagaccauuuucuaacuaaaagcuaaagaaggugcccaggagguaauaccgcuuuaagcaggcuccuagcacaaugguucuuagcguaugaaucgugacccauacagggguugaauagcagauauccugcauaucagguauuuacacuacaauucauaucaguagcaaaauuacaguuaugaaguagcaacaaaaauaauuuuaugguugguggugggcagggucaccacaacaccaggagcuguauuaaagaguggcagucuuaggaaggcuaaaagccacuguccuagcaggagacaagaugaguggguggaggggaaggcaaggccaggagaggucaagggcagaaaggacaguucuuaacugcacuugccaacuugagcacuaggcccuguaaugugaugucuccuuaauggaaugucagauggaugcccugcaaauggucuaugaugaauguccaaucaauguccgauagugaauuccuaauuacucaauacccagucaugcuguccucaggcccacugaagcaaggugcagagaaggaggcccugagguguccuccugcacccugguguuuggaaggacuugucaggaucuucuuuuggucagaagcuugcuuggucacuuugcucugcgguuugucuauaaugccgagagaguuuccuuugugcacugacaaacacauuuguuacaguguauuccaaacacuugaucaucuccaaccaugcccuaggccuugggcuggagggggugggugggaagauaguuggaaucagcuagauucugucuuugucuugagacucuuugucucacugucucucugucucugucucugucucucucucuguugggauucagggacuagaagacugagacacuggacaaguuagaaaaauguaauacacugugaaaaagaacuaguaaacaguagugucaccuaugugaugcagguagaugcccugacugugcagucucaugcacucuucagcacgaccccgggaacauuccuaucucaucugcagaaggaggagauggacuuguggcaccucucugggucaucuggacaguaaguggcagagccugccccaugcccauguccuucgaaggacgcaggcuuuuguuuccaaaauuacuuugucaccuggagaaaaaacaaauuauaaagaaacacugggcuggcaaggcugcuccucugguaaaggcaccugcccacagcuauggagaucccaguucaaucccagggucccacaguggaaggagaaacauuguaaccuuguucacugguucagccuuggcucugaauacacaacacgagcacuuugugcccucacguuguacaccgccaguaaacaugaccugaacugcccuggcucagacuggagccuacagaauguuaucaagcaacaggauuugcuuguuugcuuguuuguuuguuuguuuguuuguuuguuuuuuacugugugugcaaaguuucuugcuuuuacagaaauauaagaauuuuauuacagaaagccaagaauucuaauauguuccuacuaucauuccccagcacauaagugucugauugguaacgcuuugagcuguauuguuaaaaugguugguuuuuuaaauugcuguuugaauuagugacuuaaauuucaugaaaccacuaaauacauuuugauuugggauuaggacagaauuuccaaccauuucagaaauggcaccaaagacacuucuaccauuuuguauuauguauuuaugcaaagcaaauuucccagcaaggaucagcuuaaaauaaaaauauugaucaacccugaaaaaauguugaagacucaugcaguaacaaauuuucagccaagauuuguuugguaaaaauaaauaauuaggucuaucucauuauuauggccucuuaugcauuaauacuaauuaaguaauuaguauaaacuuuuguauuaaguguuuagcauuaaucuuuaauaaaugguaugcuuauauguuuaacaaauaacuuuuuuuuuuugagacaggguuucucuguguaggccuggcuggccuggaacucacucuguagaccaggcuggccuugaacucagaaauccuccugccucugccucccaagugcuggaauuaaaggugugugucaucaccgccuggcaacaaauaauuucuuuaaaauacauuucuuuuuuuaaugauuuaucauugugaaguguuugauuugugaaccuauuuuauauauuuguaugcuugaggcuucauacaaguuuuggaugaaaauagggucaaaaguauauaaagucuaagaagcucugauucaagccaggagaacauuuguccccuuuuggaggccuugguauagagagagccacauacaaaaaagguugagauucccgaagaacagggccacacaaggauguggcuugaaaccuauuuauuuuugcuguugcaucuccucuuucgccucagcccucuuugacgacaugcuuauggucccuuggagccuggcuuucccggauugcaaccuccugcuguucucagacaaacucucccgauuggacagcagagcugcaucgcucacuuuguguugacaaccucaugcucauuaacccacucaacagcugcacacagaggaagcaacacacaggacgggagcaaagcaggaaagggauaauuaaaagggccccaguugauucuggagccacggcuucuugggcuucagucuccuugaucagcauccucugccagguccuuucuguagucgcagaacucuccugaucucuaaacugaaaucugguuaaugguucacaaagaauggugaagaguucgcacugagguccccaggcugugaccacuaggucagaacaaccaugcagggccuaugagccgcuguucuuguuacugugacugaugaagcaacuuagggaaugaaggguuuagcuggcuuacaguucgaaaggauaccauccaucaugguggggaagcugggggaguaggcaugugagggagcuggucucguugcacucuccgucaaugugcuggcuaguuuuaugucaacuuaacacagauggagucaucugaaaggagggagcugcaacugagaagauaacuccauaauauagggcuguaggcaggucugaaaagcguuuucuuauccuauuauaugcgauaguagcacucugggccggugcuccucggugcuauaagaaagcaugggcaagcaaugaggagcgagccaguaagcagccuuccccauggccugugcauugauuggcuacugccuucaacuucuugccugguuggaguuucugccuuagcuucucucaauggacugugacucagggauaugcaaaucauggugcuuugucacagcaauagaaaccaagacagucaggaaccagagaguggacaagaacagggcuagaugauaaaacugaaaggcccauccccagagacccacuuccuccaggaaggcuccaccuccuaaagaaucuacaaucuuuuaaaguaguaccaccagcuggggaccaaauguucaaaaacuugagccuugggggacacuccacauggaagccacaauggaagauuaaaaucccugugcacauguccagcuagaacccaauuuuagacauucagaaugcauuuucucuuuuuuaaaaaaaagauuuauuuuuagccaggagagaugacacuuccccuuuaaucacagcacuugggagacagaggcggguaggucuuuaugaguucaagaccagccaggucuacaaagcaacuucccaggccagccaugucuacaaagugagacucugucucaaaaagaaacaaaacaaaacaaaacaaaaagagcauuuauuuuuauauuuuaauuaugcauauguguguauaugucuguguaggggucugugcauaugaguacgggugcccauggaggccaagagauagcaucggauccccugaagcuggaguuauagguuguugugaacugccugaagugguugcugagaacgacacucuggauuucuacaagaagacucugcacucuuagcugcugagauaucucuuuagccuuccagaaucacauuucuuuaaaaaaaacuacauuauauauauaaauauaugcauaaaauuuuuaaaugaugua

SEQ ID NO: 8228 - RNA, 75439 nt, Mus musculus
ccggccgcgaucuucuacccuuuccacucguagggucccgggcuucuccccggggcauuccuggguucccagcgagcaggguggaccccgccucgccuccuccccucgggcucgggcggcgcaggcgcagcagacgcgcccgggaggccgaggacuagagcagcuccggcuccggcucccgcuccacccgcccagucagcucccggcuggucugcggccaccgggacgcgucgggcagggccggcgggcggcgucgccaugggcucggguuggagcagcgaggaggaggagcggcagccgcugcuggggccggggcucgggccugcgccgggggcugcgcgcaggggccgggaggcgacggccgugcugccugcggcgggcccgaaccccgggaggguguacgggcgccgcuggcuggugcugcugcucuucucgcuccucgcguucgcccagggccuggucuggaacaccuggggccccauccagaacucggcgcgccaggccuauggcuucuccggaugggacaucgcgcuccugguccucugggggcccauaggcuuccugcccugcuucgcguucauguggcugcuggacaagagagguaagggguccgggacgccugcgggcgugucccuucucugggaguuggcgccugccaggauccgggccugccugugucucccugggcuuggucuagggguugugugaggugacccaguguagcuggcaucccauuccuuacucgggaacccucuguccccaaagcgacaaauacggaggaugcuuuccaaguauugauguuuuguguuacgcccuuuaugccacaaucaucagauguagaaggcuuuguauacuguggacaucagagccauccagugcacuugcuaugaaugucuuugacaccugacaaaagugacucaugcuuaaauuucaaagagauuuggggugcugagagcgaaagaucagaagagacuggugaugaccagauguaagaggguaaugagcuggcguggugacuccagcccuggaugacuguugggaaacucgggucugacgcuuggguuucuggaagguagaaccccagguaaaccgagagcuuccgccugggugacuucucaguugcgauuuauuacucucagauaaagaucgcagaugcaggaaggcucucuuucaguuagggacuccaggcuucucacuuugccaauugccagugugauucugugagaugaggaaaaggccagaguggaaagagucaagauguugaauuaucccuccagaggauaaauaaaacccccaggaggcugcugugcacgauuuagacuucuuagguuaugaggucggauacuggucggaaacugcuuuguuucuguucagucuuuuacgaguuuugauacaauagauucuuuggguaguuuugggacauugccuuagucuacuggcccauugacaaacagccauaagcuuauaaaaugaaggacauuuauuuauaaccccucuggaaaccgggaaguccaagaugaagggccaagcagaaugcuuaucuggugagcaucguucauacaaugcucauuucuuuguaaugucauaagggaaguggccagggaucucucuggggucucucuuaugagggcaguaacccuaucuguccagcccuugcccucaaaaauuuguuucauccccagucggccaccucuuaguucagucacuuagcugggaguaggauuucaacauaggaaucugggugaacacaaacauuaccugcaaaguaagaguggaacauagguugauauggagcugugaucaucuggugcaacacaguccucuaacuacugcuguggcaagaacagaauccagcugugagguucccucucuuccugaugguacgggaacccacguggaagagacaagaaaacugaugacugaauacuuccaugaucaacuugaguacaggugcucagaaagggaggcuagagaguucuaagcacugaagaguaggauccaaaagaaaaggaaagguacuucgguauguucuacacuagcacucagucaggugcauucuuguuauuguuguuuugguuugguuugguuuugguuuuuggagacaggguuucucuguguagcccggacuguccugaaacucgcuauguagaccaggcuggccuuaaacucagaaauccgccugccucugccucccaagugcugagauuaaaggugugcgucaccacugccuggcacgcucauuuuuuuuuaaggaggucauuuggcaaacugggaugacauuagaguugggugacaaccaugauaauggguguaaaagucaugaaacuuaagauaugaagcuucaaaaaacaaaacaacaacaacaacaaaaaaaaaccugaggcagauagacugcaugaauaucagguaagagcgcuguaggcuuaguguguauaguuuuuuuuguuuuguuuuguuuuguuuugguuuugguuuuuugagacaggguuucucuguguagccuuggcuguccuggaauucacuuuguaggccaggguggccuugaacucagaaauccaccugccucugccccccccuccccacccagugcugggauuaaaggugugcgccaccacacccggcacguguguauaguucuaaaaggaaggacucugguguaacuugggugugaagacccugcuagugggaagagguguguaguagaggaaggguauguugacugguggagcucuuucuuccaggaagagcuggcagagaauucuaacaagcaccugguauaggauaagguagaagagaccaauuauuagaugcugauguauuuagugacuugaagcauugcuugucccaucugucuguuuuuucaagcaugacuucacuugucaccugaaacauuaugaccuggagaaaucgcugagacaaugggucacugaaacaacccgcugacugccuggauggcuucuguaaacaccuagcuugcuugcccaccccaccucuugguuuuggauaaaaaccgaguauacaaaagaccuggguuugaaucauuucaggggcuguccuggcucugcccaccagaggccccaucucccucucuucauugguguggggugcuuaauccagaaugauuccuguaacacacugaaugggggauugucugucuguuuguuuaggggcuuucuguuugccuuuaaacugaguuacagauuauauucgguuucauuaauguuuucacuguuauuuguuuuuuggguuuuuuuuuuuuuuuuuuuuuuuuuuuguuugucuucuguuaagauucauucuaguuuuuucaaauacggaaauuuaaauaugcuccuuuaaaaguuggccauguuaagagucaccagaaagcaacaauuaaggaguugaggagauggugcaguagguaggagugcuugcugugauugcaagugaacacgaguucaaaucccuaagcacccauguaaaagcugagccugacauccgagacaggaggaucccuugagcuccagugagcuucagauucaguggaagacuaucuuuaaaaagaagguggaaagugauagaggaaggcaaccaguguacuucucugucuacccaugcaccugcaaacacagaugugcacaucacacacagaccacacucacacacacacacacacacacacacacacacacacacacacggagggagagagagagcuaaaacaaaauuagaagaggccuaaccauagccuuacuaaacuuugauuugauuuggugagugagauacucuccauucuacaaugcaggaugaacacacccaccauaacacugggucucauggguauaaacaaagagcacagaacagagaaaaccugacuguuaaccacagauuguuccuggccacauuuuuuuaagugguaaagcagaggagacuuccuuaugauacugacuuacuagaaaucuguccaggaaagacuggucuguuuugugcuuuaucuacuuccuuaaaguuuuaauuuaacuuuagcaugaaugacgcuuaggcuggcuaguuuuuaugucaacuuaauucaagcuggggucaucuggaaagaaagaauccuuuuagagaaaaugccuuuguaggugugugugugugugugugugugugugugugugugugugugugagugugugugugugugugugugugugugugaguguguguguguguguguguguguguguguguguguaggaagagagagagagaaacugauguggguguagggauucaaacuccaguccucugcaagaauauauguucuaacugcugcaccaucucuccagccccugugguucauuuuuuugguugaugauugaugugggaagguccaaccccuugaggacagugccacccuuggacugguggugcugaaugcuauaagaaagcaggcugagcaagccaugagaagcgagccaguaagcauaucuccuucagguuucugcuucaguucuugcuuccagguuccuuaguuccugcccugacuucccucagugauggaaugugaccuaaagcuuauaggcugaaaugaauccuuuccucgccaagcugcuuuuggucaugguguuuuuaauuaagacaauucaauuuuggucugguguggucuggucuguuggguucuaauauagaaacucaguccaaaacaguccaaaaaauaauuuuuguccaauggaacaaauacuuuuaaacuucuuuuuuucaguggcauuuuacuguuacuuucuuuuuuaagauuuauuuauuuauuauauguaaguacacuguaguuguccucagacacuccagaaaagggcaucagaucucauuacgaauggcugugagccaccaugugguugcugggaauugaacucaggaccuuuggaagagcaguuagugcucuuaaccgcugagccaucucuccagcccuuacuguucuuuucuaagcuuauucuucuugcuucugugcuacagaauguuaguuucuaguguacuaucaugagugcaucuaucauccauggcugucuacauuauuacuauucccucuagaaaauaaguugcuuuggggaguauuucauaguuccuauaucuguauaguaaauuuaauuuuguauuuuccauugguuaaagcaauaaaaaaaugaauuuaagauuucucccuugagcuggagagugaguacuagaguuugaggguccccagcacacacacuccacgcacagauaaccguccuccagaguucuuccuuuuaggaauaguucuccuuuucagugagagcaguuaagacacuuucauaaugcugguggugucucaacugcacccacccacagcaaguucucccuuucaguggcuugcucacugggagguaugcagcucucauuuguuagcguagaagcucuguuaucuuucuaaaacggguguuguacuuuccaccccuuuccauucaccagcaaggaaauagaagaacgcguuagugagauaauagugcccggccugugcacccuggaaagcaagccagagagcgaugaaggcgauagcaauacugaggugggacuggaggcucccagagucagggucuagugagaugacugagaaacagagaggacuggcagugcuuuggagaaaaauaaaauaaaggacagucaaggaggaaggguguacagucugguguaaucuuguguguuccaguuuauguaaccugccccacuggccucacauggaagguauauuugaguggacgccugugggaagagggaaagcuagcaugugggacuagaaugucuggagagagacgggggggggggggggggggaagagaaagaaagagagaaagaauggcugugguuggucuaguuuaaacuuaucccugacuagcuuacaaaugaaugggacucagacuaugauuauuuuauuuggccuugacaauuacuggggucugggagggggguagugugucccucacucccuucuugccccauccuucucucuuccccucuccccuuucucugcaacccccacccagguaacucaaaacccaucuaccucuaaucgcuccaguaauuggcuguagacauuuuuauuuagccaauugucgugguuuguauaugcuuggcccagagaguggcacuguuaggagguguggccuuguuggaguaugugugucacugugggcgcgggcuuaagucccucauucuagcggccaaggagucagucuuccauuagcagccuucagaugguaaagaacucucaucucagcuuugccuagaugcugcccugcucccaccuugaugagaauggacugaaccuauaaaccagcccaauuaaauguugucuuuuauaagacuugacuuggucauggugucuguucacagcaguaaaacccuaacuaagacagaaguugguacaggagacugggguauugcugugauaggcuugaccaugcuuuuguuuagaagaauggauuuugggacuuuggauuuggaaagcaguagaaugcuuuaaauggggcuuaaugggccauccuagaaggaauauggaagacuuuguugcugagagugauuugaacugugcugaccuggcccaagagguuucagaagagaagaauuucaguauguggccuagaggcugcuuuugugguauuuuggugaagaauggggcuacuuuuugcccuugucugaagagucuacuugaggcuaaggugaagagauuuauguuaauugcauugacaaaggaagucuugaaaagccuagcaaagacuuuguucuuuggauuagucucaugaagaacauucugaacaaguguagcaagcuuagaaaggaaaaauauagaauauaugguucaaauauuaaagggauaccagggagugaaauggagcugaauccuguguucuaggagauagcagauuaagggaguaggacuuuggggcaagauccuacccagcuaaauuuagauccagguuguucguacacaccuuuaaucccaggagauaaaccaagcagaucuaaauucaaggccaugcugggacagacuagguucuagguaaagaaaaguuuaaauccaggugugguggcacacaccuuuuuuccccaggagauaggcaugcaaaucuccaaguucaaggucaaucuacagagcaagauccaagacagucaagcuuaagaguuggaagacagaaagcuccugacaguguaauagaacaagggggccauguuccaacuccugcaagcagcagaaccccgaaucuucugccacguggcucuggcuuuagaaugaaaaauagaacagacuauuggaacaauugaugcugguuagcuggaguuaagauauuaguggugauuaagaagaaaccagcaucacugaggugacaucuucugggaaguguuuucugugagcacaaagaagguguguuccagagaagaccaagguuguaccuuaugcuucccccacaaccccccagguccuucucucucucucucucucucucucucucucucucucucucucucacacacacacacacacacacacacacacacacacacacacagauuaugaaaggaaugacaggcauuuaagagaaauggcauagagauuggggguuugaaauccuuguuagguauucgugaagacaguugaaacugucaguugggugcauaaauaugaaguucggagauguguauaggaacuauccccuguagugaacuuugaaaucucugggccggguuagauaucggugaagagugauggagauugagaacaggcuccagccuggaucaucccaguacucaagaguuggggaaagaggaaugaacccacagugaggacagaauggagccuuggauuuagaacacgaagcucuucggugucauuugaaagaauggccucacuggaguaccaugguuagguaagaaugaugugggaaagaaacauuggagagauagugagugcggguguugcuuucagaagucauaccugagggaaaagagaacgugaacaagagcuagagggaauguagccacuaagaauuuucuuuuaaguaaaagaacuuaaagcauauuucagugauacaggagccuguggauacaugaagaagagggaaauggaugcugggaggagagagaggaauugacauaacugugcuuuaguauuuguaugaugagaugcaguauuuacagacagacuaauugaccuuuggagccuugacaacuaaugcuuacuauaacagaagacaagauguuuaccaaaaagaugcaggugauagguggugguagcucauggggcuuauuuugcccugugucucacucagaaaaucagaaacaaaauuauuccuugauaaaugagauaagggauuggagaaauaaaaacuuacggaaugcuuucuagggaacugcaggacauauugauuagaaguuggugguuggauuguuucagcauugaaucaaccaacuuuaaauggcugauuacuaauuuggugugagaugagucugcaugaguuuccauaugaucgccacccuguucuauugggcaugucuaguuuggcaagagcagaccugugcuuuuaugcauauguacacuguguguguguguguguuucacuaggauaauaggaccaaaaaaagucuaugccgagaauaaaggguuauguugaaagugauauaaaaagcugugucaagaacaaaagaaagaauccuuagguaaauaagaaaauuaguaacuuccuaauuuucauucuuuuucuuaauuuuuaagauuuauuuuuacuauuuuaugcgucugugucuguauacgcauuugugugcuaggugcccgaggaggugcugagccuucauguggauacugggagucuuucacgggaaccagugcccuuagccacuggcccagcucuucagacccauuuauuacucuuuauaagauaaaaacuuucuucucaugguuguuaguguaugagagggaauacgugggaaagagaggucaugauugcaaagccagaugcuuguaauucagauggucacggaugugauuuuguaaaaauggggccagaguguaaccaagaauguaacaaggagaugguugucuuacuuagggcuucuauugcugugaugaaacaccaugaccaaaagcaguuuguggaggaaaguguuuauuuagcuuacauauuacaagucuauuaaggaaacccaaggcaggagcugaugcagaggccauggaggaaugcugcuuacuggcuuaaaaaucauggccuccugccuuuugguguggucaucuauauucuuuacuguuaaauauuggaagucuguaauuugcuuuuuuuuuuuuuuuuuuuuuugguuuuucgagacaggguuucucuguguagcccuggcuguccuggaacucacucuguagaccaggcuggccucgaacucagaaauccgccugccucugccucccaagugcugggauuaaaagugugugccaucaccgccuggcucuuuuuuuuuuuuuuuuuuuuuugacuuuugcagaggguuacaauuaagaaauuuucuugagucuuggaagagacauuuaaaaucguugaaacugugaaagacucuggguguuugugaaguuggacuaaaugugcugugcauuauauugcugugagacuaaugggugccagggagugcaguguggaggcuugacucggggccccucccugcccauaggccccagucuuugagcacuuggguaguggugguggaggaagugugucaguggggacgagcuuugagaguuuaaggucuguuccacuugcagucugcccucugcuucaugcuugcuguauagauccgugguaucuccccucuagaaccauaaaccagaccagcccuuccuucugugaguuaguugccuugguugugguauuuuaucacagcacagaaaguaacuaguggggaacugauuuucacuacaacaaagcaucagaaaagcacauaaagacauugagcgacugggcaccgcagugguccuggugauggcuucagcugacucccuggagaggagcagugcaaagucagagaagccgucauuuuccuaaguugaagacuugguuauuguagcuguuuguguucuagugauaacuauguucuccccuaaacuguuugcaggggaaugccugcacguagcuucugggaaccugcccccaguugguucugauugguaaauaaagauguuaacagucaauggcugggcagggcagacagagguggugggacuuuaggauuuccagguuugggaccaggagaagaggaagaagaucgagaugccaggagaaggugaaggagaggagagacgccaugccugagaugagugcaggacagagaggcauggccgccaugugaaggagcugggagagcgaggccugguugcugcuggauccagagcagccuagaaaggacauagaauuaguaaguaauaacucgggauucacugcguggagguuaggcagugguccagcuaucgagcugcuuaaggcguauuucaaauauaaaggcugagugugugucuuucauucaggaacauaaagcacugaggcgaguaccgaaccugcuguugggauuuauuuaugaaauauuuaauacaacagauuaugaauuuagaguuagcaauguagcccauuugucaggaugcccacccaucaugccagaugcccugacuuucauccccagcauccccuaagccagaauagugguacccagaccuguaaucccaaccacuggaggugaacagaaggacuaggaguucaagguuguccucugucucauuuggcucuuggucuacauggauuccaugaaaccaucucaaaaugacaggguaguuauaaaaugccauauucuuaggcuagcgagauggcucagcgagcaagggcacuagcugccaugcuugacaaccuaaguuuaauucccagaacccacguggugauaacuccuguaagcuguccucugauguucacaguuguucacacacacaaauguccaaaaaaaaaaaaaaucuuuaaaggaaaaucaaagaggccagcaaaaagaauucuuagguacaguaaguacugaaaaggaagaagccccagagaaagaaaauucuagagcuacgagagguguuuugucuggaaauuuuuccaaaggcuggacaaaacaaagcagaaacacucuaauagagaaggcagaaagaaagguccuaaagccccuauauggcuuaucccugugacagccaggaucgaggaucuucuaaaguauacccauauguauuuaagaagauggaaggaagcuugacuguguuaagacaaauauagaaugcauugaaaggccagcauuaaacuccuagaguugaaaaguuuaauuaguaucuaauuuuuaauuucuuaacuuagauuuuuaaaaauucuaguacuggggcucagugauuugugaaaccauuuuauuuuuuacuuauuucuuuauuuuuuacuuauucccaucucaucuugcuuacugcccccuccuggucacccccucccacaucucuucccccuccccuucuucugagugggugggggcucccugaguaucuccccaccauaacauaugaagucucugggaggcuaggcgcaaaauuucccacugaggccagacaaggcagccuagcuugguuuacauaucccacauaacaggcaacaguuuuuggaacaguccacgcuccaguuguucaggacccacgugaagaccaagcugcacaucuguuacauauguaagggaggccuagguacagccuguguuuguccuuugguuggugguucagucucugagagccccaagggccaaguuaguugacuguuggucuuccuguggcauuccuaucccauuugggccaccaagacuucccuaacucuuccauaauagucccuaagcuccagccacuguuugucugugggugucugcaucugucugagucagcugcuagguagagccucucagaggacagccaugcuagacuccugucugcaggcauaacggaguaucauuaacagugucagggauugguguguuugcccauggacagucggcugagaccauuuaaaauguccuaauauacaagugguuggaaucucaggagaagaagagaaagauaaaguauagauaaaauguggugacagaaaaaaacguuuugaagaaauaauggaagaaaacuucucaagccugauuugaucucucuauccugcauaucuaggaaucccagcagaagcaacauggacaaaacuacaucaaaacauauaaucauaucgacaucaaagcauauaaucauaucacucaaggccagugauaaagagaaucuuaaaaugcacaagagaaggaagacuggagggcuuugagaggagagucccuuggaggagagcuucagagguugggucccaguggucgugcugagcccucuagaaggcacagcggggagcuuucagacuuagagauuucagagucguuggauuaaaggauauauagauguguauauagacauggcguggguaaggaugaucuguggauuuuggaucuuggugucacaguuguaagcaggauaagcaggcagugucauuauccugauacuaucuguggcugacuggggcgauggcagaagagaggcuuggcagcaagcaggcuugucuucccuccaccucaggaaggagaggcccaggucaagcaugcgaucgaucacucaagaacuuugccccugcagcucuguccuugaguuaauuucgucuggauucuucguuucuauuuuauuaaauacuuguacuuuucuuuuuuaaaaagauuuauuauuauuauaucuaaguacaccguaacugucuucagacacaucagaagaggguguuggaaaacucauuaugggugguuaugagccaccaagugcuugcugggaauugaacucaggaccuucagaagagcaguuagugcucuaaaccgccgagccaucucuucagccccuguacuuuucuuuaguguaauuacagacaucuuuaaauuuucuuauaaaaauauuuauuuuguuuuccuuuuauguguguggauauuuugucuguauucuacagacauguuugcugugggaguguguucuaccaaacucgucauuacaugcuuuucuuucucaucacauaccguggucgccugagggccguucauauguagguuuuauuuuucucuuaaguguguucacuggguccuuuacugugccucucccccugagaugccuugauaucucucugauuaaauggaauucgaguccugccuuguugagguacaagggacuggaagaaagcauuccagucaaggcugagagucuacguggaauagguuaagcaacccuuggcaacaaugaaacaaaaagccugcuucuaguuucucuguuuguauaacugugcuauauccguccaaaauugcuugagugaugagcuuuucagaggcuccucauucuuacacuuauauaagcuauuacagcaucauauauuugaauaaaagcacccugcguagaagaguccugggcaguggcaauagguuaucuggaccacacagcacagccagugccccacugccucuuggcugccucuacaauuauaagcagaauccuuaagaggaagauaaaccuugugcgcaauauaaaauauaaagcucugucugcugucucauugggugcccagaauaacugaaaacaaguacuguccugcaguuuuaggguauuuauggccauguguguauuucccauuaauuacaccauuuccuguggcuaaacugccauuuccaagccuguauauugcugguagaagcaguaaugagcaguauguaugcaucccuuguuaccaggaagcacaacucucuguggcauuccuucugccaaauugcauuaaucauauucagauuauauaagaauauuauaaaguuugccccauucauaacacagaguauucucaguguggcguuuaugugccugaucuggaucuuaaauuuauuucccugugauguuuguucugcauaaucaucguuuuguuuacuuucaguuuccuucaagccgagaagaaauuugaaaaucaaacacuuaaccaucuacccucuacuaauuuuuuuuuucugaaaaggaaaacauuucauuaauuguuuagcucuguuuucucuguggcaugguuucuaauguugaauuugggacuauuugaaagaauuuggggcuaccuguaccauggcuuacuugagucaccugagugauguggcugccacagacauaagguaauaguaguucaguauagacagaagaacggcauuccaaacaugggcagaugcagcgccauuauaucguucauuauguauucacacugcaggugugaauacacucagcugucauguguauuucuaguuaccgugccuucucuuucaaucuguuccugggacaaauaccaugcccaaaagcaucuuaggggaggaaaggauugauuugacucaauaguuccaaguaacaguucauucauuguuaaagggaagccacgacaggaacuugaagcaggaaccuuggaggaaagcugcuuauggggucacucuuuggcucaugguuccuuaugcaauccaggaccagggaaagguugcuggacccuccuaaaccaauuaacaaucaagacaaugccgcugucccccgagucugaucuggacagucccucaguuaagacucccugcucugggacuccaggcugugucaaguugacacuugauaccuugucuuuauauucuuuuuugcccuuuuaugugccuggccauuggcacacauuuaaaaauaacugaucauauuaagaauacaaaggaaaaacuaccugguauacaguauugccuggaguccugagggaugauuuaaaugaaaaaaaaauuuuuuuuaacuugucaggaaugguaacauacaacuuuaaugccagcacccaugagggagagauggguguauuucugugcguucaagguuaacuugguaaacacagcaaauucuuggccagccagagcucuaaaaugucuucauuuccuccccugauuuucauuauuacuuuguuugugugcauguccguguguguguguguguguguguguguguguguauguguguauguguguguguauguauguaugauagggguguuguguuaacuuuucccggggaggauacaaguuaauauccaguaaccccagaugggcaccgaaaucagaccaaaguaugauuucacuaaaguucaacuuggugaccagugaacuuauuaaauuuucuuacagagcacaaagauuuuacuggcagaaucgcggugacacccaggcagaugcaucaccauaagggccuaccccaugguuggggagccucagggaguucuguugcaauaacuuucuacuuccuauauagccuagcauaucccaagguggggccguuuccgguugguccuuccuucagcaauaguuaauuuuaaauaugccuugacuagcucaaaggcugggcauaaucaaaggaguucuaauccucugccuggcuagcauacauuuccccccaguacuccuggucaacaccuucuaaaucuauguuuuaucuuugcuacccuauuacguucuggguagcccucuccauagggccacuuucccuuuccaccuacauuuuggaugaauuuucuucugcagcucuaaauccgauccgucucccucugagacauggcaauccuuccucucccccaguuccugcccuugcaaauucccagguucugccugcucagucuaccuacucagacuuuggcuguauggcaauucuuuauuaccaauuaaauccaucugggggcggagacccucagcaucugggagacagcauuagaaccaaucccuaacaauuaaccaggaccaaagacuucauccauauauuggucugcuaguugccauggcuacaggacacuuuucaagaaugacauguuguuaugaagaggugaaaagugaauacagugugugugugugugugugugugugugugugugugugugugugugugugagugagagagagauugguugauugauugauugauugauugauuuauggaguuuagaaaacacuuuucaggaguucauucuuucuuuccaucagaaguuccagggauugaucucagacucucaggcucacacagcaggagguuuaccucuaugucaucuugcuugcuucugauuuuaauuuuuuauaguaucacuuuauauauauauauauauauauauauauauauauauauauauauauguauauguauauguauauguauauauauauauacucacacacauacauguaugugcauacuuauuguuuuacacacauguauguauguguauguauuaugcacaccuugugcaugccuggugccuguggaggucagaagagguauuagaauugaauaauacuuucuuacucucagagucacacacaaaaaaaccacaagaacaaaacaaaaguaagcuagcuaugcaauuucucuauauacaaaggcauaucaccaagacggacuagcaaguuacggugggcguagaugccucugcaucuuuuaucucuaacacagagcauuuggcuguuccucacuguggaaguuucaccucacaguccacucucaguugacugauguggaaggaaagggaaaaucagaaccuuguaggcaugcugacuaaaaaccccagcucucaucuuaaagggaguaagagauagaauuggaguauuuuaagugaccauggccuggaaacauagaguuagguuacccuaaauuccaugcuccaucgugagcaguuacgcgcaguuacgcgaaguuuuaauaguuucacagaacaaagaaaguuauaaaucaagacaaguuuaaaauacauugguagguacaccagauagucagguacaacaagaugggggagcuauucuauaggaguggaugcuauuugaugacauucuuagcuuuagcaugggcagaagcuaguggucugcuaagucaauagauucuaagaggguuuuauguauuaucacgagaacuuaguuacaguacagacugggguaagcaguggguguuccagaagcuaaaaguagcccaagauaagguaauuggccucugaaccugcaaaaucccaaccuccccaucacucuccacagacacagacuccuuccaggagucuuucaguuuguagccagacauggcugcuuuucaggaauuuucacucacaggaggagaggugccaugggcugaacccagucggagucccuccaccccggggcagagucagaguucugggacucaggugggcaaggagucugcgagugacaagcagacacaaacacaagagugcugaaucugaauguaauuucucaaagugagcaucagacuuacauuacagaagaaaacuaggaaguuagguaaugcaucagccaagacacauugaggucauccugaugcaugaugacacaaaacagaacugcauaggcagugguuacaacuagcagccaggugaggauuucgcacccuagucacaauuuuagucuauuguauaacccacccuugccaaccuuuucaugaauaaugcaauacucuuaauuccuccuuaaaccacaacccaccuucuuccuaggccauuguaaauuccugcauaugagagugacuuagcuguuauucuaaguauccauagggaaccuccauuuaucagaggagcccaccaacuuucuucuaauauguaauguagucugccauaccugacuguaaugauaauucuaaguuuauuuuguugaacuugccuugagauuucuaacucuaaacaguaaacugcaaugccugauuucuuucacuaucuaucaacacuagaggcauuuccucugaaugaguagcauuaccuauaauauaacaauacugacugaaagaaagcacacaaaacccucuacugacuauagcaaggacacaucuggacuacauccauguuacaggacgccaaggaccccaggagaccaguuucugugaaacuuuuugcuucaggacugcgaccaagcuuuuggacuugucauuuagacuccacuggaguggcuguggcagagggggagugaagaggagcaggcacacagccauuaaaccugugccucuuagagagcacugaugccucuggaagugagguuagagauaguuguaaacugccaugaagcugaugaaccagggugcucugcuagagccacagucgcugguaacuggagccagcucuccaggucuagcagcaucauuuuauaaguugaaacccaucugaauauaucuguuaccuuagaauaauuuuuaguggcaauguaauuuuuauuaccacuuugaauuuggaaguuggaauuuuacauuugauguaauuuuuacuuucauuuguguauguguguauaugccuaagauauaaaauuuaaauaaucuuuuaaauuuauuuuccauacuuuuacuaugauaacugaauaaacccuuccagacaggcacuuggacaauuagagggauguguucucccucagucuuuguggucaucccaguuuuaugcuuaaguaaaaaugaugagugcucaguguacaggcuguuuuuccuucucaugcuaggggcuuuagggaauauaaagaguaaaugaaauauaagaguaauuacacaaaugccuuuaaucccagcacucgggaggcacaggcaggcggauuucugaguucgaggccagccuggucuacaaagugaguuccaggacagccagggcuacacagagaaacucugucucgaaaaaacaaaaaaacaaaaacaaacaaacaaacaaaagagaguaauuacacaaaacgagucccaguuggcacugggcucccauaaagaaaacagaacucaucuggaugcuuucuuccaucguaggucugcgggucacugugcuucugacgucauuucuuaugguuuugggaacuggucuacgaugcauaccuguaucagacuuagcccuuaagaaaagguaaguccuguaugacaucucugcacauuuuaaucuauuucaagugugucauuuaugcuugaccauaagacucugauaaugugaucuguagagaggcauaggcaugggagcuauuauucucuuuacuguguguaauggguaacuuaguuucuuuucacauggaagaugcuggacuaguuguggaaacaaaacaaauaaaaacaagugaaucuucuugcuacccaggagcuauaaaaaccaugagaaaugcacaaauaaguauaacaggucacacacauguauguuacauaaaauagaagcaguagggcuggagagauggcucagagguuaagaacacuuacugcuauuacagaggaccugggcucaguucugagcaucuacauggcagcuagcaaccaucuguauagcccaguuccagggacuccaacaaguaugcacaugauacacauaugucugcaggcaaugcauucauacacuuugaguaaaacaaguaaaucuaaaaaaaauuguuuucagaaauagagguaagaguauaaaggagauauaaaaugacuccaugggacagagcaguuuugguugugcagagagaaccacagguguaaaauggcagaagagggagggcaucccuggcagggaggccaugauggcuagaacugagugagugagagugagugggugaguggcuggccuuuuggaaagaccuaacguccaaguuaugauuggugcuacggaaguguggggcuggauccucuaagauugugugagcuccuggauggacuucagggcuuuuucggagcuagaaaaccacuggagguucuaagcuguggaguguccuggugacaggcugcuguucugccuguagggaagcuggagcucacaggcaaaauaaggaagccccugggaaacuagucaccaaaccaggggagacgcugcugggcauugugguagcaaugguagugaaagaguguggaaacuguguuuuggagaacuggcuacugaaaaugccgauguggggaggaaagggauccugggaacucuuggcuucacgggguucucagaaugacaggauggccugugugagcgcaaacgugaggagaggucagagguggugcggccgaggcagagccacugccugggggucuguuagagauagacgugggaggcgagguggguggcuuucauuuagagcagaacuugacaguuuaaaaauaaauguucguuuucugauuuucaaaauauauucucuuuucaggaaacuuaaguuacaaaugcuuuuguuuuguaaaagaaagccagaaaagucacacgggucccguggaaggcuguuagcuucuguccuccugaguugggucuugaugguguuugauguggucuaaauuuauuaaacagugcagauuuguuuguuuuuaaggcauccacgguguuaaaaauacaauguuguaauguccucaaggcacucugaagaugucacucagccuuugguuuuaauucugcucuggaccaccugugcucuuaccaucccaacgcuacauucaucucuaucuuuccaguuaggauucuagaaauagggcggguguugggucugcguucuggcagagaaagugaaacagaagagaaauggagcucacagagaaaugugaauaaaggaaggguggacaggagggagaaacagcucagaaauacugagccuuuccuaacuuacuuuucaaucuuguguucauuuguaaagaauagguuccccagaguaagguacucugugugcuacaguaauuccaagcagcgucuauagugcagcugccaaaaugaaaaugcuauaauuagaaccuauauuuuuaucugauaagugugcuagauugcuacuuuuucaguuuauaugacaugguggaaguaauaaagaccuacaaaauucauuuaaacaucacugagacaagaaguuggcagucugugucuugugggcccaccucccauggagcuuuucgaguucugacccagcuccaccaacaagcucggcuuccugggggugaaguuccagcaagucauuucuguccuuagucacagaugggccacuuauccauaacacgugccguguuuauuaccuucccauucagagucccucugucaaugcaaacauugaguagcuuuacuaccgugucagacagcucaagaguguggcccuaauaaacacgguuuucuagaaaaaguuuccagugugaaaugccuugcagcuggacaaguugucuuucgcauggcuguaggagaaaaggccauuugcucccaggcuuuuagaagcuaaaacucaaugagaagaaaccuggauccuugccuuccugcuuuagcaaguuccuguuguaucaaaggccuaacauauaaaacaagccauaaugguguugggagcaugguuguuuuaaagaagccaagagagaagaaggccuggcagccaagacacaaagcccgagacgagagccacguuaaaauguggucaaaugucuucaugauuagccacacuguaaaacaaagucaaaggacaaguuaaaaacaaggaaguucaacaaauaagacaaaugggccauuuguugaguuggaaguaauuaugucaagucaguaaagaaguagcaauccaugagggaauggcuaugacaagcaauaauagaaauuaaaaugcaaaugacagaauugagggagaggagccagcuuucugccaugguuaaauaaaccaaaguuaagacagugauuagaaaccgaucuggcagugccaguguuggaacaguuugggaugucccauuugcagggcgcuggagcaauauaucugguuuaaagcguacguguccuuuacucuguguauuuauagaaaauuagccuacuugcaaagcuguaccagguggccggcacacccgagugugugcagcuuugcuugugguagaggaaggccaggcucacccagcugccagccacagaagccugugcaguggauugugggauuguuuguggcugugaaaagguaacaguuugcaggugcucauguggacugucucuaaaaugugcuucugagcagagaagugugguuuacaacaguguguuuagugugcuucuacuuagaaaacaguggcaaagguacauguagcagcuuuauuuuagcaaggacccuuccuagaagaagccaucgcugccaguugucuuuggggaaggagccaaggaacuccaggucuggagagaagaaaaccuuuauuucuuguuuuauauucuuaacuacuguugggaauuuuugccacaugugacuaugucuuagguugcuuucuguugcugugauaaacacugugaccaaaagcaacuuggggaggaaagauauauuucauuuuacagcuuauaguucaucauggaggaaaggcaggaaucuggaggcaggaacugacguagaggccuggaggaugcuccccauggugugcuuagccugcuuucuuauagaacccaggaccaucugcccaggcaccaagcccagugggcugacacccccccacauaagucauuaaucaagcaaaugccccacagacaauuuauaggcaaucugaugaaggcauuuuaucaacugagguuccucuuccaaaacgacucuagcugugucaagcugacaaaaauaaaacaaaacgaaacaccagggcuguauguaugaccuuuccaauuaagagaaauuaaagugcuuccuagaugucgaugaggaaauaacucuugcuucuaagaaggucagagagaacguauucuguagcccauaucaguggccgagguugggaccauagauucugguuaucccaaccuccguguaccgaagaaagaaaugggaagcaaaucaagacacuuuucaaauacaucaaugggaugucauguaggaagucacagacaucucacugcaucaucugaugcaguguggcagcguucuuaacccuuugcuuggugggaacuaguagucuguacauuccaaggaacuuacagaaugaucacaaagauguuaggccacauacagaagagggcaaucagugggcccugaaggggcccaaagguggccuaagauaauuuggcuuuggacuagaaacaucccauucucuugggucuuuggaguuguaauuaagcagccuuguuagaaguucagcaugaggguguauccguccaggaguugucacucacaguucacuguuccccuggcuggucaggcacuacaguuuaugcauauggacucuggacaaugaaagggagagagagccaggcgugguggcgcaugccuuuaaucccagcacucgggaggcagaggcaggcagaucucugaguucgaggccagccugggcucuacaaaguggguuccaggacagccagggcuucacagagaaucucuguuucgaaacaaacaaacagaaagugagagagagagaaagacagggaacauauaguaaguuucuccaguguagaaauguggaucauuugauauuuacauuuaagaacuaagauucuuuucuauaaauguauaaaauuuaaguucccuuacauuggugucuuuaaaaauaaauuccauuuacuaaccuucuagauccuugguccccgccccagugcuaucaauuuuagcaaggucuguuagguaaucucaugcucauuuagacuuaggaccuaccugccuagggcagagggcuuucacuuuaaauagcagguaaggaaauugcguuucacuaaucuguucugugauaugaucgcuuaagugaguaucagguaauuacugcuuagacucuagggacugaagagcauggucgcucuugcaggggaucugaguucguccccagcacccacacaccugcucagaagcuucggaaacucaaguucuaagggaccugauggccucuccuggcuaccgugggcaccgggcacacacacacauggguacaugcagacaaagcacucacgauaaaaacaaaaauaggucuugaagauuuagacacuaugaagaauucuguugcccugcuugauucuuaaagcucuaggaccauguuuuuaaguauuguugccuggugcugaggugggccucaagacugagguagugggcggcugcuacuacgaguuuucaguagagggaaagguaugaaaucagagcucugacacugaguccuuccucucuuugugguguguugaugucugagguagucccuaggccccaacaucacacaggaauauugaguuauuucuuguucaacaucacccauauauaauuucacacauauuuugauguaagaaucaucaggcgcauacuccagucccaucgcccagguuagaauucuacaaaguuagcagguaacugaucacucaacuuucucccucucccaacuguguggggucgcgucaugacuguggcugagauuuucagagcagcuugaauugggccacuuagaauauuucagggccagcaagauggcugagcaggaaaggcauucacugccccaauugauggcuggaguucaaucccugagacccauaugguagaaggaaagaaccaacuacugcaagauguccucugaccuccacacaugugcuacggcacaugugugcacacgcauaauuuauaaaauagauuuagcuuuucucuuuguugguugagggagguugggaagagucucucauaauguagcccaggcuggccuccuguucccuauguagcuaagguugccuucuccucccaaguguaccaccauacccagcuucuguaguucuaggcaagcauucuaccacuaggacuacauucugccccaagaaaaaaauaaaaauuuaagagcauuucaaaggcugcugaaaaugcccacugcuuuuuuccuucaaaauaagaguuugucuuggaguuucccccuuaauauuaaaagaaacaguaaaauuuauguuacccgcaacaaauugguuauaagagcaaaauaggcuagaagcuguugguaguaacauagugaaaacacaaguggcugugcuuguuaaaucauuccaggaaguagcugcugucccugagguuggucauuguuagaagaaagcaccccccuuacucugcggcccgcaucaaaguacaucccugacagagcccaaaaacugguaagccuuguucccgaaacuuuguuuccuaaaguaaaucugguucccaaagaguugucuguuuuuguaaacacaaaaacagugaagaccucacacagggaagccaccaccuccaguuaggguuggggguaaugcugaggcuaauauccgacaucaacaucuggaaucuuaugcuucaaaauagucaugcuucaaaauagucauaaaaugcaaaaugggagaauguguguuggaaaugucuuagguagcuuguaaauuauguaagcacuugucugcuuuguuucuauguuaacuaugauaagacauugcccaaaaccaauguaggggaggaaaggguauuucuuccucacuccgucacuggaagaagucagagcagggaccgggcagaaccggaagcagagccacggaggagcagugccuacuaaugugagguuguggaggaccggugcuuacuggugugagguuguuucacugcuucgcauacagcucgggccaccugcccagggauggcaucaccacagaggaugagccuuccugcaucaaguuagccguaaagaaaaugccccauugacaugcccacaggccagucagaagcaguucuuuagcugagacucccucuuuuagccuaggugugccaaguugacaaccaagauuagccuucaaagcauuaaaacaaacaaacaaacaaaaaaagggcaaggguuggaagggagaaaaagacaggaaaaaugguguaauuauaacaaaaauuuuucaaaaaugaaaaaaaguccaugaaauggaaacaguaguccuacuuaauaaauguugguuucugucauuuaaaucgauaauucggucaauauuuacauaaccuacuucugauuuaauaaauaggccguccucuguaacaaagagaccaaaaauacagcucaauaaaaguuucauuuuauuucaaauauuaauauugugagugaccuacagcagccuaaaaaauagcaagguacuuaagagaaguggguaguuccagcauucccuacgaugaccacccugaccaugugacaagagcuggcuccuaaacaggguuaucauagcaucauuagacaaugagcagaggcugugcgcaucauuuaucucaccucucauugguucaggcuuaucauguggucaugcacauccaucugcaaaaggggcaaagcauagcucagcugccagcaucuccagccccuacuccccaguuuaauguggaccaccuugauaacuauccuaaagcuuggagauacuguaacaaaagaaaggaaacagauuguuuucagacacacugugcauuuccugugcagggaacacauccagucccuugucuagcaaccgugcugucacauccauaguaaguagcuccucugacugcucagacuguuucuauccacuguccucgguggcuggguaggagugcuugaauucugcaccccucuuggggugacacagauuucgcaguucacuuucuaucaggaggugauauggagacccgggggcuacucuaggucuugagcagucucaaguuuuguaggauuguuuugugggauccugacaguauacaaagcccucaagcacuucuagccuccugaccugcuugucagaagguucucaugugagugcaaccacaucaaagacuuuuacuccugguuaugguuuuuauaccucuugaauuuacucucccuguuuuuaaucuaagcguuaugcgugugucuaccuguggguuuuuacaagugugugccggugcccacggaggccagaagcauucaguccccuggaaucagugugucuguuuugguuuugccgcugugauaaccauggaguuguucuuguauaagagaacaccccaggucagaggaaaguguaccgcaaggcaggaagugaccagcuuucuuccaugaggcuccaccccaaaagguuguaccuuagguuagcguccaagccccgcugcugagauucucugaucuagauccaaaccacaguaaugagcaagaggcaggaaacucagagugcugcauggauuucccacccaguuccuaguuacuguaagugacagcuuuacuguacguuuacaggucgccagcccuuguggccugcagucaaagcacuagggcagugccaagcaugacauguagcucccaauguuuugauuaauuucucagucaagaagcagguuaaccuguuguaacaaauagauuccagaacaucccagcucagacaacauaguguuucuuguuugaucaagaauagguggaugggcuggagcaggaggguuguguuguuaauccugugagucauuagaaaaaacaacucuaccauguugggccagauuuaaagcaaccuuuauuuaauauuaaauacugaccaagagauggacuuuagucagggccaguccccaaaaugucccaccugacuggaugaucaaacaagaaacagagagacaagcagaucucucaaaguaugguggcagccauucuagccagucaguaacgaaacaaagaagacgcccaacacaggccucuggccuccccaccugugcauaaaccgcacaugcaccacaaagugccuccuaccacaaacacauauccuccuaccacaugcaacacacacacacacacguauccuccuaccacauguaacacacacauauauccuccuaccacaugcaacacacacacacacacacacacguauccuccuaccacauucacuacacacauguauccaucucuccacacacaaugaaaaaucccaauuuaccaagagaaagagcaacaguaccaaaaagaaacucguuguuguaacuuuaauuuuuucacaccguauuguuaaugauagcucuuaaacacuucaaccuccugguuagcccaccacccaccagagauagugaaaaagaaaggauauggggggguggaaguggaccugcuuagaaaaguucuuuggagcaacucccgucuguguugucuggaaaugagcagguuagcaggcagcggcagcuugauucacuugaaaacacaucacaguucaccagcaauccaguuugguagaguugggucagcaaccguggcaacaacaccuagcaaagacagccuggccucagccuuggcuugagucaguaggagggaccaacaggaacagcaggagaaguucucagcugugccucagggaagugaagagcagcgaaggcuggagacucaacagcauugcacagcuacuguaccagcaagcaagcugucuaucauuucauugaguccuauuuauacucuccaaauaucacguguccuccacgugcuuuggcucagcagguucauccaaucugcccgaguccuuugaaacggcaacaaacugcagcacacucccagauguuuuuuaaauauguuccugucuguggggucuugacaaaugcagcucaacuacacacuguaagguggaccaauacgugccugucguuagcgaagaauccuucaucacguguccuuucaagugcuugcguaggccuaagagcauccucucuccugugccugcuucagugaaacuuuccuaccuccacaagucugccuuagccuuucacaccucuguucacuuaaacaaaauguucuuucacaugcuugccccagcaaaacaccauccaaacaacuuuccaaagagcccucaaguuucuaccgcacaauguaaagcaaagacuuuugacugacgagggaggugggcacaguaguguccgugugauccaaaccugcgaccauuccgucaucccuggaggagcacacaguauggauggaauaaaaugcugccugugccguggcuguggggugguauacccuguggguccgccccggcuguaacgaggcuguguguugacaggagggaagauagcagcauaggcaagggcuuuauguaaaacucugccugcuuauaaaauacagccgacgguugacaaaugggauuucauguaacuaaaagacaugaguaagugaagagacagccuacggaaugagacaugacugaggguucauguaggaauuccuaaaccaaaugccaacaaacaaacgacucagucaguuaaugagccaaugaaaugagcagacaguucucaaacagugaaauacaaauagcuaguaaaugugaaaaaaaaagcguucgcuaucauuggcaucagagaaaugcagauuuaaaacuugaucaauauuccaucucaccuuagucagaauagaagugacauccaguccugcccuagacacaaacagaggggaccccacacacggauguaagugaggacauuccacacugcugguggaguaagaacuaguccaaccacuuugggaaucgauauggaaguuuuacaguuagcagagcagaaggggcccagaggcugagcuuucuuguguguaacucagugggcuuuucacgaugucccuguccuuucuauaaauugguauuuuagaagcuacuauuaacaauccuuuaaggccaaggcuuucuguucccuccagugucugcugcagcugccuugaacauugacauaauuggccaaaauuguuuaaauauuggaaaguacacuaaguuuucauuuaaaaauagaagcucuaaccgaguguccaaacuggggacuuccuaaggucucuucuugccugacuuccucuuuccuggaguuacuucagaaccucucuugggcugugaagaaggcagacuguuucuagacuaaccacuuucaguaucagugaguuuaugcuggauggcagaaggcugggagcugagagcaaguuacuaaagucuaagagaaguaauuuuuuuaauucuaaauuauuucauauuuaaaaauagaauuugaggcuagguagugguggcacauaccuuugaucucagcacauggacagcagugaguggcaggcugaucucaagaccagccugaucuaacagaacaaguuccaggacagccagggguaccccagagaaacccugucucaaaaaacaaaacaaaauaaaaaaacaaacaaacaaaaaaaagaauuuaaguaaagagcacuagcuuaccccaaggaaguuugugcuguuuuuaaaagucagucagucucuggcuucgacagugcaggucauacccugggggcugguaaagucaacgagcugugcucaggaggaaaaugucccaggugcugugcaccuucacucucccggucugggugcacuguaacagccacugacuuuauuguccuuauuuguaaauagagacccuucagggugaggccuguaugugaacagaggggcccguggguauuggcgccacuuggcauucugauuucuagucuucugauuuccaucuuagccauuaguuaugugacugagacuccacgcagugcuuucuagagaaagggaagguauaaaauuauaaaugguacuuuucaauguguuauuaacuucuuuagggaguaggucugaaguuuuaguuacaaaacuuuacaugauuacacauguuauugugagugggagucacuugggaaucguagguguuuguuccacgacgccggaaagcauaaggauaggaaaccaggguacugugcaacugagaugucgagugcucagaagacgcagaacugagccaggggcauuucuuugagaaucgaaagacuauugaauagaaugaggauugcagcugugcaugggugccauccauguggcccucagggcuuguuuucugcgcagggcauugggggccacagaugcccagaacaguuaaggacucaacagaccucuuaugugcacaggcccugggagugcacaguucugucccugcaucccaggcugugggugugggaggggccacagugucuuacucucccugcugcucacuauggaaacccaggggagggauaaacagggcucgcagaagccaagugagaaggagaagagcagcugggaggaaaggagcgaaagcaguugagcugagguuggggacacagaacucucuggaagcccugugagaaagcgcaacagagccgcagcagacagaccugcacaggccuagugaacagacucccacauuacacaccuugaguuaccuaagaccacuccuuggccauaaacuagcacagcuuagcuucuguccugcccucagccaccauacugugacagugauguccuggugaccuuugcacccucaacaucuucuguaacagcauuaauggugagcgugguggagacaguaugugugucacagcagggccacagagguggggguaggccauugucuccuuuugcucugggguucccaaggaucagacucuggcccucaggcucggcagggagcaccucaaccugcugagccgucugguuggcucucacuuugcuuuuuuccauugcuaaauuaaaauuucaaaaaaaggucacaaauggaauugaucucauguaugcguuugaaugacuugagaguucuaaacaguuuaguugcauacugauuaugcuuacacaggucuauagugaaaaagacaucgugugauagcauugcugugggcaucuugggaucugcuggcuuugggggaacuauuuggucacauaaaccuuuggaauucacuucuuucacucagaaaauuauuucucuuacacaagagaucuuuuuuuuuuuuuucauuuuugaaccuggcaguaucaauggcauuuggagauauuuucccuucaaguaaccuauguaacauccauggagagacaaguaggccugccuugcacaguucacuucuuauucacuuagcuucugccugggccccugccuccagccucauuauuccuucuuucugcuuucgggaaauaagaugcgagagagagagagagagagagagagagagagagagagagagagagagagagagagagagagagagagagagauaugcaugaugcuuaagaagcacagguagggaacagacaccuggcucucuuucuugccuagacuucuggcuuuuuccuucaggauugcgcauggcuaugugugaguguguguugagucggagggcgaaggggaaaggguuuggucagagagguaagcaugcuagguaucagauuaggaaaauggacaggagcgcgguggaauggaagcaagugugaccuccacugaccuuguaccugaagccggaagcagagcgcuaggacugggggccucaguguggggcccugguccagucccugcacacuccagaaagaggucuugugagccagagguuccaggagcucagccagccuugcacaugcucaggagauacacagucuuaacuuaccuucuuguucuauagaagcaguggagucucgauguccagggccauucagacaucuggucacagugcucaccugagcagauagugauacagggaaaucaggguucuuagucucaacgauaaaagauuuuaaguacagacugaaauggagccgugaauuagcguguaaagccuggaaccggcuagccauaacaccuuggcggcugcuuggaggggaggagggaaagcguggccucucuugcuggcacaguggucacacacaggguggacaagagcuacaccaugggagggaugcuuuagaaaagaguaagggagcccagauuguugggggaagcgugcuuagaaaagagaugaaaagaaggaaagaagaaagucacccuaccuuuuugaauaauucagagaagcaggcagacuuaccacuguacauggugcagccuugugagcuaauguguggggugggggccaaaauucgggggggggggcaggugaaaguacagcaucucauuaaagaaccagcgauccucacugucucuuuugcauggccuagggugcauuccugucccugggcugguccccagccaaagugacugaaccagcccagagacuuucugucugacauuagaagugucuuaauuauuguuuuguguauauaauccuauuaucugacaugcaacagguaugagauacugagcucagcuguauuguuuucuagcaccuguuaaugagcugcagaguacuaggaaaaaacaauguguuuugaaucuaauuuucaauuuccuuuguuagcacccuggcaaguuucuucugagccgaggcucacauauuucagcaaacugaaacaagaauaggacaaaugaaccaaguucuauggcuaugaggaggcaccaugacuguggcaacauuuacagaggaaagcuuuugauuauuaugagcuggcuuuacaguuucagagguuuaguccauugucaucauggugggagacauggcaguauguauacagacaugaugcuggagaggagcugagaauucuacauccagaucuacaggcagcaggcagagagagacacugggccuggcuugagcauuucaaaccccaaagcucaccccuaugauacauuucuuucagcaaggccacaccuccuaauagugccacucccugguaacuaaugcauucaaaucuaugagccauggucgccauugguauucagaccaccacaccaaaguuauagcgaguucuuaguuugguauuggcacagugaguaaauggugaacugaguguccuuggucucccuccagagaaagcgugucauuuagaaagucggucagcucaccuuuucagaaugucaaauucuuuauguguaugcauauauaucuuguuguaguuaaacugcuguuugguuaauauccuuuucauuuagaaaaugcuugcuucaaaugucucacagacuuccaacguuuccaauuccaggcuaauccaugggggacagauacugaacggacuggcagguccgacugucaugaaugcggcgccauuccucucuacgacgugguucucugcugacgagcgagccacugccacagcaaucgcaucaaugcugaguuaccucgguggagcgugugcguuucucgucgggccccugguuguuccagcucccaacgggacggcaccccuucucgcugcggagaguagcagggcucauauuaaagaccgaaucgagaccguguuguaugcaggugcuuugaagauuuuuuuuucuucuucuuguauucuuugguuucuauuccagucucugcucucuaguucugcugugccagaucacaucaccagagaccccugaggacugacagauacucgcacucgaaugcacuuucauuauaucuuauggauaugccuguuugaaacaacccuuccuaggacagcacuaaauguaauauguauacuugcuacauggaaaagucuugguuaauuuuacauuuuaacuccacuugcaauaaaguacucuguagcauauauucuugggauuucucuagacauggugucuaaaugucaugcuuaacuaaacauuugucaagcaucaguugguaguguucagccugcuuucucccauuauuggucacauucuugcaccuuauucaccccaaucaccuguaguuuauucuucauuguucuccauauguuagucuauuaaucauacugaccuuucuaaauuccagugccuaggcagagacaaguauacauggggagucuuaauauuuagcaagugaguuaaagcaaaauucagcauaaucuaaucccucaucuuuaucaccuuaguuucuugcaucuacucccuuguuacuuuguuuuuguuuuuguuuuguuuugagacaggguuucucuguguagcuuggcugaccuggaucucacucuguagaccaggcuggcuuugaacucagauauccgccugccccugccuccugagugcugggauuaaaggcgugcgccaccacgcccggcaagucccuuguuauuuugagucaagcccuacacucgcauuucaggguuugguguggacggaguaaaacugaaaucagggagaaaggagaacauuuucauuuacauuacacguuuacacucucagucucuucguuucuuaguuuuaguugcuuccuuaucucguuuaacuuuccugugcagugugaguucaaucagaagucgucuccaucagacaaaacccuauccuuucuggucccuucccacauuccuucuuucugaagaguccucugaggcugcuuuagaaucucuccuacaggguuuggaugggcuuucccguggaguaacuguucaucucucaaccuuuggcgaucuggcacaaaccaggcaccucugugcaucuuuguucauagcgcgccuccuacugguggccugaggaauuuaagggcacacacgcccagccucugcucugggcugguggaggcaucaaauuuugcuugucuuuguugagcuagguauuuaaaaaauaaguauugacccuugugucauaaguagcacuucaccuucauuuuucuuucagaauuuggaguugucugccuaauauucucugccacgcuagcuuauuuuccgccccggccuccucuuccucccagugucgcugcugcgagccagcggcugaguuaccggcggagcuuuuguagguuacuaaggugagugaguagacucaggggcauuguguggcaguggccauagcuguggcugcauucucucuguggggggguguggggguggggguuaucugucacggggguggcacacgcauggaggucagaggacaauaaagacaguucucuccuccaccuuuaccuggguuccagggaucaaacucaggcuguccgccuugcuggcugggaggugcuuucagcucucccaccccugauucuuaauguucaaggauaauucaaacuguuuauuuuucagcauuaaucaaauuguaaguacuccaugccaauauuaauuaaaauacuaauuauuuaauucucuaacaaauauauguugaaaacucacacuauaacaagauggcauuaauuuuugcucuauccauauuccauguagauuaauacuuaaaauguuuucugguuuuuugaaacagggugguuucucuguauagcccuggcuguccuggaacucacucuguagaccaggcuggccucgaacucaaaaauccaccugccucugccucccaagugcugggauuaaaggcgugcgccaccacacccggcuuggcuugaauucuuauaucugucagucuccuuguucuucagcuggcucucacuggaaacuuacuuccaggucaggucuguagaugucgcacucugugguuagacaggacucuguccuuuguguuccuugugacuuuuuagucaaaccuuugcacugaggugggcuucccuuuagcuuuagguuuaauugguugguugguggcuauuuuggguggcuauuuuugauuugguucuuauaccugcacuucccuuccaauccuuauuccauccuaaucucuucuaacccccaacagcuagguaggagagaaagguuagaggggaaaggucauagaucucuccaggcuucuuccugcugauuagggucauuggguuccuuggagccgguccaaucuuuguagucaggauaucuccaucuucucgucaaaccccaacagcagcaaccaggagcagcgaggggagcagcagccuugccggaggcccucccagcccucucggggccccauuuauaccucuccagaguccccagaaguaaacugugugcagcugacaaaggucaugccccuccuagagcacaaggcagucauggguaguggcuguggacaaacugaaacagccucaucucccacaccagggauucaggccaaaugcaaggugagcccccagucuagguccugguccaaggaacuauuaaaggaacucaugaggcagcaggcagcaugcaaacacuuggggcuagagagauggaucaguggcugcuuuuccagaggacccagguucaauuccccucaacccacauagcauaacugggguuuuaaagaaaccaaaauugucacugcauuugguugucaguggcccugaggauugaggcagggccugugcucacuacgccaguacucuggcacugagccacagcccuaggucucucuuuugucuuuguuuuacgugauuucgcuggugaggguaguccuugauauguggagagcucucuuuuucuucucaaguugucuccccacugcucaguaaacaaauggcccucaggguuagccagucacuuuuuaucccccuauccauuguguaccuggacugcuuccaguucauugcugccaagacacaaccgcggugaugcccucacaugccaugcauagaugugagucuuuuuggagaaugugccugcuggugcauuguuaggccauaagguucucuacacccaacuugccuggcaucaccagguugaucucaaagaugcccagcggacgucacauuaucaacaguuuguaauuaucugauuuugccacuguaacagcugugagcuauguuucauuuaauuuauauuagcucauaauuaauauguucagacucucauccuaugauuuguggcuuauuagacuucaucuacuuaaguugcucuccacaguuuugcccaauuuuuaaugguaguucuuaaauggugugcauauuuuaaguauaaaucucucuucgaucuaaacacuuucaaguaucuacucccggucuccugucugccuaaucauuuugcacaguuuuuaaaguuauugcuuguugguuuugucuuucacaugugcauuuuuauccuaccuuaguaaaugucuuuggcagccgguguaggaggacguuuuuccucagauggcgagcagcaucuggaagcaucccuggcacguggcuggcagugccauuguacuguuuguaggauuucucugucuccgucuccguggucaucuuuguugugagccagugcuacacugucacugccuuggccgagcaguuagucuugcuaucucaggacaaggguuuccgcaccaagcuuuuuaaagggugacuuagcuuuuuaaggaauuuuauuuuucauauuucuuaaguuucuagaaaaaaaauacaaguaagaguuuaguugugacuacacugaauuuacauguaggcugagaguguaaagacugugcaucuauuuagauuguuucuguucuuguaguuagguuuaagauucucgccccuccccccucuuccuuauucucucccuuccucccugucucucucucuuucauauuagucccuggccuuccugguuuauuccuagaugcuauauggguuuucuuuuguuuaguuuugauuuuuuuuuuuuaagaugaggucuugaucuguaacccaggcuguucuggaacucauggccccaaacucaaaguaacuguccugccucagccuccuaagugcaauauaacaacuuacuaguauagcacagcaaacccuggggauuuaagagcuauaagugaaaggauacuuaugcaaucucuuguuuugcuggggcuuuguaacuuucauaauauauauuggucauaaucuuucccuuccuccaguucaucucaggcucuuaccuaugucccuccccacccagcuucguauucucucuuaagaaagccaaacacaaaacaaaacaaaagaaccgugggguccguuuuguguuagccaacuauuucugagcguggggccugcccuggagugugauugauauuacccugugauuccacuaaagaaaacugauuuuccugcucccggcagauauauacaaagagcuucuuggguaggggugagacuuuguguccacucuccucucgaugcuggauuuuguguguauugaacccaggcaggucuugcucaugcugccauggucucugaguuuguaugugccucuguccugguucccugauucuaccaacucuggcucuuacaaucuucccaucuacugaccuugagggcagggcugugauaaaaucaucccauuuagggcugggugccacagaauucauucuuauaagaaaauaaaauguuagagaauuucaaguuuaucaacaaauggacacacacuccuuauucuguguucugguuucaaaaugacuuaaguauuucauaaauaguuuaaauucuacauuuuaaauuuguaauaaucuuuucuuuugcagcaauuugagguuuuugaugauugcuuuagcauacgcaauaccacuugguguguuugcuggcuggucuggaguucuggacuuaauuuuaacaccagugcaugucagucaaguaaguauuuguaccuguauauguuguugguauuuuagcucauuuaauuuauaaauaauggugauaaguuuugauuuuagcuucaaagauuagguaaaguguugccuaacuaaacaagauuccucugggacaguugaaaacuugauuuuuaacaucaguguugaguuucgaauuucuuuggcugcuguuaauacugauagacaaaagagaaaaagccuuaguuuggguaacuuuauccuucauccuuguuucauacuugauaaauuacaaacucaucaccugauauauugcuauucuaaguacuuucuugucuccgaacuaggaugccuccuuuuuauaaaacauaaccaugggccagcaggauggcuccguggguaaacccugaugaucugaguuugauacucauaacccacgcaggaggagagaucugagucuccacacacuguucuccagccugcacuuacgagugcguacacacaagcacacacacaugcacacacgcauacacacacacacacacacacaagcacacacgcauacacacacacacacacacacacacacacacacacacacacacacacauauacaaacucggaagaauuacccaugagauuaaaccuuuucaccaugcucgaugccuguacugcauucucuuugcugguaggaaaggcagauagagacccagcauaccacugugccaccauugcucugagugaacagucuggccaucugcuuuuaaugagcccuuggguugucucccacucuuugcugucacaguggggcugugugaccauucucaugcacuguccuuuugcuuguguguuuuggaauggaacugcugcuuuuuccguaugccuccuuugacaggcaguguaagucccgucugaggcagcuguaucccuuacaguccugucagcggcagcuggugcuucuccugcugcccgucaauagaacacguggcuauacagcaguguuugaagccuucucauagaugugcuaaugacugagccuugugugcauucacagggacaucuggacuuucuuuuucaacuguuagcggauauuugaauguccuauuuugugacugccuguucaagucucuugcccacccuucuugcagaaaaauagaaaagaggaaugaggaggaggcuugcuaguagcccuaaauagggucauuccuuccugcuccugaaggcugaaaaauggccugcauaccuagagcuccaaguggcuuaguugguagccugccacagaguugaaaguagagcaaagacaacagagguggaauugugguauggagccaggaucacagcaccccaaaaccucuucagggccucacacaggcuaggcacgggcucuacuacugucaugaaaucucagcccccuugaaacagggccucacuaaguugcccaguucuggcuuugaauucagucauaaugcaaguaggcuuuuagcuuacaauccuccugccucagccucccuauaucuggccuuacagaccuaugcugucaagccagguuucgugaauauuaagugcagaaugaaaaaucaucccuucuguagacaaagguuuacucuguaugaaccaccguuagcaaagcuugcagcaagcccugaagaccacaggcuacugugacagugagcccucccaaacacagguccaagucuuuuuuccucucuaccauaagcacacacaggucguccuccacagugcagugucaccaagcauagaggacaacuaaagagugcacuuucuauguuuaccacccaucaaaguagaauauaacaguccuauuagacaugcaaaaaccuuggaaauuaugcuccauguuuuaaacaagaaaagaguaaucaacagaauccaauuuuucaauagucuagguguuagauuuagcaaagacuauauugcagaagauagagggaaaaaacccucgcuugcuccuaguucgugaguguacauccuuguauccucuagggaagcagcacaguagccaugcggaacauacagcuguuugauaugauguuuaagucaguuguuguuguugcuuugcuuugguuuuuuugagacaggguuucucuguguagcccuggcuguccuggaacuugcucuguagaccaggcuggccucgaacucagauacccgccugccucugccucccaagugcugagacuaaaggcgugugacaccacugcccggccaaagauugaaucauugaaacgaagugaagguacaucucugcuuccuuaccuuuugucccuggacuaaccugucaguggacugaccugucaguggacugaccugucaguggacugaccugucaguggacugaccugucaguggacugaccugucaguggacugaucugucaguggacugaccugucaguggacugaucucucaguggacugaccugucagaggacugaccugucaguggacugaccugucaguggacugaucugucaguggacugaccugucuguggacugaccugucaguggacugaccugucaguggaaugaccugucaguggacuaaucugucaguggacugaucugucaguggacuaaccugucaguggacugaccugucaguggacugaucugucaguggacuaaccugucaguggacugaccugucaguggacugaccugucaguggacuaaccugucagugaacugaucugucaguuggacuugugguucucccgcuucuuccuccccugggcuagaagugcacuuggcuuugcccugcuggggaucaacccaggccguguaggucaccgcucucccaaccgagccacagccuuagcacugguaucaagguuaugcugguauugaugcaauuugagacauauucuaucuuuucuuuuauucuaagaguucauauaagauuaugaguucgaguuugagguccaggcguggugguauauccucuaacccuagcacucgggaggcaaaggcagguggaucucucugaguuccaggacagccagaacuacauagagaaaccccauuucaaaaaagaaaaagagauuuuaaaaaaaauauggguuugaucuucuguucuucucuaaauauuugguagaccuuacuguuuaagccauuugcuuuucugugaaaaaaaauuguuuuaacuauugaaucuguuucuuuaaaaguuacaaaauuagggcuagagagauaucugagcaguuaagagcacuugcugaucuuccagaggacucagguucaguucccagcuccuacauggcagccccaaaccaucuauaauucuaguuucaggguucuuccagcucccuuggcacugcauacauauggugcauaugcaugauagcaaacacacggacacacuaaguaaaaauagauuucuuaaagcaguccuacauuaacauuucaguggacaacuuuuuaaagauuuauuuuauguauaugaguacacuguagcugucuucagacacaccagaagagggcaucagaucccauuacagaugguuuugagccaucagguaguugcugcaguuugaacucaggaccucuggaagagcagccaaugucccguguucaguguccuggcaaaguguaugucauggucaucuacucucuggugauuuuauuggcccuccaggaccaguuacucaggauauuaguugcccugaauaucagugucuucucacauagcuuuuccuugaguaauuccacuagcuuuuuauugaauguuucuuuucugaacauccuguugauuuauucuuuccucuucauguucuucuguucucaccuauaagaaggaguuacuuugcuucuuuuccuaauuuuuaaacguaaaugccucugagugucuuugauuuuucaacuuaaauauauccauuuuaaggcaauuucuuuuuuuaaaaaguauggauugcccaucccaucucauacguuuaauuaaguaguacucuuauuauuauugcauuugaaucuaugcccauaccucucugaauguguuuaagcucaucauuauuacuuaauuuaaaauauuuccauaauccauugcaguguaggagguguuuauaagaacauauccuguuuucuuuuacaaguauaacaucuauagauuuuaauuuuuguuuaaaaauuaaaacaagauuggcaacaggaacucaguguaacccagggugaccucaagcucacagcuuaacuggggaugaccuggaucccuggucuucaccucuggagugcugggccacagucaccugucaccaugcuccauuugugagaugcaagagcucugacuuggggcuuuguucaugauuggcaggcacccucccaaugagcuacacccccagccccacagucaugcuucuugagguuuguaggacucauuggauguagaacuugccucuucaguuucuagaaauguuuagccaacaucuccuuaagauuuauguuccccaguuccucacguggcgcuguacguguuacacuuuugugcugcauuuccugucguguggcaccucuagccguacaucuuacaccuuugcacugcauucugucauuuuaccuuucagugcuucuggcuggauauuuuaucuaucauuuuuccagcucaacacgucaaucuucagcuguaagauacuauuaaauuccuccgaguuuuaacuguuuuugagugauaagucuugauuuguucuguuguaguguacagaguucuacagacacacuuaccuuuuccaucucccggcggcgcucauucucagucugcaccucaggcccuguucucuggccuguggucugcuuuacugugacggagacgucuggcugaguguuaggcacaggcuguaaagagaucaccuggauggcgagagggugcuguuuuuuucuccaaagagaacugugagguuuuaucugcuuucuggagagaaccuagacuucuuuagucugauuucaaggacuggaaccauuaaaucuaaacuuuagucucaugaaaggccauugcacuuccagugugcggugugcccaucagggucccacgucaagucuguuuucacaagguccucacccuacagagaacuccaaacccauauuuucucucauaggugaaugagaugaaccacgugucagucccuuaaauacauguucugaaauaagcagacgcccagccugucccucuggauucccuuccugccuaaucauacucgcauaacccugccuuccgccgcacucccccgggcuucagauggauuuccucccagaguuuguaauucccaaccacaauacuaauccagauuaccacgugugccugucucaguccacaccacauacuuuaacaaaauaccuuacacuaggaaguugauggaacaggaauuuauuucuaacaguucuggaacacuagcaggcuccauaucugccagauuacucucugccuccagacgccccuucucugcaccgucacacagcagaggacgaggcagcucuucuuuuauaaaaggccccucuucucuguagugucucaccggggauucgguuccaacacgugcacuagaccauagaugagucucugccacaagacaaccacuuucuccaguucucaauaaguucuaauaaggaagugugcaagucuauuuaaaugauguugaauuuugcauaucugugacuaacuaguauugcaaacccuaaaaaguccuucuugguaucuuucuauguuuaaacucugagagauacagaguccaugaucacaccagauauuaaaacauaauuuaaaguuaugcuuuaguuuuuaauuuaacaaaggaaaaagaucauaacuggauugaaaagaucagcaucaguacagcuaggcccacauucuugcugacacacauugccacucacccaggggacggaugaaagugugcguggcugugcuagagagacaaaggcucagcggguaaauggcucaucauacaagcaggaggaccuaaguguagguucuaaccugguaaaaacagugguggaggcugagucugcagacccggugcuccugcagugagaggcaggagcagcuccugaagcuugagggccaucuuagcagccaggaacaagagacccuggcucaggguaaaaggcaggguggggccggcaccagaaggugaccuccauauggcaccagggcucgaacacgccugcacaggugcuguagggauacgggcagaggugacaagugccccgagcacaugggccugaaggcggggaagagcuaaaaugggagaagcguccugagaugggagcugcugcugcuuagugagcacuugcuaugugccgcucaccaagcuaagucugcgcacagugucccucaccacuuuguacguaggaggugaauugaccagagucacugagcucacgaggagcaagaauaaaaacaguuuccgaguucagcucuuuuuuuuucucucuucuaucuacuugucuucaucagacuugaaagugacaacauguuugauagaacaacuuaaugggaaacaagcacggcuuugccuaugguccuauagauuccagucugugucugcauggcacauugcuauggggcugagagacgccaaaugucauggcgggcagcagagcaguuaaguucccauagagaggcgcccaggacaagucacagucccucgggacaugaacccaguaaacuccuuccucuagguaggcuguaccuccuaaugcuuccggaacuuuucagguagugcgggcaucugggggccaagcugagucacaugaggccugggguauguguuuuauccagguuauacuaccaucuucuuccucagccuuaggucucucuccccaucucuccucccacgguaucuuaucacucaauacagucauaaggauggccaaauguuuuagcaaccaauuauuuuauaggaguuuuauguaugacagcuggauuuaaacuucuugaggucauggacuguuuucuuucuuucuuucuuucuuucuuucuuucuuucuuucuuucuuucuuuuuuuuuuuuguuuguuuuuguuuuuuuuagagacaggguuucucuguauagcucuggcuguucuggaacucacuuuguagacuaggcuggccucgaacucagaaauccgccugucucugccuccugaguacugggauuaaaggcgugcaccaccacguuuucuauccuuucuuauugagaggucuuagcauuaggcaguauuagacaaugcuaguauauauauagcacgugccugaaaauauuuaaugguauuguuuuguugacuuaaacauuccaacaaaaauuaauacauacauagagaaauuuguauucauuaguuacacaugaaucauuucauuuuaauccauuuuuagaaauauuuccuagauuuguugccauuuagcuagcuguuaauauugacugaagaggucuuguauuaauguuauuguaugaauacaccuauuaauauguuaauaacaagccugcuacuuuguuaacagguagacgcuggcuggauuggauucugguccauaguuggaggcuguguuguugggauagcuauggcaaggugagacuauuucauaucaaacuuauaaguagaugggagggauaagaaguggguuuuccaauguuaacacuauuuaggaaaaagcagaagaaaaggccagaaauggcuucuuguuuggguucacgcuacagaacagauuccagcuacaagaagccugcuugggagcagucccucccaaaguggugucugaaggcaggaaguguauuuccagcauaaugaaacuccuucucuucacuuuauuugagagcaacauccucagauggaaccacuccaaaaaugugauauaauuuuuaaaaaauaauuuaaaagguaagccgggcgugguggcacacgccuuuaaucucagcacucgggaggcagaagcaggcggauuucugaguucgaggccagccuggucuacaaagugaguuccaggacagccggagcuacacagagaaacccugucucgaaaaaacaaacaaacaaacaaauaaaauaauaauaauuuaaaagauaaaguuaguaagaagacaaguguuauccuccuacaaacguguguuuuuguucucuguccuuggacauguaagaauuggagacaaagaaacuugguagauuuagaaaggucugggaccagcuugucucccccccucccccccccacacacacaggaucaaccaucccacagagggggcaggaggcagguggagggagaugaguguccgagagcaucugucuggccggagagauggcucagugguuaagaacacugacugcucuuccauuaaguccugaguucaauucccagcaaccacaugguggcucacaaccaucuguaaugggauccaaugcccucuucuggugugucugaagacaaugacagaguacaaaaagagcaucugucugucagagcaucucugggcacucaugggaaggcagacccugauuaacagguguagguguguccuuguaauuaucccucuguaauggaaguauaucuguaaaggucuucaguuuucuuaaacucauuuuuaucccaaccuauuaugacaacaaauucuuagaauggguuagaaaaagaaagaggguucuuauuuauuccaaaaccagaaaucuuagaaauaaaaacaucacuccuuccuaugacuuccugugaaacuucucuugguguuucuaaaguaggaacgucacuaaccuuccaagccaguacaucacaccaaacccagccaaucaguuugccaggaagaagugaaucuaauuacauauuugagaucaaaagaauaucugaaccucucggugugcgacacaacaugcuuugcacgggacagcaguauaggccuugcaaucuggggugaugcaggaaugaagucaaauccagcucgcuuuauuugaggguuuugucguuguuuugcuuuguuuuguuuuuguuagaaaggcauugaauaaaauccaaaagcugaagguuugagcuaggaagucccuuugacuaauugugaagcacauuguccugacaauuucuguaauaaauaauaaucuuuuguaaacuuagaauucagaccaagcauuucguaucuccugggggacacaucuuggggcagacauuuuauuagguugugggauccuccaggguguguagaaguguccccuaaaggagagcaaaccuuacucaguaagcaagccauccauucuucccacucacaagugguggcagcucucguauccagagucagauauuccagaaaauaccaacaaacauggucaaucacauaucaaauaaauacaggaaagaaaggaggaggcgguggugguggcaguggcugguacugaaaaauugcaaagaacaccugcauagagucagacauuacagucaguuuuaaaggcagaauggagaggacaugguauauuucuauuauauaauagaaguaauuccaaaggauagaauagcuguacuuaggcacagccagagcugugauaggaagaaaagcaacaaauggaaaugggaagagaggugaacggugugguucuuaguuggugagcguucaggaaaaggguagugaguuuugauaaucuaaaaugcuguaaaguucccagcuugaugagauaacaucuagcauccucccuauccccaccccaucccaggcugcuguucaggccucuuugucuggcccaggcuggccuugaauucucuacccuccuacguuggcuuccugggugcuaauauguugccacagcuucacuguauucuugcuccuagaaaguuuacaguuugcaugaaauaaauaauuuccaaccgagaaaaguucuuguggggaucugucuuagucaggguuucuauuccuggacaaaacaucaugaccaagaagcaaguuggggaggaaaggguuuauugagcuuacauuuccacauugcuguucaucacugaaagaagucagaacuggaacucaagcaggucagggagcaggagcugaugcagaggccauggagggauguucuuuacuggcuugccuccucuggcuugcucagccugcuuucuuauagaaccaagacuaccagcccugagauggucccacccacaaggggccuuucccccuugaucacuaauugagaaaaugccuuacaauugcaucucauggaggcauuuccucaacugaagcuccuuucucugugauaacuccagcugugucaaguugacacaaaacuagccaguacaggaucuaaagcagacugcaggggaggacuugagggagcaugaagggccauguugaacaacuccugggugaguggagcaggaguggggccacacaagggccugagguguuaguguuuccagcagaaaggccgcuacagggaaguccccaauucaaacccugcugugggaaccagccuucacauggaagagaagagagcacagcuacccaacuggaaaagggggcaggagggagagcagggccagggccagcuggaggagggaugcucagaggcgcuuguguguaugacaggggugugaguuuuagaagagccagcuuugcacuucagugucaacucuaaaacugagcuaauguguauucauuauaaaauguugaaaaaacauaaaaauagaauaaaagucaauuuaaaauucuauucugugagcuguagacuccaaacaguuuauaagagggaaaauuauuauaaaaguaaccuaaguaacaaaaaaagaaggaaauauguauucauagcuggcuucuaagguuaugcagugaaaauucaagaaaugguugcuuaaagaaaguaugcugccaauuuaaacaguacugagaagucuagcuaggauugauuugauauuguuucuuuucagguuugcggauuuuauccggggcaugcugaaacugauccugcuccuccuguuuucuggggcuacccugucguccacgugguucacccugaccugccuaaacagcaucacccacuugccuuugacaacagguaagcacagguugcuucggggcuugagguaaaggcuuucaguucacaggaaaguacgucuucugacgauagccccgguccugcucucugcaguucuuccguguguguguguguguguguguguguguguguguguguguguguguguguguguguguguauggagaugucucaguuguuuaggccuguggguaagcacagagaucugagaucagauccccauaaccuguguaaaguggugaggaugagaggcuaaagacguggcccagcucuugcagaggacucagggucacuuccuaacaugcgugucagguggcucauggucacauggagcuccagcuccugaggggccaaugccuccggccuccaagggcaacuggacucgugaacauacccaugcccguacacagaguuugagaguagauuuguuguuguugucguuagagacucggggcuuagauacaggcagauccaugaaccuuacgggcuagacagucuguuccaggcucagccgaaaacccugugucaaaaaauaaaguggaaugggauugaagaaagacaccccaaaucaaaaucaacuccacauguauauaagccuauguacaugaacaacugcacacauauuuguacaugccacaugcaugcguguauauguauacacacacacauauauacacacacgcacuuguguguguguguauguacauccagaugagaagaguccaagaaguaauugaauauuuugcauaaggccacuuuguaguauucauauaucaugaaaaugcuuacuuuuguguaaaauucacaccagagcauagcauguuuuucuccuguuuaucauugcuacuaagcgguacgguagagagaaagcacgguuggaucugaagcaugcuggcacgcagucucugaccuggccuggugccuuguuuuauauggagucaucacauuuucugcauaaagugggauuucuggguuuuggaagcuguagccaccuuacuuaguuuguguaaauagccagaaauauuuauaguugcuguuacuucuacuguuauuacuaauaugaguucuaagguugcuguaguaaguuacaggagugcaacggcucagcagcagcucagauuauuacggugcaccccuggagugggaagcuuuuaacccguggugucugggcuaaaacuuuuagggucauugggacucuagggaagagucucuccccucaccuccgggugauaucagccccgugacuucacucacaguugcaucugguccuucuguccugccacccugcucucagggaucuugguuuacaguggacccacucagauaauccaggauaaucucccaguuucagacuccaguuauuagcaaccuuaauucuaucucaggccuaauccucuuuuccuguaagguagguaacacauggauaaguuccagagacgggaacgucaaucuuuaguggagagaggcaucauucugcccacccagggucuggccuggauuccuguaauggcuuacuaaggaaggcaaggacuccaugccuguuccuuccucucuucuaauaaaaagauugcuuaagaugcagguaucugauucauauugcaaauaauuuuuagccacaguggauuccgugcucaauuacaggauuauuuauugugaaauaaauugagggauuaaugucacaccggcauuugauaaguaggaguaaauaagaaucugaagguuuuguggggccacucuuccagcggcaugugcccccaccccccaccccccacccccacccaguguagcuuagaauuucugcacauccuacuuuggaucucugagucugguauuagaaccaggaccuguacaccagcagcagugacguacagccacuuucacagagacgauagcagucauauaaggucagagugccccaggaaacucauaggggcuauacugggcacugacaucuaccggauucuaggccagggaagugcccagugucaguagacggggguuuauucugaugaugucauaguuuugagaagcuaguuuauuagcaguuguaguaauaagcagaucccuacagcgaugaucuagagcaggaaaugauguggcaguaaucaaugugauugggaauuggagcucuaaguugcccaucagaugcacacaccuguaguauuguggucauucucucaaucuguggauaguacucuuuaaaugguugcugugcugucaggacauacacaccuacugaacugcuuccaccuaaaugugugaucagcgcaguuguuagcaauuucuuuuggcuuugaaagcaccgugaaaaauggacaccauacuaaguaagcauuaaggucagagguggcaagcuugcaugauggcauguggguaaacaugcuugcugccuagccccgcagccugaguucagucugcaggacccacacauauaccuacagucucaaucagccaauaaauaguaguuagaucuaauuuucagauaaaaguccaaagaguuuuuuggguuuuuguugcuguuauuguugguggugauuuugguuuuuuaaaguuuaacaaguuaaauucccuccuggugcuggaaaaagagaaugcuucucucagcccccucaagcucugaagccuaggcauccaguguaauaauuagacgcugacuaaaaaccugugacuguuuauauaccaguauuccuacauggggucacaaucaggccaguguucugagucagauuucuuuuuauuuaauccuauguguauggauguuuugccugcuguaugucuguguacgacaugcaugcaugcagugcccauggaggcccaaagagggcgguagaaccccuggaaguagaguuacagacaguugugagcugccaugugguugcaaggaaucaaacccagguccuggaagagcagcugguguucucugcugagccaucuuuccaccucacugggccaaucuuuuuucuuucacuccauucugguguagucuagcacuugggcagcacucagauggauccguuuuaguuuacaacuucucucauccauggaaucacaugcagacuuuuuucaggaucccaucuagaagugcgcaugugugagacuuuaacaaaacauaaucuugagugcuuggugacaacuguugguuguucauuauaaagcacuaaggcaacuguaaaggucaggcucaaugucaccccagcgcagucauuaggagggaacuuaacuuuggauuuguguagugaguauaccuucuauagucagggggcaggguguauuugaaaauuguacaucauuuuaaccucccacgggugugauugaccugagaaggccacauuugccagccucugguugacaugaagugcccuggacaggaagagcagaggcagacuucuaacauaaaucagggcuggaggggaaggcugaguuugauguucccaucuucagggacacgcucacuguacuuacgucaugauauuuaugugcauuuuacuguuguuuucacuugcaaguccauuuuuuuaaugucacuuagauauucccgaaagauaguuuuaacuuaguaaaauccuggguuaggaacuagcuugugccggcuccccucugcagccucagagcuucuugcuucauaccgaguagcacuuagcaggcaggucucuaaguguaacuugcccuccuuuccagccugaagaucuggagcauggaugugugccucauagauucuguccccagccccgccuggggagggggagggggagggggagggggagugcauuaucucaucccgagccucaguagauagagcugucacucugucauucugcacaagcuucggggaaggcaaaggggcacgguuuaauggaacaauggggaauuuuaauaaaucuaucacagguacucccucugccuuuguaaaaaucugaccuaauucuuuuuaagugaaagagguuccaugaaagggaauuuacuacagaaucuaauuacggacagaucuagacuuugcaguugauauuuaaagucaguacuggcaaauucauguuucuuucuaguggccauucuuagucaggcaaugugaaaucuuucuuuccgagaaugcuuaguguugcucugacgggcuuuuauaauauauaagucaggagagucagugaaauacaugagacagucguggcuacacagcuuggcuuuguagacaacugucuauagcaggagccccuaggacugucgucaacccagcaucucacccaccuucguguccaagcacuucagugucacaguaagaagugaaccaucagauagcauguuccucagagcguccucaucacuaaaccgugacgacuguauacacaacuguggacacaacaggcuaaaagcuaguuaaguuugcuugcagcacuguccuacgacaaccgucauuagucuuuguguagcccacagaucuugcuauuagaguugccaccucugcagaaggaaaacuaggucauagcauugucucugaaggcacaggggguugauagauguacuugcucgcacacauccucuuggaagcugucagcacuaugcaacucuuucccccuuaggaaaacuuaguguuuaaaauugcauuauuaauuaacugaaguguuuacaacaggacaaauaaauaaccucgugacuagauaacgugagcuucaaaaucuagaggcuuuugcuaugaacaaccguugcgagcacauuacucaccugaucugagaaugagaugucuagcccuguuagccacaacucacacagucauuuuuuacuguauggaugaaugcuugcaaaguggcauuuugaaaaaugcuagcgcuuuugcguugaguuugcugaaacaauacaauuugacuguuugauagaaguugccuugggagcgauuauucaucuaauuucauuucuacuuacuagaaugugcgaugguguuacccagcaacuccagggugagagggaaaggagguguccugcuggacagacgcccuuuagaacaauaucugaccacagguagugccuguguuaccucgagaaaggaggccuuuuuaacuguuugaaaguugggcccugugcauaggccagagaguaagcugcuuuguuuucaugcguuuugacuuuauuacaguaauuacucccauuuuaauggcacauaaaaagucaaagcauacacaugccccuccaauucugcccccauuuuaauagcaugcagaaauuaaaaacauacucauggccccucagagcaaugaauaugauuuuuaaacauuuuuaaagaaauaggugacucaaagcuuucaggaaauaugauaaagaguaacuuaaaagggacaacucucacucauggccaugaguaacggaucagaaaagaaacuagaaacugaaccaggaagagaacaggugugugagacuucuggguguaauggucaugagagcugggaaggggcuccguguauaaaacuuggcacacgaguguggaaacccaaacuugauccugcagaacccaugccaaaggccaggugcagcugccagcaaagaguccagugcugcagaggagacgggaggcagggacaggaaaacccuggacucucgugggccagcucuccaggcuuaugcccgucucuagcaagguggaaggggagggcuaacacccaagguuaucuucacacguguccuguggcacaaauacacaugagcaccugcugcaugcacauacaaaggacgcuuuaaaaaugauuucuggaaguaauaaaaugcucaaaggaucuaguguggaagaucauguaauauuuauuuguggagauguucaagagaaauaagucuugggcagaauuguguuucagaaggcagucagucagcacucaugauuuaauaguacacugccuucuuccgagccauaaauaauuugggggucuggaaagugucugauaaaccuacgugcugguaucauuucacaaccagucuccaggcccacucuuucaaggauuauuuguugugcuucauuucugcaagauaauuacuuugccuuucagccauacggaacuguaaacauagcaaacagucaauuuuuaugggacuaaaguaugccagcaaagaggcuaaacaagggugccugcaaauuaacagcccagaaggaaaucauagucacuaaugacaucgccacaguccugacgaccucaccugggcuuaacuugcagcagguucugagggcuacagcaguuacccuuuaucaagaagugggaugacgugaaagagaggugagcuugguaacagaaccagagagccaggccagguggacacacuguauguaacccagcgacugagagacugaagcaggacaccuuaaaaguccguugcuugucuagacagugaaguaagccugacuaucuggaugggugggcuuugguuuuuuguuuucaggguuuauuuuuaugugggcaugugagugccagugcccacagacaccagacaguucuggaguuauaggugguugcuggccacccugcaggucuugggggcuguauucggguccuugcaagaguggcaagcucuuaggcauugaccguccucucuguccccugagauguuuaguuugcuauguucagccugcucagaaucuguggaaguuucccucuaccgcuugcugcugcugcuguacuuuauuuccuucugucuucauuucccaaggaggcuuugcuuuguuuugcuuuguuuguuuuguuuguuuuuuuuucauuuacaaaguuacuuucaacgggaaacaggaaacaguucuagugcagcucugauguaauaauugccgcugccuucccagcuuuguccggaaauaaaagucccaucagugugcaugugagaaaacguaucuguaaaguguauagaaacuucuuaacucucuuuaggugauucauaaugauuuuuucuuuuacacguuauaucuuauuucuuaauaaaaauguaaacagauccuuggcugcucuuguucgucuaugagcaccgugagaguuuggguuuuacauuccgggaaagaucuugcuacaugaguuaaaacuugucucugaucugcuuaagugaacuucacucguuugauauaauuuaucauucaguaaacgacccuuggggcuagaguuggcucuguaguuaagaauguacugugcuuuugcagggguagcaccccucggguaucucacagucgucuguaacuccagcuccagggagucuaccuagugugcgcauaguccuagguccauucuagccccacacauagggggauggugguuuaugcucagaggcaagaggaucaaaagcucaagaauuuccucagcuucauagccaguucagggccacucugagcaacuugacaccccccucccccaaagaaaaguaauaauauaaacauuuaagugagaccucuguugucccaucucagauauaccauuaucugauggcagcguacauaucucccacagggaaagccuuuccuauauugcuggucaacacuggguccuaaguccuuuucucccagcaaguuaucuaucugaagcaacaagcucuggagagcaaguugucucucuuuaguggcgcucagcaucuggagacaucuaccaugucuggccuaagucuuaaauugaacacacucccuccccacagcucaacagccaugugcgcauaccacugaccaaccugauccucuggucucagccuccuggcauaucagagucuuccuuugcuagaauagggcccgugagacuauucagcagggaaagacacuugucuuggggugggggguugaacccacguaaaggugaauggagagaacuacuccacagaguuguccccauacacagcaauaauaauagcauuuuaaacgugucagggccccugacaggugguugugagcugccagaggagagacaacagaacucucaaacacucuuacuuaagcucugagccaucucuccagacccuaaauuuuuuuaaauuaagagcaaaacauuccuagaacuggugcacccaccuuccugcugagcucccagccagagaccagggcgaauggcugcuuaugaucagacacguguuuugagaguggcauguaauuaccuuucucacuguguggaaauggcugccaagccaggcgauagcagaggagugaucgcaggcagagcgucuguuuacugccggagccucgaagccugcugcaugccaucagccacugacaaauggauuugaagaaaggugcaagcuaagucuuuccucaaagaugcuuaaacaauaauuguugaccuacucugcagaugauuaaaauucuuuucauuugugaccuguggauguucugccuuuggcucugucagucugucucugugcagucacuuccagcuuugguguagaauacagauuugaggcacaugcggugcguaucaguacuguuaaauaaaaaaugccaauguuuggggucuuucagucugacacaguggcuugguaggaaagccagagccuguagaccuaccugcacaguguuauuaacaggguuaggugagcauuuguggaggugacauggaaauaaagggaagagccaucgucuacaaaagcucaauuguccuuuacucagaacggcugcggucggcugucucuccaggagaguggggcugugcacaggggcucuggguguagggcagaggauaaagauuacaucugcagcuugguucccccuuagcucucaacgcgcuaaaugccaagggagggauugaccuuccaccugaggcuuuuagcuccuuaacccuucacugccaauuuaaccugugucuaaacaaguuggcuuguuuggguuuuuauuguuguuguuuguuuuggguuuuuguuuuuguuuuauuuugcuuucaggacuuuagucacuucaauuuaagacacuuaauuuaccugccccaaagagcaauaagaugaaaguuuggaauagugugaaugcugacuuaaagugucacaaaagcuuccaaguccaaaauugcaaaguuauuguugacauaucuuuuuugcuuuuuguugggguaaccuuguuuacauuguguggagguaugucuccauauuuucaguguuaagucuguacuggcagggagcuaaaugcaggcaggauauugguggugucauuuuuuuggcccaccguaaggcuuauauuugcaaauguuuguccuuacacaccuaaacagauaccugaaggucagacagcccucucuaccucgagguaaucuagaguugaaucagagauuaucucacuaccuauugguuguaauaaagaaccaguaaauggcugggcaggaagagagggcagaguuugcaggcagagagaaugaugcaggagaagaaagcagaugcaggggauucagagaauggacacagaggggacagacagaccagagcagaacagagaaagguauagagcuagccauguugggagucgugagcuagauaguuggguuacuguagaugagcuggcugggagagugucuaaacaaaaggcccaagcuuuaaaccugaauuaaagucucugucauucuuuaugcugcugacaggucugagaaagucccgcuguagcuguucuucuuuuguuuugguuuucaagauagggguucucuguguagcucaggcuauccugaauucauucuucuauagacgagguuagccuugaacucagagauucacuugcaucugccuccuagguacugggauuaaaggcaugcaccaccacgccuggcggauagagcauaucaugagucccauuagauguuggcugcagaaguucuucuuaucugaauuuuggaaaaauuuuuuuuuaucuuuuauagacagggucccaauuagcccaggcuugccucgaacucacuagucagucaaaggugaccuugaacaucugauccuucaggcuccaccuccagacuugggguuacagugugcaugguuacucuacacugugaauggcuguacauaauuuaugcagugcugaggaucaagcccaggacuuagccaggcaagcagcccaccaacuaagcuacaccuagcucuuugcugggguuucauuuguaacuauugcucacccagggcagugguucucaaccugugggucaccacccccuucacaggggucaccuaagaccaucggaaaacacagaaauuuacauuaugauucacaaccauagcaagauuacaguuacgaaguagugacaaaaauaauuuuauggcuugaggucaccacaacaugaagagcuguacuaaaggguugcagcauuaggaagauugagaaccacugagcucggggcuuggguguuuuaguggauguaauguguucauauguaguuuucucccuccaaaguuuagcuguuugguuugucaugggaaugacuuucagggcuauuauccaauuuaugugccuaacauacaucccuuuuaaccaugcuuuguauuuacacgacucuuuuugcagcucagacugcagcccaugaaaucuuauuagcuuuuuuuuuggggggggguggaaucugcaucagcaauucauuuguguuuauucugcuaaauuaccuugacguuuuaauugaaaggcaguuuauuauaauuuuagucucacuauuauaaaaagucauggaaauauuuaaugauuguguuguuugaacccucugugaugagcaggaaauuaucuugucuacuugacuuugaauaggugacacucauccacugacuacaucaaggcugaacugaaauucaaguagaaaucaaauucagacuuuuucuagucagcuuuuacaaugugcacguuccagaacacugaggauuucgugugucaaaucagcgcucacagcugccuuucccucauucugauuaggaaggcauucgguuaacucuucccuguguaauuuauuugauucuuuaguuucugcaguggaacgugauuuuagcauauccaccuaguguuugcuuucuacgugcucuuaguuaucauuuggguccuuugcaaggacuguacuggcucuuacucuccaaguauuucuccagugccauuuagcuugucuacaguccuugcacauacugcaaacagcaucucggugacuguccugccuguaucuguccccacacagauagaacauagcaucccagaaguagacuccaaaucaaagagucagcacagugauuuauguuagauguuuucaaaucaccaccagaagaugaaggucuucuaccaggaauucaucaacaguguuugaccacaggaggacuuuaccuuucuggugacagcucuucagagacuccuugugagcgugggccgagagagcugcuugguuuaaggguuuucuaacaaggucugccuucuccaaaugaugcucuccaggugaaucccagcucugccuuuguaccaagcuugguaaagaucaguggauucuguugucuccuuccaagaccuguacccaguccccucucguuagaguuucauuugcccuguuaguucuuaugauuauuguaaacauuauauuuuaauucaccugauuauaauuucauguagggauauagagccccuucaaaaauauaaacauagauaguauuuuuggcucuuuguuuuguuuuuguuauaguuugauuuguucugucuugagacaggucucuagcccaaauuguguugagacccucuauggaguccaggcuggcuuugaacucaaaucuccuggcucuaccuccugagugccagguuuacaguaugagccagaauguuaaaguggaaauauuucuaauuuuguuuccuaaaaccaucuaauuccaucaguuugugguccuagauuaaguaguagcacuugcuggucccugugugcuggaauuuuuucuugucauuuauuuaaguacuuuuuuguucuaaacuccuagcugaugugugcuugggucuguaguucuuucugcccugauuacccggugguaaucugaccagucaauaaaugauuguacauuggaaauagaauauacuauagaagcuuccaguaaccuuccauccccagcacaccacacaugagucaugagugaguaaagaaugcuuaacgcgugugugacugacauccagccaguagauagucaacacggguguuaugacauccagccaacagauagucaacaugggugcugugacauccagccaguagauagucaacacaggugcugugacauccagccaauagauaguaaacacgggugcuauguuaugcuuuauuuuuacaagucucuugaguguggggcugaggcuggagagguggcucagugguaaagagugcauguugcuccugaagaggaccugaguugaguuugcagcaccuguaacuccagggccaggccaauccagugccuuuggcauccugggcacgugaacucacaugugcauacacaucuucauauggacagucagucucagugucucugucugucucugucucucuguuucucucucucucucucucucucucucucucucucucucucucucucucucucucucucucucucucucucucucucuccucucucauugagggaaaaaucaaagucaugggcagcaggguggcucagcuugccaugcaggccugaccaccaagaacccacugaaagguggaaggagaaaugcagcucccaguguaaucaucucuguccacacgagcuccacagcacucacacacgucauacacacaugcauggcaauacgaugccuaacaauagaaaaagagacccucuugaaaacuauggccuguuuuaauggggugacuuggccgcucguaugacuguaaaggggccacugugucacccagcaguagggcuaaggugcuacaucauuguuguucucuaguuucgugucacagaguaauugccagccauuuacauuuuuagagggcauuuuagacuuuaugauccuggaacaugagcagaaguuggggugggggugggagggagcagcaaugaggucaaccagagaaguccauuagaaacugguggcacugcucuuuuccuacccgagguagguguuuaaugauuggagccagcuguggccaacucuggugcucugaaaugccagaaucugugaaugauauguaagagauuugguuuaaugccaucacuuucugcaacucugcacagcaacuuuuucuuaaugaauauuuauaguaaaaguauuuuucuuguaacuuuauaauacauucuaugcauuauugucaguagauaucuuuaugaaaauauagguacauauucuagcucuccuccacaggcucuguuccaccuugagacuugaguuacugacggcauaugggcagauaggagcugugguaacacuggaguggugugcucucagcugagugugccuacaggaaccacagcgcauccccuucaacagaaugcacuacaagucacauuaguaggcuaaccugcuaaucuagcccucccacccuccuccaaucaauuuuuauauauugauugauuuuuggagagagugucuaaguagcucagacuggcuucuaacuugcaguccuccugccucaguuuccccagugcuaugauuagaggccagcagccucuggccucuggcuggcucagcacaguguuaguguauguucuugugguauaaacauaccuuauuuuaaaagacuguggcacauaacucccucccugcugagggcuaucccuccuguguucucuggaaggaugcugagugccucgugcagcacucggaagccacugugaaccagucucugcaugugucauuuucaguaccauuucaugugccugacauuuauccuugcaucuuaaguucuccucaacaucguaaaaugagacaagauuuguucauuaacuuacugcguuuuauucccuuaccucauuugccugugacucagagaaaaguguauuuuuauuuuuaugaaucuuuucaucagaagccuuuuuuuuuuuuugcuaucuuuauuuauugugugguguaugugccacacugcacagaugggggucagaggacagccugggggaguccuuuuucuccucccaccugcagguccuggggauugaacucaggucaucaggcuggaagauggguacacccacagagccaugaugcuggcccagaaugacucuaaugcuaaguugcuuuugugcuuugggauaauccaccagaaagagaaagcgaguaaauugguacucacucagcaacaaagccuguccuuacugcagaaaaccagagcaaggugguaacagccgugugccggucugucagacuucagcaccacggggaggacacucagcuccaggacugcuccgcgggcgucccgucugcccugacucaucgccucugccguccgugaacuaaagccuguguguucuuguugcagugacauuguaugccuccugcauccuccugggaguguuccugaacagcagcguccccauauucuuugagcuuuuuguggaaacggucuaccccguuccagaagggaucaccuguggaguugucaccuuuuuaaguaauauguucaugggagugcuuuuauuuuuugucacauuuuaucauacagguaagaauucgauuauuauuauuauucacuaucuaaaugugcuuugagacagguuugugaaacugacagauaggggacuuguguggagaguucucacuaaagcauauuacuuuauggagcauucacaugcuaguacaaacagugaccacaaacaguuguguuucuugaaguguguccaugggcgcucccaccccuagaagguuugaauuagccggaguggggcagaguguuauuuucuuucaucagugacuggccagcccagcccuggccacgugacuccaaugcucgaguuugcaagacagucacuggugauaugacuuuuaaacuacguguagacugagcucucugagcccacagugaauuagugucggggguuugugugguuuaaagcccuggggaugaauaagaguaagucaauaggcugagcuguucucugaagcaggcuacuccaggaggucacgcuguuuauugggagcuucugacaagcucguaauugaaguaauaacuguguuaaccuccuuggccagaagauauauuuucaaaacauucaaagcaacaaagcaaaaucauggcaacuugaacuucuccaaacugcacaauguauccaaaugacagggauuuuuauaacaugauuaacagcaaacaagauggccccugucagucggggcugcagguaaggcuuugguuccacuacaccaggugcgggcuuagcgggccaccaagggaggagcacuggugcagucacugccucuucucuucugcuuccaguacggaaaacaccaccuguuagggagaggacaucugccuucuacacagagccucgcaucugcuguguuacagcuuuaauucacuucaguugugucgaaguggaaauugagggucugucgccuuugcauggcaaagcuucagaacuagugugugucccuagcacgacagaaacaauuuuucagcugaugggcccagguuuacuaaaugucugugcagccaugcagaacacgguuuuuuccugugaacuagaaauacuuucuuuccucacaguauuuaaacgcagcagcugauguuggauaauguuauuccccgaugacucucuuuccuuggcucuagguauaacauuauugaucaguguaaagcaggaaggcaccauaaccgcagcacucuagaacugcguccuacucaguuacacacacacacacacacacacacacacacacacccguuggacucuuuguuaaggagaguuuaguuucacucacuguuuuagacgguccuugcaugaugauguaccagcucugaugaagaucucuuagggcauggcgagaaagaucacagggcaagaugacgaagacuagggaggggcagucagaguuucccacaggagcucaccucucaaagguucagcaccacacauggccauggaagacucaggccacguuuccauacugucuuacugcagaagaacacuggguauuugguauccgcugcuccucuagguccagcagcaggguuuuguuuuguuuuguuuuguuuuguuuuguuggggaggaggggcuugggggauuguugagucaggguuucuccauguagcccuggcuguccuggaacucacucuguagaccagccuggccucagauucagagaucugccugccucugccuccugagugcugggaucaaaggcgagcaccaccacugcccagcugccagcaacagccagugguagauucaucagagauugacaccuguugugcuguagcugggacucaugcauaguggccagaaaaguaccaagcaccguuucuccuaucucuuaccugcccugguuacaacaagaauuguucuggcugagaggagaacacgguccucuuauuagccgaauucuaaucauguguucuuacucauaugugaacagcugguauaggguuccugccuaaccucuuggcugcugugagcaaaugaaacgugcaguaauaauuaauuuaguccaccaagaugauuugcagacagagaacuuucaguaaaugcccgcauguggguaguggaugugcggguagguaugugagggagcacagugcacacgcucuggaggcguguuuuguuccuucuugguaguuaacucauugaugcuaugguguaaaugagcaggcuucucuuguagagaagugagcccugugaauaugucaagaccauggacacagcuugcuuagcagugugacccgaguugaaaucccuccauccgagguuagcuguccuggcccuacaaauccugcagcaaagugccacaggcuuuaggacuuuaggauaaacugcaaaucuaaaaacuuuguaaagugauuuccucaaaugucuccuaguccugcagcccagaguccuaaauauuuuauacaaugaacucagugaucuuccauaaagccaguguggaagcagcguaauucagcaacuuuaagaugaauacuugccuauggaguagaugugagguucagcuauuuauuauugcucucuucaaaguccuacuuuauugguuuuuaagaaagccuggaauugguuugguugguugguugguuaguugguuugagauuuaggcucacuguauucaccaggcuugucucagacuccagggcccuagccagccucccaccuugcucuccuaagugacaaugacagacgugugucccgugugugccuacaaccuggcuuugaucacagugagcugaguuuagcucuccucucagaaaguccuccgcuuccuugacaagguucuuucccgcccacaccaagcuguguggugccugcgucggauaauuuuucaaagcugugcaacuccccgacaugagcauguacacucagugccuugccugaggauggcuuccccccgugguugccuccagcgugaggccaccggcguauguggagcucugggccacagagccuuucaguugggcauuacaugaaaccgaaucagagauucuguaguauuuuucugaccugggguuugcaaggucagcuucuaaagagaacggugcuuguucccuacugugaggggacuguuccucugagacccuugaugaacugugacagugcagugaugccuuauucuaaaaacaucacagaaaaaagcaguggggggaggcugccauccuccaugugcucucaaaugcaauccgauuuauauucugaaguuugucuuuugugcuguauuuggucuaagugcagcagcgaguuuugucuaaaugcauaaagauuuugaaguggcugucagaauuugagucuauagugucauucagaagauccagggaccuggcugaggcggaaagcaucacuaaugggaaggaucagcagguguggaccagggauguuacaccuaagaaggagagugcugugguguuagauugggacgggguaugucugggagguuggugguacucccuguagagugcagggaacaggccauuggcaggaucuggggugcccccuggaugcucacugggagaacagagauaguuuuguugaacgcugguuggcgcuggagguucuggagaugaugcuuguagaugaucaaacuguaagcauggugacauugagaaagaaaagggaagagguuagcagcuucugggagaaggacagaagaugaaccaacagugcagaggugcugugcaggguuggcauggugcacagggccagugcagaggugcugugcaggguuggcauggugcacagggccagugcagaggugcugugcaggguuggcauggugcacagggccagugcagaggugcugugcaggguuggcauggugcacagggccuguguggaagugcugugcaggguuggcguggugcauagagcuuguguggaagugcugugcaggguuggcguggugcauagagcuuguguggaagugcugugcaggguuggcguggugcauagagcuuguguggaagugcugugcaggguuggcguggugcauagagcuuguguggaagugcugugcaggguuggcguggugcauagagcuuguguggaagugcugugcaggguugacguggugcauagagcuuguguggaagugcugugcaggguugacguggugcauagagcuuguguggaagugcugugcagagcccaagcagagugaaauguggcacuugagcuucagauuggcaguguggauaaggcugcugugugguagaugcugcucuuacaagggagucuugcgcaguccugccuccugguguguauuucucccuccucuggggagaaucaaugggaagguuuuuaggaaacugcucagccaaacagauaaagaaugcaaacauuucaguggauuggguaucauucaguuauauucuuugauacagagcucagaaagucagaaaguuuguuggcuuuacaacuuagauuaaauguuuaagaaaccccccucugccacccuuaaccccacccccuaccccaccucuguccccugagccucagcuguaaauggucuucagcauggagaugcaggugcuccccugccucagaccauuugcuuucugagaagugauuuuaaagagcacuugcuacuuguaugcuucuaaaaguagauuugacuuuucagagagacacaguaaugaacaaacaucugaaccuaggcagaaaagaauuucacccucuaaugaaauaaauguucagcuuuggcagauuggacaaagacccugcuugaaagagggccagggauuugucagucagucuuggcauuugcauugcuuccuauauauguagcuuccuauaaauuaaagucacugcgauuuaguaggugaaccacacugucaggucucugauuccuuauauccagcgugcacacuguggcugucaaaucagagagcucacugugaguucagcugcuguugaaucccaacugcuuccuccuaccuaguaaaguuaucaucagaaauuuaggcuguauguuuaauauaaaaguagaaauugcccgagaaaguguccuuagaggaacuggguuccaugaaauccagguagaacacagaagcuaggcagaaagugggguccacaccuguuucugcugugggauaccugguauuccaucuuuaacugcuguuguugcugggagcugaggacgcugcuucucagcccaguauagaaaaugucacagcagcaccugccuucuugcucagcacagguugcucuuaagcucugugagcuggguuaaaacugaauggggggcgggggaacaggaggcgggagcuggggggaguuggagccaggggagguucaggguugacuuuuggagagugaaaccauuuuagcauuucauaggaagucaaagggaaaauauaaacccuuggaaaggagggaagaaggaaaagccauaucccuucuuucccuccauuggaacugaugguauuagacuagagcaguccccaaacaccacugacaaguucuuuaugccaagaagcuacucgcuccuauccugggauugauggguagguggggugggggcagagggaggcuagccagaugcaggucccaacccauggucccuggagcucugagcagcagccagaggcagucacagaugagugacccagcaagucgcucaggacuguccaguuacuccuagacacaagagcauuuuugaaacuugcuccugauggcauuaaaucagauaacagccacaccaccugcuuggauaacuuuuucagauuucccaaugauugccauaauccaugacuguuugugauaguagggagaagaaaacugaaaaagauauccuaauacacuggucuucuaggaguagaaaugauuaauucuuuaaugguuuaccuuauucuucccauauauucuaauuuaugucauaaugguuaauauuaaauauuuugguugagaagaucauauuuccaucaaaacauaugggaauguuaccuuaaaaguuaauugagaaggaggggagaccgcucaguggcuugcugugcgaacaugaagacuugaccucgaucgucugcaaccauguaaaaagcugggcaugcucacaaacauggacaaccccagcacugcucagacagagacaggggcaugcugagcuuugcugaccaccagucuagcugguaaaauaaguaccucacaagcuguagguucaguaggaggccucgucucaagagaauaagguggaguguggaaagaacacugaccugugugcaccuacauucaacaugcaugcagcuugcucucucacacucucucucucucucucucucucucucucucucacucacacacacacacacacacacacacacacacacacacagaguguguaugugcauguaaauaaaauauaaugugacuuuucucuuuaucuaaaugcacuagauacuucuaaaccaagacaagagugccagugauagaggacacuuaaaaaauaauuagcagucuaacaagcuaacauauaagacgaucaauuuucccccuugaauuaauagauugauuuuuuuucaaccaaagucaagguauaucaaauugaugaaaauuuauuaacaacaucgauuaaauauucuaccugaaaaucugguaauaccucacacccaccacuuagccuccagaccggcagugugcagacuguccggucgccgccaggaugccuuuuguuaggaaugcagaguagcuuaugcaggugaugcuuugcagaugccgcaaaaaugcuuacaacugcuguuugucuuauuuuauuuuuugucuugcagaguugucuugguucaacuggugccuuccugggucgugucugcucagucuccuucugauucugugcuucagggaauccuaugacagacucuaccuugacguggucgucucgguuuaagaagacagacuuguaggacuuuaaagggaccguacuuuaguagugcaccuuugcuugggugcacaugcaaugggagaaaaggcgaagaaagagauuucuuucagagguucuguuaaguuacagagucucacauuaauuuaaugacuacuagguaauaauagugcaggacgugagugucgugaggaugugaaaacucuguggacagcacagcuguguuggcggcacucuuguguggagcugugacagcucacacaggacgcacugcccgaguuggucacccccaugugcacuguacccgugcugacccacugaugagcugaacuacggcaagaagcaugggugguccuaugaagaugaccccucccaggcacacagcagagggaugggacucacgccgcuaacuucugaagacaucagaacccugcgucagacuuuaauuacaaaauagcagagcuguauaccagugauagaaguuaguccuguguacacuacauguuuuucuaauaaagccauuucuuauaugacuccuuacuuuuaaccagguuggaagccuuucacuguccuugggaacaggcccuggcuccuucccacccacccuuguuucugugaguauggcgucagucacgccagcaagguaacgaaaugccugauaggguugcauuaacuguugugugaaaagcguaacucuguuaugauuuagcacuuuguuaaaaaugaacugagaaccacaugaagcaugugugucuucagacguguguggcacacguguaaaguccagcacccacuguaacuuaccagguuagauuguagucagaugagcccccacuugaaaagaacaguguauaacuuugaagguuugaagaucugugcgugauuucugaauugcaccuguguauuuuaacuuagauuguaauauacucaguucuaaaugaagucauuguauuugauuggacagauuuuugccaauaccuauuucuuucuauaaauaauggauuuuuaaaaaaaacaaaaacaaaaacauacucauugcauggcuccuggacccgucuuucaggaggucauaaacugacuguggcgggccugugacacugaccacugguguuccguagcuccucuuagacagaaccuucccuaagcuuccagagccgcagcaacuccauugccagccaguucuccuuacagcccagucucgugcaggcaucagcagcuccugguagcccggguggacaggcugcgcaguacugacuucugcucacccguguguaccauugcacaccugcagacgcaccucucaccagaaauucacgauguaccaacuuacccgggucuugaaggaggguucugggauugcccaguaucuucugaggcucaaaauugugaagucagagggggaaaguccucagaguuaacaccagucuuuagucaccucugugucgauuccaguucuaaccagucugcuuccuuagcaugggaggaagggagggagggagggagggaggaaggaaggaugaauuagcucugcuuacuucauccucaucuuucuuaaagugaaaccgaagguagaauucugaaggugacaggaagcuagucacuaaggacaugcaaaauagccaccacccccucccauuugaggaggagagaggaagcagaggggaggaguguggagaguguugggugguguuacauaaaaucugcuauacagcuucccaugaggaacacuuuaauucaugguuaauucuacuuuuaccacaaaguacagacuaauacuuuaaaaauaggaccuaaaaauagcuaaucacuugaagacauuuccaguccauuguaucagucaccugucucaacuguguggcuuccccuccagcaaacaacugcucuacccaugcauugcagcuuuucuuagugaugaaaacuucacaggggcaggcagccagugggccugaaggaaagggaaggacagggcauuaugugucuuugcuggauaauccugugccaaccugacacaaaccaguauccuccgaaaggaaggaaucucaacugagaaaaaaugcuuccauaagcuccaggugaaggguauuuucuuaauuagugauugauaggggagggcccagcccacuguggguggggacgcccuugggcugaugauccuggguucuauaagaaagcaggcugagcaaaccagagggagcaauccaguaagcagcacuccuccauggcuucugcaucggcuccugccuccagguuucugcccuguuugaguuccuguccaaaacuuccuuuggugaugaacagcaaugugcaaguguaagcugaauaaacccuuuccuccccaacuugucuuuuggucacgguguuccguugcagcaauagaaacccuaagacaaguugguacaagaagugagguauggcugugaccaccugaccgugcuuugggaaagauuacugaaggacuugggaacuuuggacuagaaaagccauugaguguugagagcucagugagcugcucuguaggagcuuggaagauaagaguauugggagcagugcagaagauggaggccugccuugugaaguuucaaagggaaauuuaaauacucaacgggucuguuugcuauaugaauucugucguccagucagccggggcggaagagucagcacugauuaaugagagaccccacaguaccugaaugccucaaauccucauauuucucaucaacacauacuagguuugcccuuguuucauacuggaagaagccuuagcccuccaccaauccaagcucuguauggagaauguauagagauggccccaaagaaguaaaugccuuuggaucgucaaguccucuguaguaucugcuuaucgccuccacacaccgcuaagguauuuuaaaccauguucuaggauccuugaauuacccaguacaacauguaaauagcuaugcuguuugguuaggaaguaagaaaaaagucuguacaugcucauuucaauuguacuauuguccaaaaaucucaaaucugcaguggauugaguccaaagaugcagaaguggcagggcacuauggugacaaggacgugucuuuucuaaaaucucaaacucaugccuuuuccccaagccucacaguauuauagcucaauuuaaaauacuuaggguauucaugaagauucucgaguccagaagggaggggcuggugguacauagaccgccaccgaguguaagaagggcagggucugacccgcaucgauuaguucuugugucaaguuuaaagugcgugguaucgcaggugccguagcgccccccuccagucuuuaccucaccaggaucuuaugcaaagguucugaugaauaauucaguccucauaaaugaacacgaggcauuauuaauuggugaggacauauucccguauaagcucccuguggcuugucaauuaauacuuuacaguucaugggaagaaguguuuuuaauaugauccauggcagagauguaggaacaagauaauuacacagauguauuucccuggaagaaggaacugacaagaggggaucaaguacacauguaauuuugcauauuuaaauucguguggccuaagggccaggucuuacucuggaucauauauucauguuuaauuauugaaaauguuuacagcuuguuuuuaaugaagccugucuaacgagggaaucccagcuaagggauuuaaaguugaggagauuaacuccccaucuacuuaucuuuuaauugguuuuuuuuaacucuuauuuuuacuaaaauugaaguacucaucuuguauucugccugcauaccugcuuuauuuuuaaguuaagaucaaauaaaaauacauagcaaauuuacuuucag

SEQ ID NO: 8229 - RNA, 3000 nt, Mus musculus
uuuugugcagaauuuaauuuccuuaaaauccuaaaacuuacaaacuaauuuacagugauaaaguaaguuguugauugucagagcaugagguugauagggagacauaaaucaugaggggaauuggggagguuuuggacauggucagaaugugucgucuugauuaucuugauggacucaggaugcgggucgaucagauucaucaaucaaaugcuuuaaauauaugcuguuugcuguaaauuaauuauaucucaacaauaccuuuaaagauaauauaauacuuggggcuggagagaaggcucagcaguuaaaagcacugacugcuuauccagaggacccagguuugauccccagcacccacugcugcagcacacaccacacaucacaaccgucuguagcuccagacccaggaaucugacguccucuucuggccuccaugggaaucaggcaugcauuuaauauacaaacagguaaaacacucauacacauaaaauaaaaauaaaucuuaaaaauuauaauacuacuaguacauuuuaacugcacuaucuugacacuaacaguguuguucaccauugccuauacacaaucagcacuggugucaacacagugaaguggacaaauaacaguguaguaguguugugaagacaguuuugaccucaagauccaaaggggccaagaagaguccucuugagucuagcaucgucacuucucuacuuauucuguuauggcaaugucuccucaaaaucuaaaacaaucucuuaugaaaaauauucuucaagucauguuuaaugcuaacuacuaacacauauuaaucauguucauaaaauguauaaggauaacauuuaaggcccucuccccaccccagcucaauggcuucgucuccuguuggcuccuggacagaccauguuccccccaccuuccgaccugugcucagacgcucuugaguuuugcauaguaaguucuacuucugaggacuggcuuggauucagcccuggcugugaaaccucaggcacuuaagcacaugcgucccuugcuggcauuccuuuguguccuguuuggacucguaucucauagaauugcaucuugguccuauaacguguuggcuaucugcuuuccuuuuucccucagagcugcuggcauaggacugaauauggaauaggucuuugaaugauuacauucuuuagucuuuggcauucuuuaaagaacauuuugauuaaacuccuggcuuuacccuugucaaacguucugugucuucuagguaaccaaguguaacaucugucaauuuugauaaggaauuucuucagccuucuaccaaguuuauaaguuuuaauuuacagccucuguuggaggucuccaucuacuuaaucuuuucuuccauaaaggagauuaauucucuguuaaauaugcgauguuuacauaaugccaaauaagcugguacuaauauaauuggaaaauaucugguagucuugcagauggccugaacuucuugacaccagacuuguguaugacaaaauuagucucauugguuuucugcuuaccccuucauaccaaugacuaagcaaagcaugccugcgcccuuuucguuacugcccuaggaagauagggaauuggugagaaacauuaccuuuaucucuuguaguuauugauaagcauucuuaaaauugagguuguaaagaaucaacauacaauaaaaggaguuuugugccaaaagaauguuuuccagguagauucuauuucguguuaugauugagguuggcuguggagagucaggagucuuauuaagucaccaggauuucaaaucugcaaaagcaauaaauggaagauuaguucagcccuguuggacuuugugacaugccuguguggauguguugaaauagaggcagcuguuuuggaaaugauuaaaggacucucaaauggggaugcuuucugcgagacagaucagcaccgaagaauucacgugcuuaaaaaaauagaaaauaggauuuaagcaucuauucaguaaguagagaccuaauggccucuucucuuucuguaccugaaggucauuuuccugaggaaagaugaaaaauuuuuaaauucuauaauuaauuauaguuaacaaucuugguguuuuuaagaguucugauuuuauugcucugaccaacauuauuuuuuuuauucagauguauguuuguugugaaauuaugaauaguuguuuuuucuguagucugaccugugaauagaagauaaccagugugagacagugggucuaagauugacagaggaacauuauggagcugaggcauucagaguccagugguaggagcugucaauaccagccauuuaaaccccaggcuauaauccuuaccugcagaguagacacagggguaacaaggaacauauuuaaaucuucuucucucauaauaucguauaaaacuaagcaauuuaaucauagauuuuuaaaugauuuguuguuguuguugguuuuugugguagucugacagaaacuguuauccugucuuaaaaacuuccuacugguuuuucuuuaguguuuugguuguuuuugcuuguugguuuguuuguuguuguaacuguaaaaaaauggaugaguccauuauguguacagcaguuuuaaaaguguucauuucuguaauggcuauugaauuuauucauagggucagguuuaagcauuucagauccuggcaugguggcacauaccuuuaauaccagcaaagacugauaacaggcagaucugagccaggacuacacaggacuacccugucucaaaaacaaacaaacaaacaaacaaacaaacaaacaggaacucuuuaggucuugaauaaaaauagauccagcagcuccuaugacuaagccagcguuuuuuuuuuuugaaaguacuguauucaccaccauagguauuggggaaaugaccugaaugagaaacugaacugacaugagcuguggcacuugugcuggcugguuuuuaagucagcuugacacaagcuggaguuaucugagaggagg

SEQ ID NO: 8230 - RNA, 12643 nt, Mus musculus
gucuguuguauguaaggaccugacuuuauuuaaugcagauaauaacaccuugcaaaagaaaaaaauccaaaugucauugagcccuccaccacguggaauuugcaugugcacacuggaugaaauaaaagauccagaacuuaacagaaaccauuuuuuucuucuuuagaguaaauuugauuacaagauuagaagacagaaaaugaucaguuggucuuaaugauaaacacuuggugaaucauccaaagggaaagguccgaaccggaugcagaaggcagcuaugauggugcaggccuugcacuuggaaggcuguggaagcagauccugagagcucugccuaggauacaugcaagaaccugggcaggaggugaggcaggagggucagaguucaagaauagccuuggcuacauagggagaggccagucuagguuacaugagacccuggcucaaaaaaaaaaaaaaaaaaaaucuaaacaaacaaaaaaaccaaaauggggaugaaaguaaaaguuagcacuucuacuuauugguuaugucacccucagugauugacuacugugcucuguauaugaguuuucuguucaaagaauagagcuauuaaucagauugaucccaucaauguuaaguacuuacaggauaaguacuugauuaauacuuccuauuaauaucuggccaaaaugguuuuauguaugugcauaugugucuuaaggagaagguuagggugucaucuaccauuuuggagaguggcuggaauacagaucaccaggucauugccugcugugguuuucuucuaacuuggagaaccacuuacagugaacugugaugugccauccagacucuacaguagguugaacuuucuccuuuacuccuguccagggaaaggauuagaaagacuauauaugagauaacagacugcugggauucgcucaaaggauuaaaaaacaaaaagccacuacauugcagguagcaaauacugugaaauauuaaacuaagggaaggcuauuuacccguuaaaacuugaaacaauauauauucuaaaaguacaacauaauguguagggaagaauauaaaaacuauguugcacuucuguggcagggcaagugcauccucuaggacagguuccauggaucaggggagaguagagcccaaauucaaggcuuagucagugucuaaucaguacaaguugggguaagaaaacuauuuuccaaaugaaugucacggucucaagucaucucucucccgaagauuuggggaacauaucuuuuuaucuauucacuccucugcugagcuacuagcaucuugagucaggcaguagucacacaguaucuccuaggcucuguguccugaaaaauauaagucuuuuuguucuauuuauuaccaaaaguugccucaucuccuggaaacuucucuugcuauggguagggaaggaaauaugagucuuuuccagccaaaccuguuuguuguuguuguuguugucuuuuuuuuuuuuuuuuccuagacaggguuucucuguauagcccuggcuguccuggaacucacucuguagaccaggcuggccucgaacucagaaauccaccugccucugccucccaagugcugggauuaaaggggugcgccaccacguccggcugccaaaccuguuuuuaaaguucccauuuauacaaggguuucacuuucccacuuacacaaggguucaggaagagauuaaaaaauaaacaacuaauguauugcuacagagauggacaugaaaaagaauuaugggauggaacucacuggccuaggguuuaaauuccaacaucaaaaucaaaucaagccgaacuaaaccaaaccaaaucaacccaaaccaaaaaagcuaaaaccaaaacccccaaacaaacaaacaaacaaacaaacaaacaaaaaaccaggcaaugccagcacucaggaggcugauauaggcagaucuaaguucaagaccaagcugguccacaaauugaguuccagagcuaugcagugagacccugucucaaauaaacaaagcaaacaaaaaucagggaagguuccauuauguaaggacauagaagaugauuacagacucacccaacaccccaaccguaacacaagaaugacgucagauuucuucagcaaaaauugaaauccuauaaaacuauaaaguuuucuuuucuaucuccccgcuccccaguguguguguguguguagguguguaugcagaacagaggaugauguuagauauauuuguuucugucuuccuaauauuuguuuugagacaaggucucacuauguauagcuggcuguccugggacuuggacacuguagaccaggugaggucuggaacucagagauugcccgcuucugccuuccaaguucugacauuaaaggcaugcacccccaugucccgauccaccuuauuucuugagauaaggucucucagugaauccagagcucaugguuuuaacuaggcuaguuggccaguaagcuccaggaauccuccugucucuacucaccagugcuaagauuacaagugcaugccaacacaccaggcuuuuccauggauaauuucagaucugagcucauuucuucaugcuuuguagacagggccauuccccccaaccugugccuguagaguuugccuuccaugaaagagugccagccacucuagaaaagacuggcaaacagacuacuuaacaugaaaaauguuacaaagucguucuagaaacagauuuuggucuguacuauccagccuccugacacaugucuuuugagaguggacagacaucuucccugcaguuuccuuacucaaugccuuuugcuuucagcuccuccuugacacguuucagguaaucaggaucaggguagccaaaacugcaggaagaaaacaagaaacacuuuagcuucuucccaaagaauucuuaagaauguguaugacagcugguuauuguggcacaggugcgcaacacucaggugacacaacagucagagcucuaugaguuugaggccagccugagccacauaaggagacuuugccucaaaacaacaacaaaaacuguagguacuacuuacauuugagcaucuaguauucuggguuccaaacauucuccggcaauccagacagugacuaauaucuagucauccaagugccuggcuggcugaccagcaucuguuuucuagacagauugcuuaaauucuuaacuuauucuaaguacugaugcacauaauguuauaacugucauauucuacagaggcaguaguagucauacacuuaugggcaaacacaccagaagaaggcauuggaucccauuacagaugguugugagcuaccaugugguuguugggaauugaacucuggaccucuggaagagcaaucaguguucuuaaccacuaagccaucucuccagccccugugggcuuuucaaauugggggaucugaaaaggcuucaugauauauuucuuuuggaugccagagguagaggaauucagucagauuuccuggaauauaucucccaccaucuugggacccuuuauaacuaagacuucugcuaccauauauuagucuugugaguucaguaucauuguggacugaugggaagagagaggcgaggaagagggcgaggaccuuaaaaggaaucaaagccaugcuggagagaugacucaaugguuaagagcaggggcugcuuuuacagaagaccuggguucaauucccaacaccugcauggcagcucacaacuaucuguaacuucagggcaucugacacccuuacacaaacauacaugcaggcaagccacgaaugcacauaaaaauaaauaaaccuaaaaaagaaaaacagaaaucaaaggcaaauaauguuccuacgaucuaucuuuuaaauaaacaugaaacccuaaauuuaaucaacuuggguaguauucaucuugggcucugaaaccccuuucuucugcagcagaacuaaacaacugaguaauaccuuaugaauggcaggguagaagguugggggaccagucuuuuuaucuuugaaauuaucauuaugggcuauuauguguaugcuguggcuguuggcuaguuuuaugucaauuugacacaaguuggagucaucauagaggagaaaaccucaauugagaaaccgccuccuggggggggggugguggcaaacaaccucaaucccaacacuugggcagcgaaggcaggcuggccuggucuacagagugaauuccaaggcagucaggguuacaaagaaggcugccuccauaagacugggugguugguaagccuguaagacauuuucuuucuuucuuucuuucuuucuuucuuucuuucuuucuuucuuucuuucuuucuuucuuucuuucuuucucuuucuuucuuccuuccuuccuuucucucucucucucucucucucucucucucucucucucucucucucucucucucucucucuuuuugguuuuucgagacaggguuucucuguauagcuuuuucuuaauuagagauugaugucagaagggcccagcccaaugucaguggugucaccccuggacuggugauccuggaugcuguaagaaagcaggcugagcaagccauaaccaauguuccuucauggccucugcauccguuccugucuucagguuccugccuccuuugagauucugccuugucuuccuucaguggccugugacucagaauauguaaggcaaauaaacccaucauccugaaguuguuuuuuuuuggguuaucacagcuacaguaacccuaacuaagacaccaggcuaacaucuacugcuagaaugucuuucuauccccacagccucaaacugcaguguuugacaaccuugaacuucauucagcaaccacuacauuucaaaaggcucuuacuuugcugguccuccaaacuuggauguuuugugaugaauaucauuccauguaaugacauccgagacuccuguugcucgagaguauccuauugugaaagucagucugugcuuaaaggcuucguggagcagauccaaaaccuuucuucccucaguauuaucaggcaaguaugcaguucgccguguuccaugauaagccuuuccuggguuugggugcucuuucuguaugaagaaaagaaaauuauauauguguauguguguguguguguguguguaugugggugugugcauguguguacacauauggaugccucuauuuuuaguaaaguuauguucaugguagaugaagccuauugaaagccagaaaaauauuaacauuuuacucauauucugaauaauucauaguucucuucaaauuagaacacuaccugcccaacuccucccauccuaacauaugaauucuaucuuuaauaaaaagacaugaggccaggugguggugguacacaccuuuaauuccagcacucuggaggcagaggcagguggaucucugugaguuugaggccaaucugcuuuacaaauugaguuccaggacagccagcuauuacauggagaaaccuugucucacucccccgccccccaaagacgacaugaaacgcuagggguauagcucauaggugcuugcuuggcacguccaaggcucugaguucaauacauugucaaaauaauuaaaaaggcaucuaauuucuaagcaugcaacacgaucucugccucuguuauaaccgacccacaaucacagaaugaaugauuuccugggaaaaucauuaucuaagaggcuauaggaugccucguuggacuuuggcaauucuagcauagcgaaaagaaacccauguuccucgggcacacuuacuguuuggaugccaucuuuuauuucauaauuaaucacaauggugccacagccuucauaaccuggaagugacccuuuuugaguggaguaagacaugguucccucuggcugguucccuuucuggaugccguaggaagucagacacacaggacagacaggcuugauaagcauggcuuugcugauacacgaggugcagaauucaugcuugcacuuggggagcacgugcuuguugcugaugguauccaugcagaugacacaguaguccucaguccccuucgaagcugcagggcugcuagaggugccucggggagcagguaaggcugcauucuccugcugaucuccaugggggucacuacugcugaucuccauggggguuuccugauccauagcgaguuucucuccagaugacggugccagucccauucuuuuggagacauacugcauugccugcgcaaggugauguggcaagccagucaaggucacugacuccugagaugucacaaagugcacauucgggugcucuuuuuuaaaguugucggcaaacuugguauuguguaagcgagcucucuccuugcccaacccuuucagcgacagaacuucuguccucagcugccacguggcacgcuggaaggcaucaguaaaaccuguguaggacugcacugacaggucuaagucuuuauccuuggggacaaaaagaaugcagguuuucuggccuuuuuccuggacuuugccacggguguuaaacuucugcucgaucucugagauuuccuggagcaguucaggcucuagaagcuuaaagcguguugaaucgaccucgaugcccgucguguacccagaugcgguuauuuucacaggucucaggccaagaccuugggagacuuuuucuguggcggcugaaaugucagcaggagagccgaggagagucagcguucuucccugucccuuuaucaagagcuuugggaagcagcgacucagcuccugucugaccuccuuugcucucuggugcuccucuaaagagauacaaucuugcuucagagacugcgagcauuucugaaagucucugacaaaggacugacuugcuucuucuacguugccaaaugggcuggaggugaagccuacagugaccauauugggagaacuagcuuggauuucaauguuuacaccaaauuuguacucuaugaacucuagucuacccggauuaacaugcuugaaauauucaaggagaagcacaggaacuugaauacugcucugaucagggggcucccgcuccacaucgggagguguguguuucuguggggcgcacuuccguuucugcucgcuucccuuccguuucugcucccguuccaaaagcugcucacucaagaagugauguaucuuuucaauaucuuugaaguugccacacaccuucuuaauuccaucacuacccuccaugcuuuugaugaugugagggcagacagugguuauagaugcucucugcucuuuagagagcaggucacaguucagcucagcggucacagcaagaaagaucugaagguuuaagaagaagguacaaauaagaugucucagaauauccaccccuuugcagaaaggcacccagaaauuauaccaucuuuuuuuuauuagcggugacugacuucuuaaguccccugagaggagcuacaagugaggcuugccagcccccuuugcacauuagacucaccuugggggugcgguggggagggagcagugucuaaacaugaauuaaucaacgaaagccaaggccagaccucauugcagaggcucauacaacugguuugcaaggaagccugggcaugaacauuuucuaacacucaauggccaagagaucggugucuagagcugccacagucugcuugacccuugaggacuaaggguugagaaaagacaacuccuugaagcugcugugguucucaagaaagaguuugcgagcuuugaacuucaaagguagcucuaaauccaagauggagucgccuagcguugucucacccuguuuuuuucuuacuuacucucuuacuuuaagaaaaccccaaagcagccaggaggugguggcauaagccuuuaaucccagcacucaggaggaagaggcagaggaucucuguguuugaggccaggcuggccuaaauagagaccaggauagccaggacuacauagagaaacucugucuugaaaaaacaaacaaacaaacaaacaaacaagaaaaccaaauacaauaaaaggaaaacccuagugcauggaacacuuaacucauggaaaguuacuaagucuuuuaaaccuugguuuuuuaaaaguucagugaugaguuagaaauaccagauuuggauaaaaaggauacaggcaaauugaauguaauauaaaagcaacauuucugaugauugguucccacucagaguuuuuccagaugcucucuaguccacagagagcauuuucuucucuagauuagagccucaggguauuuccagaaucagucuuucccacaccuccaucaggaccaccuagaaucuaggaugucauccaccuagcccacugcagccacugaccuugcauccuggcuucuucaaugccugggcuucagugcagcagccagagcgauccuugacaaauacaaucuggauccugcaccaccggggccccaaaacaucaggcgaagcuccacagcggaaguucaaacccucagcucugccuucacaguacccuuucacgugcccagccucucacgugccucucuugcucacugccugcucccuacucuugccucacugagacuucugaguucaagacaucaauuccugggaggucugugcaugcguuucccucagccuggaauguccuaauuacaaagccacacagcuuuucuuacuuacucucuuuucauuuauuccugauuuuuagaugaagcaucauuuggaucugugugucucuucguuugcgcccuauuuaugagaguguuucugccacugucacauaucugccuuuauucuuccugcacuuguugcuggaaagacuuuuauuauaaaucuauuuacuauucuuugcuucccuuacuagauagcuaagggcccuaagagcagucugcaaugugucuguguccccagccccuacaacacugccuggcacacagaaaauagucucuauuuggaaaacacauuuuuuuuuuuuuaaauagcugaugcacucuuaucauuuaagccucaggcuaaaugucacuucaucaagaaguucucccauuguccccuugcaagcccucacccugcucuucucugagacaaaacucuguuuuuaauucuugcaugucuuagucuuggaaguacuucuacucagcucauugcuuccugucugcacacccaacacaggcugcaugaggaugggaaucuugucucugugccucuguaguccagugccuagaccagugccucgccuggagcuagccccugggacaagguuguuagaccaaaaaggcagaggcggugaccacagaagcaguuguagaaacagugccagcuuguggguucccaaagcugugagaccaggggugccagucaggagcaagagugagguccagauacguuugaaccugaaaaucacaucuggagacccgcagacuccaggacugcuuccuccuuggucggaaccaggaugucccagugcacaggagccuuaugacccccaccuccaccacucgaggcagucuuguagccugguggcuagaucacaaguuaaacuuccucucuccuuaaaaggacauguccagcaagcaagcaccuggaauuccucuucacacaaauaaagcauuccccagcaucuaugcccccagccaaugaugacacucaccuccgaaaccccuacccacuuccgcagguuuauauagccccuguucaccccaauaaagagggagguuucccugaaaaccauguccagagaaggcuguuucucccuaacucaggcuggcugagaucuugcuaauccaccuguaccaacuaagcuucauuccucccuguacaguccggggugcacaaggcugcccgaaaacaccgaggggaagggaggagcagaugccagggcagcaucagcuccucugucaacacucaccuuuuggacaacugagucaacagaguuagaaacgagcccguccuggggauguaugucaucacaaagugcuucauccagagaccccgucaaggacggaggucuggagcuuggugucuccacuggcugugucaaggaugggagucugggucucagguccucuacuggcuuuuuaguaguuuccaggacaauggucacagguuuguuauggaccaacaucucguguucgcucuuuuucaacacuuucuccuuaucuucaggggagacauuaaacauacacauucacacagaaauaagagagaauuuacauagcugauccucaguaucccuguagguugauucuagaaacgucugagcaugcuaccuccagagaugucccuaauaagcuuaggacuuucacauaagcuacccauguucucacauaugcuuuuuaguuguucauuuuuuuguuuuguuuuauuuuuuguuuuugagaccuuagguaguccuggcuguccugaaacuccugguguagaccaggguggccuugaacucacagagaucugccugccccugccuccagagugcuacaauuaaaggcaugugccacuacuauaaaugcauugguucgccuuccauagacuuuauuugaauaaaccauaggguaugggacuguuguguaaauuuucucaagacugaaacauuccacccugcaaagaaguuccuuaagcaagaagguaaacaacucaaaauagcuucaggaaaucccagaaacugaccagacucauaggccccucccugaaugaauaaacaauagagacuguugggaagaguccuccugagacucccagaacagagcugcugugaggacucauuaaaggucugcauaggagacucuuagacaaaacaagcugugaagaaaacuuaaaccaccagagaagcugccugcaggaagugaacucuaagcuccacuuaggaggaaguuuagaccaacugagccaccuggaaagaacacucccuaaccuauugagcugccuguaggugugcagugagcuccagguucccagcuuugugagcugucacccaugcuaggugggcuuuggugaugcaguugccuuugagucguuucccauauuccuguaaguaaauccaauaaccaauaccaaugcaauaaguaaugcauugguucaccaaguuggcccuuggugguaucuguuguaggcuccuggucaaaugcauacagaggaccugaacaguuauuucuggcauucuggaauagcaggcuggugauaggagaagcuaaucagaacucuaaagaagggagcuuaaguuuuagcauaggaauauaauuugguuauuagaaaucacauuucuagucugggcaugcugguacacacucacaaucuagcacuuaaaugguagugguagggguagggguauuaugaguucaaggccaaccaauggcacauggcaagauccugucucaaagggguggugguggggaaaccuauguuuuguaaugguuuugaaucucucauuucaaugacauugaauaaugguuauuguauaguuaaauggugaaacccccggccccccaaaagaaacaagaucaaaaaguuuagaauguauauucauuugcugacucucagaaaagaaugcaugaaaaugcccccauugaggacauuaguguggcaccaccugccuuuaaucccaguagaggaaggaggaucucugcgaguuugaggucagccuauggagcuaguuccaggacagacaaggauacaaggaauaacccugucucuaaaaucaaccaaacacacacacacacacacacacacacacacacacacacacacacacaccaaaaaccaaaaccaaaaccaaaccaaaccccaccaaacuaucuucagauaauuuuucuuugacuuuccucuuuaaagucauauauuacuuuuguaguccuuaaaaauaagucaacggaaucuuuauuuacaacauuaaaauggcuuggagucgagaucggugguggagcacuugccuagcgugcacaagguucuggauuuccuccucaaucccaacccccacacuuuguuucuucucucaacugggucugcugggaaauucucagauggagucgaaccgcgaccucaucagcggcuggacucauacgaggcucucuccgccacugugggauggagggagucuguggaccgcacucucccacagacagagagccacacucgcgugggcucucgucggaagcaugcagggaucgguuuggaaaccugcugguucuacccuugcacccgagccuugcccuguuuccccugccccggcucaccugcuuuuuuuaggaacuucaccucguagguguccggggcgcuggggcccacgggcuggacagagcacuccccaccucccgaggcccggcucuggaaguauaucucgagcuuccugugcgccuuggggauggacucccgcagccguacgaguagcggggacggcgggucgggacuggaagccauggcuauccgcgucuggcucguuuggggcucaggggcgcugcacagacagggaagagcaaaggcgagcccugcccuaaagacccgagaggcaaaguuucaguuucgauuccccagaaggucccuccuuguucuccgcagagccgccgccugucuugcucugccaucucucagagccaucacccggugaguaguucgcacgcucggcggugggcgcucagaggaaguuucccuacgguggcaggucgcccuucuauucuugcaggaucggaaguuug

SEQ ID NO: 8231 - RNA, 12643 nt, Mus musculus
caaacuuccgauccugcaagaauagaagggcgaccugccaccguagggaaacuuccucugagcgcccaccgccgagcgugcgaacuacucaccgggugauggcucugagagauggcagagcaagacaggcggcggcucugcggagaacaaggagggaccuucuggggaaucgaaacugaaacuuugccucucgggucuuuagggcagggcucgccuuugcucuucccugucugugcagcgccccugagccccaaacgagccagacgcggauagccauggcuuccagucccgacccgccguccccgcuacucguacggcugcgggaguccauccccaaggcgcacaggaagcucgagauauacuuccagagccgggccucgggagguggggagugcucuguccagcccgugggccccagcgccccggacaccuacgaggugaaguuccuaaaaaaagcaggugagccggggcaggggaaacagggcaaggcucgggugcaaggguagaaccagcagguuuccaaaccgaucccugcaugcuuccgacgagagcccacgcgaguguggcucucugucugugggagagugcgguccacagacucccuccaucccacaguggcggagagagccucguaugaguccagccgcugaugaggucgcgguucgacuccaucugagaauuucccagcagacccaguugagagaagaaacaaaguguggggguugggauugaggaggaaauccagaaccuugugcacgcuaggcaagugcuccaccaccgaucucgacuccaagccauuuuaauguuguaaauaaagauuccguugacuuauuuuuaaggacuacaaaaguaauauaugacuuuaaagaggaaagucaaagaaaaauuaucugaagauaguuuggugggguuugguuugguuuugguuuugguuuuugguguguguguguguguguguguguguguguguguguguguguguguguuugguugauuuuagagacaggguuauuccuuguauccuugucuguccuggaacuagcuccauaggcugaccucaaacucgcagagauccuccuuccucuacugggauuaaaggcagguggugccacacuaauguccucaaugggggcauuuucaugcauucuuuucugagagucagcaaaugaauauacauucuaaacuuuuugaucuuguuucuuuuggggggccggggguuucaccauuuaacuauacaauaaccauuauucaaugucauugaaaugagagauucaaaaccauuacaaaacauagguuuccccaccaccaccccuuugagacaggaucuugccaugugccauugguuggccuugaacucauaauaccccuaccccuaccacuaccauuuaagugcuagauugugaguguguaccagcaugcccagacuagaaaugugauuucuaauaaccaaauuauauuccuaugcuaaaacuuaagcucccuucuuuagaguucugauuagcuucuccuaucaccagccugcuauuccagaaugccagaaauaacuguucagguccucuguaugcauuugaccaggagccuacaacagauaccaccaagggccaacuuggugaaccaaugcauuacuuauugcauugguauugguuauuggauuuacuuacaggaauaugggaaacgacucaaaggcaacugcaucaccaaagcccaccuagcaugggugacagcucacaaagcugggaaccuggagcucacugcacaccuacaggcagcucaauagguuagggaguguucuuuccagguggcucaguuggucuaaacuuccuccuaaguggagcuuagaguucacuuccugcaggcagcuucucuggugguuuaaguuuucuucacagcuuguuuugucuaagagucuccuaugcagaccuuuaaugaguccucacagcagcucuguucugggagucucaggaggacucuucccaacagucucuauuguuuauucauucagggaggggccuaugagucuggucaguuucugggauuuccugaagcuauuuugaguuguuuaccuucuugcuuaaggaacuucuuugcaggguggaauguuucagucuugagaaaauuuacacaacagucccauacccuaugguuuauucaaauaaagucuauggaaggcgaaccaaugcauuuauaguaguggcacaugccuuuaauuguagcacucuggaggcaggggcaggcagaucucugugaguucaaggccacccuggucuacaccaggaguuucaggacagccaggacuaccuaaggucucaaaaacaaaaaauaaaacaaaacaaaaaaaugaacaacuaaaaagcauaugugagaacauggguagcuuaugugaaaguccuaagcuuauuagggacaucucuggagguagcaugcucagacguuucuagaaucaaccuacagggauacugaggaucagcuauguaaauucucucuuauuucugugugaauguguauguuuaaugucuccccugaagauaaggagaaaguguugaaaaagagcgaacacgagauguugguccauaacaaaccugugaccauuguccuggaaacuacuaaaaagccaguagaggaccugagacccagacucccauccuugacacagccaguggagacaccaagcuccagaccuccguccuugacggggucucuggaugaagcacuuugugaugacauacauccccaggacgggcucguuucuaacucuguugacucaguuguccaaaaggugaguguugacagaggagcugaugcugcccuggcaucugcuccucccuuccccucgguguuuucgggcagccuugugcaccccggacuguacagggaggaaugaagcuuaguugguacagguggauuagcaagaucucagccagccugaguuagggagaaacagccuucucuggacaugguuuucagggaaaccucccucuuuauuggggugaacaggggcuauauaaaccugcggaaguggguagggguuucggaggugagugucaucauuggcugggggcauagaugcuggggaaugcuuuauuugugugaagaggaauuccaggugcuugcuugcuggacauguccuuuuaaggagagaggaaguuuaacuugugaucuagccaccaggcuacaagacugccucgagugguggaggugggggucauaaggcuccugugcacugggacauccugguuccgaccaaggaggaagcaguccuggagucugcgggucuccagaugugauuuucagguucaaacguaucuggaccucacucuugcuccugacuggcaccccuggucucacagcuuugggaacccacaagcuggcacuguuucuacaacugcuucuguggucaccgccucugccuuuuuggucuaacaaccuugucccaggggcuagcuccaggcgaggcacuggucuaggcacuggacuacagaggcacagagacaagauucccauccucaugcagccuguguugggugugcagacaggaagcaaugagcugaguagaaguacuuccaagacuaagacaugcaagaauuaaaaacagaguuuugucucagagaagagcagggugagggcuugcaaggggacaaugggagaacuucuugaugaagugacauuuagccugaggcuuaaaugauaagagugcaucagcuauuuaaaaaaaaaaaaauguguuuuccaaauagagacuauuuucugugugccaggcaguguuguaggggcuggggacacagacacauugcagacugcucuuagggcccuuagcuaucuaguaagggaagcaaagaauaguaaauagauuuauaauaaaagucuuuccagcaacaagugcaggaagaauaaaggcagauaugugacaguggcagaaacacucucauaaauagggcgcaaacgaagagacacacagauccaaaugaugcuucaucuaaaaaucaggaauaaaugaaaagagaguaaguaagaaaagcuguguggcuuuguaauuaggacauuccaggcugagggaaacgcaugcacagaccucccaggaauugaugucuugaacucagaagucucagugaggcaagaguagggagcaggcagugagcaagagaggcacgugagaggcugggcacgugaaaggguacugugaaggcagagcugaggguuugaacuuccgcuguggagcuucgccugauguuuuggggccccgguggugcaggauccagauuguauuugucaaggaucgcucuggcugcugcacugaagcccaggcauugaagaagccaggaugcaaggucaguggcugcagugggcuagguggaugacauccuagauucuaggugguccugauggaggugugggaaagacugauucuggaaauacccugaggcucuaaucuagagaagaaaaugcucucuguggacuagagagcaucuggaaaaacucugagugggaaccaaucaucagaaauguugcuuuuauauuacauucaauuugccuguauccuuuuuauccaaaucugguauuucuaacucaucacugaacuuuuaaaaaaccaagguuuaaaagacuuaguaacuuuccaugaguuaaguguuccaugcacuaggguuuuccuuuuauuguauuugguuuucuuguuuguuuguuuguuuguuuguuuuuucaagacagaguuucucuauguaguccuggcuauccuggucucuauuuaggccagccuggccucaaacacagagauccucugccucuuccuccugagugcugggauuaaaggcuuaugccaccaccuccuggcugcuuugggguuuucuuaaaguaagagaguaaguaagaaaaaaacagggugagacaacgcuaggcgacuccaucuuggauuuagagcuaccuuugaaguucaaagcucgcaaacucuuucuugagaaccacagcagcuucaaggaguugucuuuucucaacccuuaguccucaagggucaagcagacuguggcagcucuagacaccgaucucuuggccauugaguguuagaaaauguucaugcccaggcuuccuugcaaaccaguuguaugagccucugcaaugaggucuggccuuggcuuucguugauuaauucauguuuagacacugcucccuccccaccgcacccccaaggugagucuaaugugcaaagggggcuggcaagccucacuuguagcuccucucaggggacuuaagaagucagucaccgcuaauaaaaaaaagaugguauaauuucugggugccuuucugcaaagggguggauauucugagacaucuuauuuguaccuucuucuuaaaccuucagaucuuucuugcugugaccgcugagcugaacugugaccugcucucuaaagagcagagagcaucuauaaccacugucugcccucacaucaucaaaagcauggaggguagugauggaauuaagaagguguguggcaacuucaaagauauugaaaagauacaucacuucuugagugagcagcuuuuggaacgggagcagaaacggaagggaagcgagcagaaacggaagugcgccccacagaaacacacaccucccgauguggagcgggagcccccugaucagagcaguauucaaguuccugugcuucuccuugaauauuucaagcauguuaauccggguagacuagaguucauagaguacaaauuugguguaaacauugaaauccaagcuaguucucccaauauggucacuguaggcuucaccuccagcccauuuggcaacguagaagaagcaagucaguccuuugucagagacuuucagaaaugcucgcagucucugaagcaagauuguaucucuuuagaggagcaccagagagcaaaggaggucagacaggagcugagucgcugcuucccaaagcucuugauaaagggacagggaagaacgcugacucuccucggcucuccugcugacauuucagccgccacagaaaaagucucccaaggucuuggccugagaccugugaaaauaaccgcaucuggguacacgacgggcaucgaggucgauucaacacgcuuuaagcuucuagagccugaacugcuccaggaaaucucagagaucgagcagaaguuuaacacccguggcaaaguccaggaaaaaggccagaaaaccugcauucuuuuuguccccaaggauaaagacuuagaccugucagugcaguccuacacagguuuuacugaugccuuccagcgugccacguggcagcugaggacagaaguucugucgcugaaaggguugggcaaggagagagcucgcuuacacaauaccaaguuugccgacaacuuuaaaaaagagcacccgaaugugcacuuugugacaucucaggagucagugaccuugacuggcuugccacaucaccuugcgcaggcaaugcaguaugucuccaaaagaaugggacuggcaccgucaucuggagagaaacucgcuauggaucaggaaacccccauggagaucagcaguagugacccccauggagaucagcaggagaaugcagccuuaccugcuccccgaggcaccucuagcagcccugcagcuucgaaggggacugaggacuacugugucaucugcauggauaccaucagcaacaagcacgugcuccccaagugcaagcaugaauucugcaccucguguaucagcaaagccaugcuuaucaagccugucuguccugugugucugacuuccuacggcauccagaaagggaaccagccagagggaaccaugucuuacuccacucaaaaagggucacuuccagguuaugaaggcuguggcaccauugugauuaauuaugaaauaaaagauggcauccaaacaguaagugugcccgaggaacauggguuucuuuucgcuaugcuagaauugccaaaguccaacgaggcauccuauagccucuuagauaaugauuuucccaggaaaucauucauucugugauugugggucgguuauaacagaggcagagaucguguugcaugcuuagaaauuagaugccuuuuuaauuauuuugacaauguauugaacucagagccuuggacgugccaagcaagcaccuaugagcuauaccccuagcguuucaugucgucuuuggggggcgggggagugagacaagguuucuccauguaauagcuggcuguccuggaacucaauuuguaaagcagauuggccucaaacucacagagauccaccugccucugccuccagagugcuggaauuaaagguguguaccaccaccaccuggccucaugucuuuuuauuaaagauagaauucauauguuaggaugggaggaguugggcagguaguguucuaauuugaagagaacuaugaauuauucagaauaugaguaaaauguuaauauuuuucuggcuuucaauaggcuucaucuaccaugaacauaacuuuacuaaaaauagaggcauccauauguguacacacaugcacacacccacauacacacacacacacacacacauacacauauauaauuuucuuuucuucauacagaaagagcacccaaacccaggaaaggcuuaucauggaacacggcgaacugcauacuugccugauaauacugagggaagaaagguuuuggaucugcuccacgaagccuuuaagcacagacugacuuucacaauaggauacucucgagcaacaggagucucggaugucauuacauggaaugauauucaucacaaaacauccaaguuuggaggaccagcaaaguaagagccuuuugaaauguagugguugcugaaugaaguucaagguugucaaacacugcaguuugaggcuguggggauagaaagacauucuagcaguagauguuagccuggugucuuaguuaggguuacuguagcugugauaacccaaaaaaaaacaacuucaggaugauggguuuauuugccuuacauauucugagucacaggccacugaaggaagacaaggcagaaucucaaaggaggcaggaaccugaagacaggaacggaugcagaggccaugaaggaacauugguuauggcuugcucagccugcuuucuuacagcauccaggaucaccaguccaggggugacaccacugacauugggcugggcccuucugacaucaaucucuaauuaagaaaaagcuauacagagaaacccugucucgaaaaaccaaaaagagagagagagagagagagagagagagagagagagagagagagagagagagagagagagaaaggaaggaaggaagaaagaaagagaaagaaagaaagaaagaaagaaagaaagaaagaaagaaagaaagaaagaaagaaagaaagaaagaaagaaaaugucuuacaggcuuaccaaccacccagucuuauggaggcagccuucuuuguaacccugacugccuuggaauucacucuguagaccaggccagccugccuucgcugcccaaguguugggauugagguuguuugccaccaccccccccccaggaggcgguuucucaauugagguuuucuccucuaugaugacuccaacuugugucaaauugacauaaaacuagccaacagccacagcauacacauaauagcccauaaugauaauuucaaagauaaaaagacuggucccccaaccuucuacccugccauucauaagguauuacucaguuguuuaguucugcugcagaagaaagggguuucagagcccaagaugaauacuacccaaguugauuaaauuuaggguuucauguuuauuuaaaagauagaucguaggaacauuauuugccuuugauuucuguuuuucuuuuuuagguuuauuuauuuuuaugugcauucguggcuugccugcauguauguuuguguaagggugucagaugcccugaaguuacagauaguugugagcugccaugcagguguugggaauugaacccaggucuucuguaaaagcagccccugcucuuaaccauugagucaucucuccagcauggcuuugauuccuuuuaagguccucgcccucuuccucgccucucucuucccaucaguccacaaugauacugaacucacaagacuaauauaugguagcagaagucuuaguuauaaagggucccaagauggugggagauauauuccaggaaaucugacugaauuccucuaccucuggcauccaaaagaaauauaucaugaagccuuuucagaucccccaauuugaaaagcccacaggggcuggagagauggcuuagugguuaagaacacugauugcucuuccagagguccagaguucaauucccaacaaccacaugguagcucacaaccaucuguaaugggauccaaugccuucuucugguguguuugcccauaaguguaugacuacuacugccucuguagaauaugacaguuauaacauuaugugcaucaguacuuagaauaaguuaagaauuuaagcaaucugucuagaaaacagaugcuggucagccagccaggcacuuggaugacuagauauuagucacugucuggauugccggagaauguuuggaacccagaauacuagaugcucaaauguaaguaguaccuacaguuuuuguuguuguuuugaggcaaagucuccuuauguggcucaggcuggccucaaacucauagagcucugacuguugugucaccugaguguugcgcaccugugccacaauaaccagcugucauacacauucuuaagaauucuuugggaagaagcuaaaguguuucuuguuuucuuccugcaguuuuggcuacccugauccugauuaccugaaacgugucaaggaggagcugaaagcaaaaggcauugaguaaggaaacugcagggaagaugucuguccacucucaaaagacaugugucaggaggcuggauaguacagaccaaaaucuguuucuagaacgacuuuguaacauuuuucauguuaaguagucuguuugccagucuuuucuagaguggcuggcacucuuucauggaaggcaaacucuacaggcacagguuggggggaauggcccugucuacaaagcaugaagaaaugagcucagaucugaaauuauccauggaaaagccugguguguuggcaugcacuuguaaucuuagcacuggugaguagagacaggaggauuccuggagcuuacuggccaacuagccuaguuaaaaccaugagcucuggauucacugagagaccuuaucucaagaaauaagguggaucgggacaugggggugcaugccuuuaaugucagaacuuggaaggcagaagcgggcaaucucugaguuccagaccucaccuggucuacaguguccaagucccaggacagccagcuauacauagugagaccuugucucaaaacaaauauuaggaagacagaaacaaauauaucuaacaucauccucuguucugcauacacaccuacacacacacacacacuggggagcggggagauagaaaagaaaacuuuauaguuuuauaggauuucaauuuuugcugaagaaaucugacgucauucuuguguuacgguugggguguugggugagucuguaaucaucuucuauguccuuacauaauggaaccuucccugauuuuuguuugcuuuguuuauuugagacagggucucacugcauagcucuggaacucaauuuguggaccagcuuggucuugaacuuagaucugccuauaucagccuccugagugcuggcauugccugguuuuuuguuuguuuguuuguuuguuuguuuguuuggggguuuugguuuuagcuuuuuugguuuggguugauuugguuugguuuaguucggcuugauuugauuuugauguuggaauuuaaacccuaggccagugaguuccaucccauaauucuuuuucauguccaucucuguagcaauacauuaguuguuuauuuuuuaaucucuuccugaacccuuguguaagugggaaagugaaacccuuguauaaaugggaacuuuaaaaacagguuuggcagccggacgugguggcgcaccccuuuaaucccagcacuugggaggcagaggcagguggauuucugaguucgaggccagccuggucuacagagugaguuccaggacagccagggcuauacagagaaacccugucuaggaaaaaaaaaaaaaaaagacaacaacaacaacaacaaacagguuuggcuggaaaagacucauauuuccuucccuacccauagcaagagaaguuuccaggagaugaggcaacuuuugguaauaaauagaacaaaaagacuuauauuuuucaggacacagagccuaggagauacugugugacuacugccugacucaagaugcuaguagcucagcagaggagugaauagauaaaaagauauguuccccaaaucuucgggagagagaugacuugagaccgugacauucauuuggaaaauaguuuucuuaccccaacuuguacugauuagacacugacuaagccuugaauuugggcucuacucuccccugauccauggaaccuguccuagaggaugcacuugcccugccacagaagugcaacauaguuuuuauauucuucccuacacauuauguuguacuuuuagaauauauauuguuucaaguuuuaacggguaaauagccuucccuuaguuuaauauuucacaguauuugcuaccugcaauguaguggcuuuuuguuuuuuaauccuuugagcgaaucccagcagucuguuaucucauauauagucuuucuaauccuuucccuggacaggaguaaaggagaaaguucaaccuacuguagagucuggauggcacaucacaguucacuguaagugguucuccaaguuagaagaaaaccacagcaggcaaugaccuggugaucuguauuccagccacucuccaaaaugguagaugacacccuaaccuucuccuuaagacacauaugcacauacauaaaaccauuuuggccagauauuaauaggaaguauuaaucaaguacuuauccuguaaguacuuaacauugaugggaucaaucugauuaauagcucuauucuuugaacagaaaacucauauacagagcacaguagucaaucacugagggugacauaaccaauaaguagaagugcuaacuuuuacuuucauccccauuuugguuuuuuuguuuguuuagauuuuuuuuuuuuuuuuuuuugagccagggucucauguaaccuagacuggccucucccuauguagccaaggcuauucuugaacucugacccuccugccucaccuccugcccagguucuugcauguauccuaggcagagcucucaggaucugcuuccacagccuuccaagugcaaggccugcaccaucauagcugccuucugcauccgguucggaccuuucccuuuggaugauucaccaaguguuuaucauuaagaccaacugaucauuuucugucuucuaaucuuguaaucaaauuuacucuaaagaagaaaaaaaugguuucuguuaaguucuggaucuuuuauuucauccagugugcacaugcaaauuccacgugguggagggcucaaugacauuuggauuuuuuucuuuugcaagguguuauuaucugcauuaaauaaagucagguccuuacauacaacagac

SEQ ID NO: 8232 - RNA, 34154 nt, Mus musculus
ggaaauucucagauggagucgaaccgcgaccucaucagcggcuggacucauacgaggcucucuccgccacugugggauggagggagucuguggaccgcacucucccacagacagagagccacacucgcgugggcucucgucggaagcaugcagggaucgguuuggaaaccugcugguucuacccuugcacccgagccuugcccuguuuccccugccccggcucaccugcuuuuuuuaggaacuucaccucguagguguccggggcgcuggggcccacgggcuggacagagcacuccccaccucccgaggcccggcucuggaaguauaucucgagcuuccugugcgccuuggggauggacucccgcagccguacgaguagcggggacggcgggucgggacuggaagccauggcuauccgcgucuggcucguuuggggcucaggggcgcugcacagacagggaagagcaaaggcgagcccugcccuaaagacccgagaggcaaaguuucaguuucgauuccccagaaggucccuccuuguucuccgcagagccgccgccugucuugcucugccaucucucagagccaucacccggugaguaguucgcacgcucggcggugggcgcucagaggaaguuucccuacgguggcaggucgcccuucuauucuugcaggaucggaaguuuggcgggaacccggaucccagguucaggccucucaaggguggagcggaauagagggguaaagaguuucaccuguuuguacuuuuugaaaugauuguuguaacuaguauuuacugagaugcgguucugauuucaaguggagagaguuuaccugcuuggugaccuguacuuuuccuguuagcugggcaccuuagggauuuucugcucgagggccuuaaguuagcgaauagcacagaucggcuugcuucccugagucccuagagagggagguaacgaggaacugagcacagaagcagucaguaccugugaacaaagcaaaagccaaagagcagguuucaagagguaucuuaagggguugggggaggggaggaaaguauucuaggcugggacagcaguagccuaaaguccagagggcuggguuccaggccagggagaggaagaggaagggucuguaagaucuauagcgucaacagaaauaaaguggggauuauguguguuaauucuaaagguuaacaccauaguuuagcucauaggugaugguuaaucuugguugucauuuugacugcgucuggaaucagcuaaaaccccagcuagcuggguagugcuugugagcgauuuucuugauugggucuuuugagacuggaagacccgcccuaaaucugggucacgcguccugguagcagccuauauaaaaggacaaggaaaaaggaaguuuugcuuuuggccugcuugccucaagacagacaagugcaccccaaagcaaccucucagcugcagccuccaaggaaccuuagaggucuuucuugugugaaagcaauacugcccucugcaggcuccccggauccuguccggccaguuugggguuaguauucgagugacuccuggaugggcauggccagcugugcucucguguuguacaguguuuuucuacugcaaagacauuacagaucaucccagagacuauuguaaguguuagucaugagucuaacauuucauaauuuuaguuuuuaggcuacuagguuaaaaucaugagaaagugcgauuucccagagcuucagauuuuuauccagacauccuuaggucagaguuguuuaucacagauucagaacacagcccgugcagguucaagcaguuuccucagucuucacacgcccggugggacgcaccacuguugagaaggcugcuccuuaggugguuugccuggucucagcacuuuguuaccauuuucuaaguguaccaacaccuucaagaccucacuucuguaaagcguuuccuauuccagccccuccagccccccccccccccacuccaacuaaaauucccugaagguaaacaguauuaaugcuauaaucacauggucauccucaccauugacaugaaaaacucuaaacagcagaauuuucuuucaggucuccuaugguuuauuucuucuucuucuucuucuucuucuucuucuucuucuucuucuucuucuucuucuucuccuucuccuucuccuucuccuccuccuccuccuccuccuccuccuccuccuccuccuccuccuucuucuuuuuuucccaaacagggucuuuuuuuuucuguguaguccuggcugucauagaacuuguagaccaggcuggccucaaacucagcugucucugucucccagcaaugggaucaaaagcgucagccuccuauguuguauuccuagaagaucccccuuggcuuuagucauugguggcacaagccuuuaaaacuaguauccaggugucuucaucuccauagcacguuccagaccaggcaagaguaacuugaugugaccuuaucucaaaaacaguaaccaaaacccaaguugccuccgcuuuggccagcucuuauugcguucuuucuaucuguucccagaaacaggccaccaucuccucgaucuacagacuacacuuggaaacacaaacaaauauaaauaucugaagacccacgugggaccugaagaauggccuauuacaugguaaacccagaaauauaaauacuuuucaucaugaaaaauccaauuauuacaugaaggguucuccccacaacauuaagaaagcuggggccuucaguuacaccuagcacccucauaugauuuuauacucucaguaguuacugcccugguagagguccuaaguuuguuuccuagcacucaugugguggcucacaaucuugccuauaaccucaguuccaggggaucuaauuuccucuucuagucuuuguugacucuucuaugcaugugguauacacaacucacguaggcucauacacacacacacacacacacacacacaaacacacacacacaaaguuuucuucuggggccugagagaugacuuagugguuaagagcauuagcugcucuuccagagaacccagguucaauucccaguccucacaugaagauucugcuuccggggauccagcgcccucuuguggccuccacagcaagcaugugauacgcaaacaugcaugcaggcaaaacacccacacguauaaacuuaaauuacaauuuuaaaaguuuuuuuccgaguuagaaauggaaaacucgaguauaguaauauaguugaguaugggggcauccaguacucaagaaguuaaggcagaaaaaucacaacagguuccaggcuagccugaguuauggaguaaaacccuaucucaaauuucaaaacauaaaaaauuaauaaauagggcuggagagauggcucagugguuaagugcaccgacugcucauccagaggucgugaguucaaaucccagcaacuacaugguggcucacaaccaucuguaaugggaucugaugcccucuucuggugugucugaagacaauuacaguguacucauauaaauaaaauaaaucuuaaaaauuaauaaauaauauacugauauaauuagcagaaugaacaaggugauggaaggccuuuuuaaaaaaaauaucaucuccaggacuaggacugugcacagaugauaaagggcuuaccuaccaugcauacagcccuggguucaauuuccaguaaugcauaaauucggcuugguaguauguaguaaguuugaggcuagccuaggcuacguaagacccagucucaugccaccauaugguguggauuuucuuuagucuuucagcagcugucucucaggacagggucaggaagugggcauggggaaaggcuccuuuaagucgaucugaaaacucccacuuucuguuugucaugaaauaggcaacuggcagugaguggguccuuacagaugugggagaugcaucuggagaggcucacagccucauguguucuauucuggccagagaaauuccacacgacuugaacccaucugagagcguuggucugagacucacuacgguugaggccuuugagccuuuucagguguuagccuccagcccuuucucuuauucugacuuagaagugcaucagcuaagcauggcagcagacauaaccucagcacuagggagacuggggaaagaggacugcuaggaguucaaggccagccugggcucuagagugacuucaaagccagccugggcucuauagugaguucaaggccagucuuggcucuauagugaguucaaagccagcuuggccuccauagugaguucaaagccagccuggccuccauagugaguucaaggccagcccugggcucuauagugaguucaaagccagccugggcucuauagugaguucaaagccagccugggcucuauagugcguuugaggcuagccuggucuacagugugaaacaaacgaaguguauugaccucuuuaagaggcacagauaggcucaguauuugcugcagcuuuuagcguuuucaguguuuuggguacacagauuaaaaaaacgauaggacaagccuggcagcggugguggcacacgccuuuaaucccagcacucaggaggcagaggcaggcagauggcugaguucgaggacagccuggucuaucgagugaguuucagggcuacacagggaauccugucuuggggaaaacaaaaaccaaacaacaauggaaaaaaaaaacacgacgaaaauaucaacaaaccgaauaaugaaucuaaacaacaaacuaaaaaauuuccuuccccaaacccuaaaccugagaaccuaugcuauuccugcuuagcgggcggcgugugugcaauuggucaucucugcuuuuugcagcuucaggcuuuuaaagcagcuguuucauuucuucacaggauacaugggcggcagcucccgccgaaagaccagguaugaucgccucucucucccucucauuuaagaaagccuuugcugagcucuuuccucagcgcagaagagggcacucagaaggagacuaucccccccucagggguucaggugugugacugcagacgcuguggagaugugggcaugugcuuuggaaggggaauugcuuccgaggcuuguggcagcugaagacauguucucuugggccccccccccacuauccuuucccuuguuggcagagacucuuuucucuauuuguuugagaauggucuagcuuuguggagguggcuggccuggaacucagaucggccugcuucugccucugagcacuaagacuaaaggugcauaucagcaugccagcccugugacacacuucugacccauuccacgacagccaaaaugagcagaaagacugaccaagagcugagagaguaaaccugccuaguuucuaggggugagccauuugccaucagugugaaggccaauugagaccgacugcuaaguuguggcuucuuuugaguaagagaggucgucagaagucuuucuuggcagcucagguuagaaacagaguaaacuacuacacuuaaucugcuguccuacuuuuuuuuuuuaauuguaugaguacacuguugcugucuucagacacaucagaagagggcacuggauccuauuacaggugguugugagcuaccaugugguugcugggaauugaacucaggaccucuggaagaacagucagugcucuuaaacacugagccaucucuccagcccguuguccuacauuuuaacgucucugaaauaaggcuccaguuuucugacauucaucuuccuuucuuagaggcaaaggcuauauugguaucucaucaaagaauaaagagaaagagccaggcgguaguggcacacgccuuuaaucccagcacuugggaggcagaggcaggcggauuucugaguucaaggccagccuggucuacaaagugaguuccaagacagccagggcuacacagagaaacccugucucgaaaaaaaacaaaaaaccaaccaaccaaacaaacaaacaaacaaaagaauaauuuuauucuuugcaauguuuuccauuugucuguaguguugucuauaaucugccuuuuguguguaucugaugucugucuguccuuguugucugucccuaacagcauuuauaaauaaacagcuguuuauuuaacagcacagaaaagacaguaugguaaaggaauuaagaauucuuuuuuuuuuuuuuuuaauuuuagaaggaaagaaguuacuuuacugaccccaggugacccacaaacagauguucucaacauauauccauguguugcuucucacauuuauuguuaauuuguuuuuuauuuuguuauuguuauuuuguuuuguauuuauuuauuuauuuuuguaauuuauuuguuauuuauuuuguuuaagguuccuuucaaccuguuggcugcuuucagcaaaugcuuaucacaacacacacaggcacacacauuauucugggucagggacuuggaagaauuguaguuuaagauuaaagcuguguauuuagggacuggagagaugagauggcucagugguuaagaguacugacugcucuuccagaggcccugaguucaauucccagcaaccacaugguggcucucaaccaucuguaaugggauccaaugcucucuucuagugugucugaagagggugacagcguacgcacauacauaaagccaugcauuuaguuuauguuuuaaaaacugacugcaaagcauauaagguugguuacacuguuuucuuaaaggcgaguuuagcagacuggauauauauacagcagggaaacagauugaguacagauauuuaagugauuucuagguauauuauuaccuugguugcaaggucgacaaaaguucaguuucugaagguaagaagaauuuucuuuuccuuccuuccuuccuuccuuccuuccuuccuuccuuccuuccuuccuuccuuccuuccuuccuuuuugcuuuuuaacacaggguuucucuguauagcucuggcugcuguggaacucacucuguagaccaggauguccucaaacucagagauucaccugccucugucucccaagagcugggauuaaaggcgugugccaccaccugcccaguaagagggauuugcagaaaaagauacugacacucuacaggcuggguuauccagaaccuggauguauaugcuggguggguauggugguaggccaaaguuuaaaggcucaaggaaggaagauucuaauucaagaacuacauagcaaggccuuguauuaucacuaccaucaacuuccccugccccugaacugaagugccugaaagccugccauuguguuacagaugccccauauaggccauaaguggcauugcucagccuuggaugggguuguccugagaaccaugacuucugcugaggugaacuuuaguaccaaauagcuauagaggcugugaacuaacuugauuucccauguauauacaaauuaagaaggaugugaacaacacaucuugcagucuuaaaaaugcaguaagugauauuuauuuauuuauuuauuuuauguaugaguacaauguagcuguacagaugguugugaucuuucaugugguuguuggggauuaaauuuugaggagcucugcuugcuccagucaaccccacucacucagucccugcuuguucuggcccaaagauucauuuauuauuauacauaaguacacuguagcugacuucugacacaccagaagaaggcaucagaucucauuaccgauaguagugaaccaccaugugguugcugggauuugaacucaggaccuucagaagagcagucggugcucuuacccgcugagccaucuugcuagcccagugauuuuuuuuuuuuuuuuaaagacaggaucucaccauguaguucuaguucuucuggcuguucuggaacuggcucuguagaccaagcugaccuugaacucacagggaucugccugccucugccuccccagggcuggggauaaggaaggguaugcauagcauaauucuuuuagcuacugugcuguaauucuguguugauuucgacugugaggaccagaguaagugccaugagccagagguugccggucuccucccccuagcugcuccuauguuacccaucuccucucaauaaggaacagcuuugacuagugacccguggaagcuggaugcauaucucagcucuuguaaugaugacugcucuaaggcucuggcccugaguuacacgaugugcucugcccucuaagagauagaugagcuucauuugcuaaccagcacacauaguauccuuguuuguuuguuguuuguguuuuccugucuuaguuucucacguucucuccuuaacuucaaccccugguguuuucuagaaucaacucuuaaaguacuuauacucaaaagucucuucucaagauuugcuucuaagcaaacuuaaacuaagacauuaagaaaagcagagggcuggagagauggcucagugguuaagagccaggacugcucuugcgaaaguccugaguucagaucccagccaccacaugguggaucacuaccaucuguaacaagaucugaugcccucuucuggggugccugaagauaccuacaguguacuuacauauacuaaauaaauaaaucuuuaaagaaaaaaaaaaaagaaaagcagagacguuaugacuacagcuucccuuuauucccaacucacaauuacaucaucuucguguguguguguguguguguguguguguguauguguuuuacaaacauugaagacauucuugcuuucucauuuagggacugcuaacaaaaugccguauacaaggcugagcccuuuucaaguggcuuugcaucuaaaacccuuauauaucuuuggcuugauuccaaauguguguguuuggggggugggggugggggguggagggcaaagcaguguugguaaggcaggucgugaaguucaucucucuuuccaagugagaaacucagccucuuaguguggaaaggaaccauguccuuuucaaaggaacugguguucauuucuuucuucuuuugucuuuucuccuuuaccagccaacaauucucuugaagaacauuauagauggcaaauucccauuaaacacaaugucuucgaaauuuuaaagagcaaugagagucagcuaugugaaguccuccaaaauaaguuuggaugcaucucuacccugagcuguccaacucuagcagggagcagcucuccugcucagagagucuucagaaggacccugaucccugggauagaguuaucugucuggaaggaugaccuuaccagacacguuguugaugcuguggugaacgcagccaaugaaaaccuuuugcauggaaguggccuggccggaagcuuggugaaaacugguggcuuugaaauccaagaagagagcaaaagaaucauugccaacguugguaaaaucucaguugguggaaucgcuaucaccggugcggggagacuuccuugccauuugauuauccaugcgguuggaccucgguggacaguuacgaacagccagacagcuaucgaauuacugaaauuugccauuaggaacauucuagauuaugucaccaaauaugaucuacgcauuaagacaguagcaauuccagcccugagcucuggaauuuuccaguucccucuggauuuguguacaagcauaauuuuagaaacuauccggcuuuauuuccaagacaagcaaauguucgguaauuugagagagauucaucuggugagcaaugaggaccccacuguugcguccuuuaaauccgccucagaaagcauccuagggagggaccugagcucuuggggggguccagaaacugacccugcuuccaccaugacucuucgcaucggccggggccugacucuccagauuguccaaggcuguauugaaaugcaaacaguaaguuuuuguuuuuauucccuggcagaggggaguccuggaauuaaugguuaaucacuaagaugcuuaaaguggaaggcuguaagauguaucuuuuggggauuagagugugugacugucagggccaggccaucuggauuagagacuagcuucauuauccuaacucaaaggcuuucuuucuuuccgucuucaguccuuccuuuaaaacacguagcagcacuuaaacaucugaaagcagagucauuauccaagagauggcuacaguuguguguggcacacggucaugugggaguuauaaugauuagguucugauucuuaggaaccagaagcgauuagaauacucuuuaaucccaaagaacuuaagcuuucucuuauuucuuuauuuuuguuuguuuguuuguuuauuuuuguuguuguuuuuuguuuuuguuuuuuuguuuuuguuuuuguuuuuuuuuugagacaggguuucucuguauagcucuggcuguccuggaacucacucuguagaccaggcuggccucgaacucagaaauccgccugccucuuguuuguuuauuuuugaaacaauguuugcuuucuaccacgucauccaagacucaugauccuccugccucagccucaaacacuagauuuuuauuuuuuuugaggcaaggucucuauagagcuuuggcuauccuggaacuugguauguagaucagacuggucuugaacucacagagauccaccugccucugccuccaaggugggauuaaaggcuacuaugccucggcuaagcacugaaauuaauuaauuaauuaaguaaguaaguaaguguguauguagguguguguauguauguguguaugaguguguauguguaucaauaugugugcugauagguguauauuugugggucuaugcaugcuuggagguggggguaggguucgcacacaugugcacacauguggagagguuaacuuugguugucuuccuaaaguacugucuacccuucuauuuuugagacagaguuucucauuggucuggaaguugucaggcgggcugugccuuacuggcuagcuagccccagggaacuugucuuggcugggaucgugagugcuugucaccacaucuggguuuuuucacacggucucuggcaaguacuuuacugacugaguuacuuaucucucuaguucuagccuauuuuuaaucuuuaaaaaaaaacuuuuauuuggcaaucucacuggggaaacaagucacucggcauugcugaagcaaacuaucaauaacaguaaacaaaaaauaguacuuaggaauacagcagggcaugguggccugucccuguaaucacaguaauuugagguggaagcccaaggaucagggacacagagguagcaaaaaguaacggugacagggcagagaagaaagcccuacugauggugccccucuagaagcaccccugggcuggcuggcuugguggcagaaugcuugcuuagcauggguuugauugccugcccugggagaagcaggcugaucuuagguugggggaguugugaacuagcaggaggaaggcuaucagggaggcuugagugacuuggucagagagacagacaggaaaugaucagccuggcuggacacacugaaguuuaaaguuauuauuaucuuuuuaaagauuuacuuauuuauguauaugaauacacuguagcugucuucaaacauacccgaagagggcaugagaucccauuacagaugguugggagccaccaugugguuacugggaauugaacucaggaccucuagaagggcagucagugcucuuagccccugagccaucucuccaguccccacaaucaaauuauaauuaacugucagggagaguagcgcuuacagccuaugagauaucagagcgaaggcugaggagacuccaugaagugaacgaucugaggagucguuaguguggcauuuaacauuuaagcagaaauguuauuuuuuaaaaagauuuauuuaugggcuggugagauggcucagcggguaagaauacccgacugcucuucugaaggucccgaguucaaaucccagcaaccacaugguggcucacaaccaucuguaaggagaucugacucccucuucuggagugucugacgacaacuacaguguacuuacauauaauaauaaauaaauaaaucuuaaaaaaauaaaaaagacuauuaauaauaauauauuauuauauuaagauuuauuuauuauuauauguaaguacacuguagcugacuucagacgcaccagaagagggagucagaucuccuuacagaugguugugagccaccaugugguugcugggauuugaacucgggaccuucagaagagcagucgggugcucuuacccacugagccaucucgccagcaccaagcagaaacauuauuaaauagcauccuuuuaccagauuuuuuaucaucuucauuuauuguuagcagcaucaggaaccuuacaucuucugaagggugccagugccccccaauggcaaauucagauugcuuuuucagggcaaaaccauuaauguccaugauaaaaggaguacuuuggcaaaugccuagagcccaacaccccagaggcagaggcagaggcagaagacuugaucuaaauuugaggccagccugaucuacaagcugcaagccagccaagaugacacagugauacccugucacaaaacaaaguccacagaaguaccuaaguuuccuuugauggaugauaagaauuuugguacuuguuuuguuaggguuuuuauugcuaugaagagacaccaugaccaagacaacucuuauaaaggcaaacacuuaauuggggcuggcuuucaguuucagagguucagucuguccauuaucaugaugacaggaagcaugacagcaugcaggcagacaugagacugaaagagccuaaaguucuacaucuuuauccaagccaagagaagacugucuuccaggcagcuaagaggaggcucucaaagcucagccccacagugacacccuucccucaaccaggccacagcuccuaacaggccacucccuaugggacaagcauauucaaaccgccagaguacugaagcucuaagggcgcagcucacuuuagcacugaucucagaguucagagacaaaguaguaagaaaugcaguugaugucuauguguacgcuguuucuguagaucugugguucucagccuuccuaaagcuguggcccuuuaacacaguuccucaucuuaaggugaccccugacuguaaaauuacuuuuguugcuacuucauaacuguaauuuacuguuacuguuauacuguuaugaaucacaauguaaauaucugccugaggcgaccgcugugaaagggucauuugacaccuccaaaggggucaugaccuacagguugagaacggcugcugaagaugaacugguuaaguggcugccuauagaauaguuggguaaguguguuuggugacccauacagaaagaaagcucuguuucacuaaaguccuuuuggccuuguuuauacuuucuuuaaccuuggacaugagaacauaaagacaggagaugucuucuguuccuaaaguuccuaagacacuuuuucuuuguuaccaagcagccuacacagaaacaacaagaagugacagagauaaggcagagaauaaaauccguauggaugugucuugaaaauaaccaugggacacagggcaguuguggcacacgccuuuaaucccacuugggaggcagaggcaggcggauuucugaguucgaagccagccuggucuacaaagugaguuccaggacagccagggcuauacagagaaacccugucuggaaauaccaaaaaaaaaaaaagaacccugggcuuacuggccuagggauuuggcucagggguagaauguuuccuuagcaugugcaugguccugaguucaguccuuagcacuggggaaacaacauaauagcuggaugaguagacuguguaugcugguaauuuuagcucugaagagaugaguauagcucaagguuauucuggagccauugugucccaguuuuuguuuuguuuuguuuaaaaaaaaaaaaaaagaaggcacacauucagguaaaaagauagaagggcuagaggauacgguucaauggguagaguauuucuugcuuaacagcaugaagccuuggguuuagucccuagagcccauaaaucuguaauccuaacacacggcagguagaaacaagaggaucagaaauuuaaguuccucuucagcuaucugggacaucugaggucauccaggcuacaggagacaccaucgcaaaaccacaacaaacaaguuaugacggugccugccuuucaguccagcgcugaggagauggaaacagauggaucucuguggacuugaggucugccuggucucuauagugaguaacaggccagccaugguuacauggugagauauugcacccccccccccaaaaaaaaaaaaaaaaacaaaggaaagaaccaaccaaccaaagaggcuagggagaaggcucagcuguuaagggugugacuguucuauuggaggaccugaguucugucuccacccaguaaaucgggcagcucccaacucuuugaguccagcuucagagacugacgcccucucugggauuuugcaggcacuacacucauguauacaaacccacacagagauauacacaucuauugaaaauaaaaucuuuuuuuuuuaauuuaauuuuaguaguuuauggguaugagugucuugucugcauguguguuggccaccaaaugcaugccuggugacugcagagcugagaagagggcuucagauccucuggaaguagaguuauaagcuuuuaugugcuagcugggaggugaacccuggucccccgcaagaacaacaauugcucuuaaccacugagccaacucuccagccugaaaauagagucuuucaaacaaaaggaguuagacggaaugaccagaaucuugaaauauauuaaguauaauucaacaaaagguaagaguaaugauaauauuuuuuauauauguacaucauuucaaaauagggugaacaaccucauagcaaugaaauguauaugucucuauuacaaaaccaauuuuuggaucuggaauuuucaaaaaguauuuuucuaaacuuuuauggauguacaaauuaguuauuuuagaaggagggauuuaacaaugaauccuguguuuucuucccuuuucagacagauguaauuguuaauucuggauacaugcaggauuuuaaaucaggacgaguggcacagucgauucuuagacaagcagggguugaaauggaaaaggaacuugacaagguuaaccuguccacagauuaucaagaggugugggucacaaaaggauuuaaauuguccugucaguaugucuuccauguggcauggcauucccaaaucaacaaauaccagguaaguuaaaaauaacccuaaauuuguacccuugcacgauccaagcauuuugauaaguuuccauuguuugauuauguuuaucaaaaaucguuagauggugucuuaguuaggguuucuauugcuguuaagagacaacucuuacaauggcaacucuuauaaaggacaacauuuaguuggggcuggcuugaagguucagagcuucaguccauuaucaucaaggcaggagcauggcagcacccaggcaggcaugaggcuggaagcgcagaaaguucuauauuuugauccaaaggcagacaggagaagagugucuugcaagcagcuaagagggggaucucauugccuguccccacagugacacacuuccugcaacaaggccacgccuacuccaacaaggcacaccuccuaauagggucagucccuauuaucaggaccaaauauauucaaaccaccacagauguguuuccuuuuuggaaacacgccuaugacuggcugagaggcugaguaaguaugguuacccccaaguucucuuaacuuggauuugaaaggucuaagugaguacccugcacgugggcacugaaacccagaacccuucagucuguuugcagucuugcucuauaauacacaauggucugcuuuauccuucuauaaugaggcaggggauucagcuucuccguauuuccuuucacagguuaaauuccaguaggaguuggagucaaagcuacuacaguuucuucugacucccauaaaacaugaaaauuagugaguagagggaguccacacagauguagagaaaugcuuauuccuagugugccuucucucucucucuccauauguauggagaaccccaaaagaccaccaaggagcugucucugauguaauagcauagagucucuuuauuugaagcaagugauggggugaaggaugggguuccagucuggcaagcauauaacagaacggcuguaagccaacagaugggcgcucugaugcaagacgguauauaaucacaaacugguuugaaaguacaucugaaacaaucagacuaaucuuugauuaacuguugcuaggaaguagcuagggaguaacucuggccaagacaagcccugagguccuuccuaguacaugggugaagcuugaguucugcuacaggucaaguucucaggcuuauuuucuuuaagguggagaccggucccaagauggaguagguuuggccucucaauagugucucucucuacauaguccuugcuaucuggaacuuacuauggagaccaggcuggccuugaacucacagagauugaccugucucugcuucgaguguugggauuaaagguauaugccaccacucuuaguuauuuucuuuuguuauggaaaugaggucacaauguauagcccaggcuagccugaaacucuguaguccaggcuaaccuaaaacucaugacaguccuccugugugggccuccugagggccagaauuauaagcucuuacacuaguaucauuuuuuaaucuuuuuugccuuguguaucuuuucuuuuuuucuucaccugugccaugucuuguccucucuuaguucuguaauccuagauuggaucuccaauuauucucuaugcuucaucuuuccaagguuuucccacagacaaucucccugucuauauagcaauucaaugcaauauugaaaaguugauggaaaauuagccuggcaugcggccuacuuuuuuaaaauuccuguuguauaggucaguuggcugugccccacauugagugccagcugugguaugcguuuugggguccagcugugguucuguguccucugccuucucccucucagggcauuuauggguggaauuuugcaggauuccaguacaauugggaaugaguggaggggggggagcacucugauggucuuaguguuauauagcucuuuuagccaaaggccuucucuguccaucuucaaugaaacagcucucuuagacaauccugacuuguauacauaccuuuauuuaggguaggcuuguacacguacauuuuauucagagugaaccagggcuauauauggauuuuggagaguaagaaaggaguuuauagaaaagugaaaguaauuggcugggguuuaaaguucggugaaugccuucuuugcauggagaggcaguccagaaaucucagguggcuggcuggguucuuaucuggaaaagaggaaguugaacuuguaggucugucaaggacuacuugaccucccucagguagagggcguggaauucgggucccgagagaaggucagggaaggggaagcccuguugguaaggggagccccccauuuuguccccagcucagaaaagcuaucccacuaaggcagacuuccucacauaaucccagacccugugaggcagaggcaggcagagcucucagacauugaggccaccuacucuauauagugaguuuuagaccagccagagcuguguagugagaccugaucuuaaaaaaaugaaaaagaaaaaaguugauggaagucugagucuuccuagcucucggcacuucucugggagaagcuacccaguggaucgucauaauauuaaagggauacuguucucuucuuuuagucuccaucucucucacugaacugucucuuuguugaccugggagcggcaggugaguggcacacugaugcuugucugacucccugagcuagggagaugaucgaggguauauaacuggaagagaucacagugcucaaaugccguggguggaauucacuugccucaguuucuuaacccuuaugcuucccacuaucugguuuauagcuaucguagguuucuguggcguggggccuuagcagcccucuaaggaugcauggacacacccauguugugugcauacuggcacuguauagcucaggcuagucugaaccuccguaguccaugcuauccuaaaacuaaauaaccaggcuggcaugguaaaaucugaguagaacugaaggguaagugaagucuuauuuuugucuuaaagguugaucuggaacuuguauuugucuuacagauauugaaagaugcaaugaaguccugucuagaaaaaugccuuaaaccagauauaaauuccauuuccuuuccugcucucgggacaggauugauggauuugaagaagaguacagcagcucagauaauguuugaggaaguuuuugcauuugcuaaagagcacaaggaaaaaacgcuaacuguaaagauugugaucuuuccaguagauguggagacguacaaggugaguuagugucuugggaaagucuuaacagcuugcucauucauuaccuaccaaugaccaauuagugucucuguucuaacacacuagguaaggaucccacaauguggugggauucuaacauuucauuucugcagaucacacacccuuggccuaaucgcaaaggucaucaucuaagccauguucauguuugcuuuucuuauuuccuuguuggcauuuauucucucuauucuuuaaagguaagcaaccuauuuuugauauggguugauucuuucuacccugcugccuccucuuccuccuccucuuccuccuccuccuccuucuccuccuccaagauauuucuugauuuuuuuuccuggauagaacuggguaucuaauaauuugcuaaaaacauuaaacucaagagaacgaagaccaaaguguggacacuuugucccuucuuagaauaggaaacaaaacacccauggaaggaguuacagagacaaaauuuggaagugugacgaaaggauggaccaucuagugauugccauauccagagauccaucccaugaucagcuuccaaacgcugacaccauugcauacacuagcaagauuuugcugaaaggacccugauauagcuguaucuugugagacuaugccagggccuagcaaacacagaaguggaugcucacggucagcuauugaauggaccacagggcccccaauggaggaacuagagaaagcacccaaggaacuaaagggaacugcaacccuauagguggaacaacaauaugaacuaagcaguaccccggagcucuugucucuagcugcauauguaucaaaagauggccuagucggccaucacugcaaagagaggcccauuggacuugcaaacuuuauaugccccaguacaggggaacaccagggccaaaaagggggaguggguggguaggggaguggggguggguggguaugggggacuuuugguauagcauuggaaauguaaaugagcuaaauaccuaauaaaaaauggaaaaaaaaaacuggguaucuauaaaaggcaauagaaggucauuuaacaaacauuucuuucauauuaacuuaagccagguguuuuugucucagagaaagaaaccagucuccagaacccacuguuggcaugucucaugagaaucggguguuccacacugguggacagaacuggaaagacacugccaagucuuguccuuggcuccaccaaagcccucuaggcucuuugcugaccaucugcuuauugucuacuccuuucauaaacguuauugcuaguggcuaaguuacaguuucugucacuuuucauucgaaagcuuugccuaaguauuucuaacccugcaacaucuccugcauucugaaaugacauaaccagagaacugacuuuuauccauuguauauggcuucucuuacuguuugcuuaacaguggauaauguuaucucauuuccaaauucuugaguggggacgaccaggaacaaccuauuauaaucucuccagguaacuaaauauaguaagaccaagggauuuuauuugcucuggaaauagaagcuacaagcauaguuuauaaaggaaauguucuauagauuaagaaacuucauuguugaguuggguguguuggugugcaccuuuaauuccacuuuuuuggaagcggaggcaagguggaucugaggaggguggagcacgacuuuaauacuaguaguacucuggaggcaggggcagguggaucucugaguuuguggccagccuggauaacagagaaaguucuaggacagcuagcgcuacacagagaaaccccgacuccaaaacccaacacacacacacacacacaccacgaagaucucugaguucgaggcuauaaugaguuccaguucauccagggcuagauagcaagauaguaaaaaccugucuaaacauauacacacuuacucucucauucuccucucuccuucccccucucucucuucauuuuugaaguguagauagauauaaagcaaaaucuagucuucuagucuuuaucuuauuaguacuaugauuugucaguaaaguaauuacugccuuuuuuuuuuuuuuuuuuuuuuuuuggguuuuugagacaggguuucucuguguagcccuggcuguccuggaacucacucuguagaccaggcuggccuugaacucagaaauccgccugccucugcaucccgagugcugggauuaaaggcaugugucaccacgcccgguuuauuacugccuauuuuaucaacuuugaauaagaacaauaauggauaaaguguuuccaaacuccuaagagauuuggauucuuucaagucaacucugucuuaaaggguaugccuagaaauacucagucuuuuuucuguaaguugucuguaacauuaauuaccauauagaacagauagugaaugcucacugaaucagcuccaguuuuaaguaguuuacaauaaugaacccauauaaaacaguuugguguguugauaacauguagaagugaucuauauuuuuauuuuagcuuuaauuugguaucuacauuaauaucugaaugaaugaaagcuuguauuuugucucaauucuaccaggucuuuguuuuguuuguuuguuuguuuuucauuuuuaccuguacuaauuucucagguguucuaagucagugguucucaaccuuccuaaugcugcaacccucuaauacaguuccucaugcuguggugacccccaaucauaaaaauauuuuccuugcuacuucauaacuuugcuacugucaugaauugcaauguaaguauccgauauucaggcuaccugaugugggacccacaggcugagaaccugcugcacacauucucuuggcuugucuaaggcugccuuagggcuuguagcagugggaauggagucuacuaggacagugguaugauguauucagguagagauuuuuauuaccgcgguugcccacucuucuaugacucucuugcuuugcuuauucuagauuuuuuaugcugaaaugacaaaaagguccaacgagcugaaucucagcgguaauaguggugaguaagaaaugaagaguuuuauaggcauagcgggacacaugaguggaggcaggauaaucaggaauuccaggucagacucacauaaaagcaaguuugaggccauccugagcuacaugagauucuuuuauaaagaagaggugggguaccuggguccuuauauucucauuaccaauucugagucaggaacucuggccuagucaagcaggucuuuuuaaacuuuuuaaagaguuaaaaacuaguugcucucacagguuugggauugcugggauagguggguucaaacagucuuggaugcuguauaccugugaggcuaguucugucucacucuuugggguggaauguuuaauggcucugcagacuggaaguacagaaggggugacucucgagaguuuugggaugcugcuucuuaggagccuauauuuauugucugucgaguggugauaauaacaguaggugauuguggaccaguaagauggcuaaucuggucaaagcaccugcugccaagccucaugaccaaaguccagcucccagaacccauacagaaaaggagaaaagugauucucauggaguauguacucacacacacacacacacacacacacacacacacacacacacacacagaguuuaaauaaauaauagacaauauuuuugaucauuuccaauuauugaaagauguuuuguaaauuaaaauuacaaagcaucaaaccaguuccaggaggcaaauaaagagaagauagagccaggcaugguggcacacgccuuuaaucccagcacucgggaggcagaggcaggcggauuucugaguucaagaccagccuggucuacagaguaaguuccaggacagccagggcuauacagagaaacccugucucaaaaaaccaaaaaaaaaaaaaaaaaaaagagagagagaagauagacaaacuccucagguagacuagaggagggaaggaauucuucagacugggagggaucaagaaaggcuucauggacauguuuugaagcugagcuuugggauguauagauuuccaucagccaucaauggugguagggcaguccuugacaugaauaaaacccacaagagcaaacaaauaaagugcguguuuauuucauggaauagagaggagcaaggcagggguggaguuuuaggcuaggcuaaugcaaaaagggaauaugaaaguucuguauguccuuaacccgaagcacagcgacaaggaucaugacuuauucaguaguccuuaaaaauaucugucagccgggcgugguggugcacaccuuuaauccuagcacuggggugggggugggggucagaggugguggauuucugaguucgaggccagccuggucuacagagugaguuccaguacagccagggauauacagagaaaccugucuugaaaaccaaaaaaaaaaaagucaagaaauuagaauuuauuuuauuauuauuuuuuuuuuagauuuauuucauguaugugaguacacuguugcugucuucagacacaccagaagagggcaucagaucuuauuaaggaugguugugagccaccauaugguugcugggauuugaacucaugaccuuuggaagagcagucagugcucuuacccgcugagccaucucuucagcccccuagaauuuauuuuuauuaagaaauuaggaauauaauuagcauugauaauguuugagaaggauuaucuuagguuaucaagggaagguuauacuaaucagggaugaagagaagcgcaucuucauuagacauauuuauauaauaaguaguuaauugaaugcauuuucguucuuagaacaguuacccuuggugauuugaacaauuuagugaucugaaauaauucuucucuccuaaaaaugauggcucaaggaaguaucacuauauuguuuucguguccuuccagaaagcaauguaaaugccccaauaaccacugaaaacaggaaaagcuaugccaccaguuagaauucccuucucaccauaguuguccuuuuguuuuuuaaaggauuuauuuauuuaauguaugugaguacacuguugaucccuucagacacaccagaagagcucauugcaucccauugcagaugcuugugagccaccauaugguuucugggaauugaacucaggaccucuggaagagcagucaguacucuuacccgaugagccagcucuccagcccuguuguuguccuaaacacuggcuuuuuuugcuuuuauuucuacucagcucccuguuuccucucuucaagguuguuuguuuguuuguuuguuuguuuuggggggggguucgagacaggguuucucuguguagccuuggcuguccuggaacucacuuuguagaucaggcuggcuagaacucagaaauccgccugccucugccucccgagugcugggauuaaaggcaugugccaccacgcccagcccaagugacuccauuuguaagauggacuaaauaguuccugucucauaggauugugaggcuuaaauagaauuguaaagcucuuggaacaauguuuggaauaguucucaacuuguuuuuucucugugacucagucaaguaaagguaauuucuuuucaucaguacaauagcauuccauuauugaagggcauccaguuauuuccauugggcaguuccaaugugaaccuucaagauggcucgguggguaaagguucuugcuaccaagucuaaacaccugaguuugaucuucuaacucuccggacacacacacacacacacacacacacacacacacacacacaacgaaccuugcaaaacuuccaaauuucugccuggugggugggugauagucuauuucucugauugcagucaacauaaacauuuuuuucacauagaugcaagccauaaaguuugcuuuucugugaaacguuuugcguaacuggcuacagguuugcuacuuuaaaaaaaaugaauauuuuaauuaauucuuugagaauuccauacaaugaauccuaauucucucccuagcucuuucuagauaucccucuauuuuauguauuuauuuauuuugagacaggcucuccuauugccaagguuagccucaaaaaucugccucucaaauauggcaauuauaagcacaugcuaccacucccaacuucgauuuguuguuguuguuuuuguuuuuguuuugguuuuguuuuguuuuguuuuguuuuuuuuuuuuuuuuuuugguuuuucgagacaggguuucucuguagcccuggcuguccuggaacucacucuggcuggccucgaacucagaaauccgccugccucugccucugccucccaaaugcugggauuaaaggcgugugccaccacacucuuuuuuguuuuuuaaaauaaauuuuauuccuugaauuauguugcuuuagguguuugauuuuaaaucugguaggugcaagaggguaaggaauaugucacuuuagcagguaagaauagguaaacucaccuauuuaugaauggcaaaucacacacacaucagaggauagauaggauaaagcauugccuucuaagcuaauugguauguuuuuuuaaggaggccauaagcuaagcauguagauucucuuuauaucugguguagcauuacagguagaugggucuuagcugcuguggcugacaauggugaugauauccuugggguguauaguggcugugauguucuguguuucuuaaguacucaacuacccuccauaucuguuuuuuuuuuuuuuaaagauuuauuuauuauuauauguaaguacacuguagcugucuucagacacuccagaagagggagucagaucuccuuacggaugguugugagccaccaugugguugcugggauuugaacucuggaccuucggaagagcagucgggugcucuuacccacugagccaucucaccagcccccauaucuguuuuuugauaggugcuuuagcccugcagugguccaguggggagcaaagaagaggcggccuugaagcuggaucuccugccaucaaucucauggguguaaaagugggagagaugugugaggcccaggaauggauugaaagguugcuggucucccuggaccaccacaucauugagaauaaucauauucucuaucuugggaaaaaagagcacgacgugcugucugagcuccagaccagcacaagagucuccauuucagagacugucaguccaagaacggccacuuuggagauuaaagguccccaggcugaccucauugacgcaguuaugaggauugaauguaugcugugugacguucaggaagaaguggcaggaaaaagggagaaaaaucuuuggagcuugucaggugagugacugcauguuaaguuaaaagcccuugcuaggaauugugcgacaccacacccuuuauccuccuggcaccuguaagguaaaucugugugaguuccaggccagccagggcuacauauauggugagacugucucaaaauaaauaaauugaaugaggaaaaaaguuucuuaaauuugaaguaaauguccuucgaacuaagggaugagggagguguuaguauggguuaguauugguauugguauagauuaguguagguauggacaguaaauuuguuaagucaggucaaaccaauaauauuccagagugcucucugugaauagagaagauggaacggaaacagaaaggagcgaaauggugaaccccaaucucccaaagccaggugcaaucccaacacagggcagauagaggcaggaggaucaggaguuuaagucuacccuagccucaaaguaaguuggagacuaaccugcccuacauacuaucccaucuucaaacaaagcagucaguucucccaaguguuccuucuggucgcauauauuugggucuuuguggauaacagacugagugaagaaaauaaaccguucuggcucagacuuaggcuauuugcuuuucaugauuggggguguaaauguuuuuguuuauucccugagacuuucauacauguagacaaugcauucauauucacccccauucuucugucccaguuccucuuagaccucccuguugggaugacccacuaauauuguauuuacugugugcguucucaauuguuaauuguugggccaggcugcaccaggcuagcgggauauguaaaugcuugucacauccucaccugcucaaaaagaaaggcaaguugcuguggggaaggucauguaucucccagugccaacugguugaguuuguaauaaagaccugagggcugaggcuugggcagaaagacagcaggaaagagacauugaguggcaaguggagagaaucaauggcagguaauuuggguuacguuuagaugggcuagcuaaggaauagccccagcagacaggccaacagcuuuaaacuguauagaugucuaugcgucuuuauuauuauucuauuauuauuaaaccucaagugaggccaguaaaagcccugaaaucuccacauuucccuuccaacuucaugucuuuuuaaaaaaaguacacugaguucaauuggagccuuccauaugcaggugaaucuagugcuauccaguggaccaugagcaacuuacugggcuacaucccugaggaaaauggacuccuccuccuaguagccaucaaauaccauaguuccuuaguuagaggggccaguucccaagacucuccccuuuacaugcucaaauuuugacugacuugauuuucugcuuaucugguacaacagccacagcugcugcuguuccuguuuccaacaacucuguuauauccagaccucuuuuuucuuuccuuuuuuuuuuuuuaagauuuauuuauuuuaugugaguacacuguugcugucuucagauauaccagaugaggcaucagaucucauuacagauguugugagccaccauguggcugcugggaauugaacucaggaccuccggaagagcagucaguacucuuaacugcugagccaucucuccagcccauccucuccccuccccuccccuccccuccccuccccuccccuccuuuuuccuuuccuuuccuuuccuuuccuuuccuuuccuuuccuuuccuuuccuuuccuuuccuuuccuuuccuuuccgaaagggucucaaguagcggaaacuggccuugaacucauugcaguaaaucuccucccaaauauccccaggcaaugaaaacacaacacaguuaauaugauuacaagcugugcgccuagauugggcagaucuaccguuacacuaccaucuuccacagcuuaugagaccucuuagaacuugcaguuucuccaggccaugugcuucugcucugcuuuucuccuucuuccuccuccucuuguccucucccucuuacauuuucuccuucucucucccccuccuucugcuccaccuucccuuuuuuuuaaauuuuuuuuauuuuuuauuuuuccaccuucccuuuuaucugcccaaucaucagcucuccuuuauuuuacaaauuaaggugggaagcagguuuacaggaaaucaccugagugcugacucauuccuuguuagcagcuacuggaccgggagaacggaauuaacaucaaauauaauuagccccagggcuagccacaacaauuacauacuuaaggauagccuugaacuccuaguucuccugccuguguggcuauugagugcuuaguuaacagguuucugccacggauguuaucugugcugaugaaaugagccaauucaagccaaaguaaaguauauaaaggcagguuuauuggguacagcucucaggcuaauucauugagaugcugugcagaggaggagacagaaaagugggguccacggagagaaagcaggcaugggggggggggcuggaagagagaacaaaaaaugucuggauuacauagggaagagccuccuggggaggggaagccaagcucauuggcugggaaguucaggauagaggacaggauaugccagccauauccuguagcagguagggacugagagaugcugguagaaccuagagaccaguucugcuuugguacguuaaauaagcaccuccacacccuguuccaacaucuuccaaaucccaauagccacugugucugaccugguuugguuuuuuuguuuguuuguuuguuuguuuuuugagauaaggccuuauaacccuggccuuccugaaauugauuauguaucccaggugaguuuuaaacuuaggacaguuauccugccucagccucccugggguuacagaugugagucaccaugguuagcucaggucacaucacuuugauaagccauguuuugucuuucuacuguuaguuguaaauuaauaaauagaaacacauacugucggauuuacuuguggugucauggauuauacaaaaagccuuaagacaaaguuagagccaugcagagaagacaauaagaaauggaacauguccacuucugcaaaugcagcauuaacggguaacuguauuuuaccugauggccagguuguaguaucugaugcccucuucuggcaugcagguguacauguagauagaggaaaaaaaauaaaaagagagagagagagagaguuaacauauuuuucccccuguguucauggagcauugaaacaagguuuuuuucuuacucauuauuuuaggacaggggaccaaccagcaagaaaaacuggauaaaauggaagaaucguacacauuucaacgauacccagcaucauuaacucaggaacuucaggaccgaaagaaacaguuugaaaaguguggcuuguggguugugcagguauaaucaaagaaggcucugguuuaccuagcuguuaacugguucuauagccaaaaugaaaauucuccugccaaggacucagccgcucagucaccuggagucuggaauaagacuggguagaaauacaggccuugaagaguagaguuagaaucaggaggcagacaugaugucaagacaagcagagacacagacucaagauuuaugaggaagugucuaccugucaucgacaacuaccguggaaagcacacgguguuuagccugccgugcuaccucuguuuaacccacuuuuaucuuacuaagccauuagcuguaaugggacacauacuaugccuguaggucauuucuguaccagugacugcacaugcugaugacacaguggaguugugugugaagcaggguaggcaugcuguguguaugcugucuaaauaaagggcuucuccaguuaaagugucccaacaaggcaaaacuuuacuucucaucagcagggugcacgcuacucagaaagaagagcugggugggggagcucacucgguuacauucuaacacagguggagacuguccuguccccacugacaggagucugaccuccacuguugcuggcuuggcuagcuuucaaagaaacugugaaaaggagaugaaggaaaugggggcagggaagugccagugccuaaauuacuuaagcuccuagcugccuggccuuuguaaauaaaaaguuuuaugggguaggagauuaaagcuuuguauaaaagucuuacuagguaugggagauaagauuugaguuccuucucauaaaagacugucaggaaagacuaauauuugaggucucuaguauguggagguuaggaaaccuuagcuguuguccugccuuaggacucuucucuuccacugcucaccuuguuuuuuuugagacagggucugugguaguuugaaugcgaacgcccccacccccacccccaccaccccauaggcucauacauuagaaugcuuggucccuaguuaguguaacuauuucagaaggguuuggagguguggucuuauuggaggaggugggucccugggagugggcuuugagguuucaaaagguaugccagccugucuuggucucuguuacuguucucauacaugccugcuuccuuuaauuaugaucauggaccaaacgucaaaaacuauaagcaagcacuaguuagaugcagucuuuuauaagagaugccuuggacauggugucucuucacagcaauagaauaguaacuaaaacggggucucucgcuuuuacuuggaacuugcuaauugggcaagcuuggccagccagugagccccagggacaugugucguccccaguccugggaucacaagcacauaucacauguguggcuucuuaaaauguagagucugaggagugaacucagguccucauguuuucaagcgggacacuuuaccaacuaacugagccaucccccaagccugugaaaucuuuauuaaguuacuuucuuuugagacagagucucacguagcccaggcuagcuuuauacuugcauauguagcugagacuguccuugaucucuuucugaccccucccccugucucuacuucugggucuaaaggcauacaacugacauuauuaaaugcacuuauugaaaaaggggguaggauauuuugaagagacagagagagaagccagauuaggagagaacugaacagcaagcuucauauauucuauccacguagcacauguaucuuucaagcagugcgggaaacaauuuaaguagccauuuuucagagcaucaaaucucuucuuugcuuacagguggagcagauagacaauaaggugcugcuggcugccuuccaagagaagaagaaaaugauggaagagaggacgccaaagggaucugggagccaaagguuguuucagcaggucccacaucaguucugcaauacggugugcagagucggcuuccacagaauguauucgacauccuauaguaggugucaggcuuguccucugggcgugucuucagggcugccuacuugggcacaggcuagcagagucagugggugacugucggggagggauccuucuccccugggcuucaggagugaagucuuuuagaaauggucacucuuuuaucuuuucugucuuuuguuugugugcgauacauugaugggagaauggacagcaggaucuauggugcucguuuuaaccuuguucccguuucaguguucuagcuauccuaucugcagagggcgccuugaugugucccuuucuuaccuuucucauuucacugauaauaccaacuccuccuuccuuaguuagaagcuaacauuuaccuuaaaguaacuuaguuacuuaagaaaguaacuugaagaaacuuguaucuugugccccgcccuaccuuuuuuagacagaaucuauguagucccggcugucuuguaacucacagagaucuggcugcaguaaccuucccugguacuguuccugggauuuaaggcauguaccaucaugcuggacccuuccguccucuauuuccugucagugaagcagguauaaucuggcagaugaaguguccccucuuacuuauuagcuacugguaugaacuggauugggagauguguagugauaacucccacuuugaaacaggagagggagaacacagaacacuuacugugugcugcuggacaggauugcucaauagccuuugucccuuucuaggucugcugccuagagaggggacugccauuggacugccucacaggcuagaacagauuauuguagccagauuacaguuucuccagcaauaggauuccuuuaaaaauucagcaagcucagugguuaagagcacuuguggcucuugcagaggacccagguuugauuucaagaaccuaccugguucacaaccaucuguuacuccagaucuagagauuugaugcccucuucugaucuauccagacaccaagaacagacuugguaccggcacacugauguaggcaaaaccacucacacauaaaauaaaaaugaguaacuauuuuuuuuuaaguccacugugccuggcuccuuauuuuuauuuuauuuuauuuuuuuaguguagcuucuauaaaacuauugaagugucucauguggcuuauauugcauuucugauucccagugcugcuccagacuaaggcaguauuugguucaguguagaagggauagaaagaaggaaugacacuagcgcuucagagaggcguuaguguguccccucuacaugauguuuucacugcugaggacugagccauggccuuguggugcuaauacaugucacuaagcugcauuaagaagaagggcuacuuuucugguauacuauacuagguauaaacauaguucaaagcaauggaggauacauaguggguguuacauuguaccaggccacaguaagagacuaggauaccuugcaagggauauaaggacuauguucuccuaaacaaagguuacucuucuugaacaaaccauuuccauuguuucucuuacaauguccaggacucugccuucuugcccaguacccuuucucuuuuugauuuucaugcugccuuuguagcacaggcuggccucaaacucaacuauccuccuguccuagugccgccuguuccuacugggugcuauuuaaaggcuguagucucaguagcuggagagauagauagaccuauuuguagcuuguguagccugccaauguucuaagaaaaacacauuuccuuacugaugccaacugccugguuaauauugacuugaaucauaaucuccgaaucuagauuuucauucuuuaaaugaaaauauuacccaaauuacagguuaauugaaucuaaucaaugugaaauugcuuugaaagccagcuacuucucuguaaauucuaauuguguguucccacauaaaaacuguugucgaugguaucagugauauugccccaggggagcuacuuaggguggaagacaucaauugugugaaugucuagagagaggauacauauuagcacccaaauagauaucaucuacuagaacauauuuuuuuucucucuuucagacccaguuuauggagccggcauauauuucaccaagagccucaaaaaucuagcagacaaggucaagaaaaccucaagcacagacaagcuaaucuauguguuugaggcagaaguacucacaggguccuucugucaggguaauuccucaaauaucaucccuccaccauugaguccuggggccuuagaugucaaugacagcguaguugacaauguuuccagcccugaaaccauuguuguuuuuaauggcaugcaggccaugccccuguacuuguggacuugcacacaggauaggacauucucacagcauccgauguggucacagggcuacucaucaggaccaggaauggucucuucgcugcaguccugggaaugggucuuaaauggcagcucuguuuagugucuacaucaguuuaacaagcagaagggguugagagaacugacaaaaugauaaauaacagguuaccuguucagaaugauggggucacuaaaggcaccgaccacacacuagcaucauagugccuuugucuuuaccucugggcuugacugggcagaugccagcuaaaacuuccucacugucuuuucuauuugacaucuuucaucuccuuuccuauaggugacagcaagaauacuuuauauagaacaaggauauuuuuuucaagccuguuauuuucuaaaaugauagcacaaacuaggacaacaggaugauuucagguuuucuauauaauuuuauaaagugcuuuggauauccaaauaaaucaccuuugucugaguaacuggcugugaaucguga

SEQ ID NO: 8233 - RNA, 34154 nt, Mus musculus
ucacgauucacagccaguuacucagacaaaggugauuuauuuggauauccaaagcacuuuauaaaauuauauagaaaaccugaaaucauccuguuguccuaguuugugcuaucauuuuagaaaauaacaggcuugaaaaaaauauccuuguucuauauaaaguauucuugcugucaccuauaggaaaggagaugaaagaugucaaauagaaaagacagugaggaaguuuuagcuggcaucugcccagucaagcccagagguaaagacaaaggcacuaugaugcuaguguguggucggugccuuuagugaccccaucauucugaacagguaaccuguuauuuaucauuuugucaguucucucaaccccuucugcuuguuaaacugauguagacacuaaacagagcugccauuuaagacccauucccaggacugcagcgaagagaccauuccugguccugaugaguagcccugugaccacaucggaugcugugagaauguccuauccugugugcaaguccacaaguacaggggcauggccugcaugccauuaaaaacaacaaugguuucagggcuggaaacauugucaacuacgcugucauugacaucuaaggccccaggacucaaugguggagggaugauauuugaggaauuacccugacagaaggacccugugaguacuucugccucaaacacauagauuagcuugucugugcuugagguuuucuugaccuugucugcuagauuuuugaggcucuuggugaaauauaugccggcuccauaaacugggucugaaagagagaaaaaaaauauguucuaguagaugauaucuauuugggugcuaauauguauccucucucuagacauucacacaauugaugucuuccacccuaaguagcuccccuggggcaauaucacugauaccaucgacaacaguuuuuaugugggaacacacaauuagaauuuacagagaaguagcuggcuuucaaagcaauuucacauugauuagauucaauuaaccuguaauuuggguaauauuuucauuuaaagaaugaaaaucuagauucggagauuaugauucaagucaauauuaaccaggcaguuggcaucaguaaggaaauguguuuuucuuagaacauuggcaggcuacacaagcuacaaauaggucuaucuaucucuccagcuacugagacuacagccuuuaaauagcacccaguaggaacaggcggcacuaggacaggaggauaguugaguuugaggccagccugugcuacaaaggcagcaugaaaaucaaaaagagaaaggguacugggcaagaaggcagaguccuggacauuguaagagaaacaauggaaaugguuuguucaagaagaguaaccuuuguuuaggagaacauaguccuuauaucccuugcaagguauccuagucucuuacuguggccugguacaauguaacacccacuauguauccuccauugcuuugaacuauguuuauaccuaguauaguauaccagaaaaguagcccuucuucuuaaugcagcuuagugacauguauuagcaccacaaggccauggcucaguccucagcagugaaaacaucauguagaggggacacacuaacgccucucugaagcgcuagugucauuccuucuuucuaucccuucuacacugaaccaaauacugccuuagucuggagcagcacugggaaucagaaaugcaauauaagccacaugagacacuucaauaguuuuauagaagcuacacuaaaaaaauaaaauaaaauaaaaauaaggagccaggcacaguggacuuaaaaaaaaauaguuacucauuuuuauuuuaugugugagugguuuugccuacaucagugugccgguaccaagucuguucuuggugucuggauagaucagaagagggcaucaaaucucuagaucuggaguaacagaugguugugaaccagguagguucuugaaaucaaaccuggguccucugcaagagccacaagugcucuuaaccacugagcuugcugaauuuuuaaaggaauccuauugcuggagaaacuguaaucuggcuacaauaaucuguucuagccugugaggcaguccaauggcaguccccucucuaggcagcagaccuagaaagggacaaaggcuauugagcaauccuguccagcagcacacaguaaguguucuguguucucccucuccuguuucaaagugggaguuaucacuacacaucucccaauccaguucauaccaguagcuaauaaguaagaggggacacuucaucugccagauuauaccugcuucacugacaggaaauagaggacggaaggguccagcaugaugguacaugccuuaaaucccaggaacaguaccagggaagguuacugcagccagaucucugugaguuacaagacagccgggacuacauagauucugucuaaaaaagguagggcggggcacaagauacaaguuucuucaaguuacuuucuuaaguaacuaaguuacuuuaagguaaauguuagcuucuaacuaaggaaggaggaguugguauuaucagugaaaugagaaagguaagaaagggacacaucaaggcgcccucugcagauaggauagcuagaacacugaaacgggaacaagguuaaaacgagcaccauagauccugcuguccauucucccaucaauguaucgcacacaaacaaaagacagaaaagauaaaagagugaccauuucuaaaagacuucacuccugaagcccaggggagaaggaucccuccccgacagucacccacugacucugcuagccugugcccaaguaggcagcccugaagacacgcccagaggacaagccugacaccuacuauaggaugucgaauacauucuguggaagccgacucugcacaccguauugcagaacugaugugggaccugcugaaacaaccuuuggcucccagaucccuuuggcguccucucuuccaucauuuucuucuucucuuggaaggcagccagcagcaccuuauugucuaucugcuccaccuguaagcaaagaagagauuugaugcucugaaaaauggcuacuuaaauuguuucccgcacugcuugaaagauacaugugcuacguggauagaauauaugaagcuugcuguucaguucucuccuaaucuggcuucucucucugucucuucaaaauauccuacccccuuuuucaauaagugcauuuaauaaugucaguuguaugccuuuagacccagaaguagagacagggggaggggucagaaagagaucaaggacagucucagcuacauaugcaaguauaaagcuagccugggcuacgugagacucugucucaaaagaaaguaacuuaauaaagauuucacaggcuugggggauggcucaguuaguugguaaagugucccgcuugaaaacaugaggaccugaguucacuccucagacucuacauuuuaagaagccacacaugugauaugugcuugugaucccaggacuggggacgacacaugucccuggggcucacuggcuggccaagcuugcccaauuagcaaguuccaaguaaaagcgagagaccccguuuuaguuacuauucuauugcugugaagagacaccauguccaaggcaucucuuauaaaagacugcaucuaacuagugcuugcuuauaguuuuugacguuugguccaugaucauaauuaaaggaagcaggcauguaugagaacaguaacagagaccaagacaggcuggcauaccuuuugaaaccucaaagcccacucccagggacccaccuccuccaauaagaccacaccuccaaacccuucugaaauaguuacacuaacuagggaccaagcauucuaauguaugagccuaugggguggugggggugggggugggggcguucgcauucaaacuaccacagacccugucucaaaaaaaacaaggugagcaguggaagagaagaguccuaaggcaggacaacagcuaagguuuccuaaccuccacauacuagagaccucaaauauuagucuuuccugacagucuuuuaugagaaggaacucaaaucuuaucucccauaccuaguaagacuuuuauacaaagcuuuaaucuccuaccccauaaaacuuuuuauuuacaaaggccaggcagcuaggagcuuaaguaauuuaggcacuggcacuucccugcccccauuuccuucaucuccuuuucacaguuucuuugaaagcuagccaagccagcaacaguggaggucagacuccugucaguggggacaggacagucuccaccuguguuagaauguaaccgagugagcucccccacccagcucuucuuucugaguagcgugcacccugcugaugagaaguaaaguuuugccuuguugggacacuuuaacuggagaagcccuuuauuuagacagcauacacacagcaugccuacccugcuucacacacaacuccacugugucaucagcaugugcagucacugguacagaaaugaccuacaggcauaguaugugucccauuacagcuaauggcuuaguaagauaaaaguggguuaaacagagguagcacggcaggcuaaacaccgugugcuuuccacgguaguugucgaugacagguagacacuuccucauaaaucuugagucugugucucugcuugucuugacaucaugucugccuccugauucuaacucuacucuucaaggccuguauuucuacccagucuuauuccagacuccaggugacugagcggcugaguccuuggcaggagaauuuucauuuuggcuauagaaccaguuaacagcuagguaaaccagagccuucuuugauuauaccugcacaacccacaagccacacuuuucaaacuguuucuuucgguccugaaguuccugaguuaaugaugcuggguaucguugaaauguguacgauucuuccauuuuauccaguuuuucuugcugguugguccccuguccuaaaauaaugaguaagaaaaaaaccuuguuucaaugcuccaugaacacagggggaaaaauauguuaacucucucucucucucucuuuuuauuuuuuuuccucuaucuacauguacaccugcaugccagaagagggcaucagauacuacaaccuggccaucagguaaaauacaguuacccguuaaugcugcauuugcagaaguggacauguuccauuucuuauugucuucucugcauggcucuaacuuugucuuaaggcuuuuuguauaauccaugacaccacaaguaaauccgacaguauguguuucuauuuauuaauuuacaacuaacaguagaaagacaaaacauggcuuaucaaagugaugugaccugagcuaaccauggugacucacaucuguaaccccagggaggcugaggcaggauaacuguccuaaguuuaaaacucaccugggauacauaaucaauuucaggaaggccaggguuauaaggccuuaucucaaaaaacaaacaaacaaacaaacaaaaaaaccaaaccaggucagacacaguggcuauugggauuuggaagauguuggaacaggguguggaggugcuuauuuaacguaccaaagcagaacuggucucuagguucuaccagcaucucucagucccuaccugcuacaggauauggcuggcauauccuguccucuauccugaacuucccagccaaugagcuuggcuuccccuccccaggaggcucuucccuauguaauccagacauuuuuuguucucucuuccagcccccccccccaugccugcuuucucuccguggaccccacuuuucugucuccuccucugcacagcaucucaaugaauuagccugagagcuguacccaauaaaccugccuuuauauacuuuacuuuggcuugaauuggcucauuucaucagcacagauaacauccguggcagaaaccuguuaacuaagcacucaauagccacacaggcaggagaacuaggaguucaaggcuauccuuaaguauguaauuguuguggcuagcccuggggcuaauuauauuugauguuaauuccguucucccgguccaguagcugcuaacaaggaaugagucagcacucaggugauuuccuguaaaccugcuucccaccuuaauuuguaaaauaaaggagagcugaugauugggcagauaaaagggaagguggaaaaauaaaaaauaaaaaaaauuuaaaaaaaagggaagguggagcagaaggagggggagagagaaggagaaaauguaagagggagaggacaagaggaggaggaagaaggagaaaagcagagcagaagcacauggccuggagaaacugcaaguucuaagaggucucauaagcuguggaagaugguaguguaacgguagaucugcccaaucuaggcgcacagcuuguaaucauauuaacuguguuguguuuucauugccuggggauauuugggaggagauuuacugcaaugaguucaaggccaguuuccgcuacuugagacccuuucggaaaggaaaggaaaggaaaggaaaggaaaggaaaggaaaggaaaggaaaggaaaggaaaggaaaggaaaggaaaaaggaggggaggggaggggaggggaggggaggggaggggagaggaugggcuggagagauggcucagcaguuaagaguacugacugcucuuccggagguccugaguucaauucccagcagccacaugguggcucacaacaucuguaaugagaucugaugccucaucugguauaucugaagacagcaacaguguacucacauaaaauaaauaaaucuuaaaaaaaaaaaaaggaaagaaaaaagaggucuggauauaacagaguuguuggaaacaggaacagcagcagcuguggcuguuguaccagauaagcagaaaaucaagucagucaaaauuugagcauguaaaggggagagucuugggaacuggccccucuaacuaaggaacuaugguauuugauggcuacuaggaggaggaguccauuuuccucagggauguagcccaguaaguugcucaugguccacuggauagcacuagauucaccugcauauggaaggcuccaauugaacucaguguacuuuuuuuaaaaagacaugaaguuggaagggaaauguggagauuucagggcuuuuacuggccucacuugagguuuaauaauaauagaauaauaauaaagacgcauagacaucuauacaguuuaaagcuguuggccugucugcuggggcuauuccuuagcuagcccaucuaaacguaacccaaauuaccugccauugauucucuccacuugccacucaaugucucuuuccugcugucuuucugcccaagccucagcccucaggucuuuauuacaaacucaaccaguuggcacugggagauacaugaccuuccccacagcaacuugccuuucuuuuugagcaggugaggaugugacaagcauuuacauaucccgcuagccuggugcagccuggcccaacaauuaacaauugagaacgcacacaguaaauacaauauuagugggucaucccaacagggaggucuaagaggaacugggacagaagaaugggggugaauaugaaugcauugucuacauguaugaaagucucagggaauaaacaaaaacauuuacacccccaaucaugaaaagcaaauagccuaagucugagccagaacgguuuauuuucuucacucagucuguuauccacaaagacccaaauauaugcgaccagaaggaacacuugggagaacugacugcuuuguuugaagaugggauaguauguagggcagguuagucuccaacuuacuuugaggcuaggguagacuuaaacuccugauccuccugccucuaucugcccuguguugggauugcaccuggcuuugggagauugggguucaccauuucgcuccuuucuguuuccguuccaucuucucuauucacagagagcacucuggaauauuauugguuugaccugacuuaacaaauuuacuguccauaccuacacuaaucuauaccaauaccaauacuaacccauacuaacaccucccucaucccuuaguucgaaggacauuuacuucaaauuuaagaaacuuuuuuccucauucaauuuauuuauuuugagacagucucaccauauauguagcccuggcuggccuggaacucacacagauuuaccuuacaggugccaggaggauaaaggguguggugucgcacaauuccuagcaagggcuuuuaacuuaacaugcagucacucaccugacaagcuccaaagauuuuucucccuuuuuccugccacuucuuccugaacgucacacagcauacauucaauccucauaacugcgucaaugaggucagccuggggaccuuuaaucuccaaaguggccguucuuggacugacagucucugaaauggagacucuugugcuggucuggagcucagacagcacgucgugcucuuuuuucccaagauagagaauaugauuauucucaaugauguggugguccagggagaccagcaaccuuucaauccauuccugggccucacacaucucucccacuuuuacacccaugagauugauggcaggagauccagcuucaaggccgccucuucuuugcuccccacuggaccacugcagggcuaaagcaccuaucaaaaaacagauaugggggcuggugagauggcucaguggguaagagcacccgacugcucuuccgaagguccagaguucaaaucccagcaaccacaugguggcucacaaccauccguaaggagaucugacucccucuucuggagugucugaagacagcuacaguguacuuacauauaauaauaaauaaaucuuuaaaaaaaaaaaaaacagauauggaggguaguugaguacuuaagaaacacagaacaucacagccacuauacaccccaaggauaucaucaccauugucagccacagcagcuaagacccaucuaccuguaaugcuacaccagauauaaagagaaucuacaugcuuagcuuauggccuccuuaaaaaaacauaccaauuagcuuagaaggcaaugcuuuauccuaucuauccucugaugugugugugauuugccauucauaaauaggugaguuuaccuauucuuaccugcuaaagugacauauuccuuacccucuugcaccuaccagauuuaaaaucaaacaccuaaagcaacauaauucaaggaauaaaauuuauuuuaaaaaacaaaaaagagugugguggcacacgccuuuaaucccagcauuugggaggcagaggcagaggcaggcggauuucugaguucgaggccagccagagugaguuccaggacagccagggcuacagagaaacccugucucgaaaaaccaaaaaaaaaaaaaaaaaaacaaaacaaaacaaaacaaaaccaaaacaaaaacaaaaacaacaacaacaaaucgaaguugggagugguagcaugugcuuauaauugccauauuugagaggcagauuuuugaggcuaaccuuggcaauaggagagccugucucaaaauaaauaaauacauaaaauagagggauaucuagaaagagcuagggagagaauuaggauucauuguauggaauucucaaagaauuaauuaaaauauucauuuuuuuuaaaguagcaaaccuguagccaguuacgcaaaacguuucacagaaaagcaaacuuuauggcuugcaucuaugugaaaaaaauguuuauguugacugcaaucagagaaauagacuaucacccacccaccaggcagaaauuuggaaguuuugcaagguucguuguguguguguguguguguguguguguguguguguguguguccggagaguuagaagaucaaacucagguguuuagacuugguagcaagaaccuuuacccaccgagccaucuugaagguucacauuggaacugcccaauggaaauaacuggaugcccuucaauaauggaaugcuauuguacugaugaaaagaaauuaccuuuacuugacugagucacagagaaaaaacaaguugagaacuauuccaaacauuguuccaagagcuuuacaauucuauuuaagccucacaauccuaugagacaggaacuauuuaguccaucuuacaaauggagucacuugggcugggcgugguggcacaugccuuuaaucccagcacucgggaggcagaggcaggcggauuucugaguucuagccagccugaucuacaaagugaguuccaggacagccaaggcuacacagagaaacccugucucgaacccccccccaaaacaaacaaacaaacaaacaaacaaccuugaagagaggaaacagggagcugaguagaaauaaaagcaaaaaaagccaguguuuaggacaacaacagggcuggagagcuggcucaucggguaagaguacugacugcucuuccagagguccugaguucaauucccagaaaccauaugguggcucacaagcaucugcaaugggaugcaaugagcucuucuggugugucugaagggaucaacaguguacucacauacauuaaauaaauaaauccuuuaaaaaacaaaaggacaacuauggugagaagggaauucuaacugguggcauagcuuuuccuguuuucagugguuauuggggcauuuacauugcuuucuggaaggacacgaaaacaauauagugauacuuccuugagccaucauuuuuaggagagaagaauuauuucagaucacuaaauuguucaaaucaccaaggguaacuguucuaagaacgaaaaugcauucaauuaacuacuuauuauauaaauaugucuaaugaagaugcgcuucucuucaucccugauuaguauaaccuucccuugauaaccuaagauaauccuucucaaacauuaucaaugcuaauuauauuccuaauuucuuaauaaaaauaaauucuagggggcugaagagauggcucagcggguaagagcacugacugcucuuccaaaggucaugaguucaaaucccagcaaccauaugguggcucacaaccauccuuaauaagaucugaugcccucuucuggugugucugaagacagcaacaguguacucacauacaugaaauaaaucuaaaaaaaaaauaauaauaaaauaaauucuaauuucuugacuuuuuuuuuuuugguuuucaagacagguuucucuguauaucccuggcuguacuggaacucacucuguagaccaggcuggccucgaacucagaaauccaccaccucugacccccacccccaccccagugcuaggauuaaaggugugcaccaccacgcccggcugacagauauuuuuaaggacuacugaauaagucaugauccuugucgcugugcuucggguuaaggacauacagaacuuucauauucccuuuuugcauuagccuagccuaaaacuccaccccugccuugcuccucucuauuccaugaaauaaacacgcacuuuauuuguuugcucuuguggguuuuauucaugucaaggacugcccuaccaccauugauggcugauggaaaucuauacaucccaaagcucagcuucaaaacauguccaugaagccuuucuugaucccucccagucugaagaauuccuucccuccucuagucuaccugaggaguuugucuaucuucucucucucuuuuuuuuuuuuuuuuuuuugguuuuuugagacaggguuucucuguauagcccuggcuguccuggaacuuacucuguagaccaggcuggucuugaacucagaaauccgccugccucugccucccgagugcugggauuaaaggcgugugccaccaugccuggcucuaucuucucuuuauuugccuccuggaacugguuugaugcuuuguaauuuuaauuuacaaaacaucuuucaauaauuggaaaugaucaaaaauauugucuauuauuuauuuaaacucugugugugugugugugugugugugugugugugugugugugugugugaguacauacuccaugagaaucacuuuucuccuuuucuguauggguucugggagcuggacuuuggucaugaggcuuggcagcaggugcuuugaccagauuagccaucuuacugguccacaaucaccuacuguuauuaucaccacucgacagacaauaaauauaggcuccuaagaagcagcaucccaaaacucucgagagucaccccuucuguacuuccagucugcagagccauuaaacauuccaccccaaagagugagacagaacuagccucacagguauacagcauccaagacuguuugaacccaccuaucccagcaaucccaaaccugugagagcaacuaguuuuuaacucuuuaaaaaguuuaaaaagaccugcuugacuaggccagaguuccugacucagaauugguaaugagaauauaaggacccagguaccccaccucuucuuuauaaaagaaucucauguagcucaggauggccucaaacuugcuuuuaugugagucugaccuggaauuccugauuauccugccuccacucaugugucccgcuaugccuauaaaacucuucauuucuuacucaccacuauuaccgcugagauucagcucguuggaccuuuuugucauuucagcauaaaaaaucuagaauaagcaaagcaagagagucauagaagagugggcaaccgcgguaauaaaaaucucuaccugaauacaucauaccacuguccuaguagacuccauucccacugcuacaagcccuaaggcagccuuagacaagccaagagaaugugugcagcagguucucagccugugggucccacaucagguagccugaauaucggauacuuacauugcaauucaugacaguagcaaaguuaugaaguagcaaggaaaauauuuuuaugauugggggucaccacagcaugaggaacuguauuagaggguugcagcauuaggaagguugagaaccacugacuuagaacaccugagaaauuaguacagguaaaaaugaaaaacaaacaaacaaacaaaacaaagaccugguagaauugagacaaaauacaagcuuucauucauucagauauuaauguagauaccaaauuaaagcuaaaauaaaaauauagaucacuucuacauguuaucaacacaccaaacuguuuuauauggguucauuauuguaaacuacuuaaaacuggagcugauucagugagcauucacuaucuguucuauaugguaauuaauguuacagacaacuuacagaaaaaagacugaguauuucuaggcauacccuuuaagacagaguugacuugaaagaauccaaaucucuuaggaguuuggaaacacuuuauccauuauuguucuuauucaaaguugauaaaauaggcaguaauaaaccgggcguggugacacaugccuuuaaucccagcacucgggaugcagaggcaggcggauuucugaguucaaggccagccuggucuacagagugaguuccaggacagccagggcuacacagagaaacccugucucaaaaacccaaaaaaaaaaaaaaaaaaaaaaaaaggcaguaauuacuuuacugacaaaucauaguacuaauaagauaaagacuagaagacuagauuuugcuuuauaucuaucuacacuucaaaaaugaagagagagagggggaaggagagaggagaaugagagaguaaguguguauauguuuagacagguuuuuacuaucuugcuaucuagcccuggaugaacuggaacucauuauagccucgaacucagagaucuucgugguguguguguguguguguguuggguuuuggagucgggguuucucuguguagcgcuagcuguccuagaacuuucucuguuauccaggcuggccacaaacucagagauccaccugccccugccuccagaguacuacuaguauuaaagucgugcuccacccuccucagauccaccuugccuccgcuuccaaaaaaguggaauuaaaggugcacaccaacacacccaacucaacaaugaaguuucuuaaucuauagaacauuuccuuuauaaacuaugcuuguagcuucuauuuccagagcaaauaaaaucccuuggucuuacuauauuuaguuaccuggagagauuauaauagguuguuccuggucguccccacucaagaauuuggaaaugagauaacauuauccacuguuaagcaaacaguaagagaagccauauacaauggauaaaagucaguucucugguuaugucauuucagaaugcaggagauguugcaggguuagaaauacuuaggcaaagcuuucgaaugaaaagugacagaaacuguaacuuagccacuagcaauaacguuuaugaaaggaguagacaauaagcagauggucagcaaagagccuagagggcuuugguggagccaaggacaagacuuggcagugucuuuccaguucuguccaccaguguggaacacccgauucucaugagacaugccaacaguggguucuggagacugguuucuuucucugagacaaaaacaccuggcuuaaguuaauaugaaagaaauguuuguuaaaugaccuucuauugccuuuuauagauacccaguuuuuuuuuuccauuuuuuauuagguauuuagcucauuuacauuuccaaugcuauaccaaaagucccccauacccacccacccccacuccccuacccacccacucccccuuuuuggcccugguguuccccuguacuggggcauauaaaguuugcaaguccaaugggccucucuuugcagugauggccgacuaggccaucuuuugauacauaugcagcuagagacaagagcuccgggguacugcuuaguucauauuguuguuccaccuauaggguugcaguucccuuuaguuccuugggugcuuucucuaguuccuccauugggggcccugugguccauucaauagcugaccgugagcauccacuucuguguuugcuaggcccuggcauagucucacaagauacagcuauaucaggguccuuucagcaaaaucuugcuaguguaugcaauggugucagcguuuggaagcugaucaugggauggaucucuggauauggcaaucacuagaugguccauccuuucgucacacuuccaaauuuugucucuguaacuccuuccauggguguuuuguuuccuauucuaagaagggacaaaguguccacacuuuggucuucguucucuugaguuuaauguuuuuagcaaauuauuagauacccaguucuauccaggaaaaaaaaucaagaaauaucuuggaggaggagaaggaggaggaggaggaagaggaggaggaagaggaggcagcaggguagaaagaaucaacccauaucaaaaauagguugcuuaccuuuaaagaauagagagaauaaaugccaacaaggaaauaagaaaagcaaacaugaacauggcuuagaugaugaccuuugcgauuaggccaagggugugugaucugcagaaaugaaauguuagaaucccaccacauugugggauccuuaccuaguguguuagaacagagacacuaauuggucauugguagguaaugaaugagcaagcuguuaagacuuucccaagacacuaacucaccuuguacgucuccacaucuacuggaaagaucacaaucuuuacaguuagcguuuuuuccuugugcucuuuagcaaaugcaaaaacuuccucaaacauuaucugagcugcuguacucuucuucaaauccaucaauccugucccgagagcaggaaaggaaauggaauuuauaucugguuuaaggcauuuuucuagacaggacuucauugcaucuuucaauaucuguaagacaaauacaaguuccagaucaaccuuuaagacaaaaauaagacuucacuuacccuucaguucuacucagauuuuaccaugccagccugguuauuuaguuuuaggauagcauggacuacggagguucagacuagccugagcuauacagugccaguaugcacacaacauggguguguccaugcauccuuagagggcugcuaaggccccacgccacagaaaccuacgauagcuauaaaccagauagugggaagcauaaggguuaagaaacugaggcaagugaauuccacccacggcauuugagcacugugaucucuuccaguuauauacccucgaucaucucccuagcucagggagucagacaagcaucagugugccacucaccugccgcucccaggucaacaaagagacaguucagugagagagauggagacuaaaagaagagaacaguaucccuuuaauauuaugacgauccacuggguagcuucucccagagaagugccgagagcuaggaagacucagacuuccaucaacuuuuuucuuuuucauuuuuuuaagaucaggucucacuacacagcucuggcuggucuaaaacucacuauauagaguagguggccucaaugucugagagcucugccugccucugccucacagggucugggauuaugugaggaagucugccuuagugggauagcuuuucugagcuggggacaaaauggggggcuccccuuaccaacagggcuuccccuucccugaccuucucucgggacccgaauuccacgcccucuaccugagggaggucaaguaguccuugacagaccuacaaguucaacuuccucuuuuccagauaagaacccagccagccaccugagauuucuggacugccucuccaugcaaagaaggcauucaccgaacuuuaaaccccagccaauuacuuucacuuuucuauaaacuccuuucuuacucuccaaaauccauauauagcccugguucacucugaauaaaauguacguguacaagccuacccuaaauaaagguauguauacaagucaggauugucuaagagagcuguuucauugaagauggacagagaaggccuuuggcuaaaagagcuauauaacacuaagaccaucagagugcuccccccccuccacucauucccaauuguacuggaauccugcaaaauuccacccauaaaugcccugagagggagaaggcagaggacacagaaccacagcuggaccccaaaacgcauaccacagcuggcacucaauguggggcacagccaacugaccuauacaacaggaauuuuaaaaaaguaggccgcaugccaggcuaauuuuccaucaacuuuucaauauugcauugaauugcuauauagacagggagauugucugugggaaaaccuuggaaagaugaagcauagagaauaauuggagauccaaucuaggauuacagaacuaagagaggacaagacauggcacaggugaagaaaaaaagaaaagauacacaaggcaaaaaagauuaaaaaaugauacuaguguaagagcuuauaauucuggcccucaggaggcccacacaggaggacugucaugaguuuuagguuagccuggacuacagaguuucaggcuagccugggcuauacauugugaccucauuuccauaacaaaagaaaauaacuaagagugguggcauauaccuuuaaucccaacacucgaagcagagacaggucaaucucugugaguucaaggccagccuggucuccauaguaaguuccagauagcaaggacuauguagagagagacacuauugagaggccaaaccuacuccaucuugggaccggucuccaccuuaaagaaaauaagccugagaacuugaccuguagcagaacucaagcuucacccauguacuaggaaggaccucagggcuugucuuggccagaguuacucccuagcuacuuccuagcaacaguuaaucaaagauuagucugauuguuucagauguacuuucaaaccaguuugugauuauauaccgucuugcaucagagcgcccaucuguuggcuuacagccguucuguuauaugcuugccagacuggaaccccauccuucaccccaucacuugcuucaaauaaagagacucuaugcuauuacaucagagacagcuccuugguggucuuuugggguucuccauacauauggagagagagagagaaggcacacuaggaauaagcauuucucuacaucuguguggacucccucuacucacuaauuuucauguuuuaugggagucagaagaaacuguaguagcuuugacuccaacuccuacuggaauuuaaccugugaaaggaaauacggagaagcugaauccccugccucauuauagaaggauaaagcagaccauuguguauuauagagcaagacugcaaacagacugaaggguucuggguuucagugcccacgugcaggguacucacuuagaccuuucaaauccaaguuaagagaacuuggggguaaccauacuuacucagccucucagccagucauaggcguguuuccaaaaaggaaacacaucuguggugguuugaauauauuugguccugauaauagggacugacccuauuaggaggugugccuuguuggaguaggcguggccuuguugcaggaagugugucacuguggggacaggcaaugagaucccccucuuagcugcuugcaagacacucuucuccugucugccuuuggaucaaaauauagaacuuucugcgcuuccagccucaugccugccugggugcugccaugcuccugccuugaugauaauggacugaagcucugaaccuucaagccagccccaacuaaauguuguccuuuauaagaguugccauuguaagaguugucucuuaacagcaauagaaacccuaacuaagacaccaucuaacgauuuuugauaaacauaaucaaacaauggaaacuuaucaaaaugcuuggaucgugcaaggguacaaauuuaggguuauuuuuaacuuaccugguauuuguugauuugggaaugccaugccacauggaagacauacugacaggacaauuuaaauccuuuugugacccacaccucuugauaaucuguggacagguuaaccuugucaaguuccuuuuccauuucaaccccugcuugucuaagaaucgacugugccacucguccugauuuaaaauccugcauguauccagaauuaacaauuacaucugucugaaaagggaagaaaacacaggauucauuguuaaaucccuccuucuaaaauaacuaauuuguacauccauaaaaguuuagaaaaauacuuuuugaaaauuccagauccaaaaauugguuuuguaauagagacauauacauuucauugcuaugagguuguucacccuauuuugaaaugauguacauauauaaaaaauauuaucauuacucuuaccuuuuguugaauuauacuuaauauauuucaagauucuggucauuccgucuaacuccuuuuguuugaaagacucuauuuucaggcuggagaguuggcucagugguuaagagcaauuguuguucuugcgggggaccaggguucaccucccagcuagcacauaaaagcuuauaacucuacuuccagaggaucugaagcccucuucucagcucugcagucaccaggcaugcauuugguggccaacacacaugcagacaagacacucauacccauaaacuacuaaaauuaaauuaaaaaaaaaagauuuuauuuucaauagauguguauaucucuguguggguuuguauacaugaguguagugccugcaaaaucccagagagggcgucagucucugaagcuggacucaaagaguugggagcugcccgauuuacuggguggagacagaacucagguccuccaauagaacagucacacccuuaacagcugagccuucucccuagccucuuugguugguugguucuuuccuuuguuuuuuuuuuuuuuuuugggggggggggugcaauaucucaccauguaaccauggcuggccuguuacucacuauagagaccaggcagaccucaaguccacagagauccaucuguuuccaucuccucagcgcuggacugaaaggcaggcaccgucauaacuuguuuguugugguuuugcgauggugucuccuguagccuggaugaccucagaugucccagauagcugaagaggaacuuaaauuucugauccucuuguuucuaccugccguguguuaggauuacagauuuaugggcucuagggacuaaacccaaggcuucaugcuguuaagcaagaaauacucuacccauugaaccguauccucuagcccuucuaucuuuuuaccugaaugugugccuucuuuuuuuuuuuuuuuaaacaaaacaaaacaaaaacugggacacaauggcuccagaauaaccuugagcuauacucaucucuucagagcuaaaauuaccagcauacacagucuacucauccagcuauuauguuguuuccccagugcuaaggacugaacucaggaccaugcacaugcuaaggaaacauucuaccccugagccaaaucccuaggccaguaagcccaggguucuuuuuuuuuuuuugguauuuccagacaggguuucucuguauagcccuggcuguccuggaacucacuuuguagaccaggcuggcuucgaacucagaaauccgccugccucugccucccaagugggauuaaaggcgugugccacaacugcccugugucccaugguuauuuucaagacacauccauacggauuuuauucucugccuuaucucugucacuucuuguuguuucuguguaggcugcuugguaacaaagaaaaagugucuuaggaacuuuaggaacagaagacaucuccugucuuuauguucucauguccaagguuaaagaaaguauaaacaaggccaaaaggacuuuagugaaacagagcuuucuuucuguaugggucaccaaacacacuuacccaacuauucuauaggcagccacuuaaccaguucaucuucagcagccguucucaaccuguaggucaugaccccuuuggaggugucaaaugacccuuucacagcggucgccucaggcagauauuuacauugugauucauaacaguauaacaguaacaguaaauuacaguuaugaaguagcaacaaaaguaauuuuacagucaggggucaccuuaagaugaggaacuguguuaaagggccacagcuuuaggaaggcugagaaccacagaucuacagaaacagcguacacauagacaucaacugcauuucuuacuacuuugucucugaacucugagaucagugcuaaagugagcugcgcccuuagagcuucaguacucuggcgguuugaauaugcuugucccauagggaguggccuguuaggagcuguggccugguugagggaagggugucacuguggggcugagcuuugagagccuccucuuagcugccuggaagacagucuucucuuggcuuggauaaagauguagaacuuuaggcucuuucagucucaugucugccugcaugcugucaugcuuccugucaucaugauaauggacagacugaaccucugaaacugaaagccagccccaauuaaguguuugccuuuauaagaguugucuuggucauggugucucuucauagcaauaaaaacccuaacaaaacaaguaccaaaauucuuaucauccaucaaaggaaacuuagguacuucuguggacuuuguuuugugacaggguaucacugugucaucuuggcuggcuugcagcuuguagaucaggcuggccucaaauuuagaucaagucuucugccucugccucugccucugggguguugggcucuaggcauuugccaaaguacuccuuuuaucauggacauuaaugguuuugcccugaaaaagcaaucugaauuugccauuggggggcacuggcacccuucagaagauguaagguuccugaugcugcuaacaauaaaugaagaugauaaaaaaucugguaaaaggaugcuauuuaauaauguuucugcuuggugcuggcgagauggcucaguggguaagagcacccgacugcucuucugaaggucccgaguucaaaucccagcaaccacaugguggcucacaaccaucuguaaggagaucugacucccucuucuggugcgucugaagucagcuacaguguacuuacauauaauaauaaauaaaucuuaauauaauaauauauuauuauuaauagucuuuuuuauuuuuuuaagauuuauuuauuuauuauuauauguaaguacacuguaguugucgucagacacuccagaagagggagucagaucuccuuacagaugguugugagccaccaugugguugcugggauuugaacucgggaccuucagaagagcagucggguauucuuacccgcugagccaucucaccagcccauaaauaaaucuuuuuaaaaaauaacauuucugcuuaaauguuaaaugccacacuaacgacuccucagaucguucacuucauggagucuccucagccuucgcucugauaucucauaggcuguaagcgcuacucucccugacaguuaauuauaauuugauuguggggacuggagagauggcucaggggcuaagagcacugacugcccuucuagagguccugaguucaauucccaguaaccacaugguggcucccaaccaucuguaaugggaucucaugcccucuucggguauguuugaagacagcuacaguguauucauauacauaaauaaguaaaucuuuaaaaagauaauaauaacuuuaaacuucaguguguccagccaggcugaucauuuccugucugucucucugaccaagucacucaagccucccugauagccuuccuccugcuaguucacaacucccccaaccuaagaucagccugcuucucccagggcaggcaaucaaacccaugcuaagcaagcauucugccaccaagccagccagcccaggggugcuucuagaggggcaccaucaguagggcuuucuucucugcccugucaccguuacuuuuugcuaccucugugucccugauccuugggcuuccaccucaaauuacugugauuacagggacaggccaccaugcccugcuguauuccuaaguacuauuuuuuguuuacuguuauugauaguuugcuucagcaaugccgagugacuuguuuccccagugagauugccaaauaaaaguuuuuuuuuaaagauuaaaaauaggcuagaacuagagagauaaguaacucagucaguaaaguacuugccagagaccgugugaaaaaacccagauguggugacaagcacucacgaucccagccaagacaaguucccuggggcuagcuagccaguaaggcacagcccgccugacaacuuccagaccaaugagaaacucugucucaaaaauagaaggguagacaguacuuuaggaagacaaccaaaguuaaccucuccacaugugugcacaugugugcgaacccuacccccaccuccaagcaugcauagacccacaaauauacaccuaucagcacacauauugauacacauacacacucauacacacauacauacacacaccuacauacacacuuacuuacuuacuuaauuaauuaauuaauuucagugcuuagccgaggcauaguagccuuuaaucccaccuuggaggcagaggcagguggaucucugugaguucaagaccagucugaucuacauaccaaguuccaggauagccaaagcucuauagagaccuugccucaaaaaaaauaaaaaucuaguguuugaggcugaggcaggaggaucaugagucuuggaugacgugguagaaagcaaacauuguuucaaaaauaaacaaacaagaggcaggcggauuucugaguucgaggccagccuggucuacagagugaguuccaggacagccagagcuauacagagaaacccugucucaaaaaaaaaacaaaaacaaaaacaaaaaaacaaaaacaaaaaacaacaacaaaaauaaacaaacaaacaaacaaaaauaaagaaauaagagaaagcuuaaguucuuugggauuaaagaguauucuaaucgcuucugguuccuaagaaucagaaccuaaucauuauaacucccacaugaccgugugccacacacaacuguagccaucucuuggauaaugacucugcuuucagauguuuaagugcugcuacguguuuuaaaggaaggacugaagacggaaagaaagaaagccuuugaguuaggauaaugaagcuagucucuaauccagauggccuggcccugacagucacacacucuaauccccaaaagauacaucuuacagccuuccacuuuaagcaucuuagugauuaaccauuaauuccaggacuccccucugccagggaauaaaaacaaaaacuuacuguuugcauuucaauacagccuuggacaaucuggagagucaggccccggccgaugcgaagagucaugguggaagcagggucaguuucuggacccccccaagagcucaggucccucccuaggaugcuuucugaggcggauuuaaaggacgcaacagugggguccucauugcucaccagaugaaucucucucaaauuaccgaacauuugcuugucuuggaaauaaagccggauaguuucuaaaauuaugcuuguacacaaauccagagggaacuggaaaauuccagagcucagggcuggaauugcuacugucuuaaugcguagaucauauuuggugacauaaucuagaauguuccuaauggcaaauuucaguaauucgauagcugucuggcuguucguaacuguccaccgagguccaaccgcauggauaaucaaauggcaaggaagucuccccgcaccggugauagcgauuccaccaacugagauuuuaccaacguuggcaaugauucuuuugcucucuucuuggauuucaaagccaccaguuuucaccaagcuuccggccaggccacuuccaugcaaaagguuuucauuggcugcguucaccacagcaucaacaacgugucugguaaggucauccuuccagacagauaacucuaucccagggaucaggguccuucugaagacucucugagcaggagagcugcucccugcuagaguuggacagcucaggguagagaugcauccaaacuuauuuuggaggacuucacauagcugacucucauugcucuuuaaaauuucgaagacauuguguuuaaugggaauuugccaucuauaauguucuucaagagaauuguuggcugguaaaggagaaaagacaaaagaagaaagaaaugaacaccaguuccuuugaaaaggacaugguuccuuuccacacuaagaggcugaguuucucacuuggaaagagagaugaacuucacgaccugccuuaccaacacugcuuugcccuccaccccccacccccaccccccaaacacacacauuuggaaucaagccaaagauauauaaggguuuuagaugcaaagccacuugaaaagggcucagccuuguauacggcauuuuguuagcagucccuaaaugagaaagcaagaaugucuucaauguuuguaaaacacauacacacacacacacacacacacacacacacgaagaugauguaauugugaguugggaauaaagggaagcuguagucauaacgucucugcuuuucuuuuuuuuuuuucuuuaaagauuuauuuauuuaguauauguaaguacacuguagguaucuucaggcaccccagaagagggcaucagaucuuguuacagaugguagugauccaccaugugguggcugggaucugaacucaggacuuucgcaagagcaguccuggcucuuaaccacugagccaucucuccagcccucugcuuuucuuaaugucuuaguuuaaguuugcuuagaagcaaaucuugagaagagacuuuugaguauaaguacuuuaagaguugauucuagaaaacaccagggguugaaguuaaggagagaacgugagaaacuaagacaggaaaacacaaacaacaaacaaacaaggauacuaugugugcugguuagcaaaugaagcucaucuaucucuuagagggcagagcacaucguguaacucagggccagagccuuagagcagucaucauuacaagagcugagauaugcauccagcuuccacgggucacuagucaaagcuguuccuuauugagaggagauggguaacauaggagcagcuagggggaggagaccggcaaccucuggcucauggcacuuacucugguccucacagucgaaaucaacacagaauuacagcacaguagcuaaaagaauuaugcuaugcauacccuuccuuauccccagcccuggggaggcagaggcaggcagaucccugugaguucaaggucagcuuggucuacagagccaguuccagaacagccagaagaacuagaacuacauggugagauccugucuuuaaaaaaaaaaaaaaaaucacugggcuagcaagauggcucagcggguaagagcaccgacugcucuucugaagguccugaguucaaaucccagcaaccacauggugguucacuacuaucgguaaugagaucugaugccuucuucuggugugucagaagucagcuacaguguacuuauguauaauaauaaaugaaucuuugggccagaacaagcagggacugagugagugggguugacuggagcaagcagagcuccucaaaauuuaauccccaacaaccacaugaaagaucacaaccaucuguacagcuacauuguacucauacauaaaauaaauaaauaaauaaauaucacuuacugcauuuuuaagacugcaagauguguuguucacauccuucuuaauuuguauauacaugggaaaucaaguuaguucacagccucuauagcuauuugguacuaaaguucaccucagcagaagucaugguucucaggacaaccccauccaaggcugagcaaugccacuuauggccuauauggggcaucuguaacacaauggcaggcuuucaggcacuucaguucaggggcaggggaaguugaugguagugauaauacaaggccuugcuauguaguucuugaauuagaaucuuccuuccuugagccuuuaaacuuuggccuaccaccauacccacccagcauauacauccagguucuggauaacccagccuguagagugucaguaucuuuuucugcaaaucccucuuacugggcaggugguggcacacgccuuuaaucccagcucuugggagacagaggcaggugaaucucugaguuugaggacauccuggucuacagagugaguuccacagcagccagagcuauacagagaaacccuguguuaaaaagcaaaaaggaaggaaggaaggaaggaaggaaggaaggaaggaaggaaggaaggaaggaaggaaggaaggaaaagaaaauucuucuuaccuucagaaacugaacuuuugucgaccuugcaaccaagguaauaauauaccuagaaaucacuuaaauaucuguacucaaucuguuucccugcuguauauauauccagucugcuaaacucgccuuuaagaaaacaguguaaccaaccuuauaugcuuugcagucaguuuuuaaaacauaaacuaaaugcauggcuuuauguaugugcguacgcugucacccucuucagacacacuagaagagagcauuggaucccauuacagaugguugagagccaccaugugguugcugggaauugaacucagggccucuggaagagcagucaguacucuuaaccacugagccaucucaucucuccagucccuaaauacacagcuuuaaucuuaaacuacaauucuuccaagucccugacccagaauaaugugugugccuguguguguugugauaagcauuugcugaaagcagccaacagguugaaaggaaccuuaaacaaaauaaauaacaaauaaauuacaaaaauaaauaaauaaauacaaaacaaaauaacaauaacaaaauaaaaaacaaauuaacaauaaaugugagaagcaacacauggauauauguugagaacaucuguuugugggucaccuggggucaguaaaguaacuucuuuccuucuaaaauuaaaaaaaaaaaaaaaagaauucuuaauuccuuuaccauacugucuuuucugugcuguuaaauaaacagcuguuuauuuauaaaugcuguuagggacagacaacaaggacagacagacaucagauacacacaaaaggcagauuauagacaacacuacagacaaauggaaaacauugcaaagaauaaaauuauucuuuuguuuguuuguuuguuugguugguugguuuuuuguuuuuuuucgagacaggguuucucuguguagcccuggcugucuuggaacucacuuuguagaccaggcuggccuugaacucagaaauccgccugccucugccucccaagugcugggauuaaaggcgugugccacuaccgccuggcucuuucucuuuauucuuugaugagauaccaauauagccuuugccucuaagaaaggaagaugaaugucagaaaacuggagccuuauuucagagacguuaaaauguaggacaacgggcuggagagauggcucaguguuuaagagcacugacuguucuuccagagguccugaguucaauucccagcaaccacaugguagcucacaaccaccuguaauaggauccagugcccucuucugaugugucugaagacagcaacaguguacucauacaauuaaaaaaaaaaaguaggacagcagauuaaguguaguaguuuacucuguuucuaaccugagcugccaagaaagacuucugacgaccucucuuacucaaaagaagccacaacuuagcagucggucucaauuggccuucacacugauggcaaauggcucaccccuagaaacuaggcagguuuacucucucagcucuuggucagucuuucugcucauuuuggcugucguggaaugggucagaagugugucacagggcuggcaugcugauaugcaccuuuagucuuagugcucagaggcagaagcaggccgaucugaguuccaggccagccaccuccacaaagcuagaccauucucaaacaaauagagaaaagagucucugccaacaagggaaaggauaguggggggggggcccaagagaacaugucuucagcugccacaagccucggaagcaauuccccuuccaaagcacaugcccacaucuccacagcgucugcagucacacaccugaaccccugagggggggauagucuccuucugagugcccucuucugcgcugaggaaagagcucagcaaaggcuuucuuaaaugagagggagagagaggcgaucauaccuggucuuucggcgggagcugccgcccauguauccugugaagaaaugaaacagcugcuuuaaaagccugaagcugcaaaaagcagagaugaccaauugcacacacgccgcccgcuaagcaggaauagcauagguucucagguuuaggguuuggggaaggaaauuuuuuaguuuguuguuuagauucauuauucgguuuguugauauuuucgucguguuuuuuuuuuccauuguuguuugguuuuuguuuuccccaagacaggauucccuguguagcccugaaacucacucgauagaccaggcuguccucgaacucagccaucugccugccucugccuccugagugcugggauuaaaggcgugugccaccaccgcugccaggcuuguccuaucguuuuuuuaaucuguguacccaaaacacugaaaacgcuaaaagcugcagcaaauacugagccuaucugugccucuuaaagaggucaauacacuucguuuguuucacacuguagaccaggcuagccucaaacgcacuauagagcccaggcuggcuuugaacucacuauagagcccaggcuggcuuugaacucacuauagagcccagggcuggccuugaacucacuauggaggccaggcuggcuuugaacucacuauggaggccaagcuggcuuugaacucacuauagagccaagacuggccuugaacucacuauagagcccaggcuggcuuugaagucacucuagagcccaggcuggccuugaacuccuagcaguccucuuuccccagucucccuagugcugagguuaugucugcugccaugcuuagcugaugcacuucuaagucagaauaagagaaagggcuggaggcuaacaccugaaaaggcucaaaggccucaaccguagugagucucagaccaacgcucucagauggguucaagucguguggaauuucucuggccagaauagaacacaugaggcugugagccucuccagaugcaucucccacaucuguaaggacccacucacugccaguugccuauuucaugacaaacagaaagugggaguuuucagaucgacuuaaaggagccuuuccccaugcccacuuccugacccuguccugagagacagcugcugaaagacuaaagaaaauccacaccauaugguggcaugagacugggucuuacguagccuaggcuagccucaaacuuacuacauacuaccaagccgaauuuaugcauuacuggaaauugaacccagggcuguaugcaugguagguaagcccuuuaucaucugugcacaguccuaguccuggagaugauauuuuuuuuaaaaaggccuuccaucaccuuguucauucugcuaauuauaucaguauauuauuuauuaauuuuuaagauuuauuuuauuuauaugaguacacuguaauugucuucagacacaccagaagagggcaucagaucccauuacagaugguugugagccaccauguaguugcugggauuugaacucacgaccucuggaugagcagucggugcacuuaaccacugagccaucucuccagcccuauuuauuaauuuuuuauguuuugaaauuugagauaggguuuuacuccauaacucaggcuagccuggaaccuguugugauuuuucugccuuaacuucuugaguacuggaugcccccauacucaacuauauuacuauacucgaguuuuccauuucuaacucggaaaaaaacuuuuaaaauuguaauuuaaguuuauacguguggguguuuugccugcaugcauguuugcguaucacaugcuugcuguggaggccacaagagggcgcuggauccccggaagcagaaucuucaugugaggacugggaauugaaccuggguucucuggaagagcagcuaaugcucuuaaccacuaagucaucucucaggccccagaagaaaacuuuguguguguguguuuguguguguguguguguguguguguguaugagccuacgugaguuguguauaccacaugcauagaagagucaacaaagacuagaagaggaaauuagauccccuggaacugagguuauaggcaagauugugagccaccacaugagugcuaggaaacaaacuuaggaccucuaccagggcaguaacuacugagaguauaaaaucauaugagggugcuagguguaacugaaggccccagcuuucuuaauguuguggggagaacccuucauguaauaauuggauuuuucaugaugaaaaguauuuauauuucuggguuuaccauguaauaggccauucuucaggucccacgugggucuucagauauuuauauuuguuuguguuuccaaguguagucuguagaucgaggagaugguggccuguuucugggaacagauagaaagaacgcaauaagagcuggccaaagcggaggcaacuuggguuuugguuacuguuuuugagauaaggucacaucaaguuacucuugccuggucuggaacgugcuauggagaugaagacaccuggauacuaguuuuaaaggcuugugccaccaaugacuaaagccaagggggaucuucuaggaauacaacauaggaggcugacgcuuuugaucccauugcugggagacagagacagcugaguuugaggccagccuggucuacaaguucuaugacagccaggacuacacagaaaaaaaaagacccuguuugggaaaaaaagaagaaggaggaggaggaggaggaggaggaggaggaggaggaggaggaggagaaggagaaggagaaggagaagaagaagaagaagaagaagaagaagaagaagaagaagaagaagaagaagaagaaauaaaccauaggagaccugaaagaaaauucugcuguuuagaguuuuucaugucaauggugaggaugaccaugugauuauagcauuaauacuguuuaccuucagggaauuuuaguuggaguggggggggggggggcuggaggggcuggaauaggaaacgcuuuacagaagugaggucuugaagguguugguacacuuagaaaaugguaacaaagugcugagaccaggcaaaccaccuaaggagcagccuucucaacaguggugcgucccaccgggcgugugaagacugaggaaacugcuugaaccugcacgggcuguguucugaaucugugauaaacaacucugaccuaaggaugucuggauaaaaaucugaagcucugggaaaucgcacuuucucaugauuuuaaccuaguagccuaaaaacuaaaauuaugaaauguuagacucaugacuaacacuuacaauagucucugggaugaucuguaaugucuuugcaguagaaaaacacuguacaacacgagagcacagcuggccaugcccauccaggagucacucgaauacuaaccccaaacuggccggacaggauccggggagccugcagagggcaguauugcuuucacacaagaaagaccucuaagguuccuuggaggcugcagcugagagguugcuuuggggugcacuugucugucuugaggcaagcaggccaaaagcaaaacuuccuuuuuccuuguccuuuuauauaggcugcuaccaggacgcgugacccagauuuagggcgggucuuccagucucaaaagacccaaucaagaaaaucgcucacaagcacuacccagcuagcugggguuuuagcugauuccagacgcagucaaaaugacaaccaagauuaaccaucaccuaugagcuaaacuaugguguuaaccuuuagaauuaacacacauaauccccacuuuauuucuguugacgcuauagaucuuacagacccuuccucuuccucucccuggccuggaacccagcccucuggacuuuaggcuacugcugucccagccuagaauacuuuccuccccucccccaaccccuuaagauaccucuugaaaccugcucuuuggcuuuugcuuuguucacagguacugacugcuucugugcucaguuccucguuaccucccucucuagggacucagggaagcaagccgaucugugcuauucgcuaacuuaaggcccucgagcagaaaaucccuaaggugcccagcuaacaggaaaaguacaggucaccaagcagguaaacucucuccacuugaaaucagaaccgcaucucaguaaauacuaguuacaacaaucauuucaaaaaguacaaacaggugaaacucuuuaccccucuauuccgcuccacccuugagaggccugaaccugggauccggguucccgccaaacuuccgauccugcaagaauagaagggcgaccugccaccguagggaaacuuccucugagcgcccaccgccgagcgugcgaacuacucaccgggugauggcucugagagauggcagagcaagacaggcggcggcucugcggagaacaaggagggaccuucuggggaaucgaaacugaaacuuugccucucgggucuuuagggcagggcucgccuuugcucuucccugucugugcagcgccccugagccccaaacgagccagacgcggauagccauggcuuccagucccgacccgccguccccgcuacucguacggcugcgggaguccauccccaaggcgcacaggaagcucgagauauacuuccagagccgggccucgggagguggggagugcucuguccagcccgugggccccagcgccccggacaccuacgaggugaaguuccuaaaaaaagcaggugagccggggcaggggaaacagggcaaggcucgggugcaaggguagaaccagcagguuuccaaaccgaucccugcaugcuuccgacgagagcccacgcgaguguggcucucugucugugggagagugcgguccacagacucccuccaucccacaguggcggagagagccucguaugaguccagccgcugaugaggucgcgguucgacuccaucugagaauuucc

SEQ ID NO: 8234 - RNA, 44339 nt, Mus musculus
cuagcccccuucccgcgucgcgacgcacacagcucggcggagaccgccucgcugagguacgcugugcgggucgggcccugagguggacggacgcggggaaagagaugagguaacagacccgagauggcggcugggauggaggaaaggcccuaggggggcggggaagcuaggacgccagacacccagggcagaacugccuggcggggccugguaacgggagcgugggccuccuccgcgccgggcccgcagguuugguguggaaacggacgccugacgagagguggcggccgggcccaggccuggggccuccugaggccuagcugcucugaggcgggucuggaaccccagccgcgcccccucaggugaugugaccagacuggaaaccucuggaagccgcgcaguuaccuuuaagggccguucauuuauuuauuuuuucuucuuucuuucuuucuuauuuauuuauuuauuuauuuauuauuuuuuaauuagcccuuuaaaaacacaggcuuuucccgccgggguuaggaccugaggagggggcguuuccggaggcgacggagaagccuaggguuagggguaacugacugcuguacguuuguuucuggcauuuguuucuguagugauuccuggaagcacugaagagcgcggccuugggacucuugauuucucagagaucagucuagcaguaggguaagagcgucaauugauugauaauugccuucacacacacacacacacacaccccaccucacagaaguguuaugaaguaggagaaagcgugcuuuguauuggaggauuauucagagaaagucuacagugagcccccucaggugauucuucagguuaauuguggcaucagacuaugcuuucagcacuucuaccuuaaauagguuugucaauuuauuuuuuucagauggaugagggauuauuuuuugccuucuacccuuuaaagauacaaggagagauuguucaauguauuuaugcacgaagguucugaagccagaaucucugggcuuguacgucagcuucauacucucaaugugauuuuugugcaagcaaaucaaacaaauguguuuaucauuagaauuggggaaauaauaauagcuauguaaaaaauaaugccauuccuuagaauuguugaggugguuaaaugaguuaauacaugcucucuaaauaauuauuuuggguucagcaauacuuucauauuuuuagacuuaaucauugcugaaugccuuauaaauuuugaagucuagggacaagggauggcuauuauguucauagaugaaaacacugguuuagagaaacccaggugguugauuuuguggccaucuaaugucaagagggauuuguucaguggcacaagugaguggauguauacuuucacauugauuuuauuaccauauuguauaaaguaauuugcaaucagaauggccaccagugaagggaauguuuaagcauauuuugaugaauucuuacaaagaacaggauaauguagacaccggaaagaguaagacaacaugcauucucuuggaaaguuuuacaucuucuacaugcuaggaauguuauugggcuuucuuuaaaauaguuucaguggauuugucuauuaaugauuuauauuuuacucaagaagagggucucacuauaguucugguugucuugaaacucacuauauagagguccgucuugaacucacagagauccaccugccucuguuucccaagugcugagauuuaaaggcaugugccacuauguccagcuaaguuuuauuuuucuuaacugcacauuuaagaugauuaugguaacuauuucauaaccccauugaaaggauaaaauaaugcauuaaaacccauuuagcacaguucuucauaauaaauauguuuauuaauuaaaauauguuuuauauuaaugauacuauugagcuucaaauacuuauauagaaaaguuauaaagaaaaguuuuaguaaaaaacuauagaaaacuaccuagaaaacuauauagacuuauauagaaaagcuuuaguaaaaaaaaauugagguguggauuuuugaauuuuagaauugauagacuauaaguaauuuuaaauuuuguuauaauuucauaacauuucuuaggucuaguaugugggguuuuccaaaccaucuccagguucagugauuagguggacgggcucacaggauucaacacauacauugucuuauuuguagcuguacuuuauagugaagauauguaaagcaaagucaguaaagugaaaagaucauauaggauacaauccgcagaaaaccaagcacagucuuccaagacccacuucuaguagaauuacagaguauacauaauuucuuaaggaaaacaguugugaccauaccugugaaguauuuucuauuagagaugccuaucagacacucagugaccagaauuuuuacugguuuguauugaaagauugguucuuuaugccaauacuaagagguaauggaaccaucaagauaucauugggcucaccacccucaaaagaauugauaaaguuuuuguaagaguuuagauaguccuuaagagaagacuguuaauaaaaaggccugccccccuccuuagucucucucaagucuuuugugcuauauaucuucuauucaugcuaucauaccaucuguaauaugggaaagccaagacaauuuucaccagaagccagugcccugacauaaggcccuugaacuuccagaacugugagcuaaauaaaccucuugguaaaaugccucagguaucuauuauguauugaaaaucagacaaagaaaauaccagaauucucagaaucuaaaaggaaaacauguuuauuuaccacaaccauuauauuuauaauagauuuggcacagugaucuaagcuuauaagagaacaauaaaaauccuucugaaauccacauucuagauacuagccaacagccagucuuguaaaaugaccuuugaagaaaaggcuguaguuaagccugccauaucaacucguuguacagucuguuucuccuguaugaagucuauauuagaauuguugcacagagagaguaaaugugaagcugguacaauuucugauucuuaauacauuugaguuuuuaaaaauuauuauguuuaagcauaggugguagaaaaaaaugaagccagccgguacagacccaaggaucuugucuuuagcugcugaaguugcaaaaaguccugaacaaaauguuccuguuauauuauugaaguuaaaagguaagaaaauacuuuuauaguuaggaaagacauuagguaaauacuaguucugucaugacacaauguuaguauuuuaauuuguuuggagaaaccuuaacacuguggaauaaaauucucuuuuuugcuauauuuuuaaugaucacaacauauaaauacaaguaucucuuggaugaauugagcaaaaauaaguauauauuauuuucuuuuuccuuagaaauaauaaacaacaccccuuugggaagcucagaguuaaagaaaguuaaacaagauauauauuguuaugaccucauucaguauugucuauugguccucagucaagauucuucucgaauccagggugguuggucuacaauuucccagcuuacacagauacuaagguaaaaugaagcaaacagaucagcuuguucuaauuuucaauaauuauuuuuuugucauucuauuaagaauaggaaucuccuauauguuuugauuguacuuaucuuucacacuguaugcucuuguuuguaacuucaggugcaauugauuguccuaagauuucuuuacacaugauuaugucguuuguuugccacuugaguccuacuuaacuaauguauucuuuuugacucaaauauuugaagaaauuaaagcucuguacuuggaaaacuuaacaguagagauugaguagcagugguacuugauacaaacacaaugaauaggugacagaaugaaaguauauagcaaagaacuguagaagaacaaguauagaaacuucauuucauuuguaaugauauugcuauuuaaacuguauauuuaucaggaagcccaaauccuguacaugaaauuuagaagcaguguuuacuuuccuacugccauguuaaaaauagaaagaucaagauuuuuuaaaaggugaugaugaaguguucucaguaccugaguuaaucuuccuucacuugcauuugauuuuauaaaauuuguuauuuuacauuauguguauaugucagugucuguauguggguauguguacaugaguacagguacccauagaaaccagaagaguguauggguucugaauuugaguucugguauuuuguaagaguagaaagugcucuuaccuacugagccauuucuccagucacaccccauuugauuucagaugaacuauccucacaggagagauauuuuucauacuuacacuauucugucuuagauccuaacuuucuaaauugcuucauucuacuuuguuauuacauaaaggccuaauucaaaguaugcaguuacaaaaaggguuaacaaauuuauguacuuuuuuauacuuaauuuucaagauuauuucaauauugauuaaacauaaguaaauaaaugcuuauauuuuuguuuugaugauacaugcuaguuuaugacaauauugguugaauauuacuuuuauuaaugcugucuuucauauagauaugcugaguaauuagguauaagaacuaaaaagaaaguaaaaacuucgugauagcaaguauuagccaaugagguuuuuugauuugggggguuuuuuuuuguuuguuuguuuuguuuuuuugguuuuugguuuuugguuuuuugagccaggguuucucuguguagcccaggcuguccuggaacucacucuguagaccaggcuggccucgaacucagaaauccaccugccccugcuucccaaguacugggauuaaaggcaugugccaccacugcccggcgccaaugagguuuuuaacaugcucaauuuguaauugucauuguuuaucaguguguacauauuuuguugaaaagauuuagucaauagugauuacuuaucauacuaauaucuacuuuuggguugaaggcucuuuuugguauaagacuacuauauaaguacuuuuauuauugauauuucugaauaugaucaacucauauccagggauuagcuuuaauguauaauuuuaagaagauaauuuuucuauaaagggcuuuuuuucaauuuuuuauuagauauuuucuucuuuuacauuucaaaugcuauccagaaaguccccuauacccucccccgacccuguuccccuguacuggggcauauaaaguuugcuagaccaagggaccucucuucccaaugauggccgacuaggccaucuucugcuacauaugcagcuagagaaacgaguucuggagguacuggcuaguucauauuguuguuccaccaauaggguugcagaccccuucaguuucuugggugcuuucucuagcuccuccauugggggcccugugauccauccaauagaugacugugagcauccacuuuuguauuugccaggcacuggcauagcuucacacgagacagcuauaucaggcaggguccuuucagcaaaaucuugcuggcauguggaauagugucugcauuugguggcugauuaugggauggauccccagguaggguagucucuggaugguccauccuuucgucuuaguuccaaacuuugucucuguaaccccuucuauggguauuuuguucccuauucuagggaggaaugaaguauccaugcguuggucuuccuucuucuugauuuucuuguauuuugcaaauuguaucuuggguauucuaauuucugggcuaauauccacuuaucagugagugcauaucaagugauuucuuuugugauuggguuaccucagucaggaugauauccuccagauacauccauuugcacaagaauuucauaaauucauuguuuuuaaaagcugaguaguacuccauuguguaaauguaccacauuuucuguauccauuccucuguugagggacaucuggguucuuuccagcuucuggcuauuauaaauaaggcugcuaugaacauaguggagcauguguccuuauuaccaguuggaacaucuucuggguauaugcucaggaaagguauugcuggaucuuccgguaguacuauguccaauuuucugaggaacugccagacugauuuucagaaugguuguacaagcuugaaaucccaccagcaauggaggaguguuccucuucuccacauccucuccagcaucugcuuauaaagggcuuuuucuucuuuauuguguauuauaaaauguuccuacuacagauagguuaauguuuuuacuguuuucccuucugauauaagaauaaacagauaauuugugggucuuaagaaagaggaauaguuugaaacuagaguguuugauuuucuuaucuuucuucccuaacgauuaaccucaccccagauauuuucagcuauuagauccuaaaauauaucaguuaauagaaauuaacaugaauuaaacagucaagguauucuuugccuuuagggugauaguagccaauucccugaaaaguucucucauuuuuucuugacuguaaagcaaguaucuuuuauauucuuuuguucucuuuccuucucucucucccuuuuguccucccuccuccccucccucgcucucccuucccuugaccucucucucucucucucucucucucucucucucucucucucucucucucucucucuuuuuuuucuuuugagacagggucucacuauguaaacuuggcugaucuggaacugauuauguaaaccaggcuugccuugaacucacagagauccuccuguguuugcuuucuaggguugugggauuuaaagaccuauaccaucaccuaggucuaucuuucauuucuuaaagaaccagcauauuuguuuucaggauuugugaacccuggaacuaaaugcaagcgagguccauuucacagcuuaguuccuuagaaagcugaaauuuucuagcaacuuuuuaauuggcuugucaacaaaagaaugacacuuaagguucucauuaaggcacaaugccuauggaaguuagacuauucaaaugauauuuaugauuaauacaagcuuauacucuuauuucagccauugcugugugggcuuagagccaggagaagauggagaagaauuuuacaaggaguuacuuccaucagcugcugaaaauuuucuuauccuggggagaagguuacaaacauguuucaucaaugcaacuaagguauaaguguuguauagccaaauaauuuucauuuuuuuuucacuguauagcccaagcuagcuucauauucgguguauagcuuugcaggucucaagaguuucaguccuuuuguuucaaccuccucagcacugggauuacuaggauguaugccauaucuaucccuuccuaaguuauccccugucauuuuucaaauaugccauaucuggcugaacauacaaguagagaagugaauuuaaacaucuuuaagcuaaaaauuacaaccaagaaauuaaucucuaaauuagaaaaauugaaaauguuagcuaaagaauacuguaugauuuuuaaagaguuugucuuaccccuuaaugugaggaaacaugcauauauacuuauauccacggcauaacuucauuccagacuguaauagcuguuucagacuuuuaauugcugacacuucaggcuaguuagaccauagcuuuuauuuauuuuauuuauuuuuuaauuuuuuugguuuuauugagacaggguucccuguguaguccuggcuguccuggaacucacuuuuuagaccaagcuggccucgaacucagaaauccaccugucucugccucccaagugcugggaauaaaggugugcaccaccacgcccggcagcuuuuauuuuuuauuugacacauaaaguuuuacauacuuuaagggaacuauguaauguuuugauaccuuuauauuuuauguaauguuuguauacagagaaaaagagaggcugggaggggaagagggaagaggagaucauggagaaaaugauucuuugccuuaucaaguaccuauuucagaucuucagauuguggagcuguugggcaaaauccaggccuuguguauggaaaucaguauucuaguauccaggaauguucugcaucuagucuacuuucuguaaagaagugccacaucaguauaucagacuuugaaaauguaaucugugaacacacccuagaacagcagcaaaugccauacuaugcuuugaauuuguaauaaggccuuuucauuaugagaagcaaacuuuugaagaccuuguauucuaccauccuuaaguguccaacccuguuagaucuauuuucauauuucuuaguguagaacacuacguaugcuguauaagcaaagaauccugccuaaugagaagucauuaggaauuuacuuagcacuguugcuuauuaagguagucauguccuuuaucuguuggaugguauuggcagcuucuguuuccauucuuguagaugacuaaaucaaucauauaacuaacuuaucaguuucccaucuauggugcccauucuuccucuaaccaacuugaccugaccuuaagugauuaucaagauugucucacugugcucagucagaccuugaguguauuugugcucaguccucaguccuaacucugaggguaggaauaggaccagaaguugagaauuuccucaucuucaguucuuuuugaguuaguugaauuaagcuagcguagaauggccccgcagggaauucagauuccaauuugaauaccaaagacuucucaucuucauuuauuaugaauuaccauauaggugauuggaaucaaacccagguccccugaaagagcagccugugaucuuaaccacuaagcuaucucucuaccuccuuaauuccacucuuucaauuauuuuuuuuaauauguguguuagcuaaacaacauuuauaugcaguaaucacacuguuggacuuauuauauuuauuuaaaaggagugagauuaauaucaaaacaucuuuacuccuauguuuauugcagcacuauuuacgauagucaaaaauaguaauaaccuaaauaucagaaaucagugcauaaauaaugaaauaaaaagggcagauuucugucauuugcaacaccauggaaagaaaugaaggccaguaagugaaguaggccacaccagaaagucacauacuguaugaauucaaugacauauagaaucuaaaacaagcucaucuccuagaaguugagacuugaaaacugguuaccagaggcuagggauaauagaagaggaaagaugagagaaaguuuaacaauggguauuuuguaauauuuaguuuaagguauuuuaugucauaugggaugauuauauaugauaaugguaaaccuuuacuuuaaaaaagaauaguuuuauuuugaauauuaaagaaauuaguaaauaguugucucauuauucugacauucauauaaacucaauucuauugagaaaacugcaagcucauauaguuuauagcaacuccuaauuagccauuaagagaauuauagacuagaaauggcucauggccuuaggacuugggaaguugauucaguaggacugcucagucccaagccagccugggcuacugagugaauuaccugaaaaucagcacaagacagguuuacuuaacguauaugauauaaucagaaauguaaugugcauaggaaagaauagagauagaaagaccaauugagauagauuuuuuucccccauuuuuuccuaggauagagcuucacuaugcagcccaaauaauguuaaacucacacucuuccugccucagucuuuugacugcuggaacauagauucccaucauuacaccuugcuaaaaggaggcuuuuuaugagugaaguauuucuugaucaugagucagacaggccaauuucugggaguuugaggccagucuaguccguuuagaauuccaggucagccagguaaugaaacccugucucaaaauucaaaacaaauauauaugguagcucacaaccuccuauaauugacgaccuucucuucuggccuccucaggcaacgcuuagaugugaugcgcauuuauauacacgcauggaaaaacacucauacauauuaaaaauaaaacgaauggaauucaaugagaaauuuaacaauauggacaauauaagaaauauuguuggcagaagauuuaacucagagaucauauauucuacaucuggaauuuugguggccauuagccuacuuggaagcuuucaagaaaauuuuuaagaauuugauauuuguggguaguauaaaauaugguaggacauauauuagauguucuagcccaggcuacauauaguuuuuugaauccauaucaaaagagaaaaauaccuauucaagaacuuugaaauguuuuaauggcaaauuuuguuaacacaagucagggguuauaaauuaaugauugacaucaucuaacaggcuuuuaaaguauaguauagacaucuagaaauacagggucuuucuuugauauugacaacaaaaaauuauggugaccugucuuguuguaucuuuggaugaaauuagaaaagcaauuuacuagacuaaggaaucauaguuuaaugugacacuuuuuacguuuggugguuuuauaggaaaagacaaguuauuuaaguuaauguguguuuuguuugcuugcuuuaacuguugcuaucaauuuuaugguacaguagaaacauucaggaucugaguugguuuauacaacuuuacauuaaaguuaaauagucagcaaaugacagacauagucaauguaaucuguuuugucuccuguuguggcacuauuaauaccuuuucacaagauuaguuucagcaaaaaacauuguuuauuuacuugguauauauuaauggaacauuuacuauacaucagaauuguagacagugaauuauaauaggcauuauaauuauaauagaauaugaauuauaaucgcaugcucucugcucucauaaaguauuagaguagauacuuagaacuggaaaauucuauuaauaaugccuaacaugcuuacauuuucauauuaucaggguuuuuaauccuggcuauauaaugaagucacucaccugacugugaaaauacaagugucugggcuuuagcuuuggaaauugagauccuguauauuuggauaugugcagagagguuguuuaaaaguuccacaaaucauucugaugcauuucaagcauuaaguucuaguguauccaucuguaauucguaagcuacuuacuuuguuuauguuuugucuggguaauuacuaugaauuaggagaguucauauacuaaaaccacagguugcacaaaugaagaaacaaagcacagaagaucagguacuuuauauauaaauagcuauugaauuuggaaaucaaggcugcugacuacucuggagaagucuuaagaaaaguagauuagaaaaguaaauugguuuuaucuuuuguauuaagggugaagagcaagauaaauuacuacauuuuuuccaaauugugacugauucucucuucugguuauugggaggucauguucaacugauacagaaugguaagaaagaaauacugcuuaauauaacuaaugucaugcagcauuugcuuuauaaaugcccaauuaaaggaacuauuccugaaauauaacuuucuucuauguuuagaaaaucugagagauggauucauuuaaguuugaacuguuuaggaaaguaauuuuuuaaaauuauaguuaguguuacaaguuuagcuuuagauuucuagagaaauccccauauacagaguaaauagaguuucacucauaaucugaaaggacaagcuguuauaaaauuuuaccaaacuuuaaaguuauuucauugaauauuguuuuacauugaaaauuauaaauauguauuaauuuuauguuuucauaggacuaaaaccguacucuuuuaugauaaucaugacacaauucuuacucuuuaaaaaauuuucacauuacauaaaugcuauaccaugguuuuuuuccccagauauucacacuugaaucuuuaauucuacauccuuucagaaucauucaugcauguaaagagucacauaauucuuuaaguauaaaagcacauuccuagggauuguaaucuauaccauuuaccacuuucuaaaggcuaccucuuugauauuaguguaacuaguacuuuugguaguuguagccauuuagcuaagugagugacuaaauacuuuuuuauuuaaaguauuaucuuuuuuccuauaauauauaucaaccauuguuacaaauuccuaauuuaaagacuuuuuaaacaaaaaauauaaggcuguuagacuugacuugauauaaaggcauauaaaggagaaagagaauacuugaaucauuuuuuaaaaugccauauuccauuuugaaaagaacuauaauaaaaugauaguauaucuaggauuaaugugaaaccauaauauaguuauaaaaauuuguuaaauguuuauaaaauuacugagcaaaaacccaaauauauauauuaaaauauuuuuaauaauauuuccauguaaaauguuucacaccuaugaagaaaguuacugaccuguaggccugggauaggaaguguauacaaaugaacuugaagugucuuaaauaccagauauaaaggaagcaauuaaacuuuaccaguauuaaaaggacucagaagccaacacacagaggccucuacuaggacuggugagcuggcucaacagauaaggagaggaauuuuuauuuucguuuaaaaggcuucugcuagccaaauaaggaaaaguugaguuaaaaguuuaauauaccagcuaaaaguuguguaguaaguuuaacacaccaaauguugcuguugaagccugccagagaauacauuauuuuugaauaaaaauuaaccuaaaucuaacuuuuauucuaccauauacaucaaugaaauuuuccucuaugugaaaggauuccauaaauuaaugaagagggcaugaaagaguagcaccuauuuugcaaucucucaugaauaagcagauauaggaauuagcuaccuauuccugucaacagcuuuaaaaagagacagcuaaacacucccaaucauuaucauaauaucacagauaaaauucaaaaccaaaauuucaaaucuccaucauuucaaucaucuaaugccaacuaccaaguuugaggaaagcaaagaaacaaauuacacuccaggaauacaguggcagaauuaaaccugcagaagcuagaggacaauuuacaugguuuuguuuucugaauaaauuacagaaaaaguaaaaauggaagaauaauugauuuuuuuuuaaagauaaccauguuucaugaaucuuacuagaaucuuaauugaaacaaauuuaaaaauucacaaaccacuuauagguuggaaaucuuaucuggcuucuugaugaaauuaagaaauaauuuucauuaagggauauagugguuuugcuuuuuuguuugucagucuuguuuccaggcuauguugcaauguuuauggagaaaauaaucugauggccuagauuuguuucaaccuacaaugaaagcagaugagaguauaaauaaaacaagucuggccaugaauuuauucaugguuaaaauuuauugacuugcucauggggaaucauuacauuauccugucuguuuuaaguaucuuuaaauuuucuauuacaaaaaaauuuaaaaauugauagguccuuuucuaacaaagaaaaaggaaaauuuaugaacuacaugccauaugauuuuaguaaauuucuggcuauuuccagagucauuaguaagaguaugacacaaauagaaaauacacuuauuguaauuacagggauuuuacuuuuaacuacuagagaaacaauguaaaacagaacuauguuuuuuccaugcuauuauaaaaugauauguaauggauaauugggcuauaaguauaacugaagaacagguguuggugugggaacaaacaaauagaaagcuacaguaguguuccacgggccagcuuauaacauaucuguccuuauuuuuaauuaaucuugucacucaacugacguaaggaacagaaacugacauuuauugggaacauaauauuuucuagaacauaugccuuugccuguuaagagaguuauuuauuucuaauuucacagaugaugaaaugaagauuaugggagguugucuuaguuaggguuacuauugcuguggugaaauaccaugaccaaaaacuacaugaagaagaaagaguuuauuugguuuauauuucuauaucaauguucaucauugaaggaaguaagggcaggaaccuggagucaggagccaaugcagaggucauggagggcugcuacuuacuggcuuguucaaugugacuuaacucagcuugcuuucuuauagaagcuaaaaccaccagagcaggaaugaccucacccaugacagacuaagccaucccacaucaauuacuaauuuuaaaaaugccccuacagccugauccuguggaggcauuuucucaauugaggaucccuccucuauagcuuaugucaaguugacacaaaacugaucaggacagagguuaagcaacuuauguagacauuaaacaccaaguuuuuguaacuggcuaauggagccuaaaaauuauaaaccuaggaaaauuuuuuauucagugaaacucauuuguagaaaaaaagauucagauuuagaugauguuauauucaauuuaaaagaaguaauaauaaaauuuuagcuugguauuuauagauggcccauuugacuauaacuaacuucauaaaaaugaaugacucuaacuaugaccauuuaaaacugcuugcaucuauaaaaaucuucauuauagggcauucaaugccagaaguuuagcagaaaugaucaaacuuucauuugauuuuaaaaaagacaaauccuuacuuagguuauuauaaaaucuuuaacauuucuuuuucucucuauucuuuuaguacugcagagugaucauuucuuacacuugcugcaaacugacaauguucagauaggagcuucagucaugacucugcuacagaauauacuacagaucaacaggugacuuaauuuacacaauuuuuaaucagaagcauuacuaauuuuaugauaguuugucaaaaucuacuacauaugacuuauacaugaaauuuaaguucucuuaugauugacuuuuaguaaaagguaauauaaaauacuauaaaagauuagaaauuuguuaucaaauuauaaucuaaaagcuauagaaaauuucaggcuuagaaagagaauuuuugugacaccuaaagaaaaauauugggaucacaguaaaaaauguuuacuuacauauuuaauaagcagcaaauuaaauaucauaguauaugcuaaaaaauagcauaaaagaaguaauagguaauucuuaggauccaaacagaaagaauguacuuaguggaauuacucauuuuuucacuugaauauggguuuauucaucaggucucauggaccacaauuacuguguuucuccuaguguuuacaauguuuauuuggauauaaucuugucuucaaugagugacaguugaauagugagacagaaaucauuacauuuugguauauuaauaugcaauguuaauguuauccacaaauguuaagaauuguauucuaacuaaacugagugaagaugcauccuggagaaguuaaagcccaagaugaaacuuugaagauaaauuguccagggaggaugaggaaaaagcaguauuucuaggcagagguaacugcaugagccagcuuuguugucagacaacagagaagcguuaugcugugggugaaaguagagaagauuuguccugcugggauuuaaaguucaguaucaguuuauagccagcacauuuugaagagacuugauauauguuauaaaagcauaucuuaaagacaaaaaaauggaagauuuuuuuuuaaguagaugaguauagucugauuacauuucaguauuauuacucugguuacugauggagaaaagaugagagcaaaacuagauaaagaagacaauuggaagaguagagguauuuuaggguugggacacuugccuuggauguuaaacauccuaaauuuuuugcccaauaguggggaaaaauaugaggcagaaccauagcaauucaaguaaaguaauaaagucuuggaagugguaauagggauuuuuuuuuuaauuaaaaucaccagaccuuuguuucuacuuuagauuaaaauagaauuacaaggaugaauuuacuggaccauuaggggaaaagaaaaagacaaauuaugaaggaucaauuccucaauaaacugaacacgacucaguauaugaaugaaaaccuagagugggauuggggagaguaaguaaauuuaggguaauuagcuuucugucauuguaacaaacuacgugagauaacagauauauacagagaaaagauugacuuuggcucaugauuuuggagccuccaguacaugacuauuuguccugguuugagccuguagugaggcaguguaucacagugagaacagguagcagggcaaagcuacucacuuacagccaugaaguaacacaaagagagaaaggaccaugccccuaaugaucuccaggccucccaguaacgucccacuccuuaaacauucagacaguucccaauagcuccuuccucgagacugagcuuugcauacaugagccuugggagcacauucgagauccaaacuguacaaaaagcuucauagcugcccugaauuaguacuaaguuuuuaggaugucguauagcaggaaaguuugaguucaagaaauaaauuaauuaaauuaaauauaaaaacaaaaaacaaaaaaaagaaaaagaaaagaaauaaagcugagaaucuaagaaaaacaagaugccgaaaauuuacaagacaaaauacuagcaaagaguuauauuagagaucuauagauggguucucuucaaaaauguaguagaguaccaaucaacuuauacauguaaaaaaguacccacuucuuuuaaauaugagggaacauuuucuaaaaggcauaucuagugucuuuaacucucaguaaacuuaagaggauuuaaauaauaacugggcuauaacuggaaugagguuggagguuggacaugagugaugugcagaucucugaaaaguaccuaaauaauguaacacaauacaccuacguaacauacaagacaaagaagaaacugaaagaaaaauaggaaaauuuuuuaaauaaacagauugugaaaauaacaugagaauuucugagguacaucuuaauucaaacaauacuuaggagaaauuuuuuauuuuaaaaaucucaacucuuaaccuaaagucaaugaaaacaauagaaaagauaagaaagcauaagcugaaucugagaaaaugaaugaaaugaaccuacagcaaaagugguuaggaaagaaacagagcuuccagcaacuuagguaaaaauuuagaggaacaauaucauuuacugucauucaaaagucacaaaggagcaauaugaacaacuuuaugcuauaaacuuaacaaguuagaugagauagacaaguucucuuuuuaacacugcauuuuucaauuuguuuuucauacaauacugaaugaaaaaaaaguagaaaagaaaggaacgugauuguuccuagguaugguggaggagaagauuuacuguagaaugugagagagcauagccagaagcagggacaucugggagagccgagaguggacaugacccugauccaugugaggaggggggagggggaaggagaggagaaccagguacagcagcgucaaugccuaaagaguagacaaaagagccaggugggauuauauaggaaagggcagcccagcuccuagguuggagaaguuugggguaggggugggguaugccaaccaagagggcccuguaacagguaucuacugaggaaugcagagagaaccuggcagccagcaucuacuuugauguguuacauaggcaccucugccauuugucccaggcuugaaaccuaaacauacauuuuuauuuuuaauuuuuuucccuuuucaagacaagaucucucuguguagcucuagcuguccuggaacuuacucuguagauaagguuggccuugaacucagauauucaccugccucugucucccaagagcuaggauuaaaggcgugcacuaccacuaccacuaccaccaccaccaccaccaccaccaccaucugccuggcuugaucaagauuuuucgccuuuccuaguuucuuucagguccucccuaccucucccuaguaccuagcaaacuuuauguucuuuuucucucuuuaaaaaugaaaaaaaaaucaagaaacacagaaccccacuaaaaaccagaaacaaacauaaaaacaaagaaacaaaaggccaguaaaacaaaagcccaaacaaaacagcaaaacaaaaaguucacaauaguaauaaaaaaaugauaguuaaaaaaaugucaaagggccgggcgugguggcgcacgccuuuaaucccagcacucgggaggcagaggcagguggauuucugaguucaaggccagccuggucuacaaagugaguuucaggacaaccagggcuauacaaagaaacccugucucaaaaaaaaaaaaaaaaaaaaaaaaaaaaaaaaaaaaaaaaagagaaaaaaaaugucaaaggaaaugaaauguucuuuauaaauuaagugcauguaugucauuuauuuguugaaucuuauugcagucuuguaauuugucaccuugaagacuuagaagcacuuguuuaaucuuacaguuuuuuaaauuuucaauuuuauaacaaguuucucugagaggaaagaagggaccuucauuuacuuuguauuuucuauuggaaauagaaagucuaugguuuccugcccacaguaggaaaucugaaauguuaguuggcuuaauaucuuagaauccaaauucucagaaccaaguuauaugcuuuaaaagguggcuaucuucaugaacuaggccaccauacacacaggcauuuaaguuacugaaacuuuuauuuuaaauuuguugugauaaccauauaugaauuauuaauuaugcuuuuuuauucuauccuauuagugguaauuuacucaaaauagaaggaaaagcccugcauucuauuuuagaugaaauucuuuucaagcuuuugucaacuccuaguccagucauaagaaguacugcuacaaagcuccugcuaguacuggcugaaucccaucaggaaauuuugauuuuacugagacuaagugccugcuauaaagguaggacauacauauuuucuuuauuugauauuagcaaagacaaaaauguauugauaguuuaugaaugguaaaauccuuauauuuugaaaaguuaguagcugaacugugcaggcaaaccuauuacaacauauaccauuuuagaacagaugucacuauaugaucaacagacaacaugcauauuuuguugaugguguucuaauaaauguuuaaucccuuucugacaaaaauauuuauauugaacauaccaaauaguguaauaaugaccaaagaugucuaugaccuuaucaauagaggagaaaauacaauugugcauuauuaucagguaauaguuaauuccuuacuuuuuacuuccuuuacucaaaaaauauuauauacauacauauaauauguaacauauauaauuauauaacaauuuuauauaucacauauguaugauauuuguucauauuuuuaguauauuauauauguguguguuuguauauaccauaugaauauauaucacauccaaacucaaauacauugauuaaaaagucauaagccuuaagaguaaaugaacucauuguuaacuaccauucuugugugaaaguguuaauuuaauugaacacuuaacugauuguaagacuauccuccauacuuacauuucauuccuuuaguauauuggauauucuuauccguauagacauggaauaagaggcaugaaaaaauuaggucauuuacuaaauacuaguuuaccaacuaccauccaaaauucuauguuagcuuuauguuguuuuuuuaaccaauauuauuuauauucaguauaguaaaauauggguuucuaguucauuaaauaugcuuaauauagaaugcuucauggcacuuuuaaaauugguagggucuguuaauuacuaaucaauuagaauaaacuuuaaucuuaaugauuugaaagacauuuuaguaacuuucuuuauuugucauuaauauagauaauuuaauuauuuuauauauugcaagaaaagagaauaagcaccaguauuagaccucuaguuguuauuaugccagacauacauuuuuucaauacugcagcuagauuucuacagaaauaugaacguccauuccaggcgcgguagcauacgccuuuaaucccagcacuugagaggcagagacagauagaucucugugagcucaaggacagccuggucuauguagugguguacuaggacagccagagcuacauagugagcucugucucaaccccaaacucuaauaaaaaagcaaaagcaacaaaaaaguaaaauugaccuuaauauucuuugauugauaaaauugcagcaguagaauuuacucaaguuuacuaagauauuuugcaguuguaaguguugcugagaacuuggaucucaaagaauguauaaugcauucaaagauccauaugauggcagcuuauuuauauuuauuaucucacauucuuuagacucaaagguuacaguguaccuuuuaugauacuguguuauuugagaauuaaaaugcaguauccuaaugucauagcacuuuuacuuccaaauuauagauguuaguuuaagaagaauugguuaaugaaacuuguuaauagcaaauaauaauaaccugcuuaagugcuuccacaagguaggcauacauagaugauauguuuauaauuuauuuucuuaagaauguuucaguuuaagauguuuguguugaaaagaaaacaaauucuuuuuucucugacuuauugcaauuauuuuagacauuuuuacauucagaugucacaagugaaggacauaaaaaugaucagaacagaggaagauuggaaagacuucaauauagaaauuguugagaaaaagaaaaaccauauacuuaaucaucuuguuauauuuauucauuuucaaaccagacuuuaacuucauuaauacuuagauaacaaaaaaaucuuacuuuauugauaauuguuuuguuuuguuauuauauuucaggacuuagaagucugcuaaauaaacaggaaacucuuacagaauuuagucgagaacuuagacagcucguugaucuuuuaaccccuaagauccaucaggaaguagaagaacagguauuauaaaaauaauuugugugauauuugauaacuguauugaacuuugguucuuccuaaauaugccucacuuucguucucuuaacacuuuaagcaaaauauuauuccugcccaguagauuucaauuucaacacaauuucaaucucccuuuuauaucuauuuauacauuugagcaggccaauuuuuuuucaugaugucucaugaaauccccuauuuacuguuuuaucaguaagccauuuaaacuucauuuucauuaaaaauaucuaucauuuuacaagcuauauauggccaccuguggcgagccuuucuuauucauugauacaaaauaauacauguauaaaauuauguuugauaugugagagguuuuauuuuaucacacuuccucaacacauacucaaaauggaggcuccagcuaacuucuguagaaagagacacacuuuuaugauuuucaggugaggccuuaaaauaaauaugaaaaauagucuaaaauaauaaaauauauuuuuggaguaaaaggaaaugagauaauucuguaccuaaaaucuuaaaugguaauugaaaagaagugcaguuuaggcaagagaaugaaaggagaaauuuggaaggaagagaguaaaggaaaagaauuuuacuuccauagacuauuuucaacauuauacaggugaugaacauacucaaaacagcauccuaaaagcuuacagaauuaaaacagauuugcauuacuacacauacauagucagcagaacuuacauagucuaggccuaaucaaguugauaauucuaaaaggacuggagcaauggcuuaacaguuaagacuguguacugcucuugcagagggccugaauucuguugucagcacccauguuggauggcucagaaaugccugcaccuccaguucuagggggauuuaaaaccucugccuucuacacaugugcaugcacacacauacgcauaauuaaaauaauaaagauaaaucuuuuaaaaguacuaaacauuaccaagauagcucccuggccaugguggcacauuuaauccuggugcuucagaggcuagggcagcaggaucauaauauuggaucaacauuggcuaucuaacaaaauguaguuucaaaaacaaaacccaacaaaacaaaagacauuagcccaaaauaguuuaugaaagauuaaggcagaacugugaaguccuugaaaaggaaguaagaucagaagagcuaacuagacugucuugaauauguucuagauguuaccugagcuuagcaucuuaugucuggaaagugagauauagugaguuuacuuggacguuuugggccugaugaacuucauguuucuggcuacccgucugucucagaugaugauuaccacuuauccuggccugcgguuuuaaaagauaaacuucucaaaaagacuuuuuuagagauguaucaaaauuauuucugguauauaauuucagaaacuacauaaagcagcuugcuugauucaagccuauuggaaagguuuccagaccagaaagagauuaaagaagcuuccgucugcugugauugccuugcagaggaguuucagguagaaaacccaaaccaaacuguugguagaaaugauaaucuagcuuugcauguaaauuuguaaucccaccgacccaccaaaaaaaaaaaaaaaaaaaaaaaaaaaaaaaaaaaaaaaaaaagaaaaaaagaaacaauauaagagcauuaccagagcacaguuaaaugcaagugggagaggggaguguuugugugugugguuuuuucuuuucuuuuuacuuuccuaauguguguuguuuuauucuugucuuuauucuguuccauaguguuacugaguaccaacgcucaaguaaccagguacccuuucagaacaaagggcauaauaagacaaaucugauggaauccaauacucaauccuguccacuuccuauccagguuugugggccaauccugaagagggagccagugaaauuuauauuauuaaauccucaaaaccagcagugcucauaagugcucauauauagaauuauauuuguggauacauaaagauuaaagauguuaaccaagauuuccugaguaaauauggcacggguaacugugauccuuuagauaugacaaaacugucaaucucuacaucaguuauauugaaaaaugugggucacuuucugaugacuaaccuagccacauucuuaaagguuacagaacaaaccauagcaaaaauaaauuuaaaaaguaguuaauacugauuauaaaguagacccauucagagguaacuuuauuuucauucaucauuacuuaaagcuaaauuuaacucacuaaaaugaaacugacauauuacagaaguaaccuuuaaaaacugaaaccacacuuuuaauaauugcagcugcauuucuguuacaaaaacaucuaaaaauaacuucaaaauugucacacaaucacucuauguuauuuaguagauauccuauaaaaacuuucuucuagacaaauuuaaagacaaguauuuuuacuuuugggcaugaguauuaucagcaaagaaaguaucaaguuuucaaacauucaucaaguagauugugagugugugugcacguguguguguguguguguguguguguguacacaugcauacauauacauacauagagagaggggguggaaaaaugugugaguuuuauuuauguguauauuguuuuacauauauaguuauaugaaaauauuccaaaauugugcguguguguguaugugcauauauggaaagagagaguuacagacuugaguuuguaacuggcuuuagcaacuugacaaguuaucaaaauucuuagccucaaauuucaaaucuagaaaauagagauaaugccuguguuucguagcacaggccaguaaucucaccuacucaggaaacaaaggcaggaagaacauauguuuaaacccagccuggauuacagaaugagaucaaagcugcuacugcuggacaauuuaguagagacccugucucaaagaguauaaggaggacuggauauaguucaaugguagaacauuuaccuagcaugaacaaaccuuagggugacuucccagcacuguaaaaauuaaaugaaugaauuacuaaaguucauguaccucacaagguugagauaauacauuuaggauaauuuaaaagguuuuaguauauggcacuuuaaaaauaggauugaaaaauauguauaauuucugcccuuaauguauacaauucuagauuaggguuuaguuuaaugauagaaugcauaguuagcauaaagucuaaucacuacacugaaaagaagaaaaccucaggaccuaaggauugugagcucauuuuuguagaaguguauguacagaaucuaauuaauacuuaaucauuuuaaaaauuuuaaguuagcauacagaguaaugaauuucuuuauagcauuuucacacacacaugcuguuaaacuuuguuuucacucacuccaucacuacacucaccauacuccuugucuccaccucuggcuaguucucuucccuaccucaaauagacuccuuuuuucuuuaccucuccuuacgauaccauuuuccccucucacagucguuuuuacaguuucauuaaauguacacacaaaauuuaauauagguucugcauaauugucugagucuagcuuacuuuaauuauuuccaguucuuuucauuuuaugcaaauuucauagcuuuguuuuucuuuauggcugaauaaaaccauucuauauauguaccauauuugcuuuauccuuccaucuauugauaaauaucuauuucuuagucacuguaaagaaugcaucaauuaauguggauauauaaauaugucuaugguauguuaacuuacucauuuuguuuggagguuauuuuguuugaggauaguguuguuuuauuuuauugagauggugucucauguaaccccuucaggguucaaacuccuaauuuguuuuuuugaaguauuuauuuuuguucuugcuuuugggagagaagaaacauacuuuucaagcaugcaaauucaucuaaguaaaauaaauacuugugaugcuuuacauacugacauauaggaaauauggaagacuagguugcaguagucaaacaauuugauaaauagcagaaaauauagaaauuauaaugaaauaaaacaucuuugaacacagaagacuuuauagccaguuauaaaacaguauguauuuaguaaacaguugaaaaauaccuguaucuggaggcagacuagaugacuaauugggauaaggaugucugucauccagccugauguguuuuagaucuacaggaucagcguuuagagggagaaaccugacuccuucagguuguccucugaucacacaugauucauggcugacaaaugcacacaaauagaaugcauggacacacagagacaauaaauguaguuagaaauuaacuuuuaaaaaaagauuuauuuauuuauuauauguaaguacacuguagcugucuucagacacuccagaagagggugucagaucucauuacggaugguugugaacuaccaugagguugcugggauuugaacucaggacauuuggaagagcaggcagugcuguuaaccacugagccaucucucuagcccuggaaauuaaauuuaacaaaaggaaaaauagggguguggagagauguuucagcaguuaagagcauuugcuacucuuguagaggaccugaguucaauuuucaguacccagaugguggcucauauugacaccccagucuggccucuauaggcaccaggcaugcaugucugcucaugcagacauacagacagauaaauguaaaaaacauuuauuucucauuuuuuauaaguauuggguguuuugccugcauauaugucuauguaccacauguauuccuggugcuuguggugucaagaauaggguaauagauuuuuuuggaccuggaguuagacaguugugagccaccauguaggugcuaggaauuuaacuugggacuucuggaagaacagcuggugcucuuaacuguagagccagcucucuugcccccauaaaucuuaaacaaaaggaaaagugagagagagaaaaaaaaguaaaaguuagauauaauuauaccauaaaguaaaaaccacuauugaaauuuuaacgucuuuuaaauaauuuauauuucuauguaaauuaauacaauuuuaguacaauuuuuauucuuauauauauauaauauguauauguuuuuucuuuuucuuuuuuuuuuuuuuuuuuuuugguuuuucgagacaggguuucuuuguaucgcccuggaacucacuuuguagaccaggcuggccuugaacucagaaauccaccugacucugccucucaagugcugggauuaaaggcaugugccaccacgcucggccaauaauauguauauauuuuaagacaggcuuucuuucuuuuuuuuuuuaagauuuauuuauuuuauguauaggaguacacuguagcuaucuacagacauccaacagaugguagcagaucccauuacagaugguuaugaaccaccaagugguuucugggaauugaacgcaggaccucuggaagagcaaucagugcucuuaacugcugagacaucucucuagccccgagauaggcuuucuuuuuguaggccuggcuguccuuggaacuugguagaccaggcuggccuuaaacucagagaaccaccugccucucaagcacugggauuaaagguguaugccaccaccacuuggcauauucuucuauauuuucauuuuauuuucaacuaacaguacaugucacuacguuuuuugcaaguuuucuauuuuaaaacuaaaauuccaucaguuagaugacucaguauuucuuuauucaauccacuauaaugagauacuuuucgguuuguuaccacuauaauacuaugcuacaacauccuugaucaugccuuuauauauuugauuauuucaguaagaaaaauaauagaaguagaauuggcugaucuguauuuuuuuagccuuuuuauuuguauuuaaaauauuucuucugauuuuugauauauuuauucuaacaucucuagagaaauuuauauauaagaacaauguauuucauuauaccuuugucuuaggguuuuacugcugugaacagacaccaugaccaaggcaacucucauauggacaacauuuaauuggggcuacuuacagguucagagguuuuguccauuaucaucaaggcaggagcauggcagcauccaggcaggcauggugcagaaggaccuaagaguuccauaucuucaucuguaggcugcuagcagaauacuggcugcuaggccacuaggaugagggucuuaaagcccauacccacagagacacacuuauucuaaccaggccacaccuaauagugccacucccugggccaagcauauacaaaccauuauaacccuaccaaugcuaggaguuaucuuccagaacauuuuugucuuuacuuguuugguuacucuugagaucaagauuuuucauguauuucuugauggacaugguuuauaaaauuguauguaaggaacuuacucuuuuucuuucacagaucuaaacgaacaaagaugauguuggagcuaaauaggcagaaggaagaagaagaccucagauuaaaauugcaacuucaaagacagagagcaaugaggcuuucacgagagucacgcuugaacaugcuugaaauaauucauccaggugaguaauaauguaaaacuguuagaauagcuuaaaccaaguuuuccucuuccuugguuaauuuuuuuuugaaucuucuugccuuuucugucucuauuuucuuucccuagagaaauaauacuaaaguucuagauuuuaaaaguuacagcuuuucugauccauaccuauaauuuaauuuuuuuaacuuucagauacauguauuaaacauaaauguuuauaauuaaagauaguggucaaugacauaaaaaaaaucuugaaaaggauccagucugucaucugcacucauucccuaguauaaaaucugugacaucuuaacauuugugacagaugaagcagaauuaauaagaacaugcuauggugguguaucuauguguacacguucaucugugugcauguguauaucuggcucaagggcaacguaaggcuucuuccuccaccccucuccacuauaguuaggaucugggcuggcuucaguagagagcuaaggaugaucuugaacuuucacccuccugcuucuaccucccaagugcuuggauuacaaguguaggccacaaauucugacuuuauucauugcugaggacugaacccagagccucaugcaugcuagcaaguacucuuagcaacugagcaaugugucucuccccucaagcguguuucaucauucauuaacuucccuuauuacucauucccaagaacauuuacucguucccuccuucuuuuuaguuuaaauguauuuuccagaauuuauccuuucucaguuauucucaaguugucucgcuugaugugucccauccauaacuauacugucagcuaucagcaaaaugcuuagcacucucauaccuggccuuccauccuacuuucucuccugagcagugcuaagcauuccuaacuagcagugcccaauaacacauuuauguuaucauugaaaaguucuguuuguauuaaccaauacaguagcaauagcuagaaguagcaauugaguauuuaaaaugugcuacugcacuuguagacuuuugaauguuuaauuuuauuuuauuuaaaucuccuuaguagccacauguaucuaauagcugcugcugugauaguuuucuuugcaauucacagauaguuacaaaacuaaagucuuacucccaaauuuucucuucauugauuccccauuucauguaaugccaucaaaaucuguucaguuucauucaauauccuuacuuuuucuuugucacucuucuauaucaggucagcuacaaauccaauuaguuugcuuuaauauuauuuauuuuuauuuauaugaguacacuagcugucuucagccacacaccagaagagugagugcaucagaucccauuacagaugguugugagcuaccauguggcugcugggaauugaacucaggaccucugaaagagcagucagugcucuuaaccacugagccaucucuccagcucccaauuaguuuuuuuaaauacucucucuaagauaccuucuuuguauuaaccacuggugcuguguucuacagcuuuguucuuuuauuuaacuauggugaaccuugaguuaaauaugguuuaugcucaccaacuccaaagucaagagaagcuuauuugugugaacaaucagaaguuuggauuacacagaguagauuaaagagcacauaaauacauuuuguucaucuucccuggucauuccaaaugcuuuccuacauagauucaugauuuuuuuuuuuuuuuuuuuuuuagucaaacugguuuugguauuggccuuuuaucccuuuucuccuuacucugggacgacaauauuaugaguccuuuuuggaaagaaacugcauauucuaggaaagcuuuacuuucuacaaucuuagaacuauuauaaaaugaaagagauuggcaaauuagugugaacaguauugacaaauacuuuuuuaaaaaagccugcaaaaucauuauuaguacuguuguccuaauuucagaccucgagaccuugagaaaauauagcugaguauguuauaauaaugucugucaucucuuuaggucaaguggagaaguacaauagggaaauggaagagaaaucagcauugacuauucagaaacauuggaggggguacagggaaaggaagaauuuucgccaacagaggccaucucucacagaguauaaagcagcugucacacuucaaagagcagugagucugcuguaguauacauagcucuauauaaggaggcaaacaaguguucaaaauugacuuugcuguuuaccaaauauaaaucugugaucaagcccuuuugcuuuucugagcuuauuuucuuuauaaaauaagaaccuaggacuggaaguauagcucauuaguugaguacuucccuagcaugugcaagaaccuaggcucaaucucuagcaaccuaaauucaaacaaagaacaauaauaucaacacuuauuugccucugcucaagcugauuuagacacuaaguccaaguacugccuuaaaaucuuguaugccauuuacuagauugcaaccuuguuauuguugcuuauuuuucucuccuauuugaccugcaaauuccucaaagauagggaacuaauccuuuuauauuggugccagcucucaacaagcuugauaugaauggauauucuguuuuuauauacuguuauauacaucagaaucagaugacauacaugaggauucuaaagucuguaaauugcauagucuuaugcaaauguauauuuuauuuacuucuuuuaaaauaaucaacuuauggagaaaguacuagcuauaauuagaacauauaauuagaacucuggaauuguagaaugguauucauaugguaguuuuucuagggauuauguauaguaagucauauuauauuggaaaagcauagcacagggcuucuuuuucacuuaguaaccuuuucccucuaauaccuacuucucuuauacaucauuaggccucuauuaagauuucaagucuggggcuggagagauggcucagcgguuaagagcacugacugcucuuccagagguccugaguucaauucccagcaaccacgugguggcucacaaccaucuguaaugagcuccgauucccucuucugcuguguaugaagacagcuacaguguacucguauacaugaaauaaaauaaaucuuuaaaaaaaagauuucaagucugaaagcauguagcuuaaucaccuuuuuuauagguuuuacuguuaauucucauuucuuaccaugauaaauuuugagcacucaauguggguuaacauuuauaaggauguuuuaauuuucuaaauuguauguaagcaugugugucuaucugugugggugugugcacuugagugcuaaugcccccugaugccagaagcaucacgguaucugaagauaguuacagguaguugugagccaugggugcugagaacuaaaccugggguuuccugcaagagcaguuuguagucuuaacugcucagaugucuuuccauccuuaugaagauauuucuaaaccaucaaaaaccaauagaauaaauacuagggaaaugugaagagugaugugucucuuccuccucccuuauguuauauaugaaacaaacgugauauuuauccugagcuaaagagacaaggcaaccugaggauagcucauuuauauccaguuagagaugcuucuuuuuagagauauuugccuuugugauagcugcccaaccagauugauuugugggaaagccuguggugcauauauauauauauaauacucauucucauuaauauguucauauugccuauguuggaaugcuaauguuuuacauauagcauccuaggacuucuacagcugugauaaaaacaccaugaccaacugcaacuuggcgaguaaaggauuuauuucaucuuaugcuuccaguuaacaucacugagggagggaagucagggcaggaacuuggagguaggaacuagagcagaggcuauggagaaaugcugcuuccuggcuuaaugcucagccugcuuuguuuauucuagcacccacuaacuagcccagggauugcaccacccauauugagcugguccugcucaaaucaaucaucaaucaagacaauguucuauaagcuuuuccacagaccuuucugguuggggcauuuuuucaguugagguuuuuuuuuccagaauaacuuuagcuuuugucaaguugacauaaaaacuagcuagcacauauaauuauguuuuuauaacucagauauaaaauaauauuuuauauagcuacauggaauuuaaaauaacuggaauuuguuaucuguguuauauuucuauagcaauuuucauuuagugguuuguuaaagccaagcauuguaacaugaccucuaaaacgcugagaggucagagaaucccaugauuccuaagcuugaaaccauucugguuuacacagcaaauucucacuucaaaggaagagggaggcauaauuaaucaguuucauuaaaaauaaauacagaguaguaagguuauccuuuacauuuauuuguaucuuaggaacaauuguuuuuucagguacuuggcaacaaaagaaaaguuaaaccauuaucuaccuucucuuucuugcuugcuuuguacaaaagccaggaccccucuuaagacauugucucacugugccucccagauugcugaccgugaucuugaauuaucuuuucucacccuucacuacuaauauuauaguucacuaucacaccuaauugaggcaguguauuuuuuaguugauaaaaguagaaagaaaaaauccaaaaugauguguaguauauuauaucucuaaugcaggcacucagaagauugaaccaggaucucaaauucaagguuagccuagacuacauagcaaguuccaggcauuccugagcuauguagcaaagacauggcccccaaauaacgaaacgcugaaagcacuucaauuauuagacuucuuuauucucauagacaaauuaagaguucuugguagugaguguugcaguguuagaacuaaauuuaaauuuuacuuuugcauguuuuuagauguuuucuuuuuuuuuuuuuuuuaccuuuuuaaaaggcagcaguaguucagaaagaguuaguuggucucuagauccagaaggguagcuugacuauagaauacuaacacacaauguuauacacucauccaucacuaagcauccauacaaaggauuagcaaaauaaaccauugaaauuuuuaaaagccaaaaacaauggcagagaauaauaaaaugacaaaauaaaugaagauaagagaaaaacaucaagggaguuuuucugagugagguauagagugaaguucucgucggaacgucauaaacccagggugguacuaaaaggaaggcuggaagagaaaaagaugugugaccaaaaaaaaaaaaaaaaaaaagagaaaaaaaaagagaaaaaaaaagaaaaaaaucccccaaacagaagaaugaaacaaagaguaucucuuuugcaggugcaagcaccauacuaaaaaugaguauuaagggacauuuaacauuuaaggcaucauucaacccccuuucuucucagcuuucaggcuuaugacugcagauaguagaguggaagcauuuucuuugggaaaucugaagucugaauaaagucaaaguuuacuaacauugaaggauccaaacaaaacaacuugguucauuaguccuaugcuguaaugcauaguagaugagcccuuuauggcagcucaguaugucuaaauagcuuuuuagugcucaacuuuauaggccauaggcaaauauaagugaacaugaggaaagcugcuugauagaaauagaggauuuaauacuuagggguuuaccucagagaguagagcaccugaccagcauauaugagguccuacauucaaucccugacaguggggaaaaacaaacaaaacaacaacaaauauuuagagagaugacacaggaauuagaaaauaagauuaguuuuugaucuaucauuuccucugauaagagaauaugguaaaaaaucaacauguuuaaaagggaaaaggaaaaggguggggguggggggggaggcagaccuggguugaacaguuaaaauuuacuagaaaggauaaaagaaaauaaugggcuagugagauggcucagcggguaagagcacugacugcucuuccaaagguccugaauucaaaucucagcaaccauauuguggcucacaaccacccguaaugagaucugacacccucuucuggugcaucugaagacagcuauaguacuuauuuauaauaaauaaaucuuuguaaaaaaaaaaaaggaaaaaaauacuauccaucagagaaaucaaauacauaaguauuuaaaaucaagaacagaaaauauagaggagaggaaaucaaaagaauuuucuagaacuacagcauugauaaauguccaauacuguaacaaacauuuauuucauuuccaugaaauacauugagaacaaagaacuuagcagcuucacuggaacugaagaaaucuugagcuaaaacugugacaugucuaagagaagugauuucuaguuaaaauuaugugcucacugaaaagggaguuaaaaagaagacuaaagacacuuauauaaucacagaagcucuuaagccagugggaaaaccaagaagguauacagcugaaauucaagaaguacagggagagauaaaaugagaaaccaagguaguugugcagagaccccaggaugagcuuuguaccagguggagagaaacagguagguuagaaccccccagaaaauguaugugcuacaauaucugauauaucaaugucuugacaauuagaaugaaguuguagaacguaaucaagucuaaguauguagaaaaucaaacacauggaaaaaauaaguguuaauuucagagaaaauaagcaaggaagacaguguaguucuaauaugugcuccagaaugaguaauagcuuuucuugcuguuguuguguauguauaauacaagcacucaggacuggcacagcagaguuacagguuugagacuaauauagccugcauaauaaaaacccuguccccccaaaauaaaacuaccuuaccuuuauguaauaaucauuaugugaauguuauuuuuuacugaaauuacaacauuaauuauguagguggacuguacaugggaguauaugcaguauaaaguaaccaaauccuuauuucuguucaagaaaaucaauaaauaauauguuuaaucugugagaaaaaaaucauagaaaucuacugauggaauucacaugaaggaaaaaaaaguuaaaguuguugccuuugggauuuguaaaacugguccuuuaaacaacagaauuaggcuagccaacuuucucuggaaaggaccagauaaggaaauauuuuaggcuuugcaagcuauagccuguaauagcuacuuaacaguugaagcacaaaagcagcuguagauaacgguuagacuaacaguaguuaagcaaguauagcuguaugccaauaaaaauuuguagacauuugaguuuugacuuauacauacguuuacaugucguaaaguauccuuuuaaauuuuuagccauguaaagugaaauaaacagguauuuacuauacagaaacaacuuacuguuuuugaccuguaagcuaugacuugccaaucagugcuuuuaaaacuguauauaauuuuagugaaaauaaaaacaugggagaaaaaugaagaauugaaaagaauaauuucauauauguaccaaaauguauaagucuauuauggaagacuugagaaaacauucagaaaauuugcuuuuaucaguagucucauagcuuaaaauguuaaaauguuuuaucuuuaccaagccuuuucuuacuaucucuuuuauauuuggaauacuguaaaacauguaaaauuaggguccuuguuucuuauuggcauagagcauguccuauagaaaccauugguuugcccagaauuguagaguuuauaaggaauuagaauugagauuagaacucaauguuuauuuccuuuuauauacucauuucuuacugcaaacauaaugagugcuuaauaugaacucagagacuauggcagcacucauaggaccucuacaaguucaagccagaugaaaucccagcacugagaguggaaaguaaacauaguccccaucccuaaccauggaauugcuaccugcugauaaagugaaaaucagugagugucacuggguauccaugcccagguguagcuggccaauacaaaacuccauugguuuugguuuuguuguguuuuauuuugugggcucuuuauuauauuuuguuuuguuugggcauuuuucuaacuuuuuguuauuguuuugguuuuugguuuuugagagauuaaguaugagaacaugaaguuagguagagagcuggaaagaaucuagcaggaguuggggaggggaaacaauuaaaauauuuuuaaaauuuuaauaauuauauauauauauauauauauauauauauauauauauauauauauauucuaaauguguaaagcccuagguuugaugccuagcaccacauucagcagguggaaacaggaggaccagauagaguuaucuuaggcuacuuguugguucaaggcuugccuaagcuaugugaggucuggcaaaccaaaaaccacaguaauagaaauauuuagguguauucuuuugucuuagucuuagaaugcccuuucauucuauugcuacaaugaaacacgaugacaaaaaaucaauuugagaaggagagggcuuauuuauuuggcuuaacuuccaggucuuaauucaucauuagaggaaaucagaacaggaauucaaggagagcuagaaccuggaggcaggaguugaugcagaagacauggagggaugcugcguacuggcuugcucagccugccuucuuauagaacccaggaccaccaacuagcccagagauggcacaacccacaaugggcugggcccucccucauuggucacuaguugagaaaaaguccuacagcuggaucucauggagauauuuucucaacuugaggcaccuuucucugugaugauucuaucuugugucaaguugacacaaaaagcagccagugcaacuaaccccuugucaacuacacacaaaucacuauuaagcuacaacccuuacuuuccuguucauuccccaagaucuaaauaacuguaaaaccuccaaaaucuuuacaaauucaaacacauuaaaauuuugguucuuuuaaaguaucccaucucuuuuaaaauccagucuuuuacaguucaaacucucuuaacugugagcuccaguaaaauacuuccuucaagggggugggggguugaauucaaggcacagucgcaaucaaaucaaagcaaaaucaaacucuaaccauccaaugucuggaauccacccaugcucuucuagaccugagucauuccucuuccaaaggucacuucuccagcucugcccucugucgcacauagcuugccuuuuagcuuuggcugcuucuacuacugcugcuguucuuuugugaucaucccaugguaccaguauggccaaaacacuggagucaucugcuguaacugggcugcacuuucacaaauagcaucucauagacucucauagugccuagccucaacuucucugcauaaucccuucaguccugggccuucaacugcuaaugagcuguaccuucaaccaauggccuuccuggccucccagaauaccaagccccagcugcucucccugaccuuuucaugucuucaaaaccacuacuaccuguguaacucuuauacaguaccaaguccagcugcaacaugagguacaaccuuggaacacagcuucucugcacucucagaaaacacuucccagaagauuucaccucagugaugcugaucucuucuuaauccuugcuaaugucuuagcuccagcuaaccagcaucaauugucccaguaaugaaaaaguuccacuuuaguaguucugguaucuuguuaaucacagcugcuaauuguucagcuccagcaaaccagaaccacagaaucuuaaaucaaaauaauagucuugauagagucuuuaauugucccucugaaauuucacagguuaugccuccaucuucuacacuacucucaacauuuuuaucuuccaagcuccuacagaacaucccaaugagguuucaacacuacucauugucuuuucuaguuccaaaguccuucuacaaucuuccccaaaacauggucaggucugucacagcaauaccucaguaugcuggugccagcuugucuuaguuaggauuucuguugcugcaacacaacaccauuaccaaaaagcaagauggagaagaaaggguuuauuuggcuuacacuuccagaugauggaggaaaucagaacaggaacucaagcaggacaaaaaccuggaagcuggagcugaugcagaguucuugaaggggugcugcucacuggcuugguuccccugacuugcucagcuuaccuucuuacagaacucaggacuaccagcccagggauagcaucacacagcguuugagcccuccaccauugaucacuaguugagaaaauguccuucagcuggaucucauggaagcauuucuucaacugaggcuccuuucucugugaugacucuuagcuugugucaaguugacacacaaaacaagucaguucucuuuuuuaaaaaauuaaaaguguauauagucuuacgcuacuaccauggugggaaagugauguaugcuuaguagaaaccagacuucaacugguagagguauuaagcauauuugcaacuuacaaguauuuucaacuuaaaauggaguuauuugacauagccugguggcacacacuuuuaaucccagcacucgggaggcagaggcaggcggauuucugaguucgaggccagccuggucuacaaagugaguuccaggacagccagggcuauacagagaaacccugucuugaaaaaccaaaaaaaaaaaaaaaaaaaaaaaaaaaguagagguggaucuguauagguaaaaaauuauuauauuccuuuauuaugucacagucucauuccccuccucaugcauacucagaauugccuaaugcaaccuugguguuacugacuuagauuauaggaaaaugaguucuauuaagggaacagaaucaaaagaucuucuuuucuuuuccuuuuccccuacuucacuccagguucuuaaauuccuagcaaagugccguaagaaaaagaaacucuuugccucuuggcauggacuucaagaacucacugaugcacgcagaguugaacugaagcaacaaguggacgauuaugucaaaagacacccgguauguaguuucugugcugaaauacauguuacauuaauccauugcauagucuuuaucacuaaaguaguacagcauauauauugauuguuggaugcagguuccauagacuuaguagacuugaauucuucuuacaguuacaggauccaaagguauaacugguggugaaugggaacucaacuuaaaaauugguuauuuccuguacuauaccaacgaaacuugugcauugcuucuuuuauaauaguccuguaaaaucuugucuguuuugaaucuuuuaauaagaauauauuaauuaucaaucaaugggcauucauucuuaccuccauaugcucaaacacaugcauaaggacuuauauucacuagucuaaacucccaagacaguaagauguagaauuugaugcccuaccucuuugguuuucaaacuguaaugcugcugacaccuuuccacaacagaaacaugcauuucucugacuuugugugggcacagugauacagaguaggugcuuccugcuucuucccucugaguuucugaccuuacacuucugcacaucuuugaaggacauuucugucugucuugagaaggacucaaccauucuugauguuuccacacuugucaaauuuuauggaaaaacuaauaguuuauacauuuugaucagaauucuuacuuuccucauuugaaccaaccauucuuaguauaucuaaggacuacucacauuucguuaggauuaugcuaaugcuccuugugucugaguuucuuucuucccuuccuucccccuuuccccuucugauacaaacacaaauuucuacaaucuaaagucugagcucugaagggugauucacauuguuaauccuggcacucaggaggcaaauacagguagagcuuugugaguuugaggacagccuggucuacagagcaaggacagccagaacuauacagagaaaaccugucucaaaaagaaaaacaaaaacaaaaaaacuguagggugacuauguuaaagauuugauauaguauuuuauccuuccagagccuguccuccacaaaaugaaaagcagaauacaaauguaucucuguccauacaugaauuugauaaccauuggaacagagcaaugauagaaaguaaauuguauaacaauguuuaauccuaucuguauaagagguuuucaucauuguuuaagucuuuauagaauagcgcugacucuugucauaugcaccacauaguuaaugcccucaguguuuagccuuuaugacagcuauccauuucuauuguuguaggacuaaaguaacuauagaugaauaaaugaauagauauggaaguaucgcaacuaaacuauuuuuauugacuuguuuauuuaucgauugucuagaggucagaagacaaccuguagucaguccucucuuuccaccauguagguuauaaacaaacucaggucauuaggcuuggcagcacacagccuucacucccugagccaucucaccacugaaagcuauuuucuaaaauaagcuuuuguuuuuaguuugcugcucuuuguuuugaauaauaguaauaacuuauauuaaaauuauagucuuuguagcauacuaaaaaguaaaauauauggaaacaauaacauaaaagccaggagaagaaauacauguaugauuuaaauuccuguuuauaaauuagaaugauaucacucagaauuaaauugguaaguuaaugguacauaauacaaauccuacaacaaugaacagauaucaaaaaguaacaaaggaaaugaaaccaaauaaaaaauauguacuuuaauuaaucaaaaaggaaaauagaaaaaggaggaauguauaagaaaguaauaggacuaauaggaaaaaucaugguaagagccugaagcaugauuauguuacaguaaauauaaaaugguaugacuagauuuuaagaguaaaauuaaaacuaaacucugggcaggaaagaugacucagcaguuaugaacacuugcugcucuuuagaggauccauguucaguucccagcacccauaucagacaauuacauccaccuguaaguuuaguauuagagauccaacaaccucucuuggccuccgugggcacuguacacacaugguacacauggaaacagguaugguacacgcacauacauaaaauaacuuacaaggaaggcuugcauauauucaagacuuuugcccauuuucagaucagguugcauuuuuguugaugagcugaugaauucucuguauucuguuccuuaucugauaaaugauuuuauuuuauucuguggcuugcccuuuuaacuguguguccuuuaauacauaaaaaaaccuuuaguuuuaugaaucucacuuugccuuuuguuauacaauuuuagcucuuauuuucaguuuuugggccuuucuucuuucacagguacucagauuccuuuagucaaaugguauaguucuuccauauaagcuuuguauaucuguguauacucuuccucuagguuaccuacauucucuaaucaaaguaaagacaguguaaauugauguuugaguguauguuuuagaagguugugauguaugaauuuaguguauaugcaguauuuucuaaugcuuugguucuuuaguugaauaugagucuagaucucagacauauggaaggaugaguguaagucuaaugaauaccccaguuugucauuuuuuacuaugcuuugauaaggucuguggcugaaagaugaacuaucaacuggaacagaacugcauuaguauuuaauaaagcuauggugucagaaauuuuaucagcuuuaaggcuaagauuauuucauuuuuauccaaauuagucacuaacaucacccuuaaauuauuugaguagucuaauggauagggucuuuuagcugauuuuagccucucauucugugaaaccagcaccacuuagagcacuguggugagggugcauuuggaguaggaaugggauaagaaauaauauuucaaaugaaguccaaaacaaaaggaguugccuucacuaaaccauuuauacuuucauuguggucuccuaaucucagggucucauuacuuaccaugucuuugaagaaaugauguguggaaggauaccaaaaagaaacauggaggcccagagagauagcucagugcuuuagaauacuuguuguucuugcacagguuccggauucaguuccuaacaccaacgaaguaacucacaacuaucuguaacucuagcuccaagggaucugacacccuguucuagcauaggcauagacacacaugugaugcacauucauacaugcacacacaugugaugcacauucauacaugcaggcaaaacucauacauacaaaauuaaauuuaaaauuuuucaaaaagaaacuuguccaucuauaucauuauauaaaguuaggguauaaguuacuuuuguuuaaaaucugcuuuguugauuuaauggauucuuucuuguuccuguuguuagguuguuugcauacuuguucauuucucuuuuagguuuuuugagacaaggugucacuauauagcccagauugauccuaggcuuaagauuguccuguuucugcuccuguguuaagauuacaggcaugaauacucacaacuuaugugguuuuuaaagauaauuuaauacuugcaccaguguacaaguuagauaagagcuauaagauucuauugauaaaaugggagauugcuaaaauucuagcucugcuaugguggguagguaaagcauauuuugauacauaaugucuuuaugacaaguuuucuguccuauguuuccagugcucucagaugucagaggcggccagcagagagcuccaugcacaagcacaagaacgacuucagcacuauuuuaugggaagagccauagaagagcgagcccagcaacacagagaagcuuugauggcucagaucagcaccaauauugaacagcugaugaguaugcucuaccuccauccuuguuucauaaauggaauaccccuugcaagagauguggcauccaaacucuuuagaagaaaagugccacaaguagucuuuauucagguccucgggaagucuuacaucaucccaguuuucaacucuauaccuucuguuugugcuuguuauaaauucaaauauuucagcuucaucaaaauuacuaauuucaaagaaguuauaaucuucuagacacauuuucccaacuuuuaaaaaauguuuuuguauuuuagaauuagauaauaacaguaguuacguacaaugaacuugucaaaaauaacgauuaauaaauuuuuaucgaaguuucucucuuuaggcuaucuaacacaauuuaucauuuuucuuuuaaagcuggaaguugccagggauugggguuguugcuaucacccacaucuguaacuucacuagaaaccuaccuucauaguuagcagugacagcauauucaguuagaacccuguccuguccugacuauaaacagcucugcuguuuccaaguugcugcuugccuggcauacuuuccacuaacccauuuccuuucuguuugcugcagaggcaccaagucugaaggaggcagaaggaaaggaacccgagcaauuccuaaguagaucuaggccuguggcagccaaggccaagcaggcccaucuuaccacccugaagcacauacaagcacccugguggaagaagcuuggagaagaaccaggggaugagguugauguuccaaaggaugagcuuaguauagauuuaggaauguuauuuaucgguggaaccaaaccucccuagagaguacugugaaagcuggcaaucuuaccuuuuaagagauuguuaguuuugccucuggcaugcaggaagacuagggcuaugccaguggcuuuccagagcaucaucuucaugcaacacuuggaagcaaaaagcaaagcauugccuaccucacucucaauucuuuccccugucucuaugcccugucugugagcuuuaauugugggagagaacucaaugugaaauuuuauuguuaauauaucuguuuucuaacuaaaaguuguuuugguuuuguuuuaaaauaaauaguguuucuaaaaaaguu

SEQ ID NO: 8235 - RNA, 58951 nt, Mus musculus
gaugaaggaaggccuugagagggaacuggguaacagaaaaucagaagagugagaccauuucuuuuguuacaugguuuuauucuuugacaguucacacauguaugcauuuugaucaugaacacucuuauuuuccucagucccucuagaaaacucucccagcacuccacccccacuuuuaugucacuaaaagaaaaauaaauacauugaguuuaauuaggguugcuuucauguauauaggugagggauugauuauauauccugggaaauuuaccgauggugacaucauuaaaaaagaaugacuccccuccucucuucccuuccucccuccucaccgccccccccccgcccccguaaaucgcuuuucugucucuuguuggagcuucuuucucacugacuccucacagagcccgagcccuuaaaucuguuugcuuaucccagcugaagagccaauuccuuaggggaacguuucaacucuuaaauacugucucuuacccucacauccugagugauguccugugacgucagguugaaaucggaguuccguuacuaaaucgcuuucucccccaucggaaggaccaaguuucaggcucuacuccggguugguucucacaaaaucgcaaauacuagcagcuggcgccccuaguccaaagucuccucagaagccgaggccauaguccuuagugggaacagcgcgagaugagaaauuaggguaaaccggaacuuccaacccauacagcaaacaccugaucuuugccgaaagcccaccccuuucgguguuuucaggccuccuuggaucuucuuccgggucacaucccaccaugugauuccacccggcacguccuucuuagaauccauuggcuccgucuuugaggaaguggaaggcuuuagggcauugguugguuucugucaguguaacgcaguuaguuacaaacaaggcgugccugguucccauagcaacgcccugagcaccgcuccgauaggucgacgccuugauucagccuuccgucucacggcgaguggcugacucccaggggcgcgucgacgguggcgccgugcuuggguuaccgagcugacguggcuucgauugggcggggggcguccggaguuggcugggacggccgccugcaggugagugggagccgcaggcuccgcggggagcuccgcaacggcucugcugcgagccccgggccaaggggcucgggacacggcucagccggccgccccgccccucaccuccgggcuccgccgccuucacccgcccgcccuagguggucgcccagugcccgccgccguacucggcccggggacacagacacccagucagucugccggcagggucguuccuccccggggagccccggaggcgggcgagcuggucagcccuacgugcacggacggcccuguguccgagcggccugggcaagccagccugggcaccgagccggggacgcuagaggcaaccugccccagcccugugcucgccccagcccugaacaaacuuaguguuccgcugucgccguuaccgcagucgaggcccacgaaugauccugcuguuggguuaggaagaugacggagagaugauccagaaggaagggaauguugaagggaguucuggaggaaaaaaaaaaacccuugguguggccuuguggcauggguuuguuguugcgcagcaggaaugagaacaggaggacgagccucagggcgauugaaggaaauauuugccugguuuauuuaaagccccgcaguuggucugugaggagaggacaguuuugggaguggaacagauauuuaaaaucauggauaaacacguugacuuuuagagauaguuggaagcucuccauuaaaggaauggauuuccagauuugagcaagauggacugugcaagaguuuauaacaaaguguggaggccuuucuagaaacaugaguaaauaggguuuggaugaucggaaugaccguaaagggucagauucaggaaauguucuguuagaaaaaugagacgacuuggaguagacacgggagaaaaaaaaaugaggacaacuaaaaaauuuuagagguuaaaaguauagccaaaugguaggucucuuacuuccagaaggcccuggccugaagcauugguguugguuacacggccuuuacuuccuugauccugguaggacuguuugaugcuuccguccucacugugcuuuaacauuuguuuaacuacagaaguaguuucugaacauucuuaauugcauaugcuacagguaaaauaucuugaauguauuccuaaguauauugauuaaguaaauuuuauguuaauuuggauaguguaacaauaucucugaaaauacaccacagauuauaaaauauacaaaaauacuagagaauuaaaugaaaaauuaaaaaaaaaaucugucuacaacggucacgacggaauuugaagaucacauaaaaugugccucuugguuucucacgaugauggucaacauuucugaggauuuccacgauuugggggggggugggaaugggguucccauucuacuggaauauaguccuuucuaaaaguaaucaucuuuagaagauuuucccuuuaacucucuuguucccagcaccucagcccauuuggauuaaagagauguugagacuaugcuuauuuauaaaauauaucauuaacuucucuugguuaccuacuagcaauaaauuauuugugacacauugaugcgcauuacauacugccuguuaguaacaacccagacuggacuacacucagagccuuaugcaugugaggcaagcacucugauaccaagcuacauccccaacccuuaaugaagacuacuuuaugaaguaaugaagagaaugagaaauccucuuucuuauuuuagguacuuuaggguugcuuuuuuuguuguuuuuguuuguguuuguguuuucaauaguuccagauagcccuggcugcccuggaacuggcucuauagaccgggcuggccucaaacagauacccaugccucugcuucccaggugcuggauuagagacaagcguugccucugccuggcucaguuauaugugcucuugaucaauggaaauccagaaccaaaggguauaaugcaaagcacaauucugucuacuugccucucuccauuccccacuccagaaauucuggaaaucauuugucccuaagacacauuccaaaggccaguaguacauacucccccgcccccgcaagucauaauacauccuuuugccacuuaauauuauacagcagcucugagaugaacgucugaaucaugaagggcucaauauaaaguauuaugaguauucauaugcuaacaguagaaaguucugaguucauuucucagcaacuaccuuagcucacagccacccguaauggguucugaugcccccuucuggcguguaccuguacaugccuagagaacauuuuaugcacauaaaguaaauaaauaaauaaaauaaaaaagaaaguucauugccaugaaacuucaugcacaaauuauuaaaaauacuauguaaaauugcugucagucucuuuguguaaaauauauauggaguuuaaaugauuuuuugugucucaacuuaguuccuguucccaacaugacucuuucauauguguauaaauacuccaaaauccaacguguuucaaaaucugaaaccaaaaauuuugacauagcacauucaaucuauauugagcauuuucagugaacaugagaauaaaacacuacccuacucuuucaggcagcuauacagccuuaccuuguagaaauuaaaaaaggaaauacaguuagcaguccuccccugaugggcauuuagguuguuugugaucaugaacagucaaacacugcugugaggacaucuuuguuuccaagugugcuuaugucugugugagccuguauguggaaaaauaaguuaccugaggguauacuaauuguuaugaaucguuauuuuagcuuacauaccuagaaaaauaaggucacccacaucacuauuaaugugguacccccccacccccccccccacacacaucccuguuuucauccuggaugaagaguggguugaggaaguuacucaaaaaaaaggggguggcuuuugugugucaccaccagccaagaaacuuguagaauugugucacuggacaaauucccugcauauuaguuuacucaucuuaaaauuagagcuauugauuguaucuacuucuuaguguccuuggauaaaauuaaacaaugaggauaaauaaguucuauguaaaggccuggagcauuguuugguaggcagugguauguauauaugcuguagguaccauuuauuucuaaguuaguaaaaaucagguuuuuuguauuaugaaauguuauuucugcuuguaaaggucuauccuaaucuugauacggauuuucuagcuguuguagcaauacugaccuauuaacucuucaggcuggugguagaucacuuugaaaauuaagacguuaaaaccacagagagccaaucaaaaaugcaugagaugaacaugaaugccucagugacuugugggcaugugauuuagauuucagagaaaggaaugggaguggguacacagaggcacccauuugugcuguuugacucuuuugcuucuauuccugugcaaguuauacuauggucucuguggcuagggaugugccaucuauuucuuguauaauuccuagugaaacacuaccuaccagauacauaucuuuaaauuaguaauugucaauaaacagugaaggcuuugagaaaaacuucuuuaaaauuuuuuuugcucgcauuuuauuguaaauuuuauuuuaauuuguauggauguuuugcuuguauguaugucugugcacuaaguauguguauaguaccccuggaacuggaguuacagaugguaguaagccacugugugggcgcuaggaaccaaaugcauguuuucugaaagagcaaccagugcucuuaagcgcugagccaucucuccagcgcuaggcauuuuauuugacuuugcaguacuucuucagggaagugucagaucauacggcagggagggugugucgagcaugaacuuggagagugcccuucuauuugccuguuuuauagaagcuuggccuucacuuggagcucuguuugaguuuccuguuuaguuguucuuugugaugcuggcacuuugugaagugacagcaaucacauuuuccuugugggaauuuaccacagugucuuccuguuugcugaucuuacaagcauauuugccacuugcguuuuuccacaagccguguauauauagacagaaccuucuugcuccauuuagcauuuaugcccuuggauuccuagccuuugugcuauacaaagcucucagcugugugaaagaugccuuucauuccuuaguuuugguuacagaagacacgcuuggcucauggacucacauuagugucucuaacugguccuuguucauccugagaugagggaacgggcauaacaagggaaaaugacuugggagcaugaugugggggagcugcuagcagaaagcugucacccagcuccaggauggugcuuuucugcccugccaucccuucacacccaccucuagauucucuucagucagcccaucuuaucuuuuaaugauaaugugcaagguguuuaagguauagugcuucgggugaguauguauauacaugccugcaccauaacacacuauauuuauuucuuuaaaaaagcuauggcuuaaaagcaguugaggaauccugagccugcgauucuagcauuuuuucucauuaauccuaaaaguaguaauagugcaagcuacucugagaaguaagugcaugcggggugggcaggcaccgaggggugggcaggcaugcaguacaguggaggagagaaaucugagcugaacgugauggaaagcagccagcuaacuaaggcuuuauaggucaggguguguaacaaagccuggcuuuaagucugaaaacgcccuuaugaauaugcuaauuccucuaaauugauuacuaccuacuguaugccuaaaucccaacaucauauaccauacggacuauauagcuaucaauaaaacuuccuaauggauggcuuuaaacauaauuguuuaacaguuguaaauuuuccuuuuuaaaaaaaaccacuucucauaagacaaaacagauuaagaaaaccccucucucuccucucucucuauauauacauauacacgcauuauauauacauuggauauguauauauacauuauauauauauugaauauguacauauguugaauauauauuaaaaaguuaccauaacaaguauaacuugguuggucauucuagaaguccuuccacguucccuaucccauuuauagccccuaucuggaucauuuauagccgccucuuacuuucuaaaauaaucacuucuuugugguuuccuuguaguuuuauuauccagaugggaaccuugcccuuuuaaagcuugauacaucuccugucuuuccccuuucacuuguguauugaccauaggucccguggaguuggacagugucugguaguucauaguguuccucuguccuccgcauuuucugcagacggcaacaggauggcuggcgugaucugaguuuucauccuuagucaacacuguagaaggugguuagguucuuucaccaugaaagucauaaugucugggcuuugcucucuuagcagcuguugacugaucaguaucuagauacauauauucauuaggcuuuucaaauguuagaguaguugucuuuucagaauaauuuguugaggcguggggagguggugcacacacucuguguguguguguguguguguguguguguguguguguguguguguguguguguguuuaggucagaggucagccuuggguguccucaggagcccuccacccuuguuuauuugagacaaggucucucacugggaccugugcucauucuucuuaggagauaaaguucuagugggaaaggcaagauaaucccuuaucuguuuuccacauucauugauucagaugagauaacuagcugguuauuacauucucucagauuuaaauuuauagguuuuggucuauugcaauuuuaucuuaugcuaauucaggccuucuguuuagccaguaggaacuuguuccuggguccucuugacauaauuguaauugucucugcuugcuucuugcuagcuugcagguuacgaugccugugugauuuuauaucuccuacuuuaugggacugaaauuagccaguuaugggaagcauucucauuagacacuugccuuuguaacaagacugccauguaggcacugaguuguuacuaaacucauuuuuuuaguggacagauggggaaacauaaagauaaaauauaagguaaaugccucacaaacuuaaacuaauguucccaagucagauuuaagaucaguuugaaguggguuauauauuucuucuguaauacaucucuguccucuuuucuuauacuaaagguuugauagaauuaaucuguccuuaaauacuuauguccuuuaauucuggauuccacauauaauaaucuaggaauaauaacacucaugcuaccaaucugauaguuuaaaacaacuuuacaagaguuuuuguuauuuuuauuuauauuuacauucuuccuaauagccauaguugucuuauauguucuuaacacacaguuaccauauccugccccccaacccugaccuugggcugcaccaacuguaugguuaguauucaccaccagucuucaugaagauuucuuucuacauuauaguuucuuuacauuucuuccauggagucuucaggacuuuauggaaaaugcucuauggauuuuccugcuucugugaaggaaaucaucugugcucuuuauauguggugcucauuuuugcuggaaauuaagucuuuggcucaccuuuuguugaguauuuuaaaucuguagcuuuucuggcccagguauugcugcaaaaacaguuuuguggucaucuuauuucuuugccuuacuaggcaugcaaucuuuugauaugaaaggagugaguauuuaaauccuauaauuuuacugaacaauaugauuggugauuugggauugauauucuccaguacauggugggcuuuuucacuacacagugucagaucuguguuuaaagugucggguaagcauucucugcucucccuuagcugaucuucagagaacccaauccagguugcuuuguaaagauuguccucgcuuucguucugcuuaacacuuuguuucuuugaagacaaauaaaacuauuagauaauuauagauuuaaguuaaaaaguuuucaaagaugauauguaguuccuaguuuuuucccaguguucucugaaguuagcauguuauauuagcaauaugccaaagaaaccaacaucgcaggccuauagucacagcauuugggagaccaaggaaguagugugaguugaaggccauucugggcuauagagcauacccuaucugaaaaacaaacaaacaaacagaaacacacuauuugaguguguguuacuaguccuagcaugcaugcacacacacacacacacacacacacacacacacacacacacacaccauacauauauauauauauauauaccaggucauaucaaguuauaccaugcacauaugauuugaucuucuuuguaccaccgggaucauggaacaucucccaaacauaagggaggucccuguaccuaucacuugagaaggaagacccucuucaugucaauggugcuucucuauuuggccuggcacauuuaauagugaacaaaugccaaccagcucuugugccucucuugauuuguugcacuccuguggcuaccaucuguuuccucuugaauggauacugcugaaaccugauuuuguagugauuuuugaucuugacuguugcuacauuaucuugggaaggguugaaaagaaacgugauuaaaugggggccuuuuguuguuuggggcuguuuuauucagauugccagcaggcuguucguguuaaucugcuugcuuuguucuuacgucagggucuaagaagcacacaaauagucacgcuugccugucuguaaaccauccucugagcuagccagucaguuguuuugucugguuugcuuauucccaaagaugggauguagauucuagagacagaaugauccugucagauaagguauauucugauaugcuuuucuguagaagauguaugcaaauauuuauguuuacaaaagauucauuaaugauuacauucauucccuuuauuaaaaucuccauagagggcugagaauguagacgagugacagugucugcauagcauucacaaggcccugaaaccucagcaccacaaaguaaagugaagcaaaguagcauaggggccuaggagcauaguucagucguagagugauuauauaguguuuguuguguagggccucagauucaaucccaacacaaaacuaaaguagcacacaaaacuguagaaaaucggucuuagaaauuugaaaauaaaguuuagaaucuguguugugaugaguguugugaugacuuauuuuucaaacugacaaaugauuguaccugucccuuuguacuaauauauggccccauguuacccuuccauucacuaguucugcuguagcgcuaguaaggagguccugugcuacccuucucuguugcuucucccaucucacacaucugugaauguguaagcuacacucgagaaacagcauccuugcugaagaccaugggcacccuaaccaugauuacccugagcaggaagaugcaaauuacuuuucauauuucucccuuuugggaguuuuuuaagguccagauaucacuuaaagaacauaaaauucacuguaguuuguaguguuauauacacaucaguuccaugucaguauuuuuuucugucacugcauaauauuauuuuauagauuauauggacugguaaaugccauuucucucacuguguaacauaauaguuauaaaagcaaauuaauuuuaguacaacuucagauuuacuuauaacuuaaaaagauuaggggcuagagaaauggaccaguaauuaaaagcacuggcugcucuuugagagaaccuggguucaguucccaguuccccugugguagcucacaacugccuguaacuccaggggauccaaagacuggcccuggugggcacugcaugcacauaccuagaugcauagacuagacauuacacacaagcaaagcgcccauacacauaaaguaaaaauuuuagaauuuauaaagauuaauacagagauaucguuguauguuguuuuuauaaugucucuuuaucugagcaguuacaugguuuucgaaacccuaaguguuagugcagggccauuaacuagcuacagggacagcucacuuacauuucaccauucuucucacugacauccuuucccguuucgaauucagucugacauccuaguuuggauuuagucagcauggccucacuugcccuagccuuugguuuucuaugugcuuuacuuugaagaacauaggaaagguguuuuuagaauguccuguuuuagguuuuucauaaccuuggguuauggauuugcaggaagaacccuauagaaauaagguaaucacaucagagugcuguuauguugugauacuugacaggggcaugcagccaggggaggguggaaauaagaucuacuuccuaaaggggauauuguuauguuaauauuuuggaauuaauguguaaggcaauucguuuuuuuuuuuauuuuaauauauguauuugucagugucaacuaauagauacauuuuuauuugaauuacauuucucucugagguuuugauuaacuuauuuuuugaauuuuaaaauuuaauuguuuaaccaccauuuguccauuuuauuuuaugugugugcauguuuugccugcaagcauguuuguacaccaagugcaugcagugcccgaagaggucagaagagggcaucagauccccuaggccuggagcuacagacaguugugagcauccacaugguuucugagaagugaauucugggcccucuggaagagcgacuggcguucuuaaccucugaccaacucugaagaccccacugugagucaucuuuagccuugcccagggagagcaagggagggagagcaccuuuagguuggcuccuugucaugugacccauauuuuccgaggucuuccuucuugucacugucuugccuugcaucuucucugcguagccugccauuucuucaagcaggggccuuuuauauaucgcuguguuugaugggcucaugcuuuguuaugaucacguggacuguuggccuauaguaacuugucuuguccguaaugucaucuuuuuucacuuuacuguauugcuaagcuugugaaaugagaugcaaagugccaccuccugucuucuggaagugauggaaacuuggaauuguucaauccuccugcucuaaggcuucuuuccuuuuuuucugcuuuuguugcuuuuuguuuccuuuuucuaauuccuugcagaacaagcauggggcacugcuuucagccacucacuaacauaaaacuuuagucuauucugagcagcaacuucacugaaaucacaugguuugccaggaaauccacaugaaaggacacauggaagggaaauuucccugaaucuuggcauuuaguugaaaaaucagaaaaggauaagucuggacaaaggaaaaccuaagauuuuugcuuaacuaugaugaaaggcagggcauuaaagacagccuuuaagacauacuugcccauuaugucccuguaguuaagaauuaucuucuugcaucuuauuccucacagugacccaagugacagggcuuauauaugguaccuacacaggacagggugcgucugcaccgugcacacugcugucagugugucccacggucaccguugccuuguuucacauagaugacacagguaccagcgucuagcagcaccugccugcucugcucgugcuccagcagccuguguccgccucuacugauccuugcguuuucucuucuguuucaccagcagagaugcugagccgauuaucgggguuagcaaauaauguuuugcaugaauuaucaggagauuacacugacuggaauuugauggcuuccucagacgcuguaaguagcucuggugcauccaaccugauaggacucacauucugugcucuucugaggagaauggcuuaagccagaggggugugagggccucccuugugcuaagcagaggugaugacacuuaccaacaaaaagaaucguaacucuaucagugauccucugcugaagcuugucagccagagagcuguggggaugaccacggcuagaugagccuaggaagcucugaugucugcucagccuguuaggaccgcagucccuguccucgucucccuccuugggaacauaacuccuguuucagggggaaaggaguaaagaaaacauccauuuacuucuacaaauucaccuuacacuuucucuuaguuuauauugcauuucuuggcccuucaggaaucagauguccauuagcuuuuugaaaggcaaacgguuaaggaaaguuuugcuuuuguuuuuuuuaaaauaacaucuuucauuuuuauuucauuuguuuauuuuguuugagacaaggucucaguguaucccaggcuggcuucaaauuugcuauguagcuaggcaaagauggccuugaacuccugaucuuccagccuauaccuuuugcauguugggaucauaagugugugcugccacccugguugguagaauguugggaguugaaggcaggccuuagcacagucacacaaggccuucacuucaccagcuaagccacauccccagucugcagcucaccuuuaauuuuaaaugaugucuuccuccacuuaauaguauguaauccucaccugccugccugccugccugccugccugccuuccuuccuuuacuuauuuauuuauuuuccucuuugguaaaauuagguuaguaguacuauauuguaaugcugaagauaacuguuauuggauuaguuagaacucaguuucuaaagaaaggaguugggcaaaagauggggcagguugugggaauuucugagggugguuuucccugugcauuguuuuguuuguguguuuuuguguaaauauuaggacucaucccaggaaacugccauggaaucgaauaauagaauaauggaauccacgcaagaggaugcucugcaccgccuggcugaggcagagaaguuagugguggagcugaaggauauuauuagucagaaggauguucaacuccagcagaaggacgaagcucugcagguauuguugcuugguuccgcugcugagcgauugauagagacucuuggaaaaucugguucuuauuucuaugacuagcucgcugcuugccuuaaauaagcugugugcuagauaaccggugaauucacaguuauugucuucuuugcuccauggcaggaggaaaaaaaagcugcugaaaacaaaauuaaaaaaauaaaacuccaugcaaaggccaagaucauguccuugaacaaacacauggaagaaauaaagacacaaggaggggcugcucugccuccagaagcccaggcagaggagcucuccaagguaggaggacaggcugccaacauggcgccuccggaacuccaguagggagggccgaucugcgcugagcacagacagcccuggugggaagaaugccucccuucccugugguuggccuugacugaaggucauguggggagagcacagugugggcuugagcuguuacccgggcccucagaguguuaaagggcugacuggaagaacuaaguccuauagaguacugauaacuaaguccuauagaguacugauaacuacagagaggagcagcgugugcuuccaggaugagugugauuagugguuaaaacauuaaaaacuaugauuuugcccugcucucaaauccuuucauuccuuaacuaauauagauuauucucuguuccuauaagcagauaaugguagauuaauguuuuaugaacuaugagcuaacuugccuggaucaaccugguguccuuggaaagaggcucccuaguuuauggcugcugccacaaagcagugucuagucgggaugcaagggaccaaggaaagcgguccuuagagaagcaugguguugcucagggcacguucuccucggcuuucccuucagcuuucccuucagagccacguguaggcauccacugagagaacagcaaacagcaguuuuuuggagcauuugugcaaauuacucugagacaggugugucacugcgcacugguuacaagucagcccaguccauccugcaggggacaugguuguaguucccuaauuugucuguugcacacuuugaugacucuauuauaauucucagaaaauucauagcguggggucagggggcuucagagucagagucagagcccgagggcccuuauuccuugccagugcugagcuuagccuugccauucagggaagggcgcucagagggcauucccuuuccuuaguggagaagcaguuacaccccguguaugaggcucuaggcuuaggccguaguacagcaggagcccgaggaggaggagaagcagaguagaauuguuuuaacuucucaaagcuguuuccuucccuccuuuaugguuccuaugguaacucuuccccuggcugugguggcaggcacugacuuuuuuccuuuccagguuugucaaaccucccuugugucauguuauuucaugcucugccuuucauuuuagcucacuucuuccuuagcccucagacuugugugucagcagcccuuuaaucacaguauacuuaguguguguguguagggggagaggaauggggggggggaagauagauagagaucagaggcaugaagaagguggcagguuccuugaugcugcagucgcagguauuucugggacccuggcuugaugcguggcucuaggauccaaagccuaauccucauagauuugagacugagcucuuugcauccugaaauccauugcucuuagguacuuuuugccuuguuccugucauugguuuucuuguuuguuucaggcaggcuucuuucucuccagaguccuggcuguucuggccguccagaccaggcugccuucuaacucagauccuccuguuccugccucccgagugcuccuaucugguuaaugaaacuguaauuaaaugucucuaaagggccaauagugugaacgaugaacuauguaugaacuacaacuuuuaaguaacugacuuuaucacauuuuucagcauaauaagaguucaacagaagaagagauggaaauagaaaaaauaaaacaugaacuccaggaaaaggagaaauuaauuaguaguuugcaagcccagcuugaccaaucagaacaagccucgcagguaggagugagucaccuugucauuauuagguuaacaaaucacuaauggcuaauggauauauauauauacauauauacauauauacauauauauauguauauauauaugguaaauguuaaguucuauuuuauauaccuuaacauuguaguacauagauaguaaccaauacuuaauaauauauaacaagcacuuauuauuauauuuaaaauuaauuuacauguguuuaaauauauuuuuaauuuacaaagacuugaagaacaaagaauggccuuugaguucugaguuugguuuuucuuuuguaaaugccuccuuuuacauagucaguagcuaucuccccaucagucagcccucccucccucccuuccucccuuccuucuaagccuaguacuuagaguuugcaguggugugugaugcucuugcuggccuuuguacauacucgguguauucuuucuguauaugguucacaugucuucuggaacuugaauuacaugauugacagugacugcucugcuccguugcugucaguuucuuccuugcacacacugccuuaccaaaaccucacucgagagacuggagagguggcucagugguuaagaguacuuucaacugcucuuguagggaaccuagguuagguccccagcaucugccucaggaagcucacaaccaccugugacuccaguuccugaggaucugaccaaugcccaccgaccucugcaggcaucuguauaccugugguacauagaaacucaugcaagcacacacauacacggagaaauucuuuaaaucuuuuuuuaaucucaucugauauaacagauaaaauucugucaucacaccuaaacgaaacuguuaucuaauaaaaauuaauuuauaauucaacuuuaaauuuuaguuaagcaauauuauuaaaaugaguuacuuuuggaggaaucacauuguaagacuucucuagccucaugugguuuguugauaccaaauuaugcagcauauucauacagguuucuuuuuucucuauauuaccucuauucugcuuucuguuuugagcugggucucacuauguagcccaggccugucuugaacucuguuuuucugucucagcccucugguuuugaaauuucaggcacacgccacuguacucagcuauugucccuagugcuggagcuagaacccacagccuugaccgugcagggcagacagccucccccaguggcuacaucucugguccucuuuaucuugaugucacuccucacaaguuuuucuaaguguauuucaauaucugucucuaacaguagcgccuguggcucaggcuugagauaucagagggccuagauuagccccacccucuucauauuucuuccucuagaaguccugcauuuagccauggccaaagaagugcugcugcucuucugauacuggcugcuguggguuccaacaaauauuuguuugcugcuuuggauuuuuccuguucccgaggccaucagauguagcucugucacuguccccuuucucucauacagucucuaaugccaagcaaacucagauuuccauaguuugcucucaacuuguuuauagagcaucucccuacuuuccugcuuuuguugucaacauugcccacguuuuuauguucgcugucuaguuggucugucucuuuccuaugugaccauucaaagauacugaaaucacuguugcuauugcuucugucuucuucugacaaauuuuaggaauucaauaauauuuuaaaaauuagcauguggaauucuuuuuugucgcaaaguauaaauuagaagggaguaggguagguauucaagauagaugagaaagucaaacaaauaagacauccaagugcuuugcuuaagugaauauucccccuuucaguuggauaagaguucugcagagauggaagacuuuguccugaugaagcagcagcuccaagaaaaggaagaacucaucagcacuuugcaaacacagcucagccagacacaggcagagcaagcugcccagguaggacgguggcaccuucacuagauucaugagauccagaguguuaaauguggcacgucagucccagcagucacuuucagagcuugguagaugaaagcauggcaguuggaugucacacuaggaggguguggaagaguuagaaguguggugaguauauggcgagugaugauacgcaucuuaacagaaaacaccagaaccucucaaaaaauacuacuuagguugaugaacuugccauagcuuauuaaugacugguuuugucucauaguuccagauacuccauuuuaacacagagagauuguguguuaggacuaggcuuguacugaauucaagagagacugacagaugaaaagaaauacagauuauucacuccauucuuuccauaaauuaaaaccuuguuaggaagccgcaccucagccuuagguuacuuaguaagcaugaaaugaagacgugaucaagggcccagaacccccugcucguggcucuaggauaucacucuucuucauacucauuucugaagccagagccauccaguuugcacuggcacccucaccucuguuuuucuguuuccuccugacaaccuaccacauaguucuccuuugagaaugcuuuuggaucaugacacaguuugaaucccuggagggccuuugcauauggcacauaacugauuuuaucuaucagauacauuaauaacaggggugucuucuaucuaggaucaggcacugguuguauacacagccagaaacauauauccagaaauugauguuuauccuauuaacuuauuuguagcacuauauacaguguaggauaggaaaagguuaugcauuuuuaaauugcuugaaauaaaggcaacgaagacaugaauauguuaacagauccaucauggagcaaaccacuccaaauacaauaaggccaaguguguugucacaagccauuauucuagcauucagaaggcugaaguguucagaucaugaguuugagaccaguguuggcaacauggcaaguuccaggacagccugggcugcacagugagacccugucucaaaaaauaaaaaugauaagaguaacaugagcauccaaguauuucgagagaaaguauuuugugaacauggcaguuauagaagcuuauguggaaaagaugggguuuaaacaaaacccaagagauaggcaauucucuagcuaagcagugcucucgaguuagggaaaagaguugcaaaggcagggaagaaaagugcaguccauuaaagggaaacuugugcgaagugcagcuggacacagcucaggaggugccgugccuuugcaagcacacccaguucuuuagucagagcaagucuuugaaaaccauaccaacaaagaagcuuuguauuuccauuuguacaguaucuugaaugccguagugagcucuaguuacucuguuccgggcaugagguucuggggcugucuuggagcaugugucugacacugaaagaaguaccaggggucaacagaaucuaacuucacuuguaagcuugauuuucugaucuucucagaauuaaaacaaaaacagcucuagaauauuuaagccauuuuuaguauccaugaaaauuucuaauuaaacguacguaugaguugauucugagucugagagcagacguucucucgugucugaaaguugcugcugggcuucuugcucucccaacauccucgcccuugccauucagagcugagguuuaggaagcugcucucuguccgugcugagugccugucguugcagaguaggcuguaagagucgucugugaaaugcucuggagaguaacuuguguaguuucucuggugugugucuucaguugaguuccaugcagcaggugguccgagagaaagacgcccgcuuugaaacacagguucgucuccaugaagaugagcuccuucaguuaguaacccagucagauguggaaacagagaugcaacagguguguugcucaagcucccuagaaugacugucauguugguuaacauuuaaucaagccuucacagccacugcccuucccacggcccucccuccacacagccgccaugcaguccuuggcuuuuuauccgugcccuaucuuuuguugccugucauuuugggguccugagcuuacauucucuuuuuccuuauccggucggagcuuggcacuuuaaagcugagcuugcgugggaaucuguguggggugagcagugggcuggcuucucuuucauuugcucauuuacaccuaccguucaugcucuaagucugaucgaaaacuucaaauugaugaagucaguuuuguaguuuaaauagagauaaaaaugaguuugaagcaacuuauuuuaaguucauugagcaaaguguuuuaagaucauugaguagacacugaaaauugacuucaucauuuuggaguuuaccauguacuaacucacaucguuuguacuuaaaaguagaacuguguaguaaugagaggugcuuuaguggcacuuugugugaucuguguuugauguauguuuguguaugugcagaugcauguuuauguacacaagugugcaugcacacauguacaugucuauggaggccagaggacuacuuuagaugucauucuuuccuaaggagccauuugcuugaauguuuccccucucugagacagggucucuauuggccuagcucacuaauuaggcuguuuccacuuccucagagcugggauugcaggcuuguuccaccuggccuggguuuuauauggauucuggggauugaaugcaagccccuacaaggauuuugccaacugugccuucuuuuccaaacucucauguguuuguucuugagugaaaacucauuauauguucuaagcaguuuuucagaauguacuacauggagcuucagaguacacugcuuugaaaaauagaauauugacuauauauauugauuauuuauucaauggcuauuuuucaagugccuuuccagugauugaaaacagaagagaaaugguuuuugcguauacagauugcucucuuuuguagguaagaaaugcauguuaccugugcuauuuagggaccagacaggaacuauauauaacuuugaaagugagugugugucauuuuaucuugaguauauuaggggcccugacucaaggccuugcuugcauuuggguuuggugguugucacacucuggagaaggcauuuuggagauucucuugcugcuggaugggccauggcauccuguuguccacucuuuaaucucuuaucuuccaugcucugaaaaauagccuuauagguacaugugacauuuugaaagguaggcaaauaaucaucuuauuuaucuguaauuaugccugaaauguuuucuuuccagaaauugagggugaugcagaggaagcuggaggagcacgaagaagccuugcugggccgugcccagguuguagaccugcugcagaaggagcuaacgucugcagagcagagaaaccagguacugucuaugguuucuaccuacugccugccagaggcgggcuccauuugcauguuagauugucaggcaggguauaaaagcccaugagcuuucagaggcuugcugccaucugggcuuaacuuccggugacaucgugguaaaacaagcacugccuuccccaggccuuccugcuuccaucuucuguugcacuuucccuucaccauugagggucuagaguccuucuaaagacuuuccuguugucgucuagcgaguuucuuuuccaucacuguaccccuuguccgaguccagugcuucuugugccuugugcuuggucuuggcuuugccugucugugcuggucaacucucugcuggacugaagggauccuauaaugcaauagucccuucccuugucuugcuaucugcggaucucccuucuuccuggguugguggccaccuacuggcccaugaggacaaagggagcagaguugucaagcagguuuucccgacagccugugaguaugcuuuggggagauuauucggagucagucaggcucuauaguuuaugggaggugggcaggaauagccagggugggcagguucaucgccgaaggcacugagaugccucauuagcguguggagaggcaguccaggagucucgauggaugcuugcuaaacaaguuucuuauucuuauucaggagaaaggaagcugaaccuguaaccucaccaaggcuauaggacacuccguagguagaggguuuaggaguuucagacuccccagcugaggucagaaaaggagaagcccuauuggugaaaggaaucugccaguuugccccaagcucggggcuuucuaauaacaucagacuuucaccucaguuagcagggcccaaugcuauccuguauggacccgugccucccacuuuggccauuucuuaccuaucuguggcuucccuguguccuugucccauugucauaucuagguagccaaauucuaaugcagaauugguucuauagcaacacagccuuuguuuacauggguguucucugcugccugguaaaaucagccauacccuucuuccucacuguccagcaaagccuccuugaggcagcuuucuuaguaguauagaagcguguucuucuuguuuucauccucaaaaaacugguauccggacucuaggucuucucuggguguccuggggcaguaacuaggccauugcugcguggauaccuguaucugugugcccucugucagauuacauguuaguuaaugcacuguggaucuucacagcucucuuaugcaauggguaguaucauucccucaucacagacaaaaaaacuucaaacauagaggaugccuacacacaccugguugauuuaguaggcuucagauuuccaucaauaaacuaaggguaguagaauuuauaugaagggccuauuuuagaaucacaugaaauagcaaauaaaaauguuaggguuuggcacauaugaaagauugugagagcacaaaucauuaccauacuacugaagacauucuagagagucaccaaccaccuguaauucucaaaucugauuagugugucuaagccuuauuuuacuagaccuuucugcacuauuuguuucuugguaguugguuguuuauauucauuucuuaaaaauagguuuucuguguaauccaggcugcccuugaauccgugauucuccuguguucugggaccccuugugccacugugucuugcugauauuuguuaguuugucacuuauuccuugaagcuucuucauucccauuagcacagggcacagcuugguucuuuuccugucucugaaacuuuucuuuauuuuaauuaguuuuccuuuauagacuucucuuccagcccgguagacaguguuugcgaacagacuagccccugcccaguauccuuacuauauacagucuuaucuccuucccucuuacagcagcuguggcugucccacugccauugguuucuucccaguauuuaucuccccaguacuuuugguauguaucuaguucccuggagauucguggcugaccaauaagcuuggcagugucaccucaccuuccuucugaaagcagauuauuuguagcucagaagacaagacacggagcuaccagcgccuggcauuccccacgcugaguagaccagaggcacccauguucuccugugagugcugcagcacugcucaugauggucgagauacaaagagccagccuaggcaccuaucaguggauguguaauacagauaaauauagauugugaaauagacacacaauggaauguuauucaguccuaaaaaaggaaugaaguucuauguucuacagcaacguggauagaaugcaggaugugacaguaagugaaacacaucaagcacagcacaucaagcacagaagucuguaguugcacuugacaacaucuguuaggaaacccuagcacagaagagugaauguucccaacacagacauuugacugacaugagagagaccagugaccgugaucugacuguuacuccugugugccucauugaaacguuacauuuacccuacaagucggucuaguuguugcguauccaauucaaaagcacauuuuaaaaaauacuuucaccauauuuucucuuaacaggguauucaguuaaaagaauaaaacucaaaccuucuuguuucuuuugucuucuuuaaccccuacaauuaauuaucaguucugcugauuuaaucucuuaauucuaacucugcccucaucaguaauauccagaccuaguucugucuuuggaacaucuuugcauaaagagcucuucccgacaaguggcaugugugugugugugugugugugugugcgcgcgugcgcacucccgugagaaggguuguccaugugaccagccuccuuauuacuuagagaacugcucuguuuucuuagugacaggugugugcagagccuuguuguuuucuagccuccucccauuuccucaccugacuuucucaaugcuaacuccaacuaccuuggcaguugguagucguguuucuccuuuggcucucucucugccugaaguaccauguuucguuccuccuugccuggcucguugcuuacuuuuaaguuuuagacuguuuggcugucuuuaaaagccuaccccaucccucuucucuucccuugaacgauucccagauaucccuccguguccucugugcuuucguaugaugcucagccugcuucggugccugaacccugcguuccuccagggcauggacuagagugauuuauucacagugaauugaguccgucuugucagagccugugcuggugcuacgacaaguauggauaagacaacgugccuccuucccucaugaagcuuguucucuaacaggagaggcacaaaugaauacacacccauauaaggcaaauaggaaugugaauaguccaaauuaucuggaaagcaaacacagaggguauucgcuacuccacagguucagugccagugagaggcucguaggaguguuucagugugcuccccgaaugagagagugcgguaguuguggauccucaugcuugguguuuuguuuguuuguuuauuuuagguucuuucacagcagcuacagcuguuggaggcugaacauaauacuuuaaagaauaccauggaaacagaaagacaggaguccaagacccugauggaaaagguagaacucgaaguggcagagagaaaguuauccuuccauaaccuucaagaagagaugcaucagcuucagggacagcuggagcgagcaggccaagcccaggcugaccuggagacacaguacagugcucuccagcaaagacauaagacagagauggaggagaagacggcuugcauuuugagucuucagaagaacgagcaagagcugcagucugccugugcugcucugaaggaggagaacucgaagcugcuucaggagaagcacgaccaggcugcugagucagcccaggccaugcggcagcuggaaggucagugugugccacaccucuagccccuuaguggauuguacuuccuagcuucagggcuugguuaguggcaagcgcacuaggaaggcaucuccucuggcgugguccccuccucccugucaagucacaagucuccuaaccgugucagcucagugcuaaacacugcucagccccagucccgacacucaggagucccguguaaaacacagcugaucgcaagaccacaguaccugcugggcacagaauggaauguguuccuggaaaugucaggccacauuuagacacacagacuaaauugcaagaagccauccauuaguuuaaagguguaucuuauugcuuuuguuguaggugagaauuuccuuuugaagaaaacuuuuguuucuaaacagguuuuaagaaacauuuuaaaauauuuuauuaaaaucgaaaaugacccuaaaagaucaccaguuuagggguuuauaaaaaacagugcaacucccugaccuuccuuuaaagaugucgccagcaucuuuaaagucuccauguagugcugacagaugggagugcacaugcccuuggagggaguuuaggaagaaguaauuugcaaacaagcaccacaagguugguuuuuaaccagaaagucuagaggccaucaugagggaaaggggaaauaaauaucugagcccauugcccucuuccccccaaaccauggucauguuuaaaccccucuggggacucuugauggucucauaacauuuuaguggagcaugaggaauguaauauaagccaccaaagccauucuuaguuuucuuuuuuucuuuuuguuuuuuuguuuguuuguuuguuuguuuuguuuuuuguuuuuuugucuuuucaaaucaggguuucucugcacagucuugggcuacccuggaacuugcuuuguagaccaagcuggccucagagaucccucugccucugccuucugaguacuggaauuaaaggugugccuggcucuaccaaauccauuuuuaagggguaaaugaaaaaugauuguuuuaaauaucuaggccugucuuuauuagcauguuaccagcuaugcauguuaauggcauuuagagugagaauuccauacaugcaaacaaacaguguguguucacaaccuccugccauccuuccucagacuuccucuuaucgcccucacccuuccagcucccuaagaaucacugcucuuucugaggcuuuuucacacuaguuccggaaguggagauggaccgugcaguugucuggcucucugcacuuagcgcaguguccccgcucaguccacuguuaugcagauagcaggacugcauuuugcuuugugacucugcaagguuccaugugcuuauuucuccuuugaaggaaguaguuuccugaggugcccuucgauccaaacaguaaaaaauguaauuggcaccauaagcuuaauuagguagcugaacuagugaaguucaaugugguguaucuguagggguuucugacucgagcagaccucgcuccugugugcuugucuuguuuuccucagauaugcauguuuguuuucucuuccuuagaucaacuccagcaaaaaucuaaagaaauuagccaauuuguaaauaagccaaacuugcaaaaaaaugaaacagcaucucagacuucuuuaccagauguuaauaaugagggcgaccagguaauuaaugugaauuucucugugaucuauauguauuugcugugcugaagggcucucucuaaugaguauugcagagaguguaaaugugcauuuucuaccuaaugaaaugcuuuuaggggggugacucuaucugaguagaauccugaaaggcaucaaaguagcuucccgacaaggauaaauaacauuugcgcuuucuaggccauuuuuccagcaauucaaauagauaggcacaguuuuauaacaagcgcuccuaucccucccuccagauaguacuguaauacugaggauaaauuugcucuucgagcuguccuuugucccucucuguccaucaguucaucuuaaugucuucuaaacgucacaggcuacuggcaucaggacuuuuucuccagauauuucagcauguauguuguugacgauaauucaguauuuguugguaguugagagagucuucuuuuucucuugaggaaagguuuacagaccauuaaaugcauaaaucagaaguauacuaugaguguuuugucagacgcauucagcugugguacccaaacucuugauaaggucuaacauacuguugucggccugcaaaguguguucuuaugcgggggcuacuauuccauuuuccaccaugauuucauguaguuuacuuauaaauauaauccuggagcaugugcccuuuucuuuuuucuuauaaauugccauuguagagcaaaagcagagauaaacuaaacaguaaacaaaugguugugguccuguccuaguaagagcaagugggagccugcacagucuugugguaccauucuguguaaagcgcugcuuuuguuuccuauggguguagauggggauguacugugcucguguguguguguguguguguccacaggccuggacaugccucucugcugaugggaucuuacaacucuuguguagcugauuauaucguuguaucaguuuguaggucucgcugacuguagaccucuacauugacagguuuaguuugguguugcuuucguuacuuuaaagaguucuccucagcucucuugucuguuaugcuuuguuuuagauagguaaucuccuuuuaaaauuccuucugcguuuaaacuuuuaucacuggcuuugaacacugggguauugguaggccagggccucauuuucacuguaguuccuggugcuuagaauuugucaacucuggugaaucucugcauuucaauucugcauucauuuugagaguugcuuuccauuagauuauuuuuaugacucuucugcugucuugauguacuuauuuuaauucuagugucuguaucaguaaugggucuguugauuguggcuuauauuuucuggcauccuuacaugccaaauaaucuuugguugccaauauugauuauauauauucacauaaauagcuugaaauguucuaaugggugucaguugucccuugaaaagaaaggucgauccacagcauguuuauccucuaucuugucaaguagguagcugugguaguugagcucuccugaguuuguucccuucuauucaugugcagccugcugaguacacauggggccacccucugcacauggccuaaaagcucauuuagggcauuaaguuuaccuacacagacacacaagcaugaauacaggaaugcccacaccugcauauucuuucucuuuccccaccccuccacccaaauauucuuaacauuguaaucuucuuagggcuaucacuuuaaauacagaaaccuuguaaugacauacucucaccuuagccuuuaugcuacauuugcugcuuauguuaauuaaaguuuuaaauuuuagcauacaguguugacaugugggcauugaaccguuacauguauuuaaaacagaucaaggagaagauguugacauauuuaccaugucccauguucuuuuucucucugaggcuugguuuccauccaguaccauguuuuucuggaauaaccaccauauuuuuguagcugggacuacuaaagaauaauucucuuggugugagcuaauauuugcauuuuguuuauucuuaaauggauuuuuaguucuguauugacacuuuuucauucaggacauuacaacaaucuauuuuauggucuucugccuuacauggucccagcaguucuuccuaugauuguuccuacagagggaaggaucguuuucccacugagcuuuaaaagaccuuucucuuacucuuuguuauauagucauuugugguuuucuuugcaauuuucuuccuuucauugagucuuuuucacagauauaagcuuguauaugagaaaaguguggccaucuuaaauaauuuuucuguguauuguguucuuccuccucuuggaugcaccaauuaaaguauauuucaauauuguccuacguguccuugagucugugguccuuuuuucuucaauaaucagacugaucaguuucucuugaucugccuucaaggucacugcaugucuuuucuccacagucuucuagcaagccuaaccauuggauuuuucauuucauauuugugauuuucuaucccagauuuucaaacuuuuucauuuuauagaguuuguuugucuugcaccuaaaguuccugucuucucauucacugcuaacauuauauauuaccauaguuauaauauuaucuuuaaaauccuacuuugcagccagaccuuacauaucuuuguaagcccagaaguuaggagguagaaacaggacacccaaguucagggccaucuggcugagugaggcucugacucaagacaaaaaccaagguaggaauuuagcucggugggagagcgcuugcagagccugccaaaggucccggguucaauugcugucaccacaauauaaauaaguucuugcuugcuaauccgaaguuugcaucauuuugugauuagucuuucuugguuauauuuuuccuugagacugaaucucaguuuccuguuucucuucgucaugagugauuuuuguacugaguucuaaaugcuauaaauguuucauuugggacggccgguuuuguuguuucuaaacuucugaagcauucuguagaguggacccacaauguccacucuggccugugguagagagagccccaaaacucaguuggagauuucugccuuggguaauuggucagcccaggaguuauaccauugauuguucagcuggcggucagauugaauguauagacaguuaacuccuugacugacguucuuccucuguuugcuucccucacacugcagcuuuguuccccuacagggcuuuuuuuuauuuucaagacagaaugccuauagcuguuuuauuggaguuuuauuuguuucauuacaaauuagaaacuuuccucuagguacaagucccaaacccuacacauaccucuugcgguuucugugcaaacucuauagccuaacauggcaauuucaauaaaguugaaugaaaaaguguauaaaguaagcccuuuguaggauaaaggguuaaaaaaacugaagauuuaauauagauacuugcuugucauuaagagagacagacauucuagauauauaaaggaaggagaagaacauuuaguuguaaguggaagaaacccaaggacaucgauaccaguucuuccgccuccugagaggucucucuuccuguucauuuuccuccaggccuugcugcuugccuggcuuuaaucagaucuauauaagguguugcuuaugaacguuuaaaauguucuuucaugcaccguugacuugggauuucuuucuucauaauccaggcuucuaucuuggauucaaacccaaugagcuggaagcuuaugggauagguuuuauuucuuuuuccaucuucagaauuaagaacuucuccaaagauucaacaggcagaggaauggaugcuguuucuacagcauccucauagcuggagaacuugaaaaugcuauacgugauagaggcccucugggcaucagugugagagcuugcacuggagaaucacuaauuuauugucucucuacuauguaggcagugauggaggagacuguggccucuuuacagaagagagugguagagcuagagaacgagaagggagccuugcuccuuagcucuggagagcuggaggagcugaaagccgagaacgguauguauaaauaaaauccggaacucuaucuucuuaucccauaagugccucugcucucuauuuguuuuguuuuguuuuguuuuucgagacaggguuucucugcguagcccuggcuguucuggaacucacucuguagaccaggcuggucuugaacucagaaaucugccugccucugccucccaagugcuggaauuaaaggugugccaccacugcccagccucugcucgugcugcugugcacauauacacauagcugacuuggcacacuaagguucucagauagcagaacugguagcuaucaagauaaaacuaauuaaugcacacuauguagcugagcacagugcuggugcuuauaucaggguuacauuuucugacauacgcuguaaacacuucagaguuucugaauacuugauauucauuuggaacuggcaaagauaucuacuagggacuaugacuggaauuggacuuuacuaagaugcugaauuuuuguaauaggcaaaaugaggacaggaaugagguaagagaaaucaaaauaaacuacaaguuaggucccugucgucuucugccauguugccauccugcuuagacuccucccccaucagcccucaccuagggcacugucuucuuuaggaacucagucuucauccuggauuaagggcuuugugcucccacaacauccuuuguaccuugacugauguauguggauggucagugcucaucugguuuauuguaagcccuuggaagacaugugugagcuguuuaagggcugagaacuuuuucaguuugcuuuaccuaaacuuagcaacaccuggcaaauaacagcugcugacuaacgucuugcuggauuaagcugagcgcauuagcauuuuguucuacuggacugcaugaacagucgaugagaacgaaggcaucucuuggaccuaccugucuucuguuuuucgugugcuuuuggagaaccuccuugguucaauagcaugugguggugaugucucacaacucucauucaucuaggagagugguuuccacccuuccaaacacagugaccauuaauacagucgguuccucauguuguugugaccccaacccuaaaauuauuuuuguugcuauaucauaacugcaguuuugcuacuguuaugaaucuuaauguaaauaucugauaugcaggcugucugauaugugacccccugugaaagaucauuagacugccaaggguugugacccacagguugagaaccauugaucuagacaucugacuacuauacuaugcugugcugugugcgagucagagaggacaucacauaaacuuuaaaaaaacuagauccaauuuuuucauguggccauuuuguaguuucccaccuagcuccugucucaaaauuaugcauuauuaaaugcauaauuauuaaaaauauugcuaacauugccaguaaagccacaaguucagcucauuacuuggcccacuugaagcacuuucuugguacuuuauccauaauccucauucuaccauuuugcaagcagcuucuguccuguucaugugauugucauaugcuuugcagguucugugauuuccguucucugucccuuggguguaauuggccuuaggguccucuacccuggcucuucugucugcuguuguaaaugaccuuugaguucuguccugucccuuccaucucacuuuguguacugccauuucuacgucuuucucaugugucugcaaugucugagcacaauacguguacugucuugaauucauauguucugugaauauucuuccuugccugugagccaggcacuauucuaugugcuguagauacagcuaugaacauuuuagaguacaagacagccauaaacauguauaaagaagagcguguuauguuaggauggaaaugaaaucggaucaugcaaguguaucugagguaagagaaagggcaggauuacagaggucaggauaggccucucugggaacuugacauucaaauagcuaaaggcagggcagucaugaaagaacauauuaaucaggggagagagcagagcaagugugaugugugaacauauuugauguuugcagaauagaaagaagcucugaguuuuugucauagagugaaaaaagcaauacaagaggagguugaaggauaagauaggagucaaaacaugcaagcuccaggucaugauaaggcauugagauguugcauaaaaacuaaaugagcuuucuuuuuuuguuuuuuguuugguuguuugguugguugguugguuuuuuugagacaggguuucucuguguaguacuggcuguccuggaacucacucuguagaccaggcuggucuugaacucagaaaucugccugccucugccucccaagugcuaagauuaaagggugugccaccacugcccggccuaaaugcucuuucuuuaguuuaguuuuucagaaagaauauaagcuuccggaaguaucuccaauauuggugcucaauaguuuuaucuuccaggguguugguacccauguuagagcugcauguuaagaccgggauccugaucccagcugucugucuugcccuguaaccucuucauauuaugucauuuguguccucauuuggucuuugggauugcaauuaaaacauauaucccuuuuagugcuaacauuuaacaucugaaugucuguuaacgaucagaacauuguaagugcaauugugcaaaaauguacaaguaggaauguagaugaacuaagacaguagaauuuuagauuauagcauaaauaacugcuccaagucacaugucuuucaaacauuacacuaucuagaacauaucucucauggucauuaucauacuguguucuauuaugucuauuauguucuguuauauaugauaucuauuauauuguguuauguauaacaucuacuguguucuauuauguaugguauguauuauguuguguuauguaugauaucuacugaguucuauuauguaugguauauauuauguuguguuaugugugauauuucauauucuuuuggaggcaucagucuuuuaucucucuuaaaguacuuuacuuauuucuuuucuccauuuuauguaucucaaguagccuugguacagcuauaucacuguuucuuucaaauguuccacauauauucucuaaagguacuacuuuuuugacuuucagaaaaacucuccucucggauuacucuuuuggaagcucagaauagagcaggggaggcugaugguacggucugugagguaaguaaccacauagugcaaucauagugggaccuggauuaaacaaggcugauuccaacaguuaacaguguugacagagaauuguauuacccauguagugaaaugacauuuaagagagucguagugacuagacuuagucacuuacucauuucuggauauuuggaauucuuugucuuaaaccaacacuaguacacacuuguauagugguuacuuuucuguuacuauaauaaaacaccaugacuaagacaacuuaaggaagagagagcauauuuggacuuacaguuccagaggguaagaguccauucauggugcacagcaagcaagcggcaggcauggcugcaggagcaggccggacaguaaucacauccuucaucauacgcucggagcagagagagggaacaagaaauggcucuaggcuucaaacucucaaagccugccuccagugacauacuuccuccaacaagaccacaccuccuaaacauccccaaauagcacccaaccagggaccaagaguugaaauccaugcgccuguggaggagagucucauucaggcaccacagcucgccucuucguagagaggaagcagaaucucuggaauuucucauguguccuaguugguaguuuuuacucaagauuguauuucaaaggagccuuuaccaaauuguagcuuuugugaccugaaaaguguuuguuuauccuacuuuuuaauucuaauuucuuuauuuaugaguuuauacauguauauacauguaugaaauaugauacuaucuaucucauuucuccccuucaguuucccccacaucccacuagcaugucucuccuaauuucaugucauuucuuuuuuugauaacccacuaaggcaaguaguauugccgauaugugcauggguauggggucauucauugcagcacaggaaaucuacgaggggaaacacccuccaaaaagagugauucucccuccccaaacagccaccaagugcuaguagcuccuuaauaacacguagggccuacagagcucuugccuaucugugcuggaauuuucucugccuucaucuuguuuaaguaaccacagcugcugugacuucaugggugugacaguccugucauuuccagagacugcauuccacagaucuccccgcacccucuagcucuacauucuucccaucuccucugugacauucccugagccuuggcagggaguggaggguggugugauaaagacguccuguuuagagucucuucccggcaccuugaccaacugaaauuuaaucuaacaagcaucauugcuuaguaucauucuaaguuugugucuuuguuagcugcauuauauuuaauuugccaugcucucuaauggauaauaagugacauuuggaaguaauguaguuucuuaacaaaguguugcuuauuauacaucagucuuugucucuagggauauaauaugaauaucauuuuagccccaaagagauacaguuuuacaaauuggcaaauucagaauuccagcugagccagaggccauccaaaauagagaaauauuaagacuugagucaagagaugaucugcuaguagauuucacucuuggggauaagacaauuuuuuuuacccugccaaggccuuaacugauggaaaagguucaccugaacuagaaaggaugguucgccuuguucgaauucuccucauuuauagcaggagagagaacucaguuggucacgugcuuacugugcaaugucaggucuuagcuuugagccauggaagcucuaaaaccuggacaugaugguacaggcuugcaaucucagcacugggagauggagaagacagaucccuggggcuugauggccagccaggcuagccugcuuggcgagcucuaagcagaaaaucuggcaggugauuucugaagaauggccugaagguugaccucuggcuuccacauacagauguacauauauguggccccaccacaugcacacaugcauacccauguauacauaagcauuaaauguuaaugccaacuaaauagaaguaccuagaguaauguuuggccaaagaucugaguaccaugaucuaaccaaguuaccacauaaaauuaaucaucagacuuacauagucagugcuucucauggagccaaugaggucuuguucacaaaaugucaauugugacuuaauuuggaaaauuguaguauuauaaaguuauaaaugauaagacucugacuaaaaauacaucuuguuuguccaagucaacauuuaaaaguauucccuuaaaggcuugccaaugguuucuagugaaagcaagcuaaaacauagcuuuaaaaaaaaacaaaaaaacagcaacacaagaaacauaagaaagaugggugucuaguaagauaauaaaaagcaaaagacgcagaaaauaauuagcaaacaaaaauuaagaaaggagauuuuaaaacauagaugcuauauagaaaaguugacuggugcuaucccuugagaucacagauauuaaauagagaaagaugcauagaagaaaauucagaggagaaaagaaaaaugggagcagccaaaaaaagcaaagcucucugguucucuguccucuugguaugagaugacuuaauucucuagucagaggaaaaugaacucugagauacuauagcgagugagggacgagaauaaaugagcgauaugaaagcaaguuauaaaaagaaaugaaaacauguuggguaauagaacaaaaaacaguagguuacauugaacccugugauagcgguauacacacacacacacacauacauacaucgcauacauuacuguaucagauuuuccugcuuguagggauggaaacauaagacugugaucugaaguuauagagaacuuuccccaaugccuaguacugagaucugugaauuauagucucugcaguacagggaaaaaguuauaaauuauuaagcuaguccuuaugaagacuauugagauuauagacauauacugcuaggccuggcauuuccuugguuuccagagcucuaaauucagguccucaugcuuguucaacaagcuuuuuucccagugagccaugcccacaccccccacaccccuuugugugcuucuguauauggcguguguggggggagggggugugugcccaugucugugccugugaagaccagaagucagagucagguuuuccuuggucgcucuccacuguguuuuguuuuguuuuguuuuguuuuguuguguuuguuuuugagacaggguuucucuguguagcucuggcuguccuggaacucacucuguccacuguauuuuuugagauaggguuucugaaucuaaaaaauuaaauacauugugugacucacuaguuuucugucccaagcaaaaaauaccgacgacauggagggagugaccuagcacgguuauauuugccacaugggucccuaaugucacguccaagugccagcagagcaccuucuagacuucuugugccugguaacgugucugcaccugcuuguuugguaauccacaugucaguguuaauuuuuuuuuuuuuuuacaacuuucuuauucaguaauugcuuaggaaaagaauuauaacauacuccuuggagucaggcaggguauucaauuguuuguugccguugucguuuuguuguuuuuaaaucagauuuuagaagaaauaacuaggcauguuaaccuagaagaagaauguucuuuugugugggaaauaccuagaaaauggauugcaagcuuccuuugggcccuuuugacuuggaagagaccucagagcagggcugauugaauuauggacauucaguuuaggagauacagaguuuuacagauuuuuaacaguuuuuuggcauaaaagaaguuugaaccagaggguuccaaguuuuaggaaauucauaaaauguucauuuguguugggcuauuuguaaugcucuaugagccauucaauuaaggccuuucuugguguuuugugguuauuuguuuuccuuauuuuguaauaggucagcacggcugguacuacucugcucaacaggagugacucuucuccugaagaaaaugggcaggcuguucuagagaacacauuuucucagaaacauaaagagcuaucaguuuuauuaguggaaaugaaagaagcccaggaggaaauugcauuucucaagucacagcugcagggcaagaggcccgagggggacuaugagguccucgaccguagagaagugcagcugauggagagugaaggaccgcccucaguuacagcaggagauguccucugugcacccagugaugagagcagcggcccagcagcugaagaggaacaggcaggcaugaaagaucggcaucgagcaucugaggcaggaccucuaaaugaugcuggaauggaacugagcuccccgaagcuggauggcguggacaaaucccucgcagugucccaugucugucagugucaccagggcgaacuggaaaggcugaaaacucaaguuuuggagcuugagacaagccuucauacagcagaggaaacuuacaagagaaacuuaagugagaaagugaaggaaauuagcagccuaacccagcuuagcgaagaggucaaagagagcgccgaggaagcccgcagcacgcucgccgcagugacggaagaaagagaccagcugcuuuaccaggugaaggagcuugaugucuuagcagaacugcgggcucggguccaagaacuggaaagcagccuugcagaagcagaaaagcaaagaggucuggacuaugaaagccagagggcucagcacaaccugcucacggagcagauccauagccuaagcauagaagccaaaucuaaagaugugaaaaucgaggcuuuacagagagagcuggauggugugcagcugcaguuuugugaacagggaacccagaugaaaacccuucagagccagcuagaggcaaaggagagggaagugcgagaggggacagagcgucugagggacaucucacaggagauggaaggacugucgcaggcucuuucucagaaagaacuggagauagccaagauggaccaacucuuguuagagaaacagaaagauguggagacacuccagcaaaccauccaggagaaggaucagcaagugacagaacucagcuucaguaugacggagaaaaugguucagcuuaacgaagagaaauuuucucuugggguggaaauuaagacucugaaggagcagcucaauuuauuguccagaacugaagaagcaacaaaagagcagguagaagagaguggagcuggguccagccuuaaacuuggucacgaugagucaggucaagaggggcuucagcaggagcuggaguugcugcggaaagaaagugagcagagaaagcggaaacugcaggcagcgcugaucaacagaaaggagcuacugcagaaagucagccagcuggaggaggagcuagccaaggugagagaggacucucggaaagagauucccuucggggagaaugagaggagaaagcuggaggaagacagagagaacagagaugacccagaagaaugggggacuucuaaguggcgagaaguagaagcuuccuuaaaacagacaauaucugaaaaagaaguggagcuggagggcauacggagggauuuaaaagaaaagacagcggcagaggaagaguuacaggcugugguccagcggaugacucgggaccugcagaguaagacaaagcagauagauuugcuucaagaagaagucacugaaaaccaagcaacuauucagaaauuagucacaggaaccauggaugccgggaauggaggcucagcagcaccuguaaaagaaacagcggcgagcagcccacccggugcagguggugaggagcacuggaagccagagcuggagggaagaauacuagaccuugaaaaagacaagacacaacuucaaaagaagcuucaagaagccuuaauugcccgcaaggcgauucugaaaaaggcacaagagaaagagaaacagcuaaaggaagagcucagggagcagaaggacgcguaccaucaccuacagggacaguuccaugagcagaauaaggagaaggagaacauugcggaccagcuaaggcaacuccagugccaagcaagggaguccauagacagacagcucccaggcacuggccagcaggaaccugguccucccgcuccaaguuuagaaggcauuucccuagaagacacagagccugcuucagaaucugacuuacacgcagcucagccuucuccucccggagagacagcagcucuccaggcuacuguuucuguugcccagauucaggcucaguugaaagaaauggagguugagaaggaagagcuggaauugaaaguuaguucuauagcaagugagcuggccaaaaagucagaagaaguacuucucuuacaagaccagauaaaugaacaggguuuagaaauccagaauuugaaggcagcauccguugaagcccaggcccacacagaacugcugaagcaggaguuggaaagcagccaguugaaaguugcuggccuggaacaucugaaaacguuacagccugaacucgaugcacugcacaagcacaugggccagaaggaagaagaggucaacuaccuuuauggacagcuuagugagaaagagcagacccucaccacgguccagacagaaaugguggagcaggagcguuuaaucaaggcucugcacacccagcuggaaaugcaagccaaggagcaugaagagaggcuaaagcaggcccagguggaaauuugugagcugaagaagaagccaacagagcuugaggaagaaacuaaugcaaagcaacaguuacagaggaaauugcaggcugcgcucaucucccggaaggaggcacucaaagaaaacaagagccugcaagagcaguuguccucagccagagaugcuguugaacgccugaccaagucucuggcagauguagaaagccagguuucuguccagaaucaagagaaagaugcaguccuaggaaaguuaaccauucuucaggaagaaagagacaagcucauugcagaaauggacagguuuuuacuggaaaaccagagccucaguggcucuugcgaaagccugaaacuagcucuggggggccucacggaagacaaggaaaagcugauggaggagcuggaauccgugagaaguucuaagauggcagagagcaccgaauggcaagagaaacacaaggagcugcagaaggaguacgagguucuucugcagucguacgagaacgugagcaacgaagccgagaggauucagcacgugguggaaagugugcggcaagagaagcaagagcuguacgcaaaguuaaggagcacagagucggacaagagagagagagagaagcagcugcaggaugcagagcaggaaauggaagagaugaaagagaagaugcgaaaguuugcaaaaucuaagcaacagaagauccuugagcuagaggaagaaaaugaccggcuuagagcggaggcgcagccuguaggaggaaccggugagagcauggaagcacuucuuucuuccaacuccagcuugaaggaggaacuagaaaagaucacauuggagcauaaaacccuuucuaaggaguuugaggcuuuaauggcggagaaggacgcucugagugaagagacucgaaaucuaaagcuucagguagaagcccaaguacugaaacaagcuagccuggaggccacugagaaaucugaugagccaaaggaugucauugaagagguaacacaagcuguggugggcaagucucaagaacgagaugcucugagugacagugccaagcuugaagauucggaagcuauucugaugggcgacggcgccaagccggguguuagugagacuuucagcucccacgaugacaucaagaacuaccuccagcagcucgaucagcuuaaaggaagaauugcugaguuagagauggagaaacagaaagacagggaacucagccaggcuuuagaaaaugagaaaaaugcccuacugacucagaucucugcaaaggauagcgagcuaaagcuccuggaggaagaagucaccaaaagaaccacgcuaaaucagcagauccaagaagaacucugcagaguuaccaagcugaaggagacggcagaagaggagaaagacgauuuagaggagaggcugaugaaucaacuggcagaacuuaaugggagcaucgggaauuauuaccaggauguuacagaugcccaaauaaaaaacgagcaacuagagucggaaaugcggaaccuucaaagaugugugagugaauuagaggaagaaaagcagcagcuggucaaggaaaaaaccaagguggagucagaaauccgaaaagaguacauggagaagauccaaggugcccagaaagggccggccaauaaaagccaugcgaaggagcuccaggagcugcugcgggaaaagcagcaagaagugaagcaacugcagaaggacugcauccgguaccucgagaggaucagcgcccuggagaagaccgucaaggcccucgaguucguucacaccgagucccagaaggauuuggaugugaccaaaggaaaucuggcccaggcaguugaacaccgcaagaaggcacaagcugaauuaucuagcuucaagauacugcucgaugacacccaaagcgaagcugcgagagugcuagcggacaaccucaaauugaaaaaggagcuucagucaaacaaagaauccaucaaaagccagauaaaacaaaaagaugaagaccucuugcgaagacuggagcaagcagaggagaaacaccggaaagagaagaagaacaugcaagagaagcuggaugccuugcacagagagaaggcccacguggaagaaacgcuugcagagauucaagucagucugaccaggaaagaccaggagaugaaggagcugcagggaagccuggauagcaccuuggcccagcuugcagccuucacuaagagcaugucaucccugcaggaugaccgggacagggugaucgaugaagcuaagaaaugggagcggagguuuggcgaugccauucaaaccaaagaggaagaggucagacucaaagaggagaacugcauugcucuaaaggaucagcuccgacagauggccauccacauggaggaauugaagaucaccgucuccagguaagcagccaacauguuccccuccagagagaacuguaaaggcaaggaaagcuuuuaaacuguuuugacuuuauuauuucauuuauucuuuauuuguuacagaaccaauguuuguuuuaaauuacuuuagaauguauauccuuccccuucuaacgcuuuuuugcuaguuuuguaacuucuuguuacaauguguaucacuauaaaaucauuaacaaaaucacugauaucuuacucccucccacccacccacacacacacacaccaccaaugucuguuaagagacagcuuagguuucucugccuucccauuucuguuucuggauuucuugacaaccugacuaccugugucuagauuuccaccagcuuauucccaaaggauugcuuuagugcccugagucgucuuccccucucucuuugccacaguugucaucaacuguacucucucugucaguuagaaacccuauacucaaacucuagaauaucauuuuccaagcucaggagccagcauuaccucuacccuuaguccgccuccccuuucauuaccuuacuguuucuuuugccaagauuguagcuuuaaagaaaccuaccauuagcuugucuggagcaaaguagaauacuugggaguugauuugcuuuucaguaucucaggcuggggaucaguaaaguaaggaacaaacuuccaugauucagaucucccugauguaucuuuaauauguuaucuuuuucuauguguuagaucauguuauuacacguguauagauacagagaacuaagauaucugaaaaccuucaauagugaauauugucugauuuguagaucaauuagguauauaucauauaguuaauauuucuccuccccuccuuuucucuacccucuuucuucccccugaccccuguccccauccccuaggcuugaacaugacaaggaaaucugggaguccaaggcccagacggagcuccagcaucaccagaaggcuuaugauaagcugcaagaggaaaauaaagaacuuacgucucaguuagaagacgcucgccagcuguaucaugauucuaagaaugaauuaacuaaguuagaaucagaacuuaagagucucaaagaccagacaacugaccuaaauaacucuuuagaaaaaugcaaagaacacgaaaacaacuuggaagggaucauaaagcagcaagaagcugauauccaaaauuguaaguucaguugugaacagcuagagacugaccuagcggccuccagagaacucaccagucggcugcacgacgaaaucaaugcgaaggaacagaagaucauaagccugcuuucuggcaaagaagaggcgauccaacuagcuguugaggaacugcaccagcaacacaguaaagagaucaaagaacuagaaaaccuguugucccaggaggaagaggagaauguggccuuagaagaggaaaacaaaagggcccuugagaaaaccaaucagcucacagaagcauuggaagccaucaagaaggagagcuuugagcagaaggcucaguuggacuccuuugugaagucuauguccucucuccaggaugaccgggaccgcaucguaagugacuaucggcagcuggaagagcgacaucucucugcaaucuuggaaaaagaccagcucauccaagaugcugcugcugagaauaauaaacugaaggaggagaugcgaggguugcgaagucacauggaugaucucaauucugagaaugccaagcuggaugcggagcugguccaguauaggcgggaccugaacgaggugauagccauaaaggacucucagcaaaagcagcuccuugaugcucagcuacagcagaauaaagagcugagaaaugaguguacaaagcuagaggaaaggcugaaaggguuagaagcagagaagcaaagccuacaaauguccuccgaugcccuccagaaggagaaacaagguuugucuaaagagaucaaaaacuuacagacacaguugaccgcccugcaggaagaaggaacgcuaggugucuaccaugcccaacugaaagcaaaagaagaagagcuccagaggcuaaauauggcucucuccuccucccagaagagaacugcagaucuggaagaggaguuaguuuguguacagaaggaagcuaccaggaagguaagugaaauugaagaucagcugaagaaagagcugaagcaccuccaucacgacgcagggauaaugcgaaacgagacagaaacagccgaagagaggguggcagagcuggcgagagaccugguugagauggaacagaaguugcuuacgguaaccaaagagaauaaggaucuuauggcgcagauucaggccuuuggaaggucaaugagcuccuugcaggacagcagagaucaugccacugaggagcuuggugaccugaaaaagaaguaugaugccagucucaaggagcuggcccagcugaaagaguggcaggacucaagcagagagggggacguucuuucccaggcugccuuuccccuguccaccucugagaacgucuugucccgccuugagaaacugaaccagcagcucacauccaaagacgagcaguugcuucaccuaucuucagaacuagaaaguucucacaaccaagugcaguccaucuccaaagccaugaccagucuacagaaugagagagaucgccuauggagugagcuggagaaauuccggaagucugaggaagggaagcagagggcugcagccccuucagcugccuccagcccagcagaaguacagagcuugaaaaaagccaugucuucacuccagaaugacagagaucgauuggugagugugugcuuccuaucuguguuuaagagguuggggccauucuucacauggauuuuuauugccauagaaaaggguaaauguuucuaaucaccgcauugccacacacuccacaguuugggucuuaagagaagcagacauauuguuaccauuuucaaggugaggauuuuucuuugcacagaaucugcauugguuauaaaaggguuaaaagguaaccagcugcuuuugcuguaaguggucccagaauuuaaaguggauuaauuggggggaaagcauggagcuggucacucagugucuucagugucagcugagcucuuggucacucacuagaccaggauagcaaggaccuagcuugucuuagaaguacagcucaacccuaacgugucaagaaagauguuaaauguaaaagggauuuccugaagucagugcuagugguguggcggcacauucgucuuaacuccagcacagaggggcugcuguugugaguucaagacgagccgagauuauguagcucacuuaaggcagucugggcaauguagugagacugucccaacaaguuuuaagaauaacuguucugccauguccuauacacuuuucacagucuauaccguuuuaauggugguacacucacuuguacauaagaaaguaaguguuaagccugaaagcuagcccagacacaagcuccaugacaauaaaaagguuucuaaaaaaaaaaaaagaauaacuguucuguggucagugauuguuugcaguugaaugauuuccugguuccucuuuccauccggucuuuuauuuuccucuacuggaauugacccagaggcucauccgugcuaggcaaguucuuuuccacugcuuuucaugaauuuugaaacagaccgaugcuaagcuacucaugcugauguuguaacucaggauccucuuuccucagcugccuaaguagauacaacugcaggcacacagcaccaugccugauucuacucacuuucuuuaaaaguaacuuuuuucacaaauggagaaaguugguuggagagauagcuugucuugugccugaguguucucugguggggcucacuggucagcuagccuagccuaugcagacaaacaucaggccagugagagacugucucagaaacaaauaagaaacccaaccagugcuugcugcacaagcauaaauaccuauguuuggaugcucagcacaccauaaaaaaagaaaaagaaaaagaaaaaaagaaaaaaaaaauccaaagcauagcaguacaucugugcgaugucagugucaggaagagauaggcagaucucuggagcccacugccagccagucaagccggauuggugaucucuggguucagugaacaaguaacagacccugucucaaaauauaaaauggagaggagagugcuaugggaaaggccugaugucagccuuuggccugcaugugccuuagcaccaacccguguuucucacgcuucccagugcugcggcccuuucacacaguccucccccauccguaacaguauuugcuccuacaauaauguugugaaccauaauguacauaucugacaugcaggguaucugaugcgcaaucccuagguugagaaccgcuguccuacaaacacauaugcacauacucaaaacaaaacaaaaagcaaagcaguguggcaccagaggagcauaugcaaaguuguccccaggcacccagauugcagcagauccugaguuagcugugcuucauucagggaccugcuuccaauaggcugugcguuguaaacacuggacucucucauccccacuugcaugcuucuugucuacuggauguugaugagccaauccuuuuuuuaaaagccaugucccuauuucuauaacuuaucaacuuaucugguuuuauuccaucgaaccguugaggugcuuuacucagcucacauguccauccuuccccuucagcauccugggauaaguuucuuuucacucagcagauggagcugcuuccaggggaugauaaauacaguccuuggugaauuacuuuggaacucuuucuuucuuucuuucuuccuuucuuucuuucuuucuuucuuucuuucuuucuuucuuucuuucuuucuuucucucucucucucucucucucuuucuuucuuucuuucuuucuuucuuucuuucuuucuuucuuaugacugcccugccucagggaugggcuagaagaggggguuucccccuuggugugccacauaagaccuuaggauguguccuuaucuucucagccucuuacuuguucuuaguaugcaagcaaccagagcccaccuccucagcacacagaucacagcaagcacauccugcccacauccucaucccguggcucuaaugucuuccucgcugcuugcuuugggggucauuccugagcucgguucucucaccgcacuucccaguugcuuaccucugucuugccuuccuacuucccgaguacuugucuuagcaguuguuccauguucccugcacacaagugccuuugcccugaggcaucucaccucacuuuaucuucugaucucguuggguguuuuuaucugccaucauguucuuuuaguugauguuguuauuucuuuaauguguauagguaugugugucugugcaccacaugcaugccugcuguccuuggauggccucagacugcaguuacagacugcaccauggggguguugggaauugaaccaagguucucuggaacagcagauagugcucuuaaucacuaaacaucucuccagcccggcuauuauguucuuaauuuguaagagauuugguuuuuucuuguuuuuguauauuuuuccugucuccugggugaauugucuaauuaguggugcuuugcuuuguugguuuuuguguacaugucugugacuguaugacaugcagguaaagacauugaaguuacaggcaguuaugaguugccugaugugugaauugaacuaggguucucuggaauugcagcaaggacucucaacugcugagccaucuccacccuguuuuguuuuugaaacagguucuuauuauaagguggggcuagccuagaagguucagaguaguccaggcugacccugaaugcacagucuuucugaaccaaccucucaaaggccaggacuacgggugugugcuugccgccuacuugccccugcccucugaccucuccuucuagcaagguuuccuuguacguuuuccuugcugcuguaguguuucucuuugccagcauucucugcugcaucuuucaucagcguagcuucucccugcuacuuuggugaauuccccucucucagcaguugcuuuucaucccugauguucgcuguucuuugcaugaagagcaauccuuguuucaucuucacaugaggaguagaaucuaggaagccugcggaaggacuugcugugaauucaaugcaaugugaucugaugaguucauugaucgugguccugaggcuggugccuuuaguuccucugggucugaucagaccuuugagagaucuuucaccucuuggauagaaggaaacucucaucuccaagcugaggaagggacgggcagcuaucacuguggcaugcgucaugucaccagucacaguuguuguagagcgguacccuuacuugcagcugggccugagauuuucaugcucccagggcacauccuuuaccuuuuccagagaguaaacugguuguuuggugagguuaccaaaaagucagaacugagaagaacuuagcgugcaguuacaucugaagcagcucugugagaauccuccuugucucagcucccgccucccuccaacccaucaccauuuuuuccagauguaccuggugcuguuaauuccugagcccuuugaagauucugcagaguaaguucuguuggguccuuggcuucucuaucaccagcuaaagauccagcugucgccgaugcguuaagucaguuaccauuauucaucugcuuuucaaccuugagugugucgcugcugacccuuguuggcuuccugauccuuuuuuuugcguuuggugcuuuuuaaaaggccacuggugugguaguauuaacguuucugagugggugaaagguguguguguguuuaaggcuguugucuuucccagauguccugacauuauuucuucaucaaacuuuugaguauuggggaagaguuuuaaaauagaaugcaguuuugcuaaaagcaaauccaucauaauauccacuaacuuugugugugagaucuauuaauuuuuaauucugauauucuuaugaggaaaaguacuguuauugucuucauuuaguggaugagggaaagaaagacuuagguguccucccauccaagaaacaguaggguaucuaauucuagagccagggugucuguaaccaccagggugcuuacccuuucucuauauagccaacaucagcucagcuuaagacugggguccaacagggauguggguuagggaugggugcaagccuaccaccugaugcccgaguuugaucccaagaauugugaaacaaacagaaaacaaauaaguaaacagcaacaaagaaaagcuugcugguguuccugugagagagagccuaauaaggacgcaggucuaaauggauucuguccagucauucuguaugucccuuaagucugcuccaaguuagaguguuagcuucagaccuggaggccaaugggguacaagugaaaggaaugguuaggccuugacaguagccuugacagcagucccucagcugucucugcgcugugggaaggugcugacgguccguggugccugugguaggagcuacuggucaauaaggaguaagacgugagucacccauugcugcucucccucugguuaaagcugaaggaacugaagaaucugcagcagcaguacuuacagaugagccaagagaugaccgagcuccguccgcugaaggcucagcuccaagaaucucaagaucagacaaaggcacuacaggugauggaggaggagcucaggcaggaaaaccucuccuggcaacacgagcugcgucagcucagguaggaccguagccgaagcguuuguuuuauuuuauuucauuuuauuuuaucuugacguuuuguuuugaaauaguuacagacuuagagugcugcagaacaguaagagagcacucgugugugcuuugccuaguuucccccagugaaagcucccgugccacucacugcaugccauacccagcggucuuuaugcacagcagggaaguagcugguguucaguagaagucccacucuucaccagauuugggaaaagaaguaaauaaaaauaacaacaaguaauguuuacugccuaauauuuaauaugugccacgcuuuauguuugauaagugauaugccucauuuagcccuuacaguagucuuaaggaauaacuagcuuauucccauuuaauggaagaaacuuggugagauucauuugcucaggucucagaccugguauauucaggagccagaguucuaaguccuugagaguuggcucugauguuaauucugcaucgugggucugacugaugaaagacuguuguggguucccaugcccugcaugaccucgccacccucauuccauacauaccuacucuacacaccaacuccuacaguucugaaguucacucucugcgugcauacaggugcccugugcugaguuuucacgcccaucuugaacugcucuucccauuuggaaacauagcucuuugcucagguucuaaacccaaugccagcccuucugugaaggcacugcagcccggccaggaagagcuuucccuccggugcuggcauggccuugcucucagcagcuuccugggugucuccacuuagagaauaaauuucacucugauauguauuagucacucauaccucauaagaauguucugaauauggaauuauucuuccugucaugaguguauuugggccguucuuuuuuucaugguguaggauggagaagaauuccugggagcugcaugagaggaggaugaaggaacaguuccucauggccaucucagauaaagaucagcagcuuggucaucugcagagucuccugagggagcugaggucuucuucccaggcucagauucucuccacacaguaccagcgacaggugaggagauccguacauuucuacacagggugccacuacccaaaagcauaagcugccuccagcugcccgucugcugccaugaggcacgccuccucccagcucuuucagggugaugcaaucucuucuagagggaggguuugaguacaaacacucuuaagagaccauuuuauugacguuuugguccuggcaggcauccccagagacaucagcuucccucgauggaucacaaaagcuaguuuaugagacagaacuucucaggacucagcucaaugacaguuuaaaggaaauucaucaaaaggagcuaagaauucagcagcuaaacagcaagguacgugucuccugcuagacugaaacugaauuucuuuuuucucuuucugaagauaagauuuggcacagacaccccgcuucagcauaaccugagaauagacguuuauauuucuuacaaacagaaguuuauaagagcuggguguuuauuccagagcaagaacacagccuauguucuccuugcccugggugggucuuuaagaaugacucggagaaacccauacaccaaauauacagaaacuucaccccaucgucucuauguuaggaaugugugggcaucucccgcccaucucccugagccauugucuuccugcugcucuuugacugucaguguucucaagagcucuuccccagaccugcccucuucuaagaaaccuagauagguagugucugccagaauuaaaguucuuuuaguucagugagacuugaguccagagguggucuuugaggagaguugugaaucuccgaaauguauguuuggggugaggggugcacguguccuaucagcagaacucguaugacaugagccaguaaggcugcucagugugugaaugugcuugcucgacacccuggugauccacagaggaaagauggaaccaacuccugagaguuguucucuguucuccacacgugugcuguagaaugaacaugccuacacucaugaagggguauaaggcauauaggcaugcauacagaaaaaccaauaacaugauucaaaaucauaaaaaccaggagauaguuuucccagaugaagagaaaagcccacaaauacuaaguaaccugcuccagguuucaagaggccauucugaagucagggcuucuauccauggaaagauaguguguuugcuacacauagaagguaccccauuagaugugaaauucaccuaacauugaaauuucagagacagcauucgcuuuggacccaaaugaaucaaugaaguagccaauccugauuuaguuccguuuuguuugggggcaggguucuccucucacucccuguuuccagaaaccccacgcucuguagcucuuuggcugugaagauccagugaacaccucccagugccauuucaggucuuauuccucucuagucugaggcucuaucuagacauccacccccaugacaguauuuuaaacugaagcagagcuguuuauagccgauagaauaaaucauguugguagaugauaacagcuaaaaguuuuaaauguuacauugacgugaaacauaaagguaacagaucaucagauagcagcagguacacuuuuacaaaguaaaacauguguaacaagcacucaagaugaaaacccaggguguuccacaucgccacaagucccuccucccuucugaucccagccacccaccuuaguagaaccacaugaaguacaaaccacacugccguaggccauugucacucugggcgggaacuaggucuccuuagggcugagaggaaaguccuuccucucuaaccucaguugcccgcccaccaguuaaaacauuugccugcugagagucuggccauguuaggcacuggggacucucacagugccucuuuugaaaccuccagucauuugagcuucaucucacucucugugggucccaucuacuaaagaauuacuccuggggacucgagugagauaaaaucaugagcugucauggugguuucucucuaaacacacagcuuaagggcgagcuuggucucugguuauauugagcucgugggcuuguuuuuuacagugauuuaagcauggacacgaccuacugccuucugcuuacauccccggaguagcuuguccugcugguauuuuuguuagggguuucugcucauagacaccauuaaaaauuaaaguuuccugcuacucuugcagaauuauuuuuccuuuugucguugaaauauuuagguauuuuucacuuugaaagaaacaaacugacaugauucaagguuagguaggacucagguccucaaagcucaggccagucgacuaggcacugcucacgguguccugggggcagcacuuacccuuucccccuauucaguucucucagcugcucgaggagaagaacguccucuccacccagcucagugacgccagccagagucuccgugagaaccagcaccacuacaguaaccucuucaaccacugcgccauccuggagaaggaggugcagaagcugcaggcgguaaggcagcaagaggcuggggggugacaagaagaggggagguauggugggugugggaugaugccuaagaaaaaugaccaaacaaauuccuaaugacaggaguacagugcucagugagauggugggacaguagcuagggacugucccuucccucugcuguggaacaggguuucagcuugcagacaugcagugucuugagagcuccccucauagcuacuaagcuguuguuuguucuaggggccgcuuaauacagauguugcuccuggagcaccccaggaaaagaauggaaugcaccgaaagagugaaccugagaccacaggagaggagcagccaagguaggaggagcaggccgcacccuccagcaugcccugugugcagagaaauugggugguggaccagagaggguaaugggaaugaauaugaccaaaauacacauuaucuacaccuauggcagugucacagugaaaccugucgcgugugaucaauguaugcuguuuuaaagaaauugaguuguaaucuugauggaaaucgaguucaucaugcacacuuaauaugucccguuaucugacuggugucacaggaguaauggaaagguugaggggaacaacacccagcaagcagauugugugaaggaagcaggcagcaguucuaacacaagggcauauacacacaacacuacaaaggccgcaguuaacuguucccacagucccacaucuccccguggguguuguugcucuaucugcccucucugccucuguguuagucaaugugucuagagacucacuuccagccuugggaagguguuuuagagacugggugcuacaucagugaugcccuuuguuugccuuuuacccaagcuucucugaaguccagcagcagcugugcaacacuaaacaagaucugagagaguuaaagaagcugcuggaagaagagcgagaccaaaggcugaccgcugagaaugcacucucccuggccaaggagcagaucagacgguaaggcgugcggcggccccuccugcucacaccucagccuccuggccuugcugcugccccuuucuguggccaggcucagggugaguugacauggucaacucagugcccuugacaugcucagaugaugauuucauuauaucgucaaaaagcagggcacuccuggaguuucagaggccugugccuuccugguugauagcuccuagagguugguaauauguuuaccauucauauuauacaaggaagcugugaaaggugucucacuuuagcccaacaacuaugugaguacauguuggguucuugugugucugugucuuugugucauguggggagcagggagacaguguccgagaucauuagaugucuuggcuuauuaucacucucuauuuuauucccuugagacacagucucucauugagccugauaguugccuuuguuagugaccagcgagccuuuagccaucccccugccuccauagugcugggguugcaggugugcacagucaggccagcuucuacaugggugcugaggagcucagugcauaucgucaugcuuguaauacaagcacuguuacccacugggccaucuccagggcccuagugucagauucuuuaaagaaucgaauaaaugcauucucauuaccuuauauaccugauacccagacguuuguuuguuuguuuguuaguuuugagacacagucucucuguguagcucuggcuggccuaaaucucaguuuguagacuaggcugguuuugaacucacagagaucuaccugccucugccucugccucccgagugcuaugauuaaaggacugaggcagcaaacauagccaacugaaguuuuacagaauguaaccuaaggaagaauaaaaggccccuuaagaaacaguaugugacugauuuaugagcgaacacacugccuaagccugaccuuccccugccagugacagguuugcugguaccuucguugugucugcaagagcaagccacugugucugaugccucuccucagaacacaugguggugcccuccccagggagcaggucuuagcugagauuucuuguuuuccuauccaguauauucacagcuguuguguuuucaacaccuguguaaguagcuuugagcaugggcucugcaggagcacagugcagcaugguguaguggccuugcaaagauuuccaggccuauuuguucauggccauuucuaggccacuuacgaaauuguuuagaucuaugauaccuggccccugagguuaauccccucaucuggacaacuugagacagcuuagucaggaugacucuggagccugugucuggaccacgucaauuaagguuagccccucccacuuuccuucugguggagaucggaaggagagccaggugacaaacugaggauaggccaccaagacccaguucagaucaaggcauuuccucucugcugaagaagagaguggcccccagacagaggucguauucagcugauagagucccuguggggacgagacacucacagugaagacgugugguuuggggcugaugagugaugagcuguggccuugcccuguuguccucggaggccacuaagcgauggcagugucucguuaagggaaaauuuccaaaaugaaguaauaagcaaaucaacagaaaguaaaacaggaagcugccaaggccucuaagagcccuaaagaauuucuugagugcuuuugccuaguauaaguuuaaaaaaaggaaaagaaaaaaaaaaccaaaaaaccaaaggugccaguugugauagugccugccuguagugccagcccuggcaggcagagccagaacuguaaauucaaggcuaguccaggcuguauacaucccuuccucaacaaaaggagcaagggcagagaagagaggagaaaggagugagcuggaccgaguguggcauagagagggaaugaggaacaggagucaaagacaaacagguacuggauucugcuuccugccugcuggacaagacucuaaccagccuuugagcaggaagcacucaggccagcauccuaaauuggcagucccuuuacuacugugagggccaggacccugggaagagccuuugcugccaguccccuaggccaccucucuggaaugacgggaagaaucgcaugcaggggacccauguugucuguuuuuccucaacacagguuggagcauagugaaugggaaucggcccggacuccuaucaugggugccuguggcucucaggagcaggcgcugcugauagaucucccaggccauagcugucgaaggguaagaggaggacacgggaugggcucgggaaugggcuuccgguguggagguggguaaugggguagguuuccagccguuguggagacuugucucccaggauugcuggugaaggggaagagcucugauuuuccuguguuuuauuuguuugugcguuucagacccggaguggugccggauggaagcggguccugcguucacucugccauucucgaacccgagugccacugcucgcagccaucuacuuccuaaugauucacguuuuacugguucuguguuucacgggucaccuauaaacuuguuacuugacugcaacucuggaacuuguaauuccuucaucucuagugucaggauugucgauuccacagcagccuucucacuuuagccccuccaccucuucuuggaaagugccugugaaaacagagguggcugugaggacaggcagagccuuaaagccugccacauccgcucuccuuaaacacuugugcuuggucugagcagcuucccagaugugcugugcucacugcucuucagauguugcagauccacauccuguguggucuuguaggaugcugagggaggccucccagccaggccaacaagaugguuccaauaaacacaguaauuuggaauccaguaucacuuuucuugguaaccggcuuugucuuguggccuguauuuucuccugccucaggaugaauacaaaguugugggcgugugagcagucuuuggagacucaggugggagcuggaaggcucccagacuucaguuguuggaucucggggaggaaggcauuuucuuccugccuguugcauugccagcggagggacgguuuguugcuguggaucgucaggacuggaccccauugcuuaugccuucagucacauguagacuaagauaguaaguggccagugccuuuccuugcaucaaaaggcaggaagaacugacaauggacagacagcaagguucgaauucuauauuucuggaugugccuccauagggguccuaagacuauccagaggccaguggggccaugccaaggugaacuggagucagggcugaauaccacaucacaacuagucucaagaacuacugagcugcugcaccagugugcugguccuugguuauucugucuccaacgccauugucacccaccacugggcacagggcugaggcgguggaaagaaaaggcaaagcaccuggauccagaccugagagcaguggccaggaauggauggaucccaccgugucgauccuccccuuuacggacaugaugugcucccuuccuguucucacccccuaaagaagagugaacugcuggacucacucaucagcccuuuguucuguggugaugaaaauuuuagucacaacaucccaaaaccuuaacuacuguaaaauaauaaaauuauuuucagaauaaggaau
